United States Patent 8,362,325 (NUCLEOTIDE SEQUENCES AND CORRESPONDING POLYPEPTIDES CONFERRING MODULATED PLANT CHARACTERISTICS) - sequence listing, part 4

SEQ ID NO: 5962 - protein, 212 aa, Sorghum bicolor
  misc_feature: Ceres ANNOT ID no. 6055636
  misc_feature (4)..(75): Pfam Id: GST_N Pfam Desc: Glutathione S-transferase, N-terminal domain
  misc_feature (1)..(212): NCBI GI: 11385487 NCBI Desc: glutathione s-transferase gst 18 [zea mays]
  misc_feature (2)..(211): NCBI GI: 46195409 NCBI Desc: glutathione s-transferase zeta [oryza glaberrima]
  misc_feature (1)..(212): NCBI GI: 4185800 NCBI Desc: glutathione s-transferase [triticum aestivum]
  misc_feature (1)..(212): NCBI GI: 112385746 NCBI Desc: glutathione s-transferase 2 [oryza sativa (japonica cultivar-group)]
  misc_feature (1)..(146): NCBI GI: 46195411 NCBI Desc: glutathione s-transferase zeta [oryza glaberrima]
  misc_feature (1)..(212): SWISSPROT Homolog: EC 2.5.1.18 Glutathione S-transferase
  misc_feature: The plant produces a reduced number of seeds.
  misc_feature: Useful for biocontainment applications
  misc_feature: Functional homolog of the protein sequence given in SEQ ID NO 12971
  misc_feature: Useful for biocontainment applications
  misc_feature: Functional homolog of the protein sequence given in SEQ ID NO 12971
MATAKPILYNAWISSCSHRVRIALNLKGVDYEYKSVNPRTDPDYEKINPIKYIPALVDGDIVVSDSLAISLYLEDKYPEHPLLPKDLKRKALNLQIANIVCSSIQPLQGYAVIGLHEGRMSPDEGLHIVQTYIDKGFRAIEKLLEGCESKYATGDDVQLGDVFLEPQIHAGINRFQIDMSKYPILERLHDAYMQNPAFESALPKNQPDAPSS

SEQ ID NO: 5963 - DNA, 588 bp, Sorghum bicolor
  misc_feature: Ceres ANNOT ID no. 6055639
  misc_feature: Encodes the peptide sequence at SEQ ID NO 5964
atggcggcttcgaagcccatcctgtacagcgcgtggatcagctcctgctccttccgagtccggatcgccctcaacctcaaaggtgtggattatgagtacagggctgtgacacggacggatctagattatgaaaagatcaatccaatcaagtatgttccagcattggttgatggggattttgttgtttctgactcccttgcaatcatactgtatcttgaagacaaatatcctcaacaccctcttttgcctcaagatctcaaaaagaaagctattaatcttcagggtctgcttgatggcaagttaggttcagatgagagccttcagattgttaggaattacaccgacaagggatttaaagcaatcgaaaaacttctggaaggttgtgacagtaaatatgctactggagacgaagtccaactggcagatgtgtttcttgcaccccagatccatgcaggcgtgacgcgcttcaaaattgatatgtcaaactaccctcttttggagaggttctacaaagcctatatggagatcccagcatttcaagtagcggctcctgaaaaacagccagatgcgcctgcgtctccatactga

SEQ ID NO: 5964 - protein, 195 aa, Sorghum bicolor
  misc_feature: Ceres ANNOT ID no. 6055639
  misc_feature (4)..(74): Pfam Id: GST_N Pfam Desc: Glutathione S-transferase, N-terminal domain
  misc_feature (72)..(177): Pfam Id: GST_C Pfam Desc: Glutathione S-transferase, C-terminal domain
  misc_feature (1)..(94): NCBI GI: 11385487 NCBI Desc: glutathione s-transferase gst 18 [zea mays]
  misc_feature (2)..(94): NCBI GI: 46195409 NCBI Desc: glutathione s-transferase zeta [oryza glaberrima]
  misc_feature (1)..(94): NCBI GI: 4185800 NCBI Desc: glutathione s-transferase [triticum aestivum]
  misc_feature (1)..(94): NCBI GI: 112385746 NCBI Desc: glutathione s-transferase 2 [oryza sativa (japonica cultivar-group)]
  misc_feature (1)..(94): NCBI GI: 46243593 NCBI Desc: glutathione s-transferase [oryza sativa (japonica cultivar-group)]
  misc_feature (8)..(123): SWISSPROT Homolog: EC 2.5.1.18 Glutathione S-transferase zeta-class 1
  misc_feature: The plant produces a reduced number of seeds.
  misc_feature: Useful for biocontainment applications
  misc_feature: Functional homolog of the protein sequence given in SEQ ID NO 12971
  misc_feature: Useful for biocontainment applications
  misc_feature: Functional homolog of the protein sequence given in SEQ ID NO 12971
MAASKPILYSAWISSCSFRVRIALNLKGVDYEYRAVTRTDLDYEKINPIKYVPALVDGDFVVSDSLAIILYLEDKYPQHPLLPQDLKKKAINLQGLLDGKLGSDESLQIVRNYTDKGFKAIEKLLEGCDSKYATGDEVQLADVFLAPQIHAGVTRFKIDMSNYPLLERFYKAYMEIPAFQVAAPEKQPDAPASPY

SEQ ID NO: 5965 - DNA, 780 bp, Sorghum bicolor
  misc_feature: Ceres ANNOT ID no. 6055750
  misc_feature: Encodes the peptide sequence at SEQ ID NO 5966
atggacggaggagccgccttcccgggcacgccgccggtgccgcgctcgccggaggacgtcttccgggactaccgcgcgcgccaggccggcctgatcagggcgctcaccaccgatgtggagaagttctacgtcatgtgcgacccagagaaggagaacctatgtttatatggacttcccaatgagacttgggaagtgaacttgcctgctgaggaggtccctcctgaactcccagagccagctctgggaattaattttgctcgtgatggaatgaatgaaaaagattggctatcacttgttgcagtgcatagtgattcttggctaatgtctgttgcattttattttggagcaaggtttggatttgacaaggaagccaggaaacgtctcttcaccatgatcaataaccttcccagcatatatgaggttgtcacaggaactgctaagaaagagcccaaagaaaaaactcataaaagcaacaataagactaacaaatctggctcaaagccctcgcgccaggcggaacccaacaactcaagggtcccaaagatgccacctccaaaggacgaggaggagagtgaaggggaggaaggggaaccacaggaagaccatgagactgcgctgtgcggcgcatgtggcctaggttatgacgacttctggatctgctgtgacttatgtgagacatggttccacggcaagtgtgtcaagatcaccccggctaaagcggagcacatcaagcagtataagtgcccttcctgcacaggaagcaagagggccaaggcttga

SEQ ID NO: 5966 - protein, 259 aa, Sorghum bicolor
  misc_feature: Ceres ANNOT ID no. 6055750
  misc_feature (206)..(254): Pfam Id: PHD Pfam Desc: PHD-finger
  misc_feature (3)..(259): NCBI GI: 4091080 NCBI Desc: nucleic acid binding protein [oryza sativa]
  misc_feature (3)..(259): NCBI GI: 4884860 NCBI Desc: nucleic acid binding protein [oryza sativa]
  misc_feature (14)..(258): NCBI GI: 116563475 NCBI Desc: phd1 [medicago truncatula]
  misc_feature (1)..(259): NCBI GI: 110740836 NCBI Desc: nucleic acid binding protein - like [arabidopsis thaliana]
  misc_feature (9)..(258): NCBI GI: 115394656 NCBI Desc: phd5 [glycine max]
  misc_feature: The sequence is a functional homolog of SEQ ID NO 1981 in the 11/479,226US patent application
  misc_feature: Useful for making plants with altered alkaloid content
  misc_feature: Useful for making plants with modulated growth and phenotype characteristics
  misc_feature: GREAT-hit functional homolog of the protein sequence given in SEQ ID NO 13176
  misc_feature: The sequence is a functional homolog of SEQ ID NO 1981 in the 20070022495 US patent application
  misc_feature: Useful for making plants with altered alkaloid content
  misc_feature: Functional homolog of the protein sequence given in SEQ ID NO 13176
  misc_feature: The sequence is a functional homolog of SEQ ID NO 1981 in the 11/479,226 US patent application
  misc_feature: The sequence is a functional homolog of SEQ ID NO 1052 in the 10/225,066 US patent application
  misc_feature: The sequence is a functional homolog of SEQ ID NO 2552 in the 10/374,780 US patent application
  misc_feature: The sequence is a functional homolog of SEQ ID NO 1645 in the 11/479,226 US patent application
  misc_feature: The sequence is a functional homolog of SEQ ID NO 782 in the 10/412,699 US patent application
  misc_feature: The sequence is a functional homolog of SEQ ID NO 816 in the 10/412,699 US patent application
  misc_feature: Useful for making plants with altered lignin content
  misc_feature: Useful for making plants with modulated flowering time
  misc_feature: Functional homolog of the protein sequence given in SEQ ID NO 13473
  misc_feature: The sequence is a functional homolog of SEQ ID NO. 482 in the 11/188,298 US application
MDGGAAFPGTPPVPRSPEDVFRDYRARQAGLIRALTTDVEKFYVMCDPEKENLCLYGLPNETWEVNLPAEEVPPELPEPALGINFARDGMNEKDWLSLVAVHSDSWLMSVAFYFGARFGFDKEARKRLFTMINNLPSIYEVVTGTAKKEPKEKTHKSNNKTNKSGSKPSRQAEPNNSRVPKMPPPKDEEESEGEEGEPQEDHETALCGACGLGYDDFWICCDLCETWFHGKCVKITPAKAEHIKQYKCPSCTGSKRAKA

SEQ ID NO: 5967 - DNA, 1116 bp, Sorghum bicolor
  misc_feature: Ceres ANNOT ID no. 6055791
  misc_feature: Encodes the peptide sequence at SEQ ID NO 5968
atggctcatcgcgttctcctcctcctttctctcgcggcggccgtcgcggtagccgccgccgtcgacacggaggatccgctgatccggcaggtggttcccggcggagatgacaacgagctggagctgaacgcggagtcccacttcctgagctttgtgcagcggttcggcaagtcctacaaggacgccgaagagcacgcgtaccggctgtccatcttcaaggccaacctgcgccgcgcgcgccggcaccagctgctggacccgtcggcggagcacggcgtcactaagttctccgacctgacgccggccgagttccgccggacctacctcggcctccgtaagtcacggcgcgcgctcctcagagagctcgggaagtcggcgaacgaggcgcctgtgctccccaccgatggcctgcccgacgacttcgattggagggaccacggcgccgtcacccctgtcaagaaccagggttcgtgcggctcgtgctggtcgttcagcacgtcgggagcgctggagggtgcgcactacctcgcaactggcaagctggaggtgctttccgagcagcagatggtcgactgtgaccacgtgtgtgatacatcagaacctgattcatgtgattctgggtgcaatggtgggctgatgacgaatgccttcagttatctccagaaggctggtggccttgagagtgagaaggattacccttacactgggagtgatgataaatgcaagtttgacaagtccaagattgttgcttcagttcagaacttcagtgttgtgtctgttgatgagggtcaaattgctgctaacctcattaaacatgggccactggcaatcggcatcaatgctgcctacatgcagacatacatcggaggcgtgtcatgtccatacatctgtggcaggacccttgaccacggtgttctccttgttggctatggcgcagctggttttgcccccattcgcctgaaggacaagccatactggatcatcaagaactcgtggggcgagaactggggggagaacggatactacaagatatgcaggggttccaatgttcgcaacaagtgcggcgtcgactccatggtctctaccgtgtccgcagtccgcacctcgaaggagtag

SEQ ID NO: 5968 - protein, 371 aa, Sorghum bicolor
  misc_feature: Ceres ANNOT ID no. 6055791
  misc_feature (137)..(364): Pfam Id: Peptidase_C1 Pfam Desc: Papain family cysteine protease
  misc_feature (48)..(104): Pfam Id: Inhibitor_I29 Pfam Desc: Cathepsin propeptide inhibitor domain (I29)
  misc_feature (1)..(371): NCBI GI: 643597 NCBI Desc: cysteine proteinase [zea mays]
  misc_feature (5)..(371): NCBI GI: 56682917 NCBI Desc: cysteine protease [triticum aestivum]
  misc_feature (5)..(371): NCBI GI: 38344381 NCBI Desc: osjnbb0054b09.3 [oryza sativa (japonica cultivar-group)]
  misc_feature (5)..(371): NCBI GI: 116309071 NCBI Desc: osigba0130o15.4 [oryza sativa (indica cultivar-group)]
  misc_feature (5)..(369): NCBI GI: 15705865 NCBI Desc: cysteine proteinase precursor [sandersonia aurantiaca]
MAHRVLLLLSLAAAVAVAAAVDTEDPLIRQVVPGGDDNELELNAESHFLSFVQRFGKSYKDAEEHAYRLSIFKANLRRARRHQLLDPSAEHGVTKFSDLTPAEFRRTYLGLRKSRRALLRELGKSANEAPVLPTDGLPDDFDWRDHGAVTPVKNQGSCGSCWSFSTSGALEGAHYLATGKLEVLSEQQMVDCDHVCDTSEPDSCDSGCNGGLMTNAFSYLQKAGGLESEKDYPYTGSDDKCKFDKSKIVASVQNFSVVSVDEGQIAANLIKHGPLAIGINAAYMQTYIGGVSCPYICGRTLDHGVLLVGYGAAGFAPIRLKDKPYWIIKNSWGENWGENGYYKICRGSNVRNKCGVDSMVSTVSAVRTSKE

SEQ ID NO: 5969 - DNA, 546 bp, Sorghum bicolor
  misc_feature: Ceres ANNOT ID no. 6055963
  misc_feature: Encodes the peptide sequence at SEQ ID NO 5970
atggctcacacgcttaacgagctagctcaagctggcaaacgagctgagccatctcactgcatgtcaggatctatggcagatagggagcatcgaacggtgtttgttacagtggggaccacatgttttgatgctcttgtcatggcggtcgcttctccagaagtgaagaaggctttgttgcaaaaaggttatagtaatcttgttattcaaatgggccgaggaacatatgttccatccaaggtctcaggaaatgctacccttcaagttgatcatttcacattttcaccgagcattgctgacaatatgggaacagcttctctagttatcagccatgcaggttcaggaagcgtatttgagacgctacgactcggcaaaccactaatcgttgtcgtaaatgaagatttgatggacaatcaccagagtgaattagcagaagaattcgctgaaaggaagcatctcttctgtgcacgcccacaaacgttgggagagggggatgctaaaccagttgtcacccagatcaacaaatttcttgactttcccgttgattga

SEQ ID NO: 5970 - protein, 181 aa, Sorghum bicolor
  misc_feature: Ceres ANNOT ID no. 6055963
  misc_feature (32)..(182): Pfam Id: Glyco_tran_28_C Pfam Desc: Glycosyltransferase family 28 C-terminal domain
  misc_feature (78)..(181): NCBI GI: 115446081 NCBI Desc: os02g0467700 [oryza sativa (japonica cultivar-group)]
  misc_feature (31)..(164): NCBI GI: 50539980 NCBI Desc: zgc:92907 [danio rerio]
  misc_feature (25)..(181): NCBI GI: 31209045 NCBI Desc: ensangp00000021333 [anopheles gambiae]
  misc_feature (31)..(160): NCBI GI: 74752876 NCBI Desc: probable glycosyltransferase glt28d1 (glycosyltransferase 28 domain-containing protein 1)
  misc_feature (31)..(161): NCBI GI: 47123223 NCBI Desc: mgc84616 protein [xenopus laevis]
  misc_feature: Useful for making plants with altered oil content
  misc_feature: Useful for making plants with modulated biomass
  misc_feature: Useful for making plants with modulated heat sensitivity
  misc_feature: GREAT-hit functional homolog of the protein sequence given in SEQ ID NO 13434
  misc_feature: GREAT-hit functional homolog of the protein sequence given in SEQ ID NO 13458
  misc_feature: Useful for making plants with altered oil content
  misc_feature: Functional homolog of the protein sequence given in SEQ ID NO 13458
MAHTLNELAQAGKRAEPSHCMSGSMADREHRTVFVTVGTTCFDALVMAVASPEVKKALLQKGYSNLVIQMGRGTYVPSKVSGNATLQVDHFTFSPSIADNMGTASLVISHAGSGSVFETLRLGKPLIVVVNEDLMDNHQSELAEEFAERKHLFCARPQTLGEGDAKPVVTQINKFLDFPVD

SEQ ID NO: 5971 - DNA, 657 bp, Sorghum bicolor
  misc_feature: Ceres ANNOT ID no. 6056040
  misc_feature: Encodes the peptide sequence at SEQ ID NO 5972
atggtgctgtgggtcttcggctacgggtccctgatctggaaccccggcttcgacttcgacgacagaatcctcggctttatcaagggctacaagcgcacgtttaatctcgcttgcattgaccacagaggcacaccggagcatccggcgaggacctgcactcttgaaacggatgacgaggccatatgctggggaattgcatattgtgtcaagggtggcccagaaaaagagcgaaaagcaatgcagtacttggagagaagagagtgtgagtatgacctgaagatatccattgatttctacaaggaaggagatcccctgaaaccagctgtgacgggtgtcttagtttttgtgtctactccagatccaattggcaacaagtactatcttggccctgctcctttgcaggatatggcaaagcaaattgctacagccaatggccctactggctataatagggattacctgttctcaatggagaaggcattagccagcataagccacgaagatgagtcaatcatagagcttgcaaacgaggtgaggaaggtgctcaacaaaacaaaggagaccaagatcactggtgccaatgcttccctcaaatctcatgcccctcttgtgcacctgtctgcgcttccagaaggcaccgttgtggactcgagatag

SEQ ID NO: 5972 - protein, 218 aa, Sorghum bicolor
  misc_feature: Ceres ANNOT ID no. 6056040
  misc_feature (3)..(181): Pfam Id: ChaC Pfam Desc: ChaC-like protein
  misc_feature (1)..(215): NCBI GI: 82623379 NCBI Desc: chac-like family protein-like [solanum tuberosum]
  misc_feature (1)..(215): NCBI GI: 76573349 NCBI Desc: meloidogyne-induced giant cell protein-like protein [solanum tuberosum]
  misc_feature (1)..(81): NCBI GI: 3319340 NCBI Desc: contains similarity to e. coli cation transport protein chac (gb:d90756) [arabidopsis thaliana]
  misc_feature (80)..(218): NCBI GI: 31711499 NCBI Desc: oscttp [oryza sativa (indica cultivar-group)]
  misc_feature (1)..(180): NCBI GI: 38344831 NCBI Desc: osjnba0064h22.12 [oryza sativa (japonica cultivar-group)]
MVLWVFGYGSLIWNPGFDFDDRILGFIKGYKRTFNLACIDHRGTPEHPARTCTLETDDEAICWGIAYCVKGGPEKERKAMQYLERRECEYDLKISIDFYKEGDPLKPAVTGVLVFVSTPDPIGNKYYLGPAPLQDMAKQIATANGPTGYNRDYLFSMEKALASISHEDESIIELANEVRKVLNKTKETKITGANASLKSHAPLVHLSALPEGTVVDSR

SEQ ID NO: 5973 - DNA, 1365 bp, Sorghum bicolor
  misc_feature: Ceres ANNOT ID no. 6056107
  misc_feature: Encodes the peptide sequence at SEQ ID NO 5974
atggccaagcccaagccttcctccgccggcgccaagtcggcagcggctgccgccgcccctgcgccgcctgccacagtgcactcagcgctggtcacctacacctccatgctcgcgctcctctccctctgcccgcccttcgttatcctcctgtggtacacgatggtgcacgcggacggatcggtggtgcggacttacgagcacctcagggagcacggcgtgctcgaggggctcaaggccatctggcccatgcccaccctcgtcgcatggaagatcatcttcggcttcggactcttcgaggccgtcctgcagctgctgctccctgggaagcgcttcgaagggcccatctcgcctgccgggaacgtgccggtctacaaggcaaatggcttacaagcatatgcagtgaccttgataacttacctcggtttgtggtggttcggtatatttaaccctgcaatagtgtatgatcacttgggggagatatactctgctcttgtctttggaagctttgtgttctgtattttgctctacataaagggtcatgtagctccatcttcatctgactctggatcctcagggaatgtgataattgacttctactggggtatggagctgtaccctcggattggcaagtactttgatatcaaagtcttcacaaactgtcgttttggtatgatgtcctgggctgttcttgctgtaacctactgcataaagcagtatgaaatgaatggcagagttgctgattctatgcttgtaaatactgcacttatgttgatctatatcactaagttcttttggtgggaatctggatattggtgtactatggacattgctcatgatagagctggtttctatatctgctggggatgcttggtatgggttccatccatatatacttcgcctggaatgtaccttgtaaaccaccctgtgaatttgggtccccagttagcactctcaattcttctagctggaatgttgtgcatatacataaactatgattgtgaccgtcagcgccaagaatttagacggacaaatgggaaatgctcagtctggggcaaggctccatctaagattgttgcttcttatcagactacaaagggagaaactaaaaccagtcttctcttgacttctggatggtggggcttgtcacgtcacttccactatgtcccagagattctatctgcgtttttctggactgttccagctcttttcaatcacttcctaccatacttctatgtgatcttcttgactatattattgtttgaccgagcaaagagggatgatgaccggtgctcatcaaagtacgggaagtactggaagacttactgcaacaaagtaccatacagagtcattcctggcatttactga

SEQ ID NO: 5974 - protein, 454 aa, Sorghum bicolor
  misc_feature: Ceres ANNOT ID no. 6056107
  misc_feature (3)..(454): Pfam Id: ERG4_ERG24 Pfam Desc: Ergosterol biosynthesis ERG4/ERG24 family
  misc_feature (21)..(454): NCBI GI: 39726086 NCBI Desc: sterol delta-7 reductase [tropaeolum majus]
  misc_feature (25)..(454): NCBI GI: 23198074 NCBI Desc: sterol delta7 reductase [arabidopsis thaliana]
  misc_feature (17)..(454): NCBI GI: 74273625 NCBI Desc: sterol delta-7 reductase dwf5 [gossypium hirsutum]
  misc_feature (25)..(454): NCBI GI: 145324893 NCBI Desc: dwf5 (dwarf 5) [arabidopsis thaliana]
  misc_feature (25)..(454): NCBI GI: 1245182 NCBI Desc: sterol delta-7 reductase
  misc_feature (25)..(454): SWISSPROT Homolog: EC 1.3.1.21 7-dehydrocholesterol reductase
MAKPKPSSAGAKSAAAAAAPAPPATVHSALVTYTSMLALLSLCPPFVILLWYTMVHADGSVVRTYEHLREHGVLEGLKAIWPMPTLVAWKIIFGFGLFEAVLQLLLPGKRFEGPISPAGNVPVYKANGLQAYAVTLITYLGLWWFGIFNPAIVYDHLGEIYSALVFGSFVFCILLYIKGHVAPSSSDSGSSGNVIIDFYWGMELYPRIGKYFDIKVFTNCRFGMMSWAVLAVTYCIKQYEMNGRVADSMLVNTALMLIYITKFFWWESGYWCTMDIAHDRAGFYICWGCLVWVPSIYTSPGMYLVNHPVNLGPQLALSILLAGMLCIYINYDCDRQRQEFRRTNGKCSVWGKAPSKIVASYQTTKGETKTSLLLTSGWWGLSRHFHYVPEILSAFFWTVPALFNHFLPYFYVIFLTILLFDRAKRDDDRCSSKYGKYWKTYCNKVPYRVIPGIY

SEQ ID NO: 5975 - DNA, 891 bp, Sorghum bicolor
  misc_feature: Ceres ANNOT ID no. 6056744
  misc_feature: Encodes the peptide sequence at SEQ ID NO 5976
atggcttcatgttcgcccaccattgccgttgccctcatcctttcctacttctcgtcgcctgcagctgccttcaacatcaccaggctactcggagagttctccgatttcacaacgtttaacaacctcctgtcgcagacgaagcttgcggaggatatcaaccgccggcagaccatcaccgtgctcgccgtggacaacggcgcggcggggggcatctcctccctcccgtccgacgtccagcggaaggtgctctcaatgcatgtcgttctcgactactacgacaccgcaaagctcggggccatcaagaaccactccgccctgctgaccacaatgttccagtcctccggcaaggccaccgaccgcatgggcttcctcaacttcaccaagcgctccgacggtgtcatgctgttcggctccgcccagcctggagcgcagatgacatcccatatggtgaagtcagtcgcttcccgcccgtacaacatctcagtgctgcaggtcagcgaccccatcgtgccgcccggcgtcggaggctccgcggacagcggcgaggccacggcgcccgcgcccgcaactaagggaaagaaggaagctgctccgcccaatgataaggaggcccctgctccggcaccgtccgacgacgccagcacagacgcacctgccgatgcccctgggccggcggcggacggcccaacggctgatggccctgcggcggacggcccaacggctgatggacctgcggcagatggccccacggcggacggcccggcacctgacgcgccggcgcataagaagagcagcgacgaggcggctgacgcgcccgagggttcagccgctggcagagtagtggccgctgcgggtctgggaatcgtggcacttctgatgacgatcatttga

SEQ ID NO: 5976 - protein, 296 aa, Sorghum bicolor
  misc_feature: Ceres ANNOT ID no. 6056744
  misc_feature (2)..(295): NCBI GI: 47497569 NCBI Desc: endosperm specific protein-like [oryza sativa (japonica cultivar-group)]
  misc_feature (1)..(250): NCBI GI: 38346426 NCBI Desc: osjnba0019j05.11 [oryza sativa (japonica cultivar-group)]
  misc_feature (1)..(250): NCBI GI: 116309039 NCBI Desc: osigba0097i11.4 [oryza sativa (indica cultivar-group)]
  misc_feature (8)..(189): NCBI GI: 21595125 NCBI Desc: endosperm-specific protein-like protein [arabidopsis thaliana]
  misc_feature (1)..(192): NCBI GI: 115349886 NCBI Desc: fasciclin-like protein fla1 [triticum aestivum]
  misc_feature: Useful for making plants with altered cell wall content and/or composition
  misc_feature: GREAT-hit functional homolog of the protein sequence encoded by LOCUS at2g24450
  misc_feature: Functional homolog of the protein sequence encoded by LOCUS at3g12660
  misc_feature: Functional homolog of the protein sequence encoded by LOCUS at4g31370
MASCSPTIAVALILSYFSSPAAAFNITRLLGEFSDFTTFNNLLSQTKLAEDINRRQTITVLAVDNGAAGGISSLPSDVQRKVLSMHVVLDYYDTAKLGAIKNHSALLTTMFQSSGKATDRMGFLNFTKRSDGVMLFGSAQPGAQMTSHMVKSVASRPYNISVLQVSDPIVPPGVGGSADSGEATAPAPATKGKKEAAPPNDKEAPAPAPSDDASTDAPADAPGPAADGPTADGPAADGPTADGPAADGPTADGPAPDAPAHKKSSDEAADAPEGSAAGRVVAAAGLGIVALLMTII

SEQ ID NO: 5977 - DNA, 1149 bp, Sorghum bicolor
  misc_feature: Ceres ANNOT ID no. 6056973
  misc_feature: Encodes the peptide sequence at SEQ ID NO 5978
atggagtctctcctcgcctcgcgatccattaggtcttccttctccgccatcgccgctagcaccaggggcgcttccccaaggccctcgcgcgtcgccaccctcgccggcagcggcgcccgcccctcccgcccgctccgtgccggccccatggactcgattcttgaggttctggcacaggacgatatgctgaacgcaaaggagctggtccaatgggagaatggcttgtcattcaatgacatagcagctagacaggggattcgcatccgcaggcacttccgccccactgcctccttgaagcagatagaggaggagctgggagcccctcgcaacatcctagagaagatcgtttgggacaaggagattgaagtagctcaggggcatgctaagaagcctattgaggaggtgactcaggctgcaaggaaagcccctccttcaagagacttctatggcgctttagaagctgcctacaagcgtaatggggtgcctgcattaattgctgaggtcaagaaagcatccccgagtaggggtgtgctcagggagaactttaatcctgttgaaattgctcaagcttatgaaaagaatggagctgcatgtttgagcattttgacggatgagaagtactttcagggaagctttgagaatcttgagaaggtgcgcacctcaggagtgaagtgtccccttctctgcaaagagtttgtcattgataagtggcaaatctataatgctcgctctaagggtgctgatgcaattctactaattgctgctgtactaccagacattgacataaggaattttcttcagatttgcgaagagttgggaatgacagctcttattgaggttcatgatgaaagagagatggagcgtgtgctgaatataaatggagttaagcttattggtatcaataatcgaagccttgagacatttgttgttgatacttcgaacaccaagatgttgcttgagaagcatggcgatagcatcagggagaagggaattttggttgttggtgaatcaggtttgtttactccggatgatgttgcttatgttcagaatgctggtgtttctgctgttttggttggggaatctctggtgaagcaagagtgccctggacgagccattgttgggttatttggcaaagaactgctgcattga

SEQ ID NO: 5978 - protein, 382 aa, Sorghum bicolor
  misc_feature: Ceres ANNOT ID no. 6056973
  misc_feature (111)..(375): Pfam Id: IGPS Pfam Desc: Indole-3-glycerol phosphate synthase
  misc_feature (79)..(380): NCBI GI: 116309729 NCBI Desc: osigba0115m15.12 [oryza sativa (indica cultivar-group)]
  misc_feature (60)..(382): NCBI GI: 619732 NCBI Desc: indole-3-glycerol phosphate synthase
  misc_feature (129)..(380): NCBI GI: 38606522 NCBI Desc: osjnba0016o02.9 [oryza sativa (japonica cultivar-group)]
  misc_feature (78)..(380): NCBI GI: 145334777 NCBI Desc: indole-3-glycerol-phosphate synthase [arabidopsis thaliana]
  misc_feature (142)..(380): NCBI GI: 115458874 NCBI Desc: os04g0467700 [oryza sativa (japonica cultivar-group)]
  misc_feature (60)..(382): SWISSPROT Homolog: EC 4.1.1.48 Indole-3-glycerol phosphate synthase, chloroplast precursor
MESLLASRSIRSSFSAIAASTRGASPRPSRVATLAGSGARPSRPLRAGPMDSILEVLAQDDMLNAKELVQWENGLSFNDIAARQGIRIRRHFRPTASLKQIEEELGAPRNILEKIVWDKEIEVAQGHAKKPIEEVTQAARKAPPSRDFYGALEAAYKRNGVPALIAEVKKASPSRGVLRENFNPVEIAQAYEKNGAACLSILTDEKYFQGSFENLEKVRTSGVKCPLLCKEFVIDKWQIYNARSKGADAILLIAAVLPDIDIRNFLQICEELGMTALIEVHDEREMERVLNINGVKLIGINNRSLETFVVDTSNTKMLLEKHGDSIREKGILVVGESGLFTPDDVAYVQNAGVSAVLVGESLVKQECPGRAIVGLFGKELLH

SEQ ID NO: 5979 - DNA, 1077 bp, Sorghum bicolor
  misc_feature: Ceres ANNOT ID no. 6056980
  misc_feature: Encodes the peptide sequence at SEQ ID NO 5980
atggatgaaaccatgggaaggagaacagtcagtggccttcttgtcaccaaaggaggctcaattcttgtcttcagggaagaaagcccacgccacaaggccaccacatgttgtacccgcctcgggtgcagcagtaagcttttcccaaacaaagacaggaagacacgcagggcatccatggaaacatcggctcatcagagatcacaagtgttgaggaaatccaacaggatgtcccctcaaggaagtatttcttatgatcgaagcaccagtaggaatacagcaagtacttttggtgagactgacaatataccaagacgaaaagaaaatcccgggtgtgatctactagctcggttgaaagaaagggtcaatgcatccaggaaacgctcattgggtggactgggtagtcctaacatatcatcaacaaacacatcaagcagtagccggtcgttttcaagatcaatatgtcagccagcttcgagaatgagaaaggatggaggaagggttgcagaagctatgaggatgcataaagccagagagaatagtggtagctctagggaagatgtgttgacaagaaattctatccaagatccttcagacaggtttctatctcaaagcttgttgaggcgcaggagtagacttcagcaagggccagtatcatcattcgaggatactttagattattccagtgaatactggcactttgatatggatgacagtgaagaggttgaggattactatgtctttaatgatcagcatagaggaatgagaatggacattgatgacatgtcttatgaggacttgcttgcgcttggggagagaataggtactgtaagcactggcctttcagatgatgcactttccaagtgtctgaagagaagcctctatgtgcccacaacttcaagcagccatgaagatggtgacatcaaatgcatcatatgtcaggaggagtactcctctgatgtggaggtggccaagatggcatgcaagcattactaccataccacttgcatccaacagtggcttcagcaaaagaattggtgcccgatttgtaaatgtgtcgcttctgtcatcagctcatag

SEQ ID NO: 5980 - protein, 358 aa, Sorghum bicolor
  misc_feature: Ceres ANNOT ID no. 6056980
  misc_feature (309)..(349): Pfam Id: zf-C3HC4 Pfam Desc: Zinc finger, C3HC4 type (RING finger)
  misc_feature (1)..(353): NCBI GI: 38344153 NCBI Desc: osjnba0041a02.20 [oryza sativa (japonica cultivar-group)]
  misc_feature (1)..(353): NCBI GI: 116309663 NCBI Desc: osigba0118p15.2 [oryza sativa (indica cultivar-group)]
  misc_feature (1)..(313): NCBI GI: 115460358 NCBI Desc: os04g0603200 [oryza sativa (japonica cultivar-group)]
  misc_feature (247)..(353): NCBI GI: 58652060 NCBI Desc: at5g10650 [arabidopsis thaliana]
  misc_feature (247)..(353): NCBI GI: 20466428 NCBI Desc: pspzf zinc finger protein-like [arabidopsis thaliana]
  misc_feature: The sequence is a functional homolog of SEQ ID NO. 271 in the 11/188,298 US application
  misc_feature: The sequence is a functional homolog of SEQ ID NO. 329 in the 11/188,298 US application
MDETMGRRTVSGLLVTKGGSILVFREESPRHKATTCCTRLGCSSKLFPNKDRKTRRASMETSAHQRSQVLRKSNRMSPQGSISYDRSTSRNTASTFGETDNIPRRKENPGCDLLARLKERVNASRKRSLGGLGSPNISSTNTSSSSRSFSRSICQPASRMRKDGGRVAEAMRMHKARENSGSSREDVLTRNSIQDPSDRFLSQSLLRRRSRLQQGPVSSFEDTLDYSSEYWHFDMDDSEEVEDYYVFNDQHRGMRMDIDDMSYEDLLALGERIGTVSTGLSDDALSKCLKRSLYVPTTSSSHEDGDIKCIICQEEYSSDVEVAKMACKHYYHTTCIQQWLQQKNWCPICKCVASVISS

SEQ ID NO: 5981 - DNA, 999 bp, Sorghum bicolor
  misc_feature: Ceres ANNOT ID no. 6056981
  misc_feature: Encodes the peptide sequence at SEQ ID NO 5982
atggcctcccctggccccgccggcgcagcgagtgccgcggcctcgccgtcgccgccgatgcagcttccgtcgccgttcgcggagctcgtcaaggccccctccggcctcgagaagatcgtgcttcgcggcgctcgcaactgctgtgccgagatctatctttatggaggtcaagtaacatcatggaagaatgacaatggggaagagctgctttttctcagcagcaaggctattttcaaacctccaaaagctattcgtggtggtataccagtctgctttccccaatttggaacacatggaaatcttgaacaacatggattcgctaggaaccgtttctggactattgacaacaatccacctcctttaccagtaaaccctgctattaaagcttttgttgatctgattctgaagccttctgaggaagatttaaagatctggcctcacagttttgaatttcgcttgagagttgctcttggaccttctggagatttgagtctaacatcacgaatcaggaatacaaacacagatggaagacctttctcttatacatttgcataccacacatacttctctgtctctgacataagtgaggttcgtgttgaaggactggaaacaatggactaccttgataacttgaaggcaaaggagcgtttcacagagcaaggcgatgctattgtttttgaatcagaagttgataaagtttatcttgctgcaccctccaaaattgctatcattgatcatgagaagaaaagaacatttgttgtgacaaaagaagggcttcctgatgctgttgtttggaacccttgggataagaaggcaaaagcaatgcaagattttggggatgcagaatacaagagcatgctgtgtgtggagcctgcagctgtagagaggcctattactctgaaacctggcgaagagtggaaaggaaggcttgtgctctcagcggttccttcaagttactgtagtggacagttagatccattgaaggtccttcagggttga

SEQ ID NO: 5982 - protein, 332 aa, Sorghum bicolor
  misc_feature: Ceres ANNOT ID no. 6056981
  misc_feature (37)..(313): Pfam Id: Aldose_epim Pfam Desc: Aldose 1-epimerase
  misc_feature (1)..(332): NCBI GI: 549984 NCBI Desc: possible apospory-associated protein
  misc_feature (73)..(332): NCBI GI: 115475481 NCBI Desc: os08g0241600 [oryza sativa (japonica cultivar-group)]
  misc_feature (10)..(332): NCBI GI: 38344152 NCBI Desc: osjnba0041a02.19 [oryza sativa (japonica cultivar-group)]
  misc_feature (10)..(332): NCBI GI: 116309662 NCBI Desc: osigba0118p15.1 [oryza sativa (indica cultivar-group)]
  misc_feature (29)..(332): NCBI GI: 124360080 NCBI Desc: galactose mutarotase-like [medicago truncatula]
MASPGPAGAASAAASPSPPMQLPSPFAELVKAPSGLEKIVLRGARNCCAEIYLYGGQVTSWKNDNGEELLFLSSKAIFKPPKAIRGGIPVCFPQFGTHGNLEQHGFARNRFWTIDNNPPPLPVNPAIKAFVDLILKPSEEDLKIWPHSFEFRLRVALGPSGDLSLTSRIRNTNTDGRPFSYTFAYHTYFSVSDISEVRVEGLETMDYLDNLKAKERFTEQGDAIVFESEVDKVYLAAPSKIAIIDHEKKRTFVVTKEGLPDAVVWNPWDKKAKAMQDFGDAEYKSMLCVEPAAVERPITLKPGEEWKGRLVLSAVPSSYCSGQLDPLKVLQG

SEQ ID NO: 5983 - DNA, 429 bp, Sorghum bicolor
  misc_feature: Ceres ANNOT ID no. 6057033
  misc_feature: Encodes the peptide sequence at SEQ ID NO 5984
atggagaagaaaaacccatccgcggtgtcgcaacaggtgaagaaggcgccggagctgcagaatcccaagatccaggcggcgctggaccgctgcgtcggtgaatccgccaccatgagcggcaccggaaggaccgacctcgggtcccagaagaagccgctgccggaggagctcatcctgttcacaccttcgccgtccactccatcccctccgccccccacatcgccgccaccgtcgtcgaccccggctcctgcgaccaccactgcatccccgtccgcgtcatcgtcctactccccggcgaactcctctttagacacctacttcttcggcgttggatcgacgatgctgcctgcatctgggatatcggttcaagcttcttctacctccggcaacgtcatcaactctttcggttgccggaacatgtcttcttag

SEQ ID NO: 5984 - protein, 142 aa, Sorghum bicolor
  misc_feature: Ceres ANNOT ID no. 6057033
  misc_feature (35)..(102): NCBI GI: 117929342 NCBI Desc: glycosyl transferase, family 51 [acidothermus cellulolyticus 11b]
  misc_feature (33)..(138): NCBI GI: 117929240 NCBI Desc: chitinase [acidothermus cellulolyticus 11b]
  misc_feature (52)..(102): NCBI GI: 559557 NCBI Desc: arabinogalactan-protein
  misc_feature (6)..(105): NCBI GI: 38345395 NCBI Desc: osjnba0067k08.24 [oryza sativa (japonica cultivar-group)]
  misc_feature (61)..(132): NCBI GI: 86609033 NCBI Desc: conserved repeat domain protein [cyanobacteria bacterium yellowstone b-prime]
MEKKNPSAVSQQVKKAPELQNPKIQAALDRCVGESATMSGTGRTDLGSQKKPLPEELILFTPSPSTPSPPPPTSPPPSSTPAPATTTASPSASSSYSPANSSLDTYFFGVGSTMLPASGISVQASSTSGNVINSFGCRNMSS

SEQ ID NO: 5985 - DNA, 1116 bp, Sorghum bicolor
  misc_feature: Ceres ANNOT ID no. 6057129
  misc_feature: Encodes the peptide sequence at SEQ ID NO 5986
atggcggcttcgggagggctcgagcagtggcagaaggacgggttcttccaggcggccgaggaggtgcaggagtcggcggacttgatggaatctgtctatagaacttggatgcgcgagcgatgtgatggttctagctcagacgaggtggatgatttgcaaagggagcttcagacagctttaggaactgcaaaatggcagttggaacagtttgagagggctgtaagttcatgcaacgataagtattcactggaagagggtacactggcaaggcgtaggcagtttgtggtagccattgaggatcagatttctcgtgtagagaaagaaataaatggttctttaatggacaatggcagacaagggctcaactgggtgaagttagatgatgaagagcgagatgatctagtcgctttcctttcagcacctgcagagttctattcagaaatgaagagaacagacagcagtaaccatgccccatctagacaaaagaatgtgccgaacgatcagagtgatccaactttaattattaaagacatatatgaagtgccacgcagagaaatttttactgttaagagtgatgtttgtggtctagctgaggagttacatggccttagaagaaatatgagttcaggtaatgatcattggaagattgacattggtagcgagggggatgatgatagaaaattgtccccagacgcaaatggggttcaggccacaagtcagacaactgctttatcaagcatccggagaggcacagaatctttaacaagagtgagatggttttggaatagcttgtggaaacccaagagtgatgaacatcggacagtaagatatggtatatcaaataatcttgacctcagggttctatccttattaacacagagatttaatgggctagccgaaagaagcagaaattatttgacaagttggaaggaaaattccagaatttctggacggatgggtgggcttcatatacaaggccaacaacagaacattcaatttggtcgttctattcggatcaccctcttactggtgttgagtatctttctgattggtcagtgccgaacttatcttattttgcactacgagaaagtgaaaaattattcacatacaccataa

SEQ ID NO: 5986 - protein, 371 aa, Sorghum bicolor
  misc_feature: Ceres ANNOT ID no. 6057129
  misc_feature (13)..(106): Pfam Id: Syntaxin-6_N Pfam Desc: Syntaxin 6, N-terminal
  misc_feature (1)..(350): NCBI GI: 40253501 NCBI Desc: clathrin-coat assembly protein-like [oryza sativa (japonica cultivar-group)]
  misc_feature (1)..(179): NCBI GI: 140052131 NCBI Desc: t-snare [medicago truncatula]
  misc_feature (7)..(235): NCBI GI: 6693035 NCBI Desc: t22c5.15 [arabidopsis thaliana]
  misc_feature (1)..(159): NCBI GI: 87241412 NCBI Desc: t-snare [medicago truncatula]
  misc_feature (29)..(247): NCBI GI: 145329172 NCBI Desc: syntaxin family protein [arabidopsis thaliana]
MAASGGLEQWQKDGFFQAAEEVQESADLMESVYRTWMRERCDGSSSDEVDDLQRELQTALGTAKWQLEQFERAVSSCNDKYSLEEGTLARRRQFVVAIEDQISRVEKEINGSLMDNGRQGLNWVKLDDEERDDLVAFLSAPAEFYSEMKRTDSSNHAPSRQKNVPNDQSDPTLIIKDIYEVPRREIFTVKSDVCGLAEELHGLRRNMSSGNDHWKIDIGSEGDDDRKLSPDANGVQATSQTTALSSIRRGTESLTRVRWFWNSLWKPKSDEHRTVRYGISNNLDLRVLSLLTQRFNGLAERSRNYLTSWKENSRISGRMGGLHIQGQQQNIQFGRSIRITLLLVLSIFLIGQCRTYLILHYEKVKNYSHTP

SEQ ID NO: 5987 - DNA, 1614 bp, Sorghum bicolor
  misc_feature: Ceres ANNOT ID no. 6057135
  misc_feature: Encodes the peptide sequence at SEQ ID NO 5988
atggcggtggcggcggtcgcggggaagctgggagcgggaggtgatccggtggcggtggaggttctcctgccgcctctgtcggaggcggatccccttcacgcagagaagaagaggatactggaaaataggaacctatcttgtgaaattcagattcctgttacatgttctgctgccgatgccctcaaattactggatcagattattgaagctgctagggtagtgtacatggatgagctagagctttattttgcaggagatgatgtcggtccattctctgcaaggaatgaacttgaatctctaaatgttttgttcaaaacaatgaaaaaattgcttctaacttccaatgccgctgccaaggaagtactacagatactacaggatgagatagttgttaagctgaaatctgttggaaagtcagacgatgcttggatggttgttcaaacacagaaccatgatgctgaagattctcttctgaaatggggggagcatcttgaaggtttagtttttcagggagctggaagaggaatggtagcttctgaaagtataggtgtgggggaaattgctcttgaaattccagagtccctcatcatatctgatgaacttctttgtcaatctgaagtgtttcttgcattaaaagatttcaatagtatcacttctgagactatgttattgttgtggagcatgagagagcggtataatctagcttcaaagtttaaaccatactttgatacactcccggcaaatttcaatacaggcttgagttttggaattgacggacttgctgcattagaaggaacccttctttttgatgagataatgcaagctaagcagcacttgcgccagcagtatgatgaattatttcccttactttgcacaaattttcctgagatattccggaaggatgtgtgcacatgggacaattttctgtgggcatgtgaactatggtattccaacagtatgatggttgttctaagtagtgggaaattatcaacttgcttggttcctgttgctggacttctcaatcactcggtgtcccctcatattttgaactatggtcgagtagatgaagctacaaaatcattgaagtttcctttgtctcggccctgtgatgcaggggagcaatgctttctcagttatggaaaacatccagggtcacatcttgttacattctatggtttcctaccaagaggagataacccttatgatgttatacctttagatcttgacacatctgcggatgatgaggacggcacagctcagtctgtgacaacaagccaaaccactcatatggttcgtgggacatggctgtctagatctggaggattccccacgtatggcctgcctcagcccttgctgtcccatctccgtgctgctctaggttgtgatatagacgaatccactacggaagctgatataaaggaaaatgacaaggtggtgctggaaacaatcctgtccatatttaatcccatgcttgaagcattgcctgagcaagatgattcccaccgggagggcgccagttgggatgtgaagctatcattggactacaaagatctgcagagaaagataatatcgtccattgtcacttcctgtacctcagccttggaaaatttttaa

SEQ ID NO: 5988 - protein, 537 aa, Sorghum bicolor
  misc_feature: Ceres ANNOT ID no. 6057135
  misc_feature (156)..(386): Pfam Id: SET Pfam Desc: SET domain
  misc_feature (2)..(461): NCBI GI: 115475507 NCBI Desc: os08g0244400 [oryza sativa (japonica cultivar-group)]
  misc_feature (170)..(283): NCBI GI: 140052134 NCBI Desc: hydroxymethylglutaryl-coa reductase, nad-binding [medicago truncatula]
  misc_feature (162)..(492): NCBI GI: 85110711 NCBI Desc: related to histone-lysine n-methyltransferase [mips] [neurospora crassa n150]
  misc_feature (162)..(492): NCBI GI: 12718364 NCBI Desc: related to histone-lysine n-methyltransferase [neurospora crassa]
  misc_feature (174)..(414): NCBI GI: 146181028 NCBI Desc: set domain containing protein [tetrahymena thermophila sb210]
MAVAAVAGKLGAGGDPVAVEVLLPPLSEADPLHAEKKRILENRNLSCEIQIPVTCSAADALKLLDQIIEAARVVYMDELELYFAGDDVGPFSARNELESLNVLFKTMKKLLLTSNAAAKEVLQILQDEIVVKLKSVGKSDDAWMVVQTQNHDAEDSLLKWGEHLEGLVFQGAGRGMVASESIGVGEIALEIPESLIISDELLCQSEVFLALKDFNSITSETMLLLWSMRERYNLASKFKPYFDTLPANFNTGLSFGIDGLAALEGTLLFDEIMQAKQHLRQQYDELFPLLCTNFPEIFRKDVCTWDNFLWACELWYSNSMMVVLSSGKLSTCLVPVAGLLNHSVSPHILNYGRVDEATKSLKFPLSRPCDAGEQCFLSYGKHPGSHLVTFYGFLPRGDNPYDVIPLDLDTSADDEDGTAQSVTTSQTTHMVRGTWLSRSGGFPTYGLPQPLLSHLRAALGCDIDESTTEADIKENDKVVLETILSIFNPMLEALPEQDDSHREGASWDVKLSLDYKDLQRKIISSIVTSCTSALENF

SEQ ID NO: 5989 - DNA, 735 bp, Sorghum bicolor
  misc_feature: Ceres ANNOT ID no. 6057185
  misc_feature: Encodes the peptide sequence at SEQ ID NO 5990
atgccatccgccgacgccggcgacacgatgcccgcgcaggcgccggaaacaagggcggtcatctcgcacgtcatcttcgacatggacggcctcctcctcgatacggaggggttctacacgacgatgcaggagaagatcttggagaggtatggcaaggtgttcgactggtccgtgaaggccaagatgatgggcaagaccacggccgagtccacgcgcatcttgtttgaggaattcgacctctcccgcctgctcaccccggagcagttcctcgaggagcgcgagatcatgctccagatgctcctgcccacctgcgttgccatgccaggtgtggaacgcttgatccatcttctccatacaaatggaatacctatagctgttgcaactggaacccataaacatcactttgcattaaagacacaaaaccaccaggacatattttccctgatgcatcatattgtcacaggggatgatccagaagtgaaggcggggaagccatctcctgatattttccttgctgctatgaggagatttgagggtaatgtagaacccagtaattgcttggtatttgaagatgcaccattgggtgtggcagcagccaaaacttcaggaatgcacgtggtgatggtcccagattcaaggctagatgtttcacatcacaaaggagctgaccaagttctcacttcactattggaattcaatcctagcgaatggggcctgccaccttttatggattag

SEQ ID NO: 5990 - protein, 244 aa, Sorghum bicolor
  misc_feature: Ceres ANNOT ID no. 6057185
  misc_feature (21)..(212): Pfam Id: Hydrolase Pfam Desc: haloacid dehalogenase-like hydrolase
  misc_feature (3)..(244): NCBI GI: 92873799 NCBI Desc: had-superfamily hydrolase subfamily ia, variant 3; epoxide hydrolase n-terminal domain-like phosphatase [medicago truncatula]
  misc_feature (18)..(244): NCBI GI: 18416631 NCBI Desc: haloacid dehalogenase-like hydrolase family protein [arabidopsis thaliana]
  misc_feature (2)..(244): NCBI GI: 21618138 NCBI Desc: gs1-like protein [arabidopsis thaliana]
  misc_feature (28)..(244): NCBI GI: 9758306 NCBI Desc: gs1-like protein [arabidopsis thaliana]
  misc_feature (11)..(242): NCBI GI: 89269960 NCBI Desc: haloacid dehalogenase-like hydrolase domain containing 1a [xenopus tropicalis]
MPSADAGDTMPAQAPETRAVISHVIFDMDGLLLDTEGFYTTMQEKILERYGKVFDWSVKAKMMGKTTAESTRILFEEFDLSRLLTPEQFLEEREIMLQMLLPTCVAMPGVERLIHLLHTNGIPIAVATGTHKHHFALKTQNHQDIFSLMHHIVTGDDPEVKAGKPSPDIFLAAMRRFEGNVEPSNCLVFEDAPLGVAAAKTSGMHVVMVPDSRLDVSHHKGADQVLTSLLEFNPSEWGLPPFMD

SEQ ID NO: 5991 - DNA, 2283 bp, Sorghum bicolor
  misc_feature: Ceres ANNOT ID no. 6057224
  misc_feature: Encodes the peptide sequence at SEQ ID NO 5992
atggcgccgccgagctcgtggtggggcagcgatcaggagcagcacggcacgccggtggtggtgaagatggacaacccttactcccttgtggagatcgacggtcccggcatgccgccctccgacaaggcccggggcaagaacgcgaagcagttcacgtgggtgctgctcctgcgcgcgcaccgcgccgtgggttgcgtggcgtggctggccggcgggttctggggcgtcctgggcgccgtgaaccgccgcgttcgccggagccgcgacgccgacgaggagccggacgccgaggcctcgggccgtggccgggtcatgctgcggttcctgcgcgccttcctgctgctctccctggcgatgctggccctggagacggtggcgcacctcaaggggtggcagttcccgcagcacctgccggggaacctgcaggagctggaggagcagctgcagcacctccccgagcacctgcgccacctccccgagaacctccggcagcttcccgaccacctccgcgtgccggagcggcaggagatccagggctggctgcaccgcgcgtacgtggcctggctggagttccgcgtcgactacatcgcctgggccatccagaagctgtcctgcttctgcatcctgctcttcatggtccagtccgtggaccgcatcgtgcagtgcctcgcctgcttctggatcaagatccgcggcatcaagcctcgtatcccgccgccggcgtccgccggcaagaagaagaagcctcgtcggaagagcgcggatgtcgagaacggtgaagccgacgacgacgccgacggctacttccccatggtgctcatccagatgcccatgtgcaacgagaaagaggtgtacgagacatcgatctcgcacgtgtgccagatggactggccgcgggaccggctgctgatccaggtgctggacgactcggacgacgaggtgtgccagatgctgatcagggcggaggtgaccaagtggagccagcgcggcgtcaacatcatctaccgccaccgcctgtcgcgcaccggctacaaggccggcaacctcaagtccgccatggcctgcgactacgtcaaggactacgagttcgtcgccatcttcgacgcagacttccagcccaacccggacttcctcaagctcaccgtgccacacttcaaggaggacccggagcttggtctggtccaggctcgttggagcttcgtgaacaaggacgagaacctgctgacccggctgcagaacatcaacctgtgcttccacttcgaggtcgagcagcaggtcaatggcgtctacctcaacttctttggcttcaacggcacggccggcgtgtggcgcatcaaggccctcgaggactccggcggctggatggagcgcaccaccgtcgaggacatggacatcgccgtccgcgcacacctcaacggctggaagttcatcttcctcaacgacgtcaaggtcctctgcgagctgccggagtcttaccaggcttacaggaagcagcagcacaggtggcactccggccccatgcagctcttccgcctctgcatcccggccatcatcaggtccaagatcccgttctggaagaaggcgaacctggtgatgctcttcttcctgctgcgcaagctggtgctgcccttctactccttcacgctcttctgcgtgatcctgccgctcaccatgttcgtgccggaggcggagctgcccatctgggtcatctgctacatcccggttctcatgtcgctcctcaacatcatgccggcgcccaagtcgttcccgttcatcatcccctacctcctcttcgagaacaccatgtccgtcaccaagttcaacgccatggtgtccgggctgttccagctggggagctcctacgagtggatcgtcaccaagaaggccggccgcacctcgtccgccaacgacatcctcgcgatggccgaggccgacgcccacgcgccgctgccggccaagctcgcgcgccgcgtctccgagggcggcctcgaggagtggagcaggctcagggaacaggaggccgccgagtgggccaacaaggaggacgccgccgcgtctctggctgccgccgccgccgccgcgccggccacgcccaagaagagcagcaaggccaagaagcccaaccggatcttcaagaaggagctcgcgctcgcgtgcctcctcctcacggccgccacgcggagcctgctctccaagcaggggctgcacttctacttcctgctcttccagggcgtcaccttcctcgccgtcggcctcgacctcatcggcgagcaggtcagctag

SEQ ID NO: 5992 - protein, 760 aa, Sorghum bicolor
  misc_feature: Ceres ANNOT ID no. 6057224
  misc_feature (245)..(693): NCBI GI: 34419218 NCBI Desc: tpa: cellulose synthase-like c2 [oryza sativa (indica cultivar-group)]
  misc_feature (245)..(693): NCBI GI: 50726490 NCBI Desc: cslc2 [oryza sativa (japonica cultivar-group)]
  misc_feature (172)..(664): NCBI GI: 114224789 NCBI Desc: cellulose synthase-like c3 [physcomitrella patens]
  misc_feature (273)..(760): NCBI GI: 115475565 NCBI Desc: os08g0253800 [oryza sativa (japonica cultivar-group)]
  misc_feature (172)..(664): NCBI GI: 114224787 NCBI Desc: cellulose synthase-like c2 [physcomitrella patens]
  misc_feature: Useful for making plants with altered cell wall content and/or composition
  misc_feature: Functional homolog of the protein sequence encoded by LOCUS at2g24630
  misc_feature: Functional homolog of the protein sequence encoded by LOCUS at4g31590
  misc_feature: Useful for making plants with altered cell wall content and/or composition
  misc_feature: Functional homolog of the protein sequence given in SEQ ID NO 13908
  misc_feature: Useful for making plants with altered carbohydrate content
  misc_feature: Functional homolog of the protein sequence given in SEQ ID NO 13855
  misc_feature: The sequence is a functional homolog of SEQ ID NO. 403 in the 11/188,298 US application
MAPPSSWWGSDQEQHGTPVVVKMDNPYSLVEIDGPGMPPSDKARGKNAKQFTWVLLLRAHRAVGCVAWLAGGFWGVLGAVNRRVRRSRDADEEPDAEASGRGRVMLRFLRAFLLLSLAMLALETVAHLKGWQFPQHLPGNLQELEEQLQHLPEHLRHLPENLRQLPDHLRVPERQEIQGWLHRAYVAWLEFRVDYIAWAIQKLSCFCILLFMVQSVDRIVQCLACFWIKIRGIKPRIPPPASAGKKKKPRRKSADVENGEADDDADGYFPMVLIQMPMCNEKEVYETSISHVCQMDWPRDRLLIQVLDDSDDEVCQMLIRAEVTKWSQRGVNIIYRHRLSRTGYKAGNLKSAMACDYVKDYEFVAIFDADFQPNPDFLKLTVPHFKEDPELGLVQARWSFVNKDENLLTRLQNINLCFHFEVEQQVNGVYLNFFGFNGTAGVWRIKALEDSGGWMERTTVEDMDIAVRAHLNGWKFIFLNDVKVLCELPESYQAYRKQQHRWHSGPMQLFRLCIPAIIRSKIPFWKKANLVMLFFLLRKLVLPFYSFTLFCVILPLTMFVPEAELPIWVICYIPVLMSLLNIMPAPKSFPFIIPYLLFENTMSVTKFNAMVSGLFQLGSSYEWIVTKKAGRTSSANDILAMAEADAHAPLPAKLARRVSEGGLEEWSRLREQEAAEWANKEDAAASLAAAAAAAPATPKKSSKAKKPNRIFKKELALACLLLTAATRSLLSKQGLHFYFLLFQGVTFLAVGLDLIGEQVS

SEQ ID NO: 5993 - DNA, 636 bp, Sorghum bicolor
  misc_feature: Ceres ANNOT ID no. 6057254
  misc_feature: Encodes the peptide sequence at SEQ ID NO 5994
atggacgaagtcgtcagccagattttggagaagcaagtgctgtcggccgcgaaggcggtggaggacaagctcgatgaggagatcgccgcgctcgaccgcctcgatccggacgacatcgaggcgctccgcgagcgccggatccagcagatgcgccgcgccgccgagcgccgcgccaagtggcgcgcgctggggcacggggagtacaccgaggtccccgagaaggagttcttctccgccgccaaggccagcgagcggctcgtctgccacttctaccgcgacaactggccctgcaaggttgtggataaacacttgtcaattcttgcaaaacagcatgtagaaacacggtttgtgaaagtccatgctgagaaggctcccttcctgacagagaagctcaggatagttgtccttccgactcttgctatagttaagaatgccaaggtcgaggactatgtggttggctttgatgagcttggcggcaaagacgacttcagcaccgaggatctggaagaacggctggcgaaatcccaagttatcttcctcgatggagaagggtctgcatacgccgcaaagcaggctgccgccaccaaacgaagcgttcggcaatcagacaccggcgactcatctgactctgaatag

SEQ ID NO: 5994 - protein, 211 aa, Sorghum bicolor
  misc_feature: Ceres ANNOT ID no. 6057254
  misc_feature (3)..(183): NCBI GI: 62896791 NCBI Desc: atp binding protein associated with cell differentiation variant [homo sapiens]
  misc_feature (3)..(178): NCBI GI: 19683948 NCBI Desc: txndc9 protein [homo sapiens]
  misc_feature (3)..(182): NCBI GI: 2342477 NCBI Desc: atp binding protein [homo sapiens]
  misc_feature (5)..(209): NCBI GI: 55244531 NCBI Desc: ensangp00000019750 [anopheles gambiae str. pest]
  misc_feature (3)..(182): NCBI GI: 38051964 NCBI Desc: txndc9 protein [rattus norvegicus]
MDEVVSQILEKQVLSAAKAVEDKLDEEIAALDRLDPDDIEALRERRIQQMRRAAERRAKWRALGHGEYTEVPEKEFFSAAKASERLVCHFYRDNWPCKVVDKHLSILAKQHVETRFVKVHAEKAPFLTEKLRIVVLPTLAIVKNAKVEDYVVGFDELGGKDDFSTEDLEERLAKSQVIFLDGEGSAYAAKQAAATKRSVRQSDTGDSSDSE

SEQ ID NO: 5995 - DNA, 927 bp, Sorghum bicolor
  misc_feature: Ceres ANNOT ID no. 6057390
  misc_feature: Encodes the peptide sequence at SEQ ID NO 5996
atggccggcgccggcatccacccgttccagtggccacccgcagcggccgcgccgcccccgccgggggcggcggcctcggtcgccgtcccgccgcctccccccgtgcccggcgcgccgggcaccgttgccgccgacgaggtccgcaccatcttcatcacggggctccctgccgacgtcaaggaaagggagctgcacaacctgctgcgctggctcccgggattcgaggcctcccagatcaacttcaagggcgaccagcccatgggcttcgcgctcttctcctccgcgcaccaggccatcgctgccaaggccgcgctccaggatatggtgttcgatgctgagacccaggtggcgctgcacaccgagatggctaagaagaacctcttcgtcaagagaggtgtgggaattgatgcaaatgctgtggatcaaagtaaacggttgcgaacaggtggagattatactcattctccttatgctcctccatttcatccacctccaccagctgtttccatgtggggaaccccaggatatatcacagcgccgcctccttacaatccctatgctgcctatccagtgccccctgtagctatgacttcaccttctcctgttactggtccaactgcctatgctcctgtgcagaacacaaaggataatcctccctgcaatacccttttcattggcaatctcggtgatactgtagtcgaagaggaattgcgaagccttttcagtgtgcaacctggatacaaacaaatgaaagtattacgtcaagataggaacactgtttgctttattgaatttgaggatgtgaatgctgctacatctgtacaccaaactctgcagggtgctgttattcctagttctggtcgtggtggaatgaaggattcagctggtggccttgcgagcgttctgaatggagctcctgtgaactga

SEQ ID NO: 5996 - protein, 308 aa, Sorghum bicolor
  misc_feature: Ceres ANNOT ID no. 6057390
  misc_feature (1)..(292): NCBI GI: 92881618 NCBI Desc: rna-binding region rnp-1 (rna recognition motif) [medicago truncatula]
  misc_feature (44)..(292): NCBI GI: 21615411 NCBI Desc: proline rich protein 3 [cicer arietinum]
  misc_feature (18)..(155): NCBI GI: 55297274 NCBI Desc: rna-binding protein-like [oryza sativa (japonica cultivar-group)]
  misc_feature (13)..(147): NCBI GI: 52077025 NCBI Desc: rna-binding protein-like [oryza sativa (japonica cultivar-group)]
  misc_feature (46)..(131): NCBI GI: 1370048 NCBI Desc: mec-8 [caenorhabditis elegans]
  misc_feature: The sequence is a functional homolog of SEQ ID NO. 339 in the 11/188,298 US application
MAGAGIHPFQWPPAAAAPPPPGAAASVAVPPPPPVPGAPGTVAADEVRTIFITGLPADVKERELHNLLRWLPGFEASQINFKGDQPMGFALFSSAHQAIAAKAALQDMVFDAETQVALHTEMAKKNLFVKRGVGIDANAVDQSKRLRTGGDYTHSPYAPPFHPPPPAVSMWGTPGYITAPPPYNPYAAYPVPPVAMTSPSPVTGPTAYAPVQNTKDNPPCNTLFIGNLGDTVVEEELRSLFSVQPGYKQMKVLRQDRNTVCFIEFEDVNAATSVHQTLQGAVIPSSGRGGMKDSAGGLASVLNGAPVN

SEQ ID NO: 5997 - DNA, 1116 bp, Sorghum bicolor
  misc_feature: Ceres ANNOT ID no. 6057459
  misc_feature: Encodes the peptide sequence at SEQ ID NO 5998
  misc_feature: Up-regulated in shoot tissues in response to methyl jasmonate treatment
  misc_feature: Up-regulated in root tissues in response to methyl jasmonate treatment
atggccgccgccgctcgcgccgccctcccgcggccccacctctccctcccttcctcctcccgccgcagcagcccccgtctgtccctcacgccctcctccgcccctcctcgcctgcgcggcggcgctgccacctccgtcgccgccggcacctccgccgcgccgcagcagcaccaggtcaccgcgcgcctgggcgacgtgatcgaggcgcagcagttcgaccgggacgcgctgaacgagatcttcgaggtggcgcgggagatggaggccgtggagcggggctcccacggcgcccccagccgcgtcctcgaggggtacctcatggccacgctcttctacgagccctccacgcgcacgcgcctctccttcgaggccgctatgcggaggctcggcggggaggtgctcaccaccgagaacgcgcgcgagttctcttccgccgccaagggggagacactcgaagataccataagaactgttgagggttattctgatattattgttctgagacattttgaaagtggagccgcaaggagagcagcagatactgcgaatattcctgttattaatgcaggtgatgggccagggcaacatccaacccaggctctgttggatgtgtacacaataaagagagaaattggcacactagatggaataaaacttggtttggttggtgaccttgctaatgggaggacagttcgttctctggcttacttgattgctaagtaccagaacataaagatatactttgtatctccagatgttgttaaaatgaaggatgacatcaaggactacttaaattccaaaggtgttgaatgggaagaaagttcagatttgttggaggtggcttccaagtgtgatgttatttatcaaacacgtattcaaaaagaaagatttggtgagaggattgatctttatgaagctgctcgtggtaagtacattgtggataagaaggtcttggatgtgctgccaaagcattctgtgatcatgcatccccttccaaggcttgatgagatcagggtagaagtcgatagtgatccaagagctgcatattttaggcaggctaagaatggcctctacataaggatggcattgctcaaacttctgcttgttggtcactga

SEQ ID NO: 5998 - protein, 371 aa, Sorghum bicolor
  misc_feature: Ceres ANNOT ID no. 6057459
  misc_feature (214)..(367): Pfam Id: OTCace Pfam Desc: Aspartate/ornithine carbamoyltransferase, Asp/Orn bindingdomain
  misc_feature (64)..(210): Pfam Id: OTCace_N Pfam Desc: Aspartate/ornithine carbamoyltransferase, carbamoyl-P bindingdomain
  misc_feature (62)..(370): NCBI GI: 609344 NCBI Desc: aspartate carbamoyltransferase
  misc_feature (62)..(370): NCBI GI: 144924033 NCBI Desc: aspartate carbamoyltransferase [medicago truncatula]
  misc_feature (62)..(370): NCBI GI: 3914503 NCBI Desc: aspartate carbamoyltransferase 2, chloroplast precursor (aspartate transcarbamylase 2) (atcase 2)
  misc_feature (63)..(370): NCBI GI: 21535795 NCBI Desc: aspartate carbamoyltransferase [solanum tuberosum]
  misc_feature (4)..(370): NCBI GI: 3914502 NCBI Desc: aspartate carbamoyltransferase 1, chloroplast precursor (aspartate transcarbamylase 1) (atcase 1)
  misc_feature (62)..(370): SWISSPROT Homolog: EC 2.1.3.2 Aspartate carbamoyltransferase 3, chloroplast precursor
  misc_feature: Up-regulated in shoot tissues in response to methyl jasmonate treatment
  misc_feature: Up-regulated in root tissues in response to methyl jasmonate treatment
MAAAARAALPRPHLSLPSSSRRSSPRLSLTPSSAPPRLRGGAATSVAAGTSAAPQQHQVTARLGDVIEAQQFDRDALNEIFEVAREMEAVERGSHGAPSRVLEGYLMATLFYEPSTRTRLSFEAAMRRLGGEVLTTENAREFSSAAKGETLEDTIRTVEGYSDIIVLRHFESGAARRAADTANIPVINAGDGPGQHPTQALLDVYTIKREIGTLDGIKLGLVGDLANGRTVRSLAYLIAKYQNIKIYFVSPDVVKMKDDIKDYLNSKGVEWEESSDLLEVASKCDVIYQTRIQKERFGERIDLYEAARGKYIVDKKVLDVLPKHSVIMHPLPRLDEIRVEVDSDPRAAYFRQAKNGLYIRMALLKLLLVGH

SEQ ID NO: 5999 - DNA, 1356 bp, Sorghum bicolor
  misc_feature: Ceres ANNOT ID no. 6057472
  misc_feature: Encodes the peptide sequence at SEQ ID NO 6000
atggggacgcaaacaccgccccagagcttctctcctcaaaaggagaaggacgacggcggcaggacgcaacaggagaagtcgatcgatgagtggctcccaatcaactcctccaggaaggccaagtggtggtactccgccttccacaatgtcaccgccatggtcggcgccggcgtgcttggccttccctacgccatgtccgagctcggctggggccctggcatcgtggtgatgatcctgtcatggatcatcacgctgtacacgctatggcagatggtggagatgcacgagatggtgccagggaagcggttcgaccgctaccacgagctcgggcagcacgtgttcggcgagcggctgggcctctggatcgtcgtgccgcagcagctcgccgtggaggtgagcctcaatatcatctacatggtcaccggcggccagtccctcaagaagttccacgacgtcatctgcgacggcaagtgcagcgacttcaagctctcctacttcatcatgatcttcgcctccgtccacttcgtcctctcacagctccccaacttcaactccatctccgccgtctccctcgccgccgccatcatgtcgcttagttactccaccattgcgtggggcgcatcactggacaaggggaagggcacagacgtggactatagtctgcgcgcgacgacgactccagggaaggtgttcgacttcctcgggggcctaggggacgtcgcgttcgcgtattcggggcacaacgtggtgctggagatccaggctaccatcccgtccacgccggagaagccatctaagaagcccatgtggaagggtgccttcgtcgcctacgtcattgtcgcgatctgctacttccccgtcgcattcgttgggtactgggcctttggcagtggtgtcgatgagaacatcctcatgacgctctccaagcctaagtggctcattgccctcgccaacatgtttgtcgtcatccatgtcattggcagttaccaggtttatgccatgccagtgttcgacatgatagagacggtgctggtgaagaaactgcggttcgctccaagcttcactctccgtcttattgcccggagtgtttacgttgcgttcacaatgtttgtaggcatcactttccccttctttggtggattgctcagtttctttggcggattagccttcgcaccaacaacttattttcttccctgcatcatgtggctcaaggtctacaagcccaaacgcttcggcctttcatggttcatcaactggatctgcattgttattggagtgctgctgctggttctgggtccgataggagggatgcggcagattattttgtcagccaagacatacaaattctaccagtaa

SEQ ID NO: 6000 - protein, 451 aa, Sorghum bicolor
  misc_feature: Ceres ANNOT ID no. 6057472
  misc_feature (38)..(438): Pfam Id: Aa_trans Pfam Desc: Transmembrane amino acid transporter protein
  misc_feature (15)..(450): NCBI GI: 2576361 NCBI Desc: lysine and histidine specific transporter [arabidopsis thaliana]
  misc_feature (11)..(450): NCBI GI: 1906549 NCBI Desc: amino acid permease [nicotiana sylvestris]
  misc_feature (34)..(449): NCBI GI: 140046054 NCBI Desc: amino acid/polyamine transporter ii [medicago truncatula]
  misc_feature (21)..(419): NCBI GI: 2443875 NCBI Desc: amino acid permease [arabidopsis thaliana]
  misc_feature (22)..(450): NCBI GI: 92871429 NCBI Desc: amino acid/polyamine transporter ii [medicago truncatula]
  misc_feature: Useful for making plants with altered oil content
  misc_feature: Useful for making plants with modulated biomass
  misc_feature: Useful for making plants with modulated heat sensitivity
  misc_feature: Functional homolog of the protein sequence given in SEQ ID NO 13361
  misc_feature: GREAT-hit functional homolog of the protein sequence given in SEQ ID NO 13434
  misc_feature: GREAT-hit functional homolog of the protein sequence given in SEQ ID NO 13448
  misc_feature: Useful for making plants with altered oil content
  misc_feature: Functional homolog of the protein sequence given in SEQ ID NO 13448
  misc_feature: The sequence is a functional homolog of SEQ ID NO. 313 in the 11/188,298 US application
  misc_feature: The sequence is a functional homolog of SEQ ID NO. 438 in the 11/188,298 US application
MGTQTPPQSFSPQKEKDDGGRTQQEKSIDEWLPINSSRKAKWWYSAFHNVTAMVGAGVLGLPYAMSELGWGPGIVVMILSWIITLYTLWQMVEMHEMVPGKRFDRYHELGQHVFGERLGLWIVVPQQLAVEVSLNIIYMVTGGQSLKKFHDVICDGKCSDFKLSYFIMIFASVHFVLSQLPNFNSISAVSLAAAIMSLSYSTIAWGASLDKGKGTDVDYSLRATTTPGKVFDFLGGLGDVAFAYSGHNVVLEIQATIPSTPEKPSKKPMWKGAFVAYVIVAICYFPVAFVGYWAFGSGVDENILMTLSKPKWLIALANMFVVIHVIGSYQVYAMPVFDMIETVLVKKLRFAPSFTLRLIARSVYVAFTMFVGITFPFFGGLLSFFGGLAFAPTTYFLPCIMWLKVYKPKRFGLSWFINWICIVIGVLLLVLGPIGGMRQIILSAKTYKFYQ

SEQ ID NO: 6001 - DNA, 1452 bp, Sorghum bicolor
  misc_feature: Ceres ANNOT ID no. 6057517
  misc_feature: Encodes the peptide sequence at SEQ ID NO 6002
atggggctcttaggtatgatgggcgactcgtttggttgctcggcgaccggggagcgacttgtctctgctgcaagagatggagacatccaggaggctagagccctcttggaactcaatccccgccttgcacggtactcgactttcgggatccggaactcgcctctccattactcggcagcaaagggccaccatgagattgtctccctcctaatcgaatccggcgttaatattaaccttagaaattgcagaggacagactgctctgatgcaagcttgtctatatggtcactggaaagttgtacagattctagttctttttaaagctaatattcacaggagagattgttttagtggcgcgaccgctattcattttgccgccctaaaaggtcatactcggtgcattcggcttcttgtggctgattacgtgcctagtttgtcagagttttggaccattatgcgtgcaaagtccaaagatcaaatgaaaaaggatgcctttgatgccgtggctctccagagactagttaatggaaagtcggatggtggcgtcaccccgcttcacttggcagcccttcatgggcatgctgagagtgtgcagctgctgttagaccttggagcctccgtctctgaggttactgtcaatgatggttcaactattgacctcattggttcagggagcacacccctccattacgcggcatgtggtggaagtgctgtttgctgccaacttctcattgcagcaggagcaaacatgggagctcaaaatgctaatgggttgactcctttattggtggctcgttcgtggcacaaaactagtattgaaggtattctaagcaagcaaccagaaaatcgaatgcgtattcttccttcaccatacctttgtctaccactgatgagcattgtcaaaattgcccgggaatgtggatggaggaaaacttctgcctcatccacttgtcaggatccatgtgtcatatgtttggaggtggaatgcactgtagctgcagaaggttgcggccatgagttttgcaccaaatgtgcactctacttgtgctccaccactagcagctcaacatccatccgcggagttcctggctccatatcctgccctttgtgtcggcatgccattgtctccttcatgaggctcaccagcactaccccaataaaggagcttccatggacaagtgcatcgctagctctatgtgcagcaggcgcaagcactggtcctgatcatggcaggtccttgcagcgacggagtgatatgcgtcggttgcgctcgtcctcagttcagctgggatgctcttcttttatatccattggctctgggaagctgtcatccataaagctgaactgcacaggagctgaagaggcagtgccttgcctcgtcagctgcctgaggcctgatgtgcagcgttcatcgtcatacagggaaagaattaggagatattcggagttttga

SEQ ID NO: 6002 - protein, 483 aa, Sorghum bicolor
  misc_feature: Ceres ANNOT ID no. 6057517
  misc_feature (50)..(82): Pfam Id: Ank Pfam Desc: Ankyrin repeat
  misc_feature (83)..(115): Pfam Id: Ank Pfam Desc: Ankyrin repeat
  misc_feature (180)..(212): Pfam Id: Ank Pfam Desc: Ankyrin repeat
  misc_feature (223)..(255): Pfam Id: Ank Pfam Desc: Ankyrin repeat
  misc_feature (321)..(370): Pfam Id: zf-C3HC4 Pfam Desc: Zinc finger, C3HC4 type (RING finger)
  misc_feature (1)..(403): NCBI GI: 45773910 NCBI Desc: at5g57740 [arabidopsis thaliana]
  misc_feature (7)..(476): NCBI GI: 63020474 NCBI Desc: pollen ankyrin-like protein [lilium longiflorum]
  misc_feature (7)..(457): NCBI GI: 42567717 NCBI Desc: ankyrin repeat family protein [arabidopsis thaliana]
  misc_feature (91)..(412): NCBI GI: 68248528 NCBI Desc: xb3-related protein [oryza sativa (japonica cultivar-group)]
  misc_feature (223)..(436): NCBI GI: 115482998 NCBI Desc: os10g0521600 [oryza sativa (japonica cultivar-group)]
MGLLGMMGDSFGCSATGERLVSAARDGDIQEARALLELNPRLARYSTFGIRNSPLHYSAAKGHHEIVSLLIESGVNINLRNCRGQTALMQACLYGHWKVVQILVLFKANIHRRDCFSGATAIHFAALKGHTRCIRLLVADYVPSLSEFWTIMRAKSKDQMKKDAFDAVALQRLVNGKSDGGVTPLHLAALHGHAESVQLLLDLGASVSEVTVNDGSTIDLIGSGSTPLHYAACGGSAVCCQLLIAAGANMGAQNANGLTPLLVARSWHKTSIEGILSKQPENRMRILPSPYLCLPLMSIVKIARECGWRKTSASSTCQDPCVICLEVECTVAAEGCGHEFCTKCALYLCSTTSSSTSIRGVPGSISCPLCRHAIVSFMRLTSTTPIKELPWTSASLALCAAGASTGPDHGRSLQRRSDMRRLRSSSVQLGCSSFISIGSGKLSSIKLNCTGAEEAVPCLVSCLRPDVQRSSSYRERIRRYSEF

SEQ ID NO: 6003 - DNA, 807 bp, Sorghum bicolor
  misc_feature: Ceres ANNOT ID no. 6057744
  misc_feature: Encodes the peptide sequence at SEQ ID NO 6004
atggcgtcggcgtcgcggctgctcccgcccgcgcctcctccttccgcccagctccgcggcccgcgggaccgccttgccgtgcggcgcctccggtgccgcgcctccgcctccgcctcggccactgatggcgccgtgctgctggagcgtggcggtcccgcggcggtggccgtgcgcgagttcgtcacgcttgacgagctccgcgccgccgtgcgcctccgcgtacgcaccttctacgagtatgccgtcgactccgtcggaaccgaggatcacagaaaagctcttgcagatagggagtttgaagcattacaggatagaatttctgggaagatgataaattttcaaagagtttcttgcataaatgggactgttccactgtccccatcattaatgtcagctgaggaactttgttctacatgcaagtttgtggaggatggagaagagagagtagtagttggtagtttagaccttaatcagtgtctttggctaccagatgaattgactggaaagaagcctggggtaaatgaagacatccagacaagagcgtacctaagcaatgtctgtgttgccaaggaggttcagaaaaagggcttaggctatacattggttgacaagtccaagaaattagctcgtgaatggggcataacagacctgtatgtccatgtcgctattgacaacatagcagggcaaaagctgtacgagaagagtggatttgtttatgagggcgaagaacctgcatggaaggctaggtttctggggagaccacggagattgcttctttggctcgatatgagcaaagtgcctttgtga

SEQ ID NO: 6004 - protein, 268 aa, Sorghum bicolor
  misc_feature: Ceres ANNOT ID no. 6057744
  misc_feature (142)..(238): Pfam Id: Acetyltransf_1 Pfam Desc: Acetyltransferase (GNAT) family
  misc_feature (22)..(268): NCBI GI: 22137098 NCBI Desc: at4g28030/t13j8_140 [arabidopsis thaliana]
  misc_feature (22)..(268): NCBI GI: 79325293 NCBI Desc: n-acetyltransferase [arabidopsis thaliana]
  misc_feature (182)..(259): NCBI GI: 119490862 NCBI Desc: gcn5-related n-acetyltransferase [lyngbya sp. pcc 8106]
  misc_feature (99)..(259): NCBI GI: 113476696 NCBI Desc: gcn5-related n-acetyltransferase [trichodesmium erythraeum ims101]
  misc_feature (182)..(264): NCBI GI: 53687727 NCBI Desc: cog0454: histone acetyltransferase hpa2 and related acetyltransferases [nostoc punctiforme pcc 73102]
MASASRLLPPAPPPSAQLRGPRDRLAVRRLRCRASASASATDGAVLLERGGPAAVAVREFVTLDELRAAVRLRVRTFYEYAVDSVGTEDHRKALADREFEALQDRISGKMINFQRVSCINGTVPLSPSLMSAEELCSTCKFVEDGEERVVVGSLDLNQCLWLPDELTGKKPGVNEDIQTRAYLSNVCVAKEVQKKGLGYTLVDKSKKLAREWGITDLYVHVAIDNIAGQKLYEKSGFVYEGEEPAWKARFLGRPRRLLLWLDMSKVPL

SEQ ID NO: 6005 - DNA, 450 bp, Sorghum bicolor
  misc_feature: Ceres ANNOT ID no. 6057893
  misc_feature: Encodes the peptide sequence at SEQ ID NO 6006
atggccacggcacaccctcgccggtgggcgctcctcctgcagctcggcatcgcccttggcatcctgctcgcggcggctgaggcttggacgggggagatcagcggccgcgtcgtctgcgacgtctgcggcgacgcagccatcggcccggaggaccacgccctcgaaggtgcggaggttgctgtcctctgcatcacaaaatccggtgaggttatcaactaccaagccttcacaaactctaagggcatgtatactgttgccgagactatgccagagagtgacaggtgggactcgtgcttggcaaggcctatcagcagtttccatctgcattgcacacggaggggtgatgctcactctggggtaaagttcacttacaacaaaccatctgggaactctcacactgtcaagactttcctctacaagccagccaccgcccctctgtattgtagctaa

SEQ ID NO: 6006 - protein, 149 aa, Sorghum bicolor
  misc_feature: Ceres ANNOT ID no. 6057893
  misc_feature (33)..(145): NCBI GI: 1362130 NCBI Desc: major allergen ole19 - common olive (fragment)
MATAHPRRWALLLQLGIALGILLAAAEAWTGEISGRVVCDVCGDAAIGPEDHALEGAEVAVLCITKSGEVINYQAFTNSKGMYTVAETMPESDRWDSCLARPISSFHLHCTRRGDAHSGVKFTYNKPSGNSHTVKTFLYKPATAPLYCS

SEQ ID NO: 6007 - DNA, 1077 bp, Sorghum bicolor
  misc_feature: Ceres ANNOT ID no. 6058053
  misc_feature: Encodes the peptide sequence at SEQ ID NO 6008
atggtcgtgtgcaaatgccgaaaggcgacgagggtttactgcttcgtccaccaggtccccgtctgtggcgtgtgcatatgctttccggagcatcagctatgcgtggtgaaaaactatgctgaatgggttgttaattctgagtatgactggccacaacattgttcatcttgcaattcagtactcgaaggtggaactgaagaaacaacacgacttggttgcttgcatgtggtgcacacgaaatgcttgatatcgcatatccaaaattttccttcccaaacagcaccagctggatatgtctgcccttcctgttctgcacctatatggccaccttcaagcattaaagatacaggttcgcgccttcacactaaactgaaagaagcgatagtccagactggattggagacaaatgtatttggaaatcattatgtgacaatagctaaagctgatactcggacacctgcttttgcatcagatcctctaaaaaatttatccagtactgatgatagagaatctaataatgcaaattcagctaaagatgcagctttgccatcaacattacattctggaatgtactcttctgctgtaggatctgggacaactattcatgttgaaccagaaattgttgaaatagagggtcctagtcctgtattgccccaaatttcagaacaggagtccaatttgataagaagtccgagcccacatgggcctggtgccatgacaagaaaaggtgctactactgttgacagacaaaattctgagatttcttattatgctgatgatgaagatggaaatcgcaaaaagtatactaaaaggggtacatttcgtcacaaatttctaaggatgctactgcctttctggtctagtgcactgccaacgctaccagtcacagcaccatcaaaaaaagatagtgatgctccagaggggagtcgaccacgccatcagagatcatcaagaatggaccccactaagatcttacttgcaatggctatcctggcatgtatactaacgatgggaatactctattaccggttgtcgcagcgaggtctttctgaaaacttccttgaggatgctcagtaa

SEQ ID NO: 6008 - protein, 358 aa, Sorghum bicolor
  misc_feature: Ceres ANNOT ID no. 6058053
  misc_feature (54)..(103): Pfam Id: zf-C3HC4 Pfam Desc: Zinc finger, C3HC4 type (RING finger)
  misc_feature (1)..(358): NCBI GI: 16323316 NCBI Desc: at2g14841/at2g14841 [arabidopsis thaliana]
  misc_feature (96)..(358): NCBI GI: 62642315 NCBI Desc: zinc finger family protein [picea abies]
  misc_feature (1)..(216): NCBI GI: 95769305 NCBI Desc: zinc finger protein-like 1 [bos taurus]
  misc_feature (1)..(180): NCBI GI: 4165025 NCBI Desc: zinc-finger protein mcg4 [homo sapiens]
  misc_feature (1)..(180): NCBI GI: 33300635 NCBI Desc: zinc finger protein-like 1 [homo sapiens]
MVVCKCRKATRVYCFVHQVPVCGVCICFPEHQLCVVKNYAEWVVNSEYDWPQHCSSCNSVLEGGTEETTRLGCLHVVHTKCLISHIQNFPSQTAPAGYVCPSCSAPIWPPSSIKDTGSRLHTKLKEAIVQTGLETNVFGNHYVTIAKADTRTPAFASDPLKNLSSTDDRESNNANSAKDAALPSTLHSGMYSSAVGSGTTIHVEPEIVEIEGPSPVLPQISEQESNLIRSPSPHGPGAMTRKGATTVDRQNSEISYYADDEDGNRKKYTKRGTFRHKFLRMLLPFWSSALPTLPVTAPSKKDSDAPEGSRPRHQRSSRMDPTKILLAMAILACILTMGILYYRLSQRGLSENFLEDAQ

SEQ ID NO: 6009 - DNA, 510 bp, Sorghum bicolor
  misc_feature: Ceres ANNOT ID no. 6058986
  misc_feature: Encodes the peptide sequence at SEQ ID NO 6010
atggccacgacgtcagcgcggacgcacggccaccagcagcaatacggtctgcggcaggacccgctgcgacgcatgcggggcctggatgccaagtcgtcgctccaggccagcccgcgcgcgaccacggtggccacggccgccctcctcgtcccgctgggtgccgcgctgctgggcgcctcggggctcgcgctggctgcgaccgtgaccggtctcgcggtcgtgacaccgctcctcgtgatcttgagcccggtgctcatacccttcgcgctggccgcggtgctcatcgcgtcggggctcctcgcgtcgggcgcgctcagcgtcgcaggcgtctcggcgctcacgtgggctatcgggtacgtctggcgatggcaaggcgaaggcgaaggcggggtgacagggatggtggtgcagccgctgaaccacgggttgaagcggcacggcgtggaaggcaccgctgcgttcgtggggcaccggcccctgccccgggacatcgatgttgctagtgcatga

SEQ ID NO: 6010 - protein, 169 aa, Sorghum bicolor
  misc_feature: Ceres ANNOT ID no. 6058986
  misc_feature (39)..(159): Pfam Id: Oleosin Pfam Desc: Oleosin
  misc_feature (20)..(158): NCBI GI: 115468060 NCBI Desc: os06g0473800 [oryza sativa (japonica cultivar-group)]
  misc_feature (6)..(147): NCBI GI: 9858857 NCBI Desc: seed oleosin isoform 1 [fagopyrum esculentum]
  misc_feature (11)..(114): NCBI GI: 963062 NCBI Desc: high molecular weight oleosin [hordeum vulgare subsp. vulgare]
  misc_feature (31)..(125): NCBI GI: 2145023 NCBI Desc: 15.5 kda oleosin [sesamum indicum]
  misc_feature (34)..(120): NCBI GI: 5381321 NCBI Desc: 15 kda oleosin [sesamum indicum]
MATTSARTHGHQQQYGLRQDPLRRMRGLDAKSSLQASPRATTVATAALLVPLGAALLGASGLALAATVTGLAVVTPLLVILSPVLIPFALAAVLIASGLLASGALSVAGVSALTWAIGYVWRWQGEGEGGVTGMVVQPLNHGLKRHGVEGTAAFVGHRPLPRDIDVASA

SEQ ID NO: 6011 - DNA, 861 bp, Sorghum bicolor
  misc_feature: Ceres ANNOT ID no. 6059525
  misc_feature: Encodes the peptide sequence at SEQ ID NO 6012
atggcgttttcaattttgaagaaactcgtcaaccttttgatactatttgtatttgccaaaagttggacaggagatcctgggtacggcttcggtagctacggctacggctacggctacggctatggcaccggcgccggcgccggcggctacgactacgacatggccggctacggtggcggaggcgcctactactcggcgaacgaccggtaccctgccgcgccggctgcctatgaggacccgctcgctggtcggaggcaggacgacttccccgctccgctcacggggctggagtttcagccgtcggacacctgccccaagaactacgtcatcttcgaccagacgtacgaccggagccgggtcatgttccacccctcgctggccaacaacttcggctcctctgctggcggatacgactacgatcgccattgctacggttacgagcagaattacgccggtaagagcgcctactacggctgcggcgacgatggcggcggggcctccatccggcagaaagaggacaccgacgagatcgacgcgctcatgagcacggaggacggtgaggacgaggacgacgtgctgagcacgggccgaactcctgggtgccgtgccggtggctccccggattctacatgctcgtccgggtacgccgccactggcggtggcggtgcgaagcacgagatgggcggctgtggcggcgaaaagaagaaggaacggatgaaaaagatggtgcggacgctcaaggggatcatccctggtggcgaccggatggacacgccagccgtcctcgatgaggccgtgaggtacctcaagtctctcaaggtggaggtcaagaagctcggtgcgcgcgggtcaagcagctag

SEQ ID NO: 6012 - protein, 286 aa, Sorghum bicolor
  misc_feature: Ceres ANNOT ID no. 6059525
  misc_feature (92)..(280): NCBI GI: 92889982 NCBI Desc: helix-loop-helix dna-binding [medicago truncatula]
  misc_feature (9)..(62): NCBI GI: 114153098 NCBI Desc: ggy domain protein [argas monolakensis]
  misc_feature (22)..(71): NCBI GI: 1345540 NCBI Desc: glycine-rich protein [lycopersicon esculentum]
  misc_feature (27)..(71): NCBI GI: 1345533 NCBI Desc: glycine-rich protein [lycopersicon esculentum]
  misc_feature (22)..(71): NCBI GI: 19236 NCBI Desc: glycine-rich protein [lycopersicon esculentum]
  misc_feature: Useful for making plants with altered cell wall content and/or composition
  misc_feature: GREAT-hit functional homolog of the protein sequence encoded by LOCUS at1g29950
  misc_feature: Useful for making plants with altered carbohydrate content
  misc_feature: Functional homolog of the protein sequence given in SEQ ID NO 13941
MAFSILKKLVNLLILFVFAKSWTGDPGYGFGSYGYGYGYGYGTGAGAGGYDYDMAGYGGGGAYYSANDRYPAAPAAYEDPLAGRRQDDFPAPLTGLEFQPSDTCPKNYVIFDQTYDRSRVMFHPSLANNFGSSAGGYDYDRHCYGYEQNYAGKSAYYGCGDDGGGASIRQKEDTDEIDALMSTEDGEDEDDVLSTGRTPGCRAGGSPDSTCSSGYAATGGGGAKHEMGGCGGEKKKERMKKMVRTLKGIIPGGDRMDTPAVLDEAVRYLKSLKVEVKKLGARGSSS

SEQ ID NO: 6013 - DNA, 735 bp, Sorghum bicolor
  misc_feature: Ceres ANNOT ID no. 6059646
  misc_feature: Encodes the peptide sequence at SEQ ID NO 6014
atggcgccgccacaggaacaggactacatcgggttgtctccagcggcggcggcggccacggagctgcgcttggggcttccgggcacggaggaagcggacggcggtgaggctgcggcggggacgccgctcacgctggagctactgccgaagggcggggccaagcgcgggttcacggacgccatcgtgcggcgggaggcggcggcaaggggcaaggcgccggcagaggacgaagaggtggacaagaagaagacgcaggcgccggcggctaaggcacaggtggtaggatggccaccaatccggagttacagaaagaacactatggcaatgaaccagcccactctgaaaaccaaagacgatggtgaggctaagcaggcactagtacaggattgcctctatgtcaaggttagcatggatggtgcgccatacctcaggaaggtggaccttaagatgtacaaaaactacaaggatctctcgttggcactggagaagatgttcagctgctttactgttggccatagtgaatctaatgggaaatcgggaagagaaggactatctgattgccgactgatggatcataaaaatggcactgagcttgttctcacgtacaaggacaaagatggagattggatgcttgttggtgatgttccatggagctgtaggaggctcaggatcatgaaggggtcagatgcagtgggccttgctcctagagtctctgacaagagcaagaatggttaa

SEQ ID NO: 6014 - protein, 244 aa, Sorghum bicolor
  misc_feature: Ceres ANNOT ID no. 6059646
  misc_feature (19)..(237): Pfam Id: AUX_IAA Pfam Desc: AUX/IAA family
  misc_feature (1)..(243): NCBI GI: 75252766 NCBI Desc: auxin-responsive protein iaa21 (indoleacetic acid-induced protein 21)
  misc_feature (20)..(243): NCBI GI: 75251160 NCBI Desc: auxin-responsive protein iaa3 (indoleacetic acid-induced protein 3)
  misc_feature (86)..(243): NCBI GI: 92872146 NCBI Desc: aux/iaa protein [medicago truncatula]
  misc_feature (20)..(243): NCBI GI: 75226278 NCBI Desc: auxin-responsive protein iaa17 (indoleacetic acid-induced protein 17)
  misc_feature (87)..(243): NCBI GI: 20257219 NCBI Desc: auxin-regulated protein [zinnia elegans]
  misc_feature: The sequence is a functional homolog of SEQ ID NO 1149 in the 10/412,699US patent application
  misc_feature: The sequence is a functional homolog of SEQ ID NO 736 in the 10/374,780US patent application
  misc_feature: The sequence is a functional homolog of SEQ ID NO 737 in the 10/374,780US patent application
  misc_feature: The sequence is a functional homolog of SEQ ID NO 738 in the 10/374,780US patent application
  misc_feature: The sequence is a functional homolog of SEQ ID NO 739 in the 10/374,780US patent application
  misc_feature: The sequence is a functional homolog of SEQ ID NO 742 in the 10/374,780US patent application
  misc_feature: The sequence is a functional homolog of SEQ ID NO 890 in the 10/412,699US patent application
  misc_feature: Useful for making plants with modulated growth and phenotype characteristics
  misc_feature: The sequence is a functional homolog of SEQ ID NO 1149 in the 20040045049 US patent application
  misc_feature: The sequence is a functional homolog of SEQ ID NO 890 in the 20040045049 US patent application
  misc_feature: The sequence is a functional homolog of SEQ ID NO 736 in the 20060162006 US patent application
  misc_feature: The sequence is a functional homolog of SEQ ID NO 737 in the 20060162006 US patent application
  misc_feature: The sequence is a functional homolog of SEQ ID NO 738 in the 20060162006 US patent application
  misc_feature: The sequence is a functional homolog of SEQ ID NO 739 in the 20060162006 US patent application
  misc_feature: The sequence is a functional homolog of SEQ ID NO 890 in the 10/412,699 US patent application
  misc_feature: Useful for making plants with altered alkaloid content
  misc_feature: Functional homolog of the protein sequence given in SEQ ID NO 13611
  misc_feature: Useful for making plants with altered terpenoid content
  misc_feature: Functional homolog of the protein sequence given in SEQ ID NO 13610
  misc_feature: The sequence is a functional homolog of SEQ ID NO 2002 in the 10/374,780 US patent application
  misc_feature: The sequence is a functional homolog of SEQ ID NO 644 in the 11/479,226 US patent application
  misc_feature: The sequence is a functional homolog of SEQ ID NO 652 in the 11/479,226 US patent application
  misc_feature: The sequence is a functional homolog of SEQ ID NO 636 in the 11/479,226 US patent application
  misc_feature: The sequence is a functional homolog of SEQ ID NO 738 in the 10/374,780 US patent application
  misc_feature: The sequence is a functional homolog of SEQ ID NO 648 in the 11/479,226 US patent application
  misc_feature: The sequence is a functional homolog of SEQ ID NO 656 in the 11/479,226 US patent application
  misc_feature: The sequence is a functional homolog of SEQ ID NO 736 in the 10/374,780 US patent application
MAPPQEQDYIGLSPAAAAATELRLGLPGTEEADGGEAAAGTPLTLELLPKGGAKRGFTDAIVRREAAARGKAPAEDEEVDKKKTQAPAAKAQVVGWPPIRSYRKNTMAMNQPTLKTKDDGEAKQALVQDCLYVKVSMDGAPYLRKVDLKMYKNYKDLSLALEKMFSCFTVGHSESNGKSGREGLSDCRLMDHKNGTELVLTYKDKDGDWMLVGDVPWSCRRLRIMKGSDAVGLAPRVSDKSKNG

SEQ ID NO: 6015 - DNA, 2028 bp, Sorghum bicolor
  misc_feature: Ceres ANNOT ID no. 6059704
  misc_feature: Encodes the peptide sequence at SEQ ID NO 6016
atgccgcagtcggtgctggtggagcgcgcgacgagcgagtcgctcatcggccccgactggtctctcaaccttgagatctgcgacatcctcaaccacgacccctcgcaagccaaagatgtagtgaagactatcaagaaacggattgggcacaagaactcgaaggtccagcttcttgcattaacgttgctggagaccttgattaaaaactgtggtgattttgttcatatgcaagttgctgagaaggatatacttcatgaaatggtgaagatagctaagaagaagcctgactatcacgtcaaagagaagatactaattctgatagacacttggcaagaagcttttggtggtgcccgtgcaagatatccccagtattacgcagcatatcaagagatgctgcgtgctggtgctgtatttcctcaaaggccggagagtaccgtgccaatctatactcctccacagacacagcctctaaggaactatccgccttctgcattgcgtaacactgattatcgacaagatgtgcctgaatcctcttctgcaccagaagtgcctgcattaagcttgacagaaattcagaatgcacgtggggtcatggatgttcttgcagagatgttaaatgctattgatcctggtaacagagagggtctaaggcaggaggttattgtggaccttgtggaccaatgccgttcatataagcaaagagtggtgcaacttgtcaattcaacgtcggacgaggacctattaagtcagggcctttcattgaatgatgatttacagcgtgttttagcaaaacacgatgcaattgctgctggcatagccgttcgagtagaaaaaccgaaatcagtcccggcccgcgcagacagttcaccaacgaagcccgagccgacaaaggaggcagaccaaaggtctgctaaagttgccagtagtgtgactccatttgagcagttagcacttcctgcaccaccatcatcaagtgcttcaaagtctcatggagaatcagctgttaccccaaatattgacttacttagcggtgatgagttcttcaaaccagaacctgttcattcccaagctcttgttcctttagtgactcagcctgcagcttcagcttcttcaagccccagtactttagaccttttagacatgttttcagatagcaatgctatcaataacaccagccagaaccctaccataccttctgtatctaacacaaatcctaatccatcagtacaagcctatccttctccacagcaacctgttccaccacaccatccttcaccatatgctaatgggttaaattcagatacaatgacaccctatgatcaaggctctaacttaacctcagcaagttcatggaatggacagtttgcccatggaatgattccaccacagcaggcactgaattatggtcaagttgaacaaagcaacgaccttccaccaccaccctgggaagctctgcctgcagaaactgagcaattagaagccgaccatcctggtgggttgtcagctgtgccacaatttggagttactcaaccccagccagtccaaattacacatcctgggcagcaactgttaccatcgcaactaatgccaagtggacaaccaggagggcagttccagcctagacttggggctcaacaaccatatgctacacaaaatacacagtatggaggaatgtatccgccagtgcaaggcaaccaaccagcaggtatttatccccagcaaatggctggagatgtctaccagcaacagatgtttagtggccagatgacaggctatggctatggtcagcagcctggaggctactacgttccgaacgccgcatatgcatatgccagtgcaaatgatctttctcagaggatgaatggtctctcgatgcaagacaacagtctgtatggcacacccgcgccgtcttccctccagcagcgtaacaggccaagtagacctgaagattcgctctttagtgatcttgttagcattgccaaaacaaagcctagtaaatctgcgtccaacaaggctggtaacttgtaa

SEQ ID NO: 6016 - protein, 675 aa, Sorghum bicolor
  misc_feature: Ceres ANNOT ID no. 6059704
  misc_feature (1)..(135): Pfam Id: VHS Pfam Desc: VHS domain
  misc_feature (181)..(279): Pfam Id: GAT Pfam Desc: GAT domain
  misc_feature (6)..(675): NCBI GI: 82791812 NCBI Desc: vhs and gat domain protein [glycine max]
  misc_feature (4)..(654): NCBI GI: 92887452 NCBI Desc: epsin, n-terminal; gat; enth/vhs [medicago truncatula]
  misc_feature (4)..(482): NCBI GI: 42567576 NCBI Desc: vhs domain-containing protein / gat domain-containing protein [arabidopsis thaliana]
  misc_feature (6)..(368): NCBI GI: 140065047 NCBI Desc: gat; enth/vhs [medicago truncatula]
  misc_feature (2)..(394): NCBI GI: 108879069 NCBI Desc: target of myb1 (tom1) [aedes aegypti]
MPQSVLVERATSESLIGPDWSLNLEICDILNHDPSQAKDVVKTIKKRIGHKNSKVQLLALTLLETLIKNCGDFVHMQVAEKDILHEMVKIAKKKPDYHVKEKILILIDTWQEAFGGARARYPQYYAAYQEMLRAGAVFPQRPESTVPIYTPPQTQPLRNYPPSALRNTDYRQDVPESSSAPEVPALSLTEIQNARGVMDVLAEMLNAIDPGNREGLRQEVIVDLVDQCRSYKQRVVQLVNSTSDEDLLSQGLSLNDDLQRVLAKHDAIAAGIAVRVEKPKSVPARADSSPTKPEPTKEADQRSAKVASSVTPFEQLALPAPPSSSASKSHGESAVTPNIDLLSGDEFFKPEPVHSQALVPLVTQPAASASSSPSTLDLLDMFSDSNAINNTSQNPTIPSVSNTNPNPSVQAYPSPQQPVPPHHPSPYANGLNSDTMTPYDQGSNLTSASSWNGQFAHGMIPPQQALNYGQVEQSNDLPPPPWEALPAETEQLEADHPGGLSAVPQFGVTQPQPVQITHPGQQLLPSQLMPSGQPGGQFQPRLGAQQPYATQNTQYGGMYPPVQGNQPAGIYPQQMAGDVYQQQMFSGQMTGYGYGQQPGGYYVPNAAYAYASANDLSQRMNGLSMQDNSLYGTPAPSSLQQRNRPSRPEDSLFSDLVSIAKTKPSKSASNKAGNL

SEQ ID NO: 6017 - DNA, 765 bp, Sorghum bicolor
  misc_feature: Ceres ANNOT ID no. 6059767
  misc_feature: Encodes the peptide sequence at SEQ ID NO 6018
atggccgatccggcggaggagaacgttgcctcgccgcctccgaccccggcggccccagccgagggcgtctcggacccgcccctgcagcctgctgctgacggcgcctcaacggagaaggtgtctgctccggcgccggaggtaaggtcccggggattcaggcttcttggagaggacaactccgtgcacaaggcccttgggggcgctgctgatgttctgttatggaaagacaagaaaacttctgctgttgtaatagggggtgcaactgtcatctgggttctgttcgaagtgcttgattaccatctcctgactctgatatcccatgcactgattggtgtgcttgccatcttattcctctggtccaaagctaccacctttatcaggaagagtccaccagatattccagtagtgcagatacctgaggatcttgttgtgaatgtttcacgagcattatgcaatgacatcaacagagcacttcacttattccatgagattgcaatggggcatgatctgaagaagtttttgtttgtgatcgtggggctgtgggttaactctgtatttggaagcagctgtgacttcctcaccttgatatacattgccgtcctgttgctccacacggtgccaatcttgtacgacaagtaccaggacaaggtggaccatttcgctggaagggcacacaccgaggccctcaagcagtacgaggtgctggatgccaaggtcctgagcaaaatccccaggggtccggtcaaatccaagaagcagaactag

SEQ ID NO: 6018 - protein, 254 aa, Sorghum bicolor
  misc_feature: Ceres ANNOT ID no. 6059767
  misc_feature (68)..(251): Pfam Id: Reticulon Pfam Desc: Reticulon
  misc_feature (57)..(252): NCBI GI: 78714222 NCBI Desc: reticulon [hordeum vulgare]
  misc_feature (22)..(252): NCBI GI: 20160502 NCBI Desc: osjnbb0021a09.5 [oryza sativa (japonica cultivar-group)]
  misc_feature (76)..(252): NCBI GI: 115435410 NCBI Desc: os01g0226300 [oryza sativa (japonica cultivar-group)]
  misc_feature (1)..(251): NCBI GI: 56381963 NCBI Desc: at3g61560 [arabidopsis thaliana]
  misc_feature (43)..(244): NCBI GI: 92874883 NCBI Desc: reticulon [medicago truncatula]
MADPAEENVASPPPTPAAPAEGVSDPPLQPAADGASTEKVSAPAPEVRSRGFRLLGEDNSVHKALGGAADVLLWKDKKTSAVVIGGATVIWVLFEVLDYHLLTLISHALIGVLAILFLWSKATTFIRKSPPDIPVVQIPEDLVVNVSRALCNDINRALHLFHEIAMGHDLKKFLFVIVGLWVNSVFGSSCDFLTLIYIAVLLLHTVPILYDKYQDKVDHFAGRAHTEALKQYEVLDAKVLSKIPRGPVKSKKQN

SEQ ID NO: 6019 - DNA, 1164 bp, Sorghum bicolor
  misc_feature: Ceres ANNOT ID no. 6059929
  misc_feature: Encodes the peptide sequence at SEQ ID NO 6020
atggcagcgccgccggcgccgggggagggggagctgacggaggtgctcatcggcgagatcatccaccgcttcccgccgaacaatccggcatgcctcttccgcgcttcagccgtttcccgggcgtggcgtgccttcgtcacctccgacgatgtcctccgccgctaccgcgagttccacggggcaccgccggttctgggcctcctgcagaaccgcgatcctgccgacgaaccagagcctcctgcacaagtgcagcctcgcttctatgccaccgctacccctcccccgccgatcaacctgcccaacatccagggcgactactcgctccttctcgactgccgccacggtcgcgtgctggtccataccatatttccccacggcctcatcgtctgtaaccccatcaccggcgagcagcaggtcctgcccgactatcatgtgtttcccttcagttgcttcggcggagcggtgctctgcgccgtcgacgactgcgaccacctcgactgccatgggggcgccttccgcgtggtcttcacgggcaccatcaacaccgacgctgaagcggacgaacacatcgacgaggtcttcacatcggcgatcctctactcttcggataccggattctggaccgcgccgacgacagtccaccccggccccctcatgaactccaacgacgtgatgggcccaagcctgctcgccggcgacgcggtgtacttcaccctggacctccagaacagccgcactgttctcaggtacgatttgggcggggcggccctgtctgtgatgaacgcgccaccgtcggtcaggactaggagggacacgttcctggtgacgggggaggacgaagggctggggtttgccgccgtggaggactaccgcctccgcctgtggtcgtggagcgaggctgtatgggcgccgtggagggacatcagcctggagacgatgatacccttgaccatcggagaccccaccaccgagctcaaggtgatcggcttcgcagagatgtctggtgtcatctttgtcatggcaaatggcatcgtttccgctctcgagttgatgtctggcgaaatcagcgaggtcagagagacgctcaactccagcactatctttcccttcgagagcttctatactccaggttcgagactactctgtgcttcactcatcacataa

SEQ ID NO: 6020 - protein, 387 aa, Sorghum bicolor
  misc_feature: Ceres ANNOT ID no. 6059929
  misc_feature (3)..(378): NCBI GI: 115470391 NCBI Desc: os07g0122900 [oryza sativa (japonica cultivar-group)]
  misc_feature (11)..(380): NCBI GI: 115437584 NCBI Desc: os01g0557400 [oryza sativa (japonica cultivar-group)]
  misc_feature (110)..(376): NCBI GI: 115475786 NCBI Desc: os08g0299900 [oryza sativa (japonica cultivar-group)]
  misc_feature (4)..(264): NCBI GI: 38567955 NCBI Desc: osjnbb0115i21.11 [oryza sativa (japonica cultivar-group)]
  misc_feature (25)..(376): NCBI GI: 115481210 NCBI Desc: os10g0158700 [oryza sativa (japonica cultivar-group)]
MAAPPAPGEGELTEVLIGEIIHRFPPNNPACLFRASAVSRAWRAFVTSDDVLRRYREFHGAPPVLGLLQNRDPADEPEPPAQVQPRFYATATPPPPINLPNIQGDYSLLLDCRHGRVLVHTIFPHGLIVCNPITGEQQVLPDYHVFPFSCFGGAVLCAVDDCDHLDCHGGAFRVVFTGTINTDAEADEHIDEVFTSAILYSSDTGFWTAPTTVHPGPLMNSNDVMGPSLLAGDAVYFTLDLQNSRTVLRYDLGGAALSVMNAPPSVRTRRDTFLVTGEDEGLGFAAVEDYRLRLWSWSEAVWAPWRDISLETMIPLTIGDPTTELKVIGFAEMSGVIFVMANGIVSALELMSGEISEVRETLNSSTIFPFESFYTPGSRLLCASLIT

SEQ ID NO: 6021 - DNA, 312 bp, Sorghum bicolor
  misc_feature: Ceres ANNOT ID no. 6059980
  misc_feature: Encodes the peptide sequence at SEQ ID NO 6022
atgggttccctaggcccaagcaccattagcagcatgaacatggccaaggcagccagcgtcgttggtggtaagaccggcgttgttgctgtcgccgaccagcagaaagaagtcccccccaagacgatgaattgcagtagctacgccttccagatgccgctgcactacccgcggtacaagaaggcggactacgagagcatgccggagtggcgcgtcgactgcctgctccgcgagtacggcctccccgccgacggcgacctcgacagcaagagaaagttcgccatgggcgccttcctctggcccgaccagtactga

SEQ ID NO: 6022 - protein, 103 aa, Sorghum bicolor
  misc_feature: Ceres ANNOT ID no. 6059980
  misc_feature (1)..(103): NCBI GI: 115468306 NCBI Desc: os06g0523300 [oryza sativa (japonica cultivar-group)]
  misc_feature: Useful for making plants with modulated nitrogen use efficiency
  misc_feature: Functional homolog of the protein sequence given in SEQ ID NO 13496
  misc_feature: Useful for making plants with modulated nitrogen use efficiency
  misc_feature: Functional homolog of the protein sequence given in SEQ ID NO 13496
MGSLGPSTISSMNMAKAASVVGGKTGVVAVADQQKEVPPKTMNCSSYAFQMPLHYPRYKKADYESMPEWRVDCLLREYGLPADGDLDSKRKFAMGAFLWPDQY

SEQ ID NO: 6023 - DNA, 282 bp, Sorghum bicolor
  misc_feature: Ceres ANNOT ID no. 6059985
  misc_feature: Encodes the peptide sequence at SEQ ID NO 6024
atgggatccttgggccctaccgtgagcttgagcatcatggccaagcccagcggcggccagcagccggagagggagaggaaggagggcggcggcgtcttcagcggcggctgcggcttccggatgccgctgcactacccgcgctacaagaaggcggactacgagagcatgccggagtggcgcgtcgactgcctgctccgtgagtacggcctccccgctgacggcgacctcgacagcaagcgccgcttcgccatgggagccttcctctggcccgaccagtactga

SEQ ID NO: 6024 - protein, 93 aa, Sorghum bicolor
  misc_feature: Ceres ANNOT ID no. 6059985
  misc_feature (1)..(93): NCBI GI: 115468306 NCBI Desc: os06g0523300 [oryza sativa (japonica cultivar-group)]
  misc_feature: Useful for making plants with modulated drought sensitivity
  misc_feature: Useful for making plants with modulated nitrogen use efficiency
  misc_feature: Useful for making plants with modulated seed size
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13495
  misc_feature: GREAT-hit functional homolog of the protein sequence given in SEQ ID NO 13496
  misc_feature: Useful for making plants with modulated nitrogen use efficiency
  misc_feature: Functional homolog of the protein sequence given in SEQ ID NO 13496
MGSLGPTVSLSIMAKPSGGQQPERERKEGGGVFSGGCGFRMPLHYPRYKKADYESMPEWRVDCLLREYGLPADGDLDSKRRFAMGAFLWPDQY

SEQ ID NO: 6025 - DNA, 969 bp, Sorghum bicolor
  misc_feature: Ceres ANNOT ID no. 6059986
  misc_feature: Encodes the peptide sequence at SEQ ID NO 6026
atgcagtggtacttggtggccgcgctcctcaccgtcctcaccagctcccagggaatattgaccaccctttcccagagcaatggcaaatataagtatgattatgccacaattccttttttagctgagctcttcaagttgtctgtctcaggcttcttcctctggaaggaatgccattcttcatctccaccaaggatgacaaaggaatggaggagtgtgcgactatatcttgttccttcagtcatatacctcatccacaacaatgtccagtttgcaacattgacttatgttgacccatctacctatcagataatgggaaacctgaaaattgttacaactgggattttgtttaggcttgttctaaaaaggaagttgtccaatctacaatggatggcaattgttttattggctgttggtacaactacaagccaggtgaaaggatgtggagatgcaccatgtgattctcttttctcagcaccattgcagggttacatgcttggaatactttctgcttgtctttccgctctagccggtgtgtacacagaatatttgatgaagaagaacaatgatagtttgtactggcaaaatgtacaattatatacgtttggagttatgttcaacatgggctggctaatttatggtgattttaaagctagatttgagctgggtccatggtggcagcgcctttttaatggttattcaatcacaacatggatggtagtgttcaatttaggatctactggtctgctagtatcatggttgatgaagtattctgacaatatagtcaaggtgtactcaacttcaatggcaatgcttttgacgatggttttatctatatatcttttcagtgtgaaagctacaattcagctcttcttgggcattatcatttgtataatttccctgcagatgtattttatgcctgtgcacatgcttgttgaattgccacaaacattgcctgtagcatcaaagtag

SEQ ID NO: 6026 - protein, 322 aa, Sorghum bicolor
  misc_feature: Ceres ANNOT ID no. 6059986
  misc_feature (67)..(296): Pfam Id: Nuc_sug_transp Pfam Desc: Nucleotide-sugar transporter
  misc_feature (17)..(316): NCBI GI: 10177360 NCBI Desc: cmp-sialic acid transporter-like protein [arabidopsis thaliana]
  misc_feature (4)..(161): NCBI GI: 54644280 NCBI Desc: ga12720-pa [drosophila pseudoobscura]
  misc_feature (4)..(161): NCBI GI: 24581845 NCBI Desc: cg14040-pa [drosophila melanogaster]
  misc_feature (12)..(307): NCBI GI: 140070518 NCBI Desc: nucleotide-sugar transporter [medicago truncatula]
  misc_feature (4)..(161): NCBI GI: 21064469 NCBI Desc: re36989p [drosophila melanogaster]
MQWYLVAALLTVLTSSQGILTTLSQSNGKYKYDYATIPFLAELFKLSVSGFFLWKECHSSSPPRMTKEWRSVRLYLVPSVIYLIHNNVQFATLTYVDPSTYQIMGNLKIVTTGILFRLVLKRKLSNLQWMAIVLLAVGTTTSQVKGCGDAPCDSLFSAPLQGYMLGILSACLSALAGVYTEYLMKKNNDSLYWQNVQLYTFGVMFNMGWLIYGDFKARFELGPWWQRLFNGYSITTWMVVFNLGSTGLLVSWLMKYSDNIVKVYSTSMAMLLTMVLSIYLFSVKATIQLFLGIIICIISLQMYFMPVHMLVELPQTLPVASK

SEQ ID NO: 6027 - DNA, 2604 bp, Sorghum bicolor
  misc_feature: Ceres ANNOT ID no. 6060177
  misc_feature: Encodes the peptide sequence at SEQ ID NO 6028
  misc_feature: Up-regulated in shoot tissues in response to salicylic acid treatment
atggccgccacgcccctccctgtcacctccccacctccaccacccctaccgcagccgcccaccgccgccactatccgctctctcactgccgcgggcaaccacgccgccgctctccacgcgctatcatccctgtcggcggcgtcctcctcccactcagccacgctcgaccgcttcgcgctcccgcccgccgccaagtccgccgccgcgctccgctccctcacagccgtccggtccattcacggcgccgcgctgcgccacgacctcctcgatgggcccaccccggccgtctccaacgcgctcctcaccgcctacgcgcgatgcggcgacctcaccgccgcgctcgcgctcttcgatgccatgcccagccgcgacgccgtcacattcaactccctcatcgccgcgctctgcctcttccgccgctggctcccggcactcgacgcgctccgcgacatgctcctggagggccacccgctcacctcattcacgcttgtcagcgtcctgctcgcgtgctcccacctcgctgaggacctgcgcctcggccgtgaggcgcacgcgttcgctctcaagaacgggttcctggacggcgacgaacgattcgcgttcaacgcgctgctctccatgtacgcgcgcctcggcctagtcgacgacgcgcagacgctcttcggctccgtcggcgccaccgacgtgccgggcggcggcgtcgtcacgtggaacaccatggtcagcctgctggtccagagcggccgctgcggcgaggccatcgaggtgctttacgacatggtcgcgcgcggggtgcgcccggacggcgtcacgttcgcgagcgcgctcccggcgtgctcgcagctggagatgctctccctcggccgggagatgcacgcctacgtcctcaaggacgccgacctcgccgccaactcgttcgtcgccagcgcgctcgtggacatgtacgccagccacgagcgggtgggtgcggcgaggctggtgttcgacatggtcccggccggcgagcgccagctcgggctgtggaacgccatgatctgcgggtatgcgcaggctggcttggacgaggacgcactggagctcttcgcgcggatggagaccgaggccggcgtcgtacccagcgagaccaccattgcgggcgtgctgccctcgtgcgcgcgctcggagaccttcgccggcaaggaagcggtgcacgggtacgtcgtgaagcgcggcatggcggacaacccgttcgtgcagaacgcgctcatggacctgtacgctcgcctcggcgacatggacgctgcgcggtggatcttcgccacgatcgagccccgcgacgtggtctcttggaacaccctcatcaccggctgcgtcgtgcagggccacatccgcgacgcgttccagctggtccgggagatgcagcagcaagggagattcactgatgccgcaacagaagacgggattgccggggcggatgaagagccggtggtgcccaacaacatcacactcatgaccctgctccctggctgcgcgatgcttgcggcgccagcgagggggaaggagatccacggctacgcggtgcgtcacgccttggactcggacgtcgccgtcgggagcgcgctggtggacatgtacgccaagtgcggctgcctggcgctgtcgagggccgtgttcgaccggctgccgaggaggaacgtcatcacctggaacgttctcatcatggcctacggcatgcatgggctcggtgacgaggccatcgcgctgttcgaccgcatggtggcgagcgacgaggctaagccgaacgaggtcaccttcatcgccgcactagcagcctgcagccactccggcatggtcgaccgcggcctggagatgttccgtagcatgaagaggaaccacggggtggagccaacgcctgaccttcacgcctgcgctgttgacattctcggtcgggctggcaggctggacgaggcctacaggatcatcagctcaatggagccaggagagcagcaggtgtccgcgtggagcagcttccttggagcatgccggctgcaccggaacgtcgctcttggcgagattgctgccgagcggctgttcgagctcgagcctgacgaggcgagccattacgtgctcctgtgcaacatttactccgccgccggcctatgggagaagtcatcagaggtgcggagcaggatgcggcagaggggcgtcagcaaggaacccggctgcagctggatcgaactcgacggcgtgatccacaggttcatggctggcgagtctgcgcacccagagagcacgctggtgcacgcgcacatggacgcactctgggagcggatgagagaccaggggtacacgccagacacgtcgtctgtgcttcacgacattgaggagagcgagaaggcggcgatcctccggtaccacagcgagaagctcgccattgccttcgggctgctgcggacgccaccgggcgccaccatcagggtggccaagaacctgagggtgtgcaacgactgccatgaggctgctaagttcatctccaggatggttgggagggatattgtgctgagggacgtgaggagatttcaccatttcgtggacggtgcctgctcctgtggggattactggtag

SEQ ID NO: 6028 - protein, 867 aa, Sorghum bicolor
  misc_feature: Ceres ANNOT ID no. 6060177
  misc_feature (126)..(160): Pfam Id: PPR Pfam Desc: PPR repeat
  misc_feature (235)..(269): Pfam Id: PPR Pfam Desc: PPR repeat
  misc_feature (339)..(373): Pfam Id: PPR Pfam Desc: PPR repeat
  misc_feature (441)..(475): Pfam Id: PPR Pfam Desc: PPR repeat
  misc_feature (560)..(594): Pfam Id: PPR Pfam Desc: PPR repeat
  misc_feature (2)..(867): NCBI GI: 38344863 NCBI Desc: osjnba0020p07.6 [oryza sativa (japonica cultivar-group)]
  misc_feature (2)..(867): NCBI GI: 116308873 NCBI Desc: h0613h07.7 [oryza sativa (indica cultivar-group)]
  misc_feature (96)..(867): NCBI GI: 30694644 NCBI Desc: pentatricopeptide (ppr) repeat-containing protein [arabidopsis thaliana]
  misc_feature (70)..(867): NCBI GI: 92876242 NCBI Desc: tetratricopeptide-like helical [medicago truncatula]
  misc_feature (491)..(867): NCBI GI: 53791352 NCBI Desc: pentatricopeptide (ppr) repeat-containing protein-like [oryza sativa (japonica cultivar-group)]
  misc_feature: Up-regulated in shoot tissues in response to salicylic acid treatment
MAATPLPVTSPPPPPLPQPPTAATIRSLTAAGNHAAALHALSSLSAASSSHSATLDRFALPPAAKSAAALRSLTAVRSIHGAALRHDLLDGPTPAVSNALLTAYARCGDLTAALALFDAMPSRDAVTFNSLIAALCLFRRWLPALDALRDMLLEGHPLTSFTLVSVLLACSHLAEDLRLGREAHAFALKNGFLDGDERFAFNALLSMYARLGLVDDAQTLFGSVGATDVPGGGVVTWNTMVSLLVQSGRCGEAIEVLYDMVARGVRPDGVTFASALPACSQLEMLSLGREMHAYVLKDADLAANSFVASALVDMYASHERVGAARLVFDMVPAGERQLGLWNAMICGYAQAGLDEDALELFARMETEAGVVPSETTIAGVLPSCARSETFAGKEAVHGYVVKRGMADNPFVQNALMDLYARLGDMDAARWIFATIEPRDVVSWNTLITGCVVQGHIRDAFQLVREMQQQGRFTDAATEDGIAGADEEPVVPNNITLMTLLPGCAMLAAPARGKEIHGYAVRHALDSDVAVGSALVDMYAKCGCLALSRAVFDRLPRRNVITWNVLIMAYGMHGLGDEAIALFDRMVASDEAKPNEVTFIAALAACSHSGMVDRGLEMFRSMKRNHGVEPTPDLHACAVDILGRAGRLDEAYRIISSMEPGEQQVSAWSSFLGACRLHRNVALGEIAAERLFELEPDEASHYVLLCNIYSAAGLWEKSSEVRSRMRQRGVSKEPGCSWIELDGVIHRFMAGESAHPESTLVHAHMDALWERMRDQGYTPDTSSVLHDIEESEKAAILRYHSEKLAIAFGLLRTPPGATIRVAKNLRVCNDCHEAAKFISRMVGRDIVLRDVRRFHHFVDGACSCGDYW

SEQ ID NO: 6029 - DNA, 282 bp, Sorghum bicolor
  misc_feature: Ceres ANNOT ID no. 6060349
  misc_feature: Encodes the peptide sequence at SEQ ID NO 6030
atgccgcggatccctctgatcaagttccccaagcggaatctgaaagccccatcggcgccagcgccgtcgcaacccgcagatcagcacgcgaccctcatgtcccggttgggggctaaagcagaggcaccatcttctggagggattaaaaattaccgctttaggtcagatgtaccttccccaccttctcatactgccgtaggaggtccagcttcactccttcctaagcgtaaacccctgactgaagaagaaattgaggctattatgttgggaggctccatctga

SEQ ID NO: 6030 - protein, 93 aa, Sorghum bicolor
  misc_feature: Ceres ANNOT ID no. 6060349
  misc_feature: Useful for making plants with modulated heat sensitivity
  misc_feature: GREAT-hit functional homolog of the protein sequence given in SEQ ID NO 12976
  misc_feature: Useful for making plants with modulated heat sensitivity
  misc_feature: Functional homolog of the protein sequence given in SEQ ID NO 12976
MPRIPLIKFPKRNLKAPSAPAPSQPADQHATLMSRLGAKAEAPSSGGIKNYRFRSDVPSPPSHTAVGGPASLLPKRKPLTEEEIEAIMLGGSI

SEQ ID NO: 6031 - DNA, 1125 bp, Sorghum bicolor
  misc_feature: Ceres ANNOT ID no. 6060422
  misc_feature: Encodes the peptide sequence at SEQ ID NO 6032
atgccgggagatgggggagcaactggaagggcgacgtgggtgtgcgcggttctcgcggcgttcccatttctagcggcggcggcggcggggaggtaccacgcggtgttcaatttcggggactcgctggtcgacgccggcaacctggtcacggagggcatcccggactacctcgccaccgcgcgcccgccctacggccagacctacttcggctaccccaccggcagatgctccgacggccgcctcgtcgtcgatttcatcgcgcaagagttcggcctcccgctgctgccgccgtccaaggccaagaacgccagcttcgcgcagggcgccaacttcgccatcaccggcgccaccgcgctcgacaccgacttcttccagaagcgggggctcggcaagaccgtctggaactccggctccctcttcacacaaatccagtggctgcgtgacctcaagccatcgctctgcagctccgcgcaagaatgcaaggagttcttcgccaagtgcctgtttatcgtaggtgaattcggtggaaatgactacaacgccccgctgttcgccggcaaggacctcaaggaggcatacaaactgatgccccatgtgattcagggcatctccgatggagttgaacaattggttaccgagggggcaaaggatttgattgtgcccggagtgatgccgtcggggtgctttccagtctacttgaccatgtacactgacccaaaggaagggcatggctcgcgcaccggctgcctcaagcggttcaacacattctcttgggtgcacaatgcgatgctcaagcgcgcacttgagaagctccgagagaagcaccctggtgtgaggatcatctatggtgattacttcacgccaatcatccagttcatacttcagcccaagaaatttggattctacaaacaaccaccaagagcctgctgtggcgctcctgggaggggcccttacaacttcaatctaacagcaaagtgtggcgagcctggcgcttccgcatgtgctgatcctacaacgcactggagctgggatggtattcacttgacggaagccgcatatcgacaaattgccagaggttggcttcatggaccattcggagaccagcctattgtgcaatcgtcttga

SEQ ID NO: 6032 - protein, 374 aa, Sorghum bicolor
  misc_feature: Ceres ANNOT ID no. 6060422
  misc_feature (35)..(360): Pfam Id: Lipase_GDSL Pfam Desc: GDSL-like Lipase/Acylhydrolase
  misc_feature (6)..(374): NCBI GI: 47497746 NCBI Desc: lipase-like [oryza sativa (japonica cultivar-group)]
  misc_feature (6)..(374): NCBI GI: 115445329 NCBI Desc: os02g0250400 [oryza sativa (japonica cultivar-group)]
  misc_feature (17)..(371): NCBI GI: 115435284 NCBI Desc: os01g0216500 [oryza sativa (japonica cultivar-group)]
  misc_feature (11)..(365): NCBI GI: 115435276 NCBI Desc: os01g0215700 [oryza sativa (japonica cultivar-group)]
  misc_feature (25)..(362): NCBI GI: 48958181 NCBI Desc: esterase [alopecurus myosuroides]
MPGDGGATGRATWVCAVLAAFPFLAAAAAGRYHAVFNFGDSLVDAGNLVTEGIPDYLATARPPYGQTYFGYPTGRCSDGRLVVDFIAQEFGLPLLPPSKAKNASFAQGANFAITGATALDTDFFQKRGLGKTVWNSGSLFTQIQWLRDLKPSLCSSAQECKEFFAKCLFIVGEFGGNDYNAPLFAGKDLKEAYKLMPHVIQGISDGVEQLVTEGAKDLIVPGVMPSGCFPVYLTMYTDPKEGHGSRTGCLKRFNTFSWVHNAMLKRALEKLREKHPGVRIIYGDYFTPIIQFILQPKKFGFYKQPPRACCGAPGRGPYNFNLTAKCGEPGASACADPTTHWSWDGIHLTEAAYRQIARGWLHGPFGDQPIVQSS

SEQ ID NO: 6033 - DNA, 1200 bp, Sorghum bicolor
  misc_feature: Ceres ANNOT ID no. 6060424
  misc_feature: Encodes the peptide sequence at SEQ ID NO 6034
atgcgcgtcggtccgggaagctgcctgctgctgccgacaaccgcaaccacaatggccgtcgcccacgcgccgcagcgccgccggggcgtgctcctcctcgtgctcgtcgccgcgctcgtggcggcgctgccggccacctgcgccgcggccaggagcaagagcaagaagtcgtacacggccatcttcagcttcggggactcgctctccgacgccggcaacctcatcgtcaacggcacgcccaaggcgctcaccaccgcgcgcccgccctacgggatgaccttcttccgcaagcccaccggccgctgctccaacggccgcctcgtcgtcgacttcctcgccgagcatttcgggctaccgctgccacagccgtcacaggccaagggcaaggacttcaagaagggcgccaacttcgccatcaccggcgcgacggcgctggagtactccttcttcaaggcacacggcatcgaccagcgcatctggaacaccggctccatcaacacccagatcggctggctccaggacatgaagccgtctctctgcaaatcggaccaagactgcaaggattacttcagcaagtccctgtttgtggtcggggagtttgggggcaatgactacaatgcgcctctgttttctggtgtcaaattttctgaaatcaagacttatgtgccccttgttacaaaggccatcgccaacggcgttgagaaattgatcgagcttggggcaacagacttattggtgccgggcgttctcccaattggttgctttccattgtacctgacgttgtacaacaccagcagcaaatcagactacaacgcccgcaccggatgccttcggaggtacaaccgcctcgccttccaccacaacagggagctgaagcagcagcttgatgagcttcagaagaagtaccccaagacaaaaatcatgtatggggattacttcaaggctgcaatgcagtttgtcgtctaccctggaaaatttggtttcagcacggctttgcaagcatgctgcggcgcaggagggcagggcaactacaacttcaacctgaagaagaagtgtggcgagcagggcgcaagcgtgtgctccaacccgtcgtcgtatgtgagctgggacggcatccacatgactgaagctgcatacaagaaggtcgccgatggctggttgaatggcccgtatgctgaacctccgattctcaagtcataa

SEQ ID NO: 6034 - protein, 399 aa, Sorghum bicolor
  misc_feature: Ceres ANNOT ID no. 6060424
  misc_feature (61)..(386): Pfam Id: Lipase_GDSL Pfam Desc: GDSL-like Lipase/Acylhydrolase
  misc_feature (28)..(399): NCBI GI: 47497746 NCBI Desc: lipase-like [oryza sativa (japonica cultivar-group)]
  misc_feature (28)..(399): NCBI GI: 115445329 NCBI Desc: os02g0250400 [oryza sativa (japonica cultivar-group)]
  misc_feature (18)..(397): NCBI GI: 115435276 NCBI Desc: os01g0215700 [oryza sativa (japonica cultivar-group)]
  misc_feature (99)..(399): NCBI GI: 115466518 NCBI Desc: os06g0157000 [oryza sativa (japonica cultivar-group)]
  misc_feature (38)..(397): NCBI GI: 115435284 NCBI Desc: os01g0216500 [oryza sativa (japonica cultivar-group)]
MRVGPGSCLLLPTTATTMAVAHAPQRRRGVLLLVLVAALVAALPATCAAARSKSKKSYTAIFSFGDSLSDAGNLIVNGTPKALTTARPPYGMTFFRKPTGRCSNGRLVVDFLAEHFGLPLPQPSQAKGKDFKKGANFAITGATALEYSFFKAHGIDQRIWNTGSINTQIGWLQDMKPSLCKSDQDCKDYFSKSLFVVGEFGGNDYNAPLFSGVKFSEIKTYVPLVTKAIANGVEKLIELGATDLLVPGVLPIGCFPLYLTLYNTSSKSDYNARTGCLRRYNRLAFHHNRELKQQLDELQKKYPKTKIMYGDYFKAAMQFVVYPGKFGFSTALQACCGAGGQGNYNFNLKKKCGEQGASVCSNPSSYVSWDGIHMTEAAYKKVADGWLNGPYAEPPILKS

SEQ ID NO: 6035 - DNA, 2286 bp, Sorghum bicolor
  misc_feature: Ceres ANNOT ID no. 6060707
  misc_feature: Encodes the peptide sequence at SEQ ID NO 6036
atgaaccgtggcggcgatcgctcgggtggcccctccagcggcggagaccgctctggtgcccggttccagcggggtccctcccgctggtccggcagcggcggcggcggattagggggtagcccgccctatcgctactcctcccgcggcgcggcagatggaggtggtggagggggcggtggcggtggcggtggcggtggcgggaggttccacccctatcggggttcttccgactattctagcggcggtggaggctacagaggcggtggtggcggcgggaacgactccggcgagcagaggcaacgatatggcggcggcaacagaggcggaggccgtggggatttccaagatcatgatagtagaagtaactatgtcaaactttttgtcggatctgttccaaggacagcaactgaagaagatgttcggcctttatttgaggagcatggagatgttcttgaagttgctttaattaaggataggaagaccggtgaacaacaaggttgttgttttgttaaatatgctacttctgaagaggcagagagggccatcaggggtctgcacaatcagtacactttacctggagcgatgggccctattcaagttagatatgctgatggtgaaagggaacggcatgtttctgtgacaaatttgctaggggccatcgagcacaaattatttgttgcatccctcaataagcaagcaactccaaaggagattgaagagatatttgccccatatggtcatgttgaagatgtttacattatgagagatggcatgaggcagagcagaggctgtggatttgtcaaattctcatcaaaagagacagcagtggaagcaatgaatgcccttaatgggacttacataatgagggggtgcgagcaaccattagtcattagatttgctgatcctaagaggcctagacctggagaatcgaggggtggccctgcatttggaggtcctggtttcagtcctcgatcggatgcagcacttgttatcaggccaacagccaatcttgatgaatcaaggggccggcatatgcctccagaatcttggcgtccatcaagtccaaggtcaatggcacctaaccaatataataattttggatctgacaatcccttggcactaagttgtggcactgtaacatcagcagataataatgctgcttttcggcctccaatgttccctggaaatggttccttgtcaaatcagacggctgtgcctacttcgtcacacatgggcatgaacacttccattgtacaaggacaccatataggaggccaacagatcccacccttgcaaaagccacctggtccaccacagaatttccctgtacaactgcagaatgctcagccaggacagcctctgcaggggcctattccacagattgggcaacttcaggtcccacaatccgcgggacctgtttcatttggccagaatatttcatctatgcaattacctggccaacctcctgcgtcacagccattgatgcaacagaatgcttctctaggtgctttacaggcccctccatctgtacagtccaattcaatgcaagctgttcctggccagcagcaacttcccaccagtgtcgctccccaagtgctccagcagtcgatgcagcagatgccttcacaagcaccacagttgctgcttcaacagcaggcagctttgcagtctagttatcaatcttcacagcaggcgatttatcagcttcagcaacagctacaactaatgcagcagcagtctaacctaaatcagcaaccctctgcacaggttcctaaacagcagtctgggcagccagtgcagtctagtaaccctagtgctccaggtgccattattccgataaatattaatgcaactccgcagcaggttggttcacctgcagtttctttaacctgtaactggacagagcatacctcccctgaaggttttaactactactacaatagcattactcgtgagagtaagtgggagaagcctgaagagtatgtgctgtatgagcagcagcagcagcagcagcagcagcagcagcagcagcagcagcagaaactgcttttgcttcaacagcaccaacaaaagattgctgtgcagcaactgcagtcaccgccacagggtcaatcacttatatccatgcaaccgattcaacagcttccccaggcacaaggacaaacacaaatgcatatgaaacagcaggaattaaattattcccaatttcaggcagctggttccattgatcccaacaggattcaacagggcattcaagctgggcaagaacgtgcttggaaaagttaa

SEQ ID NO: 6036 - protein, 761 aa, Sorghum bicolor
  misc_feature: Ceres ANNOT ID no. 6060707
  misc_feature (126)..(198): Pfam Id: RRM_1 Pfam Desc: RNA recognition motif. (a.k.a. RRM, RBD, or RNP domain)
  misc_feature (224)..(295): Pfam Id: RRM_1 Pfam Desc: RNA recognition motif. (a.k.a. RRM, RBD, or RNP domain)
  misc_feature (629)..(658): Pfam Id: WW Pfam Desc: WW domain
  misc_feature (1)..(761): NCBI GI: 58003966 NCBI Desc: fca [oryza sativa (japonica cultivar-group)]
  misc_feature (1)..(761): NCBI GI: 33390912 NCBI Desc: flowering time control protein isoform rfca-1 [oryza sativa (indica cultivar-group)]
  misc_feature (1)..(761): NCBI GI: 32482144 NCBI Desc: fca-a2 [triticum aestivum]
  misc_feature (6)..(761): NCBI GI: 32482114 NCBI Desc: fca protein [triticum aestivum]
  misc_feature (6)..(761): NCBI GI: 32482140 NCBI Desc: fca protein [triticum aestivum]
  misc_feature: Useful for making plants with altered terpenoid content
  misc_feature: Useful for making plants with modulated flowering time
  misc_feature: Functional homolog of the protein sequence given in SEQ ID NO 13083
  misc_feature: GREAT-hit functional homolog of the protein sequence given in SEQ ID NO 13384
  misc_feature: The sequence is a functional homolog of SEQ ID NO. 339 in the 11/188,298 US application
  misc_feature: The sequence is a functional homolog of SEQ ID NO. 458 in the 11/188,298 US application
MNRGGDRSGGPSSGGDRSGARFQRGPSRWSGSGGGGLGGSPPYRYSSRGAADGGGGGGGGGGGGGGGRFHPYRGSSDYSSGGGGYRGGGGGGNDSGEQRQRYGGGNRGGGRGDFQDHDSRSNYVKLFVGSVPRTATEEDVRPLFEEHGDVLEVALIKDRKTGEQQGCCFVKYATSEEAERAIRGLHNQYTLPGAMGPIQVRYADGERERHVSVTNLLGAIEHKLFVASLNKQATPKEIEEIFAPYGHVEDVYIMRDGMRQSRGCGFVKFSSKETAVEAMNALNGTYIMRGCEQPLVIRFADPKRPRPGESRGGPAFGGPGFSPRSDAALVIRPTANLDESRGRHMPPESWRPSSPRSMAPNQYNNFGSDNPLALSCGTVTSADNNAAFRPPMFPGNGSLSNQTAVPTSSHMGMNTSIVQGHHIGGQQIPPLQKPPGPPQNFPVQLQNAQPGQPLQGPIPQIGQLQVPQSAGPVSFGQNISSMQLPGQPPASQPLMQQNASLGALQAPPSVQSNSMQAVPGQQQLPTSVAPQVLQQSMQQMPSQAPQLLLQQQAALQSSYQSSQQAIYQLQQQLQLMQQQSNLNQQPSAQVPKQQSGQPVQSSNPSAPGAIIPININATPQQVGSPAVSLTCNWTEHTSPEGFNYYYNSITRESKWEKPEEYVLYEQQQQQQQQQQQQQQQKLLLLQQHQQKIAVQQLQSPPQGQSLISMQPIQQLPQAQGQTQMHMKQQELNYSQFQAAGSIDPNRIQQGIQAGQERAWKS

SEQ ID NO: 6037 - DNA, 987 bp, Sorghum bicolor
  misc_feature: Ceres ANNOT ID no. 6060890
  misc_feature: Encodes the peptide sequence at SEQ ID NO 6038
atggaccgccctgtcggcgcatcgtaccagcgcttcccccgcgttcggatccgcgacctcaaggacgactacgccaagttcgagctccgcgacaccgacgccagcatggccaacgccctccgccgcgtcatgatcgccgaggtcccaaccgtcgccatcgatctcgtcgagatcgaggttaactcctccgtcctcaacgacgagttcatcgcccaccgcctggggctcatcccgctcacctccgccgccgccatgcaaatgcgcttctctcgggactgcgacgcttgcgacggcgacggctcctgcgagtactgctccgtcgagtttcacctcgccgcgcgcgccaccgactccgaccagacgctcgaggtcacatccaacgacctgaggtccatggatcctaaggtctgcccagtcgaccaagcacgcgcctaccagcaggcgctcggtggcaccgacccctttggagccaatacctcaaacgaaaataggggcatacttattgtaaagctgcgtcgggggcaagaactaaggcttcgtgccattgctaggaaaggaattggcaaggaccatgccaaatggtcaccagctgctaccgtgactttcatgtatgagcctgacatacgtatcaatgaagaactaatggaaacattgacagtggaagagagaagaaggttgattgaaagcagccctacaaaagtatttaagcttgattctgctaatcaggtggtggtggacaatgctgaggcatacacctatgatgatgaggtgatcaagcacgctgaggccttgggaaagccaggcttagttgaaatcaacgcgaaggaggacagcttcatcttcactgtagaaacaactggcgccatcacggcctacgagctgatcatgaacgcaatcacggtcctgaggcagaagctggatgctgtccgcctccaggacgatgatggtgaccttggcgagctcggtgcccaccttggcgggccttag

SEQ ID NO: 6038 - protein, 328 aa, Sorghum bicolor
  misc_feature: Ceres ANNOT ID no. 6060890
  misc_feature (56)..(195): Pfam Id: RNA_pol_A_bac Pfam Desc: RNA polymerase Rpb3/RpoA insert domain
  misc_feature (19)..(311): Pfam Id: RNA_pol_L Pfam Desc: RNA polymerase Rpb3/Rpb11 dimerisation domain
  misc_feature (6)..(327): NCBI GI: 85719360 NCBI Desc: rna polymerase, dimerisation [medicago truncatula]
  misc_feature (6)..(327): NCBI GI: 21593370 NCBI Desc: dna-directed rna polymerase ii, third largest subunit [arabidopsis thaliana]
  misc_feature (6)..(325): NCBI GI: 514320 NCBI Desc: rna polymerase ii third largest subunit
  misc_feature (6)..(246): NCBI GI: 145328718 NCBI Desc: rbp36b (rna polymerase ii 36 kda polypeptide b) [arabidopsis thaliana]
  misc_feature (9)..(204): NCBI GI: 71535027 NCBI Desc: dna-directed rna polymerase ii third largest subunit [medicago sativa]
  misc_feature (6)..(327): SWISSPROT Homolog: EC 2.7.7.6 DNA-directed RNA polymerase II 36 kDa polypeptide A
MDRPVGASYQRFPRVRIRDLKDDYAKFELRDTDASMANALRRVMIAEVPTVAIDLVEIEVNSSVLNDEFIAHRLGLIPLTSAAAMQMRFSRDCDACDGDGSCEYCSVEFHLAARATDSDQTLEVTSNDLRSMDPKVCPVDQARAYQQALGGTDPFGANTSNENRGILIVKLRRGQELRLRAIARKGIGKDHAKWSPAATVTFMYEPDIRINEELMETLTVEERRRLIESSPTKVFKLDSANQVVVDNAEAYTYDDEVIKHAEALGKPGLVEINAKEDSFIFTVETTGAITAYELIMNAITVLRQKLDAVRLQDDDGDLGELGAHLGGP

SEQ ID NO: 6039 - DNA, 702 bp, Sorghum bicolor
  misc_feature: Ceres ANNOT ID no. 6062309
  misc_feature: Encodes the peptide sequence at SEQ ID NO 6040
atggctctccgtaccctggcatcgaagaaggccctatccttcgcgctcggcggcgcggcccggccgttggcggcgtccgcgaggggggtgacgacggtcacgctccccgacctctcctacgacttcggcgcgctggagccggccatctcgggggagatcatgcgcctgcaccaccagaagcaccacgccacctacgtcgccaactacaacaaggcgctggagcagctcgacgccgccgtcgccaagagcgacgcctccgctgtcgtccagctccagggcgccatcaagttcaacggcggcggtcatgtgaaccattcaatcttctggaagaacctcaagcctattagcgaaggtggtggggagccacctcatgggaaacttggctgggccattgatgaggattttggttcgtttgaagcacttgtaaagaagatgaatgcagaaggcgctgctttacagggatctggatgggtgtggttagctttggataaagaggcaaaaaagctttcagttgaaactacagctaatcaggatcctctggtgactaaagatgcaagcttggttccgctgttggggattgatgtctgggagcatgcatactacctgcagtacaagaatgttaggccggattacctgaacaacatctggaaggtgatgaactggaaatatgctggagaggtgtacgaaaatgttcttgcttga

SEQ ID NO: 6040 - protein, 233 aa, Sorghum bicolor
  misc_feature: Ceres ANNOT ID no. 6062309
  misc_feature (120)..(228): Pfam Id: Sod_Fe_C Pfam Desc: Iron/manganese superoxide dismutases, C-terminal domain
  misc_feature (32)..(113): Pfam Id: Sod_Fe_N Pfam Desc: Iron/manganese superoxide dismutases, alpha-hairpin domain
  misc_feature (1)..(233): NCBI GI: 7548002 NCBI Desc: mn-superoxide dismutase [zea mays]
  misc_feature (1)..(233): NCBI GI: 168624 NCBI Desc: manganese superoxide dismutase (sod-3) (ec 1.15.1.1)
  misc_feature (1)..(233): NCBI GI: 7548001 NCBI Desc: mn-superoxide dismutase [zea mays]
  misc_feature (1)..(233): NCBI GI: 7548000 NCBI Desc: mn-superoxide dismutase [zea mays]
  misc_feature (1)..(233): NCBI GI: 1654387 NCBI Desc: manganese superoxide dismutase [triticum aestivum]
  misc_feature (1)..(233): SWISSPROT Homolog: EC 1.15.1.1 Superoxide dismutase [Mn] 3.4, mitochondrial precursor
MALRTLASKKALSFALGGAARPLAASARGVTTVTLPDLSYDFGALEPAISGEIMRLHHQKHHATYVANYNKALEQLDAAVAKSDASAVVQLQGAIKFNGGGHVNHSIFWKNLKPISEGGGEPPHGKLGWAIDEDFGSFEALVKKMNAEGAALQGSGWVWLALDKEAKKLSVETTANQDPLVTKDASLVPLLGIDVWEHAYYLQYKNVRPDYLNNIWKVMNWKYAGEVYENVLA

SEQ ID NO: 6041 - DNA, 2973 bp, Sorghum bicolor
  misc_feature: Ceres ANNOT ID no. 6062837
  misc_feature: Encodes the peptide sequence at SEQ ID NO 6042
  misc_feature: Down-regulated in shoot tissues in response to salicylic acid treatment
atgctgcgtgcggcggcggctgccgccgccatcctcccggtgcggttcgccgccgcgccgaccgtggcggcggcggaggagctcaggtctccgctgctcagggtcattgggacgctgaggggcggccgcggctcggtgctgctgggaaggagggtgcgtttctgctccaactcctctgcgagcgactccgaggcggcggcggcggaggcgaaggccgaggatgcgaccgctgctgagggggaggcggacagcaaggcgtcttccgccatcgtgtcgaccaacaccaatctcgacgactgcctctcggttatagcgttacctcttccacatcggccactctttcctggattttacatgccgatgtatgtaaaggaccaaaagctgttgcaagccctaatagaaaatcgcaaaagatcagctccgtatgctggtgcctttcttgtgaaagatgaagaaggtactgaccctaacattgtgactggttcagattcagagaaaagcattgatgatctcaaagggaaagacttgctgaagcgtcttcatgaagttgggacgcttgctcagattacaagcattcaaggggatcaggtagttctatttggtcaccgacgtttacggataactgagatggtcgaagaggatccactcacagttaaagttgaccatctaaaggaaaatccctacaacaaggatgatgatgttatgaaagctacctcattcgaagttatatcaactttaagggatgtcctaaggacaagttccctttggaaggatcatgtgcaaacctaccaacagcacattggtgactttaactaccaacggttagcagacttcggtgctgctatctctggtgccaacaagttgcattgccaggaggtgcttgaggaattagatgtatacaagcgtttgaagttgactcttgagttaataaaaaaggagatggagattagtaagctacagcaagccatagcaaaagcaattgaagaaaagattagtggagatcagcgacgttatttgttgaatgagcaacttaaggcaatcaagaaggagctgggtttggagactgatgacaaaacggcattgtctgcaaaatttaaggaacgtatagaattaaagaaggacaaatgtcctcctcatgttttacaagtcattgaagaagagcttacaaagcttcagcttttagaagccagctctagtgagttcagtgtaactcgtaattatttggactggctgacagtattgccatggggaaattatagtgatgaaaacttcgatgtccaccatgctcagaaaattctcgatgaagaccattatggtttgaatgacgtgaaagagagaatactggaattcatagcagttgggaagttaagagggacttcacaaggcaagatcatatgtctttctgggccaccaggagttgggaaaaccagtattggtcgttcaattgcacgtgcactgaaccgccagttctacaggttttctgttggaggtttggctgatgtggctgaaatcaagggccatcgacgcacgtatgttggtgcaatgccagggaagatggtgcagtgtcttaaatcagttgggacagcaaatcctctagtattgatagatgagattgacaagcttgggaaggggcattctggcgatccagctagtgcattgttggaactcctcgatcctgagcagaatgttaatttcttagatcactaccttgatgttcctattgacctatccaaggttctgttcgtttgcacagcgaacgtaatagagatgataccaaatccgttactggataggatggagatcattgctatagctgggtatataactgatgaaaaggtgcatattgctcgagactatctagagaagaatacaagacaggcttgtggcataaagcctcaacaggttgaagttacagatgctgctcttcttgctctcattgaaaattactgccgagaagctggagtgaggaaccttcaaaagcagattgagaaaatttaccgtaagatagctctgcagcttgttcgccaaggggtgtcaaatgagccagaccaggagtctcccagtgtcactgtaagtgaggaatctagtagtggtgatagcaccacagcaaaagatgagattttgaaggatcctgctgtagaagatgcttcagtcgccaataatgttacaaatcctgcctctgaggaagctaatgaagtaaatttgacaactgaagcaccaaaagaagacaacacatctaagggcaacaaggacacatatggagcagcagaagatgcagcagacaaggcaattgaaaaggttgtggttgattcatcaaacctcggcgactttgttgggaaacctgtgttccaggctgagcgtatatatgagcagacacctgttggagtggtcatgggcttagcttggactgctatgggtggttctactttgtacatcgaaacaacaaaagtggaggagggggaagggaaaggtgcacttgtgctgacgggacagcttggagatgtcatgaaagagagtgctcagatagcgcacacagttggcagagctgtattactggagaaagagccagataatcagttctttgcaaactcgaagctgcacttgcatgttcctgcagggtccacccctaaggatggccctagtgctggatgcaccatgataacatctatgctgtccttagctatgggaatgcctgtcaagaaggaccttgcaatgacaggtgaagtaacattaactggaagaatcctcccaatcggcggggtaaaagagaaaacgattgcggcaaggagaagtgcgataaagacactcatatttccagcagcgaataaaagggactttgacgagcttgcttctaatgtgaaggaaggcctcgaagttcattttgttgacacatacggtgaaatatatgatttagcttttcagagtgacgcggggacagaaacaagcttagatgatttagctttacaggattga

SEQ ID NO: 6042 - protein, 990 aa, Sorghum bicolor
  misc_feature: Ceres ANNOT ID no. 6062837
  misc_feature (768)..(975): Pfam Id: Lon_C Pfam Desc: Lon protease (S16) C-terminal proteolytic domain
  misc_feature (464)..(659): Pfam Id: AAA Pfam Desc: ATPase family associated with various cellular activities(AAA)
  misc_feature (102)..(312): Pfam Id: LON Pfam Desc: ATP-dependent protease La (LON) domain
  misc_feature (22)..(982): NCBI GI: 1816588 NCBI Desc: lon2 [zea mays]
  misc_feature (22)..(769): NCBI GI: 79522090 NCBI Desc: lon_ara_ara; atp binding / atp-dependent peptidase/ nucleoside-triphosphatase/ nucleotide binding / serine-type endopeptidase/ serine-type peptidase [arabidopsis thaliana]
  misc_feature (22)..(769): NCBI GI: 1848291 NCBI Desc: lon protease homolog [arabidopsis thaliana]
  misc_feature (260)..(973): NCBI GI: 140065918 NCBI Desc: peptidase s16, lon protease [medicago truncatula]
  misc_feature (362)..(976): NCBI GI: 2191174 NCBI Desc: similar to the peptidase family s16 [arabidopsis thaliana]
  misc_feature: Down-regulated in shoot tissues in response to salicylic acid treatment
MLRAAAAAAAILPVRFAAAPTVAAAEELRSPLLRVIGTLRGGRGSVLLGRRVRFCSNSSASDSEAAAAEAKAEDATAAEGEADSKASSAIVSTNTNLDDCLSVIALPLPHRPLFPGFYMPMYVKDQKLLQALIENRKRSAPYAGAFLVKDEEGTDPNIVTGSDSEKSIDDLKGKDLLKRLHEVGTLAQITSIQGDQVVLFGHRRLRITEMVEEDPLTVKVDHLKENPYNKDDDVMKATSFEVISTLRDVLRTSSLWKDHVQTYQQHIGDFNYQRLADFGAAISGANKLHCQEVLEELDVYKRLKLTLELIKKEMEISKLQQAIAKAIEEKISGDQRRYLLNEQLKAIKKELGLETDDKTALSAKFKERIELKKDKCPPHVLQVIEEELTKLQLLEASSSEFSVTRNYLDWLTVLPWGNYSDENFDVHHAQKILDEDHYGLNDVKERILEFIAVGKLRGTSQGKIICLSGPPGVGKTSIGRSIARALNRQFYRFSVGGLADVAEIKGHRRTYVGAMPGKMVQCLKSVGTANPLVLIDEIDKLGKGHSGDPASALLELLDPEQNVNFLDHYLDVPIDLSKVLFVCTANVIEMIPNPLLDRMEIIAIAGYITDEKVHIARDYLEKNTRQACGIKPQQVEVTDAALLALIENYCREAGVRNLQKQIEKIYRKIALQLVRQGVSNEPDQESPSVTVSEESSSGDSTTAKDEILKDPAVEDASVANNVTNPASEEANEVNLTTEAPKEDNTSKGNKDTYGAAEDAADKAIEKVVVDSSNLGDFVGKPVFQAERIYEQTPVGVVMGLAWTAMGGSTLYIETTKVEEGEGKGALVLTGQLGDVMKESAQIAHTVGRAVLLEKEPDNQFFANSKLHLHVPAGSTPKDGPSAGCTMITSMLSLAMGMPVKKDLAMTGEVTLTGRILPIGGVKEKTIAARRSAIKTLIFPAANKRDFDELASNVKEGLEVHFVDTYGEIYDLAFQSDAGTETSLDDLALQD

SEQ ID NO: 6043 - DNA, 1332 bp, Sorghum bicolor
  misc_feature: Ceres ANNOT ID no. 6062961
  misc_feature: Encodes the peptide sequence at SEQ ID NO 6044
atggccgacggcgctacgcccaggcgcaaatccgtcccggactggctcaacaacccgatctggtccgcgcctcccccgtccccgcgccacagctcccctccccgcacggcaccctccccacctcagccgccgccgtctcccgtgctccctccccagccgccgcgggatccgactccaatccctcctcccaacgcccgacgcgacggcgatgcttcagacgacgaagacgacgaaggcaagggcgcgggcgccccgtcgcgctcccacctcgtcgctgagttcaaagtcacgctggacaggaaggtggtggatctggcagagctccggaggctcgcatgccagggcgtccccgatgccgctggtattcggcccatcgtctggaagcttctcttgggatatttgccaactgatcgtgctctatggccatatgaactggagaaaaagaggtcccaatactgtgctttccaagatgaacttctggttaatccttcagaagttactcgaagaatggaggaaatgtcagtttctaaaagagaggaacataatgctgaagggactggtgtgctaccaagggcggaaatcgttcgtgatgagcatcccctaagccttgggaaaactagtgtttggaaccaatacttccaggagtctgagattgtagagcagatcgatagagatgttaagcgtactcatcctgagatgcaatttttcaatggggactcttcagattcgttgtctaatcaggagtcactaaagcgtatacttacaatatttgcaaaattgaatccgggtatacgatatgtacaaggaatgaatgaggttttggcacctctctattatgttttcaagaatgatcctgaccaaagtcatgctgctttagcagagccagatgcctttttctgttttgtcgagctgcttagtgggttccgagataacttttgcaagcaacttgacaacagtgtggttggtatacgctccacaattgctacactatcacagcttctgagaagacatgacgaggaactctggcggcatttagaagttgtaaccaaggttaatccacagttctacgcattcagatggatcaccttgctgctaacgcaggagtttaagttccgtgactgcctcagcctgtgggacacactattgggcgatccagagggacctcaggctacattgttgcggatctgctgcgcgatgctaattcttgtccgaaggcggctcttggctggcgatttcactgcgaacctgaagctcctccagaactacccacccacaaacatcgaccaccttctacacattgctaacaagctgcgagggccgcttcccttctga

SEQ ID NO: 6044 - protein, 443 aa, Sorghum bicolor
  misc_feature: Ceres ANNOT ID no. 6062961
  misc_feature (195)..(410): Pfam Id: TBC Pfam Desc: TBC domain
  misc_feature (2)..(443): NCBI GI: 116634829 NCBI Desc: osigba0135c09.4 [oryza sativa (indica cultivar-group)]
  misc_feature (128)..(443): NCBI GI: 115457970 NCBI Desc: os04g0377600 [oryza sativa (japonica cultivar-group)]
  misc_feature (9)..(438): NCBI GI: 92892994 NCBI Desc: rabgap/tbc [medicago truncatula]
  misc_feature (9)..(438): NCBI GI: 140059084 NCBI Desc: rabgap/tbc [medicago truncatula]
  misc_feature (81)..(437): NCBI GI: 56785363 NCBI Desc: rabgap/tbc domain-containing protein-like [oryza sativa (japonica cultivar-group)]
MADGATPRRKSVPDWLNNPIWSAPPPSPRHSSPPRTAPSPPQPPPSPVLPPQPPRDPTPIPPPNARRDGDASDDEDDEGKGAGAPSRSHLVAEFKVTLDRKVVDLAELRRLACQGVPDAAGIRPIVWKLLLGYLPTDRALWPYELEKKRSQYCAFQDELLVNPSEVTRRMEEMSVSKREEHNAEGTGVLPRAEIVRDEHPLSLGKTSVWNQYFQESEIVEQIDRDVKRTHPEMQFFNGDSSDSLSNQESLKRILTIFAKLNPGIRYVQGMNEVLAPLYYVFKNDPDQSHAALAEPDAFFCFVELLSGFRDNFCKQLDNSVVGIRSTIATLSQLLRRHDEELWRHLEVVTKVNPQFYAFRWITLLLTQEFKFRDCLSLWDTLLGDPEGPQATLLRICCAMLILVRRRLLAGDFTANLKLLQNYPPTNIDHLLHIANKLRGPLPF

SEQ ID NO: 6045 - DNA, 1338 bp, Sorghum bicolor
  misc_feature: Ceres ANNOT ID no. 6063163
  misc_feature: Encodes the peptide sequence at SEQ ID NO 6046
atgatgtcgcgacagtgcacaaaccgcatctttctaagtggaggttccagcttcctccatggcctcaaatctagagtttcatccagtgggagtcgtggcaccgtcagacttaactggtgctgcatgagagccaatctctggaggaccaagcgccctggtttcaaggctactccgtctgagatgattgcagtactgcaagcgtcagatattttcagtagcatcaggaaatggagcaagttgcaattggttgccatgacaggggtgatggcatgtgtagttctggtagtcccttctgctgatgcaatcgatgctctcaagacatgcacttgcctactaaaggaatgcagaatagagctggccaaatgcatagcgaacccgtcctgtgcagcaaacgtagcatgcttgaacacatgcaataatcgacctgatgaaactgaatgccagatcaaatgtggagacctgtttgagaacagtgtagtcgatgaattcaatgaatgtgctgtttcacgcaagaaatgtgttccaagaaaatccgatgtcggagagttcccagtccctgatccatctgccctggttaaggacttcaatatggcagattttgatggcaaatggtacatttcaagtggcttaaacccgacatttgacacatttgattgccagcttcacgagtttcatgtccagggagacaaactaatcgcaaacataacatggagaatccgcaccccagactctggtttctttaccaggtcaaccattcaacgtttcgtgcaggacccctcacagcctggcatactctataaccatgacaatgagttcctgcactatcaagatgactggtacattatctcatccaaggttgagaacaaggatgatgactacatatttgtatactaccgtggtcgaaatgacgcatgggatggttatggtggttctgttttgtacacaagaagtaaaactgtacctgaaacaataatacctgagctagaaagagctgcaaaaagcataggtcgggacttctcgacgttcatcaggactgataacacctgtggtcctgagccacctcttgtggagagaatcgagaagactgtggaggaaggagagaagaccatcgtcagggaggtgaaggagattgaggaggaggttgaggagctggagaaggaggaggcatcattgtttcaaaagctggcagaaggtctcatggaggtgaaacaggatttgatgaacttcttgcaggggctgagcaaggaggagatggagctgttggatcagctgaacatggaagcgactgaagttgagaaagtcttcagccgtgcactgccattgaggaagctaaggtag

SEQ ID NO: 6046 - protein, 445 aa, Sorghum bicolor
  misc_feature: Ceres ANNOT ID no. 6063163
  misc_feature (162)..(359): Pfam Id: VDE Pfam Desc: Violaxanthin de-epoxidase (VDE)
  misc_feature (19)..(445): NCBI GI: 115457984 NCBI Desc: os04g0379700 [oryza sativa (japonica cultivar-group)]
  misc_feature (27)..(445): NCBI GI: 17438153 NCBI Desc: violaxanthin de-epoxidase precursor [oryza sativa subsp. indica]
  misc_feature (27)..(445): NCBI GI: 19033168 NCBI Desc: violaxanthin de-epoxidase [oryza sativa (japonica cultivar-group)]
  misc_feature (1)..(445): NCBI GI: 13676584 NCBI Desc: violaxanthin de-epoxidase [triticum aestivum]
  misc_feature (75)..(445): NCBI GI: 87299443 NCBI Desc: violaxanthin deepoxidase [chrysanthemum x morifolium]
  misc_feature (42)..(445): SWISSPROT Homolog: EC 1.10.99.3 Violaxanthin de-epoxidase, chloroplast precursor
  misc_feature: Useful for making plants with modulated nitrogen use efficiency
  misc_feature: Functional homolog of the protein sequence given in SEQ ID NO 13943
MMSRQCTNRIFLSGGSSFLHGLKSRVSSSGSRGTVRLNWCCMRANLWRTKRPGFKATPSEMIAVLQASDIFSSIRKWSKLQLVAMTGVMACVVLVVPSADAIDALKTCTCLLKECRIELAKCIANPSCAANVACLNTCNNRPDETECQIKCGDLFENSVVDEFNECAVSRKKCVPRKSDVGEFPVPDPSALVKDFNMADFDGKWYISSGLNPTFDTFDCQLHEFHVQGDKLIANITWRIRTPDSGFFTRSTIQRFVQDPSQPGILYNHDNEFLHYQDDWYIISSKVENKDDDYIFVYYRGRNDAWDGYGGSVLYTRSKTVPETIIPELERAAKSIGRDFSTFIRTDNTCGPEPPLVERIEKTVEEGEKTIVREVKEIEEEVEELEKEEASLFQKLAEGLMEVKQDLMNFLQGLSKEEMELLDQLNMEATEVEKVFSRALPLRKLR

SEQ ID NO: 6047 - DNA, 1239 bp, Sorghum bicolor
  misc_feature: Ceres ANNOT ID no. 6063357
  misc_feature: Encodes the peptide sequence at SEQ ID NO 6048
atggccgccgctgccgccgttcgcgcggaggaggatggcccgtggggtggtggtggccatggcgtccaccatcaacaggtgagcacaacggatccctcgcctctcgctgtcttcctcgccgtgagatgctttccttcgcggaaatgtgttggttcttgggagccacgatctttgggggtcaaaactgtcaaagaaccctatactcctccacgagaggtacatcgccaaattacccattcactaccacctcagaagcgggagatttttgattcacttcaaccttgggccaaggataacctattgaacctactgaagccagttgaaaagtcatggcagccacaggacttcctaccagagccttcttctgatggattttatgatgaagttaaagaactgagggagcgggcaaatgaaatacctgatgagtactttgtttgcttagttggtgatatggttaccgaggaagccttacctacctatcaaacaatgcttaacacccttgatggagtccgggatgaaactggtgcaagtccaaccacgtgggcggtttggacaagggcatggacagctgaagagaatagacatggtgacctccttaataagtatatgtaccttactggacgggttgacatgaaacaaattgagaagaccatacagtatctgattggttccggaatggatcctggaactgagaacaacccatacttgggtttcctttacacatcatttcaagaaagagcaacatttgtatcgcatgggaatactgcaaggcatgccaaggagtatggtgatctcaagctggcccagatatgtggtacaatagcagctgatgaaaagcgccatgaaacagcctacaccaagatagtcgagaagctctttgagattgatcctgattacacagtgcttgcatttgctgacatgatgaggaagaagatcacaatgcctgctcatctcatgtacgatggcaaggatgacaacctgtttgagcacttcagtgcagtggcgcagaggctgggcgtctacactgctaaagattatgctgacatccttgagttcttggtccagaggtggaaagttgcagatctcactgggctgtctggagaagggagaagggcacaggatttcgtctgtaccttggcacctagaatcaggcgattggacgaaagagctcaagcaagggcgaagcaagcaccagttattcctttcagttggatttatgaccgcaaggtgcagctttaa

SEQ ID NO: 6048 - protein, 412 aa, Sorghum bicolor
  misc_feature: Ceres ANNOT ID no. 6063357
  misc_feature (82)..(410): Pfam Id: FA_desaturase_2 Pfam Desc: Fatty acid desaturase
  misc_feature (58)..(412): NCBI GI: 32489062 NCBI Desc: osjnbb0089b03.6 [oryza sativa (japonica cultivar-group)]
  misc_feature (60)..(412): NCBI GI: 115457988 NCBI Desc: os04g0379900 [oryza sativa (japonica cultivar-group)]
  misc_feature (60)..(412): NCBI GI: 3915029 NCBI Desc: acyl-[acyl-carrier-protein] desaturase, chloroplast precursor (stearoyl-acp desaturase)
  misc_feature (60)..(412): NCBI GI: 976257 NCBI Desc: stearyl-acp desaturase [oryza sativa (japonica cultivar-group)]
  misc_feature (64)..(412): NCBI GI: 115441871 NCBI Desc: os01g0919900 [oryza sativa (japonica cultivar-group)]
  misc_feature (60)..(412): SWISSPROT Homolog: EC 1.14.19.2 Acyl-[acyl-carrier-protein] desaturase, chloroplast precursor
  misc_feature: The sequence is a functional homolog of SEQ ID NO. 338 in the 11/188,298 US application
MAAAAAVRAEEDGPWGGGGHGVHHQQVSTTDPSPLAVFLAVRCFPSRKCVGSWEPRSLGVKTVKEPYTPPREVHRQITHSLPPQKREIFDSLQPWAKDNLLNLLKPVEKSWQPQDFLPEPSSDGFYDEVKELRERANEIPDEYFVCLVGDMVTEEALPTYQTMLNTLDGVRDETGASPTTWAVWTRAWTAEENRHGDLLNKYMYLTGRVDMKQIEKTIQYLIGSGMDPGTENNPYLGFLYTSFQERATFVSHGNTARHAKEYGDLKLAQICGTIAADEKRHETAYTKIVEKLFEIDPDYTVLAFADMMRKKITMPAHLMYDGKDDNLFEHFSAVAQRLGVYTAKDYADILEFLVQRWKVADLTGLSGEGRRAQDFVCTLAPRIRRLDERAQARAKQAPVIPFSWIYDRKVQL

SEQ ID NO: 6049 - DNA, 777 bp, Sorghum bicolor
  misc_feature: Ceres ANNOT ID no. 6063500
  misc_feature: Encodes the peptide sequence at SEQ ID NO 6050
atgacgacgcccggctcctgccccgcgaccaccgccgccacccaccctcccgtctgcgacgctggtggatcgcaaaaattggtgcggccgcgactggtgctcttcggcgactccatcaccgagcagtccttccgccccggtggctggggcgccgcactgtctgacacctactcgcgcaaggctgatgtagttgccagaggctatggtggatacaacacaagatgggctcttttcttaatacatcacatctttccactggatggtttagcaccccctcttgcaaccactattttctttggagcaaatgacgctgcccttttaggaagaactagcgagcgacaacatgttccagtttcagagtataaaaacaatctcaaaacgattgttaatcatttgaaggactgttctaattccatggttattgtgcttattacaccacctccagttgatgaagaaggaagggaaagatttgatgcgaggaagctacctgaaaggacaaatgagatggctggggtctatgctggttattgcgttgaactagccagagaaatgcatataccctgcattaatatctggtcaaagatgcaggagacagaaggatggcagaaactttacctaagtgacggcctgcatctgactccggaaggaaacgcagttgtccataaggaggtcgtcgaaacattgagaaatgctggtctgaaagcagaacacatgccgtatgacttccctcatcactccaaaatagacgggagttgtccagaaaaggcgttccaatga

SEQ ID NO: 6050 - protein, 258 aa, Sorghum bicolor
  misc_feature: Ceres ANNOT ID no. 6063500
  misc_feature (32)..(224): Pfam Id: Lipase_GDSL Pfam Desc: GDSL-like Lipase/Acylhydrolase
  misc_feature (27)..(257): NCBI GI: 79530356 NCBI Desc: carboxylic ester hydrolase/ hydrolase, acting on ester bonds [arabidopsis thaliana]
  misc_feature (28)..(246): NCBI GI: 13161403 NCBI Desc: cprd49 [vigna unguiculata]
  misc_feature (28)..(243): NCBI GI: 16974631 NCBI Desc: at2g38180/f16m14.11 [arabidopsis thaliana]
  misc_feature (25)..(256): NCBI GI: 56208571 NCBI Desc: novel gdsl-like lipase\/acylhydrolase domain containing protein [danio rerio]
  misc_feature (29)..(249): NCBI GI: 21554235 NCBI Desc: cprd49 [arabidopsis thaliana]
MTTPGSCPATTAATHPPVCDAGGSQKLVRPRLVLFGDSITEQSFRPGGWGAALSDTYSRKADVVARGYGGYNTRWALFLIHHIFPLDGLAPPLATTIFFGANDAALLGRTSERQHVPVSEYKNNLKTIVNHLKDCSNSMVIVLITPPPVDEEGRERFDARKLPERTNEMAGVYAGYCVELAREMHIPCINIWSKMQETEGWQKLYLSDGLHLTPEGNAVVHKEVVETLRNAGLKAEHMPYDFPHHSKIDGSCPEKAFQ

SEQ ID NO: 6051 - DNA, 474 bp, Sorghum bicolor
  misc_feature: Ceres ANNOT ID no. 6063505
  misc_feature: Encodes the peptide sequence at SEQ ID NO 6052
atgggcttcatctcgttcgtcggccgggtgctcttcgcctccctcttcctcctctccgcctaccaagagttcattgaatttggaaatgatggtggaccggcagcgaagaccttgaagccaaagttcaatctcttcgtcaagctagtgtccaagaataccggattgggggtgccgcatattgatataaaaactgtcattgcggctaccatgtttcttaaaggctttggtggtcttctgttcatattcagcagctcatttggagcattcctcctgctcatttacttggcgtttatgacccctatcgtgtatgatttctacaactatgaaatggagtcagagcagtttgtccagctttttttcaagttcacacagaacttggcgtttatcggtgccctgcttttcttcctggggatgaagaactcgattccaagaaggcgctccaagggaaggacaacaaaaaccaagacaaactga

SEQ ID NO: 6052 - protein, 157 aa, Sorghum bicolor
  misc_feature: Ceres ANNOT ID no. 6063505
  misc_feature (1)..(138): Pfam Id: HR_lesion Pfam Desc: HR-like lesion-inducing
  misc_feature (1)..(157): NCBI GI: 1762945 NCBI Desc: orf; able to induce hr-like lesions [nicotiana tabacum]
  misc_feature (1)..(156): NCBI GI: 115482234 NCBI Desc: os10g0445500 [oryza sativa (japonica cultivar-group)]
  misc_feature (1)..(157): NCBI GI: 21553825 NCBI Desc: elicitor like protein [arabidopsis thaliana]
  misc_feature (1)..(127): NCBI GI: 1762939 NCBI Desc: orf; able to induce hr-like lesions [nicotiana tabacum]
  misc_feature (1)..(155): NCBI GI: 20147297 NCBI Desc: at1g04340/f19p19_23 [arabidopsis thaliana]
  misc_feature: Useful for making plants with modulated nitrogen use efficiency
  misc_feature: Functional homolog of the protein sequence given in SEQ ID NO 13261
MGFISFVGRVLFASLFLLSAYQEFIEFGNDGGPAAKTLKPKFNLFVKLVSKNTGLGVPHIDIKTVIAATMFLKGFGGLLFIFSSSFGAFLLLIYLAFMTPIVYDFYNYEMESEQFVQLFFKFTQNLAFIGALLFFLGMKNSIPRRRSKGRTTKTKTN

SEQ ID NO: 6053 - DNA, 1485 bp, Sorghum bicolor
  misc_feature: Ceres ANNOT ID no. 6063560
  misc_feature: Encodes the peptide sequence at SEQ ID NO 6054
atggcttggcagagattgctgctcctggccgcggccgttgctctcaccgtcaccgccggcggcgccgcgttccagttcgaagaggccactctcgagagcatccagcagggcttcaagaacggcagcctgaactcgacggcgctggtccgctactacctggaccagatcgcgcggctgaacccgaagctccacgccgtcatcgaggtgaaccccgacgcgctcggcgacgcggcccgtgccgacgccgagcgggcgtcgtcgagcggcgggcgcgggctcctccacggcgtccccgtgctggtcaaggacctcatcgcgacgcgcgaccggctgaacacgacggccgggtcgttcgcgctgctcgggtccgtcgccgggcgcgacgccggcgccatcgtgctcggcaagtccaacctccctgagtggggcaacatgcgcagcgccatgggactccacggctggagcgcgcgaggcggacaagccatgaacccttacgtgctgaaaatggatccatgcgaggcaagcaccggttcggccatcgctgcggcggcaaacatggcagccgtgacactcgggacggaaaccatagcttccatactctgcccggcgtcggcgaatgcagtggtcgggatcaagccaacagttggcttgacgagtcgctccggtgtgatccccttcacgcttaggcaggacactgtcggaccattgtgtcgcaccgtagcagacgctgtccacgtgctggatgctattgtcggttatgatgaccttgacgctgaagccacaatggcagcgtcccagtacatccctcaaggcgggtacaagcagtttctgaagattgacgggttacgtgacaagaggattggtataccaaatggcttctttcacttcgaaactaagacaggattggtgtacaagcagcatatcgaaacaatgagacgacttggagcgaacgtgatcgaaaacctgaacatagagaatctgagcgtgtcacggaacaccaccacgagtggattcgcggttgcagcgccagcagagttcaagatcaacctgaacaactacctatcaaacttatcctacactccagtccgctgcctagctgacatcatagctttcaacatcgcccatcctgacgaggagaagctgatagagtacgatcagcagctcctgctgttatctgaaagcaccagaggaatcggcccgttggagagagctgcgatacatcggatggaggagttgtcggcaaatggggtggagaagatgatgaaggaacactgtctcgacgccatttttacacctgattcgagcgtcgccaccgtccttgcctacaatggcctccctggaatcgaagtgccggctggatacgacgagaatggtgtcccctttggcgttaccttcggtgggctcaggggatatgagcccaggctcgtcgagatggcatatgcgtttgagcaggcaaccaaggtgcgaaggcctcccaccatatga

SEQ ID NO: 6054 - protein, 494 aa, Sorghum bicolor
  misc_feature: Ceres ANNOT ID no. 6063560
  misc_feature (47)..(476): Pfam Id: Amidase Pfam Desc: Amidase
  misc_feature (1)..(492): NCBI GI: 116317815 NCBI Desc: osigba0140c02.3 [oryza sativa (indica cultivar-group)]
  misc_feature (1)..(492): NCBI GI: 38346899 NCBI Desc: osjnbb0006l01.6 [oryza sativa (japonica cultivar-group)]
  misc_feature (1)..(492): NCBI GI: 115457176 NCBI Desc: os04g0184100 [oryza sativa (japonica cultivar-group)]
  misc_feature (1)..(492): NCBI GI: 116317819 NCBI Desc: osigba0140c02.7 [oryza sativa (indica cultivar-group)]
  misc_feature (13)..(492): NCBI GI: 38347081 NCBI Desc: osjnba0001m07.1 [oryza sativa (japonica cultivar-group)]
MAWQRLLLLAAAVALTVTAGGAAFQFEEATLESIQQGFKNGSLNSTALVRYYLDQIARLNPKLHAVIEVNPDALGDAARADAERASSSGGRGLLHGVPVLVKDLIATRDRLNTTAGSFALLGSVAGRDAGAIVLGKSNLPEWGNMRSAMGLHGWSARGGQAMNPYVLKMDPCEASTGSAIAAAANMAAVTLGTETIASILCPASANAVVGIKPTVGLTSRSGVIPFTLRQDTVGPLCRTVADAVHVLDAIVGYDDLDAEATMAASQYIPQGGYKQFLKIDGLRDKRIGIPNGFFHFETKTGLVYKQHIETMRRLGANVIENLNIENLSVSRNTTTSGFAVAAPAEFKINLNNYLSNLSYTPVRCLADIIAFNIAHPDEEKLIEYDQQLLLLSESTRGIGPLERAAIHRMEELSANGVEKMMKEHCLDAIFTPDSSVATVLAYNGLPGIEVPAGYDENGVPFGVTFGGLRGYEPRLVEMAYAFEQATKVRRPPTI

SEQ ID NO: 6055 - DNA, 1650 bp, Sorghum bicolor
  misc_feature: Ceres ANNOT ID no. 6063594
  misc_feature: Encodes the peptide sequence at SEQ ID NO 6056
atggcacacgatcacaaggtgctcgacgctctcgacgccgccaagacacagtggtaccacttcacggcggtggtgatcgccggcatgggcttcttcaccgacgcgtacgacctcttctccatctccctcgtcaccaagctcctcggccgcgtctactacttcaaccccaactccaacacccccggctccctcccgcccaacgtctccgccgccgtgaacggcgtcgcgttctgcggcacgctcgccgggcagctcttcttcggctggctcggcgacaagctgggccgcaagaaggtgtacggcatgacgctgatgctcatggtcgtctcctgcctcgcgtccggcctctcgttcgggtccacccccaatgccgtcatggccacgctctgcttcttccgcttctggctcggcgtcggcatcggcggcgactacccgctgtccgccaccatcatgtccgagtacgccaacaagcggacgcgcggcgcgttcatcgccgccgtcttcgccatgcagggcttcggcaacctcaccggtggcatcgtcgccatcgtcgtctcggcggcgttcaagtcccgcttcgacgcgccggcgtacaaggacgaccccgccgcctccacggtgccgcaggccgactacgcgtggcgcatcgtcctcatgttcggcgccatcccggcgctgctcacctactactggcgcatgaagatgcccgagacggcgcggtacaccgcgctggtcgccaagaacgccaagcaggcgacgtcggacatggcgcgcgtgctcaacgtcgacgagctcgccgtggagcagcagaagccgaagccggcggaggaggaggaggaggaagccctcgagcgccgccgccgccgcgaggaggagtacgggctcttctcccggcagttcgcgaggcggcacggtctccacctggtgggcacgacggtgtgctggttcacgctggacatcgccttctactcgcagaacctgttccagaaggacatctacgccgccgtcaactggctgcccaaggcggagaccatgaacgccatggaggagatgttgaggatctcccgcgcgcagacgctggtcgcgctgtgcggcaccatcccgggctactggttcaccgtcttcttcgtcgacgtcgtcggccgcttcgccatccagctcggcggcttcttcttcatgacggcgttcatgctcggcctcgccgtcccgtaccaccactggacgacgccgggacaccacgtcggcttcgtcgtcatgtacgccttcactttcttcttcgccaactttggtccaaactccaccaccttcgtcgtgccggcggagatcttcccggcgaggctgcggtccacttgccacggcatctcttccgctgcagggaagtgtggcgccattgtcgggtcatttgggttcctgtacgcggcgcagagcacggatcctgcgaagacggacgccggctacccgccgggcatcggagtgcgcaactcgctgttcgtgctcgccggatgcaatgtgatcggcttcctgttcacgttcctggtgccggagtccaaggggaagtcgctggaggagctctccggcgagaacgaggacgaagaggcagcacctgcgcagagtaaccagcagaccgtcccgacggatttgagtgaataa

SEQ ID NO: 6056 - protein, 549 aa, Sorghum bicolor
  misc_feature: Ceres ANNOT ID no. 6063594
  misc_feature (23)..(528): Pfam Id: Sugar_tr Pfam Desc: Sugar (and other) transporter
  misc_feature (27)..(467): Pfam Id: MFS_1 Pfam Desc: Major Facilitator Superfamily
  misc_feature (1)..(544): NCBI GI: 52550767 NCBI Desc: phosphate transporter 5 [oryza sativa (japonica cultivar-group)]
  misc_feature (1)..(544): NCBI GI: 20162457 NCBI Desc: phosphate transporter [oryza sativa]
  misc_feature (1)..(544): NCBI GI: 116317867 NCBI Desc: osigba0132g14.5 [oryza sativa (indica cultivar-group)]
  misc_feature (1)..(544): NCBI GI: 15983299 NCBI Desc: phosphate transporter [oryza sativa subsp. indica]
  misc_feature (6)..(535): NCBI GI: 49066604 NCBI Desc: phosphate transport protein [zea mays]
  misc_feature: Useful for making plants with modulated phosphate use efficiency
  misc_feature: GREAT-hit functional homolog of the protein sequence given in SEQ ID NO 13399
  misc_feature: GREAT-hit functional homolog of the protein sequence given in SEQ ID NO 13400
  misc_feature: Functional homolog of the protein sequence given in SEQ ID NO 13401
  misc_feature: Functional homolog of the protein sequence given in SEQ ID NO 13404
  misc_feature: Useful for making plants with modulated phosphate use efficiency
  misc_feature: Functional homolog of the protein sequence given in SEQ ID NO 13399
  misc_feature: Useful for making plants with modulated carbohydrate content
  misc_feature: Functional homolog of the protein sequence given in SEQ ID NO 13408
  misc_feature: The sequence is a functional homolog of SEQ ID NO. 296 in the 11/188,298 US application
  misc_feature: The sequence is a functional homolog of SEQ ID NO. 331 in the 11/188,298 US application
  misc_feature: The sequence is a functional homolog of SEQ ID NO. 449 in the 11/188,298 US application
MAHDHKVLDALDAAKTQWYHFTAVVIAGMGFFTDAYDLFSISLVTKLLGRVYYFNPNSNTPGSLPPNVSAAVNGVAFCGTLAGQLFFGWLGDKLGRKKVYGMTLMLMVVSCLASGLSFGSTPNAVMATLCFFRFWLGVGIGGDYPLSATIMSEYANKRTRGAFIAAVFAMQGFGNLTGGIVAIVVSAAFKSRFDAPAYKDDPAASTVPQADYAWRIVLMFGAIPALLTYYWRMKMPETARYTALVAKNAKQATSDMARVLNVDELAVEQQKPKPAEEEEEEALERRRRREEEYGLFSRQFARRHGLHLVGTTVCWFTLDIAFYSQNLFQKDIYAAVNWLPKAETMNAMEEMLRISRAQTLVALCGTIPGYWFTVFFVDVVGRFAIQLGGFFFMTAFMLGLAVPYHHWTTPGHHVGFVVMYAFTFFFANFGPNSTTFVVPAEIFPARLRSTCHGISSAAGKCGAIVGSFGFLYAAQSTDPAKTDAGYPPGIGVRNSLFVLAGCNVIGFLFTFLVPESKGKSLEELSGENEDEEAAPAQSNQQTVPTDLSE

SEQ ID NO: 6057 - DNA, 534 bp, Sorghum bicolor
  misc_feature: Ceres ANNOT ID no. 6063813
  misc_feature: Encodes the peptide sequence at SEQ ID NO 6058
atgtcgtcgtcctccgagctctacaaccttgtccccgcaccccaaaccctaaaccctcccgcacctgccgccgccgatctctccagctccaccgccgtcgcggcggcggcggcggcggcgccgggggacggcgccctccgcggccgggttcgccgtccggtggggtcctcctccgtcgaccggcacgccaaggtcgccggccgcggccgccgggtccgcatcccggccatggtggcggcgcgcgtcttccagctcacgcgcgagctcgggcaccgcagcgacggagagaccatcgagtggttgctccgccaggccgagccctccataatcgccgccaccggcaccggggtcaccaccgaggaggcgccctcggtccttgtccccgtctcctccgtcgcggccaccgcgtccatgacgccggtctcgtactcgtactacaccgcgctcctcatgcaacctcccaccgccaaggagtcccctcctgcctctgcatacgtctctggcactgctgcggaggagaataataataactag

SEQ ID NO: 6058 - protein, 177 aa, Sorghum bicolor
  misc_feature: Ceres ANNOT ID no. 6063813
  misc_feature (42)..(173): Pfam Id: TCP Pfam Desc: TCP family transcription factor
  misc_feature (1)..(176): NCBI GI: 38346539 NCBI Desc: osjnba0040d17.14 [oryza sativa (japonica cultivar-group)]
  misc_feature (1)..(176): NCBI GI: 2580438 NCBI Desc: pcf1 [oryza sativa (japonica cultivar-group)]
  misc_feature (7)..(176): NCBI GI: 115457224 NCBI Desc: os04g0194600 [oryza sativa (japonica cultivar-group)]
  misc_feature (8)..(146): NCBI GI: 37719051 NCBI Desc: tcp-domain protein [antirrhinum majus subsp. majus]
  misc_feature (25)..(153): NCBI GI: 140068571 NCBI Desc: tcp transcription factor [medicago truncatula]
  misc_feature: The sequence is a functional homolog of SEQ ID NO 2426 in the 10/374,780US patent application
  misc_feature: The sequence is a functional homolog of SEQ ID NO 246 in the 10/225,068US patent application
  misc_feature: The sequence is a functional homolog of SEQ ID NO 554 in the 10/412,699US patent application
  misc_feature: Useful for making plants with modulated growth and phenotype characteristics
  misc_feature: The sequence is a functional homolog of SEQ ID NO 554 in the 20040045049 US patent application
MSSSSELYNLVPAPQTLNPPAPAAADLSSSTAVAAAAAAAPGDGALRGRVRRPVGSSSVDRHAKVAGRGRRVRIPAMVAARVFQLTRELGHRSDGETIEWLLRQAEPSIIAATGTGVTTEEAPSVLVPVSSVAATASMTPVSYSYYTALLMQPPTAKESPPASAYVSGTAAEENNNN

SEQ ID NO: 6059 - DNA, 687 bp, Sorghum bicolor
  misc_feature: Ceres ANNOT ID no. 6063831
  misc_feature: Encodes the peptide sequence at SEQ ID NO 6060
atggacattaggctgctggtatccgcggacgccaccctcgccgccgcccgctcccgcccttccacgtccgcgctccagcgccagattgtcgtcccgggccgccgccgggcgtcgtgcaggtccgtccgcgcgcgctccgccgcagctgccgcgccagccgcgggaggcatctccgggcatagcaatggagtgtacacggttggtgacttcatgacaggaagggacaatctccatgttgtccaaccttctacaccggttgaccaagccctggagctgctggtacagcacaagatctctggcttacctgtggttgacgatgatgggaagttggttggggttgtatcagattatgatctgctagctttggattcgatttcaggaaatgaattgcccgatacaaatacaaacatgtttcctgatgtggatagtacatggaagactttccacgagatacagagactattaagcaaaactaatgggaaggtcattggtgatgtaatgacgtcttcacctttagcggtgcgtcaaaatactaatcttgatgctgctacaaggttgctgcttgaaactaaataccggagattacctgtagttgatagcatggggaaactagttgggatgattacaaggggaaacgtcgtcagcgctgccctcaaaataaagaagaaaactgaagaaggtgcttga

SEQ ID NO: 6060 - protein, 228 aa, Sorghum bicolor
  misc_feature: Ceres ANNOT ID no. 6063831
  misc_feature (71)..(218): Pfam Id: CBS Pfam Desc: CBS domain pair
  misc_feature (1)..(228): NCBI GI: 46389988 NCBI Desc: cbs domain containing protein-like [oryza sativa (japonica cultivar-group)]
  misc_feature (20)..(225): NCBI GI: 92873938 NCBI Desc: cbs [medicago truncatula]
  misc_feature (66)..(216): NCBI GI: 23127710 NCBI Desc: cog0517: fog: cbs domain [nostoc punctiforme pcc 73102]
  misc_feature (66)..(216): NCBI GI: 16331252 NCBI Desc: imp dehydrogenase [synechocystis sp. pcc 6803]
  misc_feature (67)..(216): NCBI GI: 22299345 NCBI Desc: cbs domain protein [thermosynechococcus elongatus bp-1]
MDIRLLVSADATLAAARSRPSTSALQRQIVVPGRRRASCRSVRARSAAAAAPAAGGISGHSNGVYTVGDFMTGRDNLHVVQPSTPVDQALELLVQHKISGLPVVDDDGKLVGVVSDYDLLALDSISGNELPDTNTNMFPDVDSTWKTFHEIQRLLSKTNGKVIGDVMTSSPLAVRQNTNLDAATRLLLETKYRRLPVVDSMGKLVGMITRGNVVSAALKIKKKTEEGA

SEQ ID NO: 6061 - DNA, 1044 bp, Sorghum bicolor
  misc_feature: Ceres ANNOT ID no. 6063872
  misc_feature: Encodes the peptide sequence at SEQ ID NO 6062
atggctactcaccactcgtcggctttcctcttggccgccatcgtcgccttcgccggcgctctgagcaccgctctggcggcgcgcgacctcggcgaccaggccatggtggcgaggcacgatgagtggatggccaagtacggccgcgtctacagcgacgcggcggagaaggcgcggcggttcgaggtgttcaaggccaacgtcgtcttcatcgagtccgtcaacgccgggaaccacaagttcgagctggaggccaaccagttcgccgacctcaccgacgacgagttcagggccacctggaccggttacaggcccaggcggccggcggcggcggcgagcagccggaaagcgacggggttcaggtacgccaatgtcagcctcgccgacgttccgacgtccgtggactggaggacgaaaggcgccgtcacgcccatcaaggaccaaggcgagtgtgggtgctgctgggcgttctccgccgtggcgtccatggagggcgccgtgaagatcagcacggggaagctcgtctcgctctcggagcaggagctcgtcgactgcgacgtcaacggcatggaccagggctgtgagggcggcgagatggacgacgcgttcgagttcgtcgtcgacaatggcgggctcaccaccgagagcaagtacccgtacacgggctctgatggtaactgcaactccgacgaggccaagaacgacgccgcgtccatcacgggatacgaggacgtgccggccaacgacgagacctccctgcggaaggcggtggccaaccagcctgtgtcggtcgccgtcgacggaggggacaacctctttaggttctacaagggcggcgtcctctctggcgcgtgtggaacggagctcgatcatggcatcgccgccgtcgggtacggcgtcgccggcgacggcaccaagttctggctgatgaagaactcgtgggggacgtcgtggggcgaggctgggtacatccggatggagagggacatcgccgacgacgagggtctgtgcggcctcgccatgcagccttcctacccgacagcctag

SEQ ID NO: 6062 - protein, 347 aa, Sorghum bicolor
  misc_feature: Ceres ANNOT ID no. 6063872
  misc_feature (129)..(346): Pfam Id: Peptidase_C1 Pfam Desc: Papain family cysteine protease
  misc_feature (39)..(95): Pfam Id: Inhibitor_I29 Pfam Desc: Cathepsin propeptide inhibitor domain (I29)
  misc_feature (10)..(347): NCBI GI: 116309130 NCBI Desc: h0825g02.10 [oryza sativa (indica cultivar-group)]
  misc_feature (10)..(347): NCBI GI: 116309178 NCBI Desc: osigba0147o06.5 [oryza sativa (indica cultivar-group)]
  misc_feature (1)..(347): NCBI GI: 24285904 NCBI Desc: cysteine proteinase precursor [ipomoea batatas]
  misc_feature (6)..(347): NCBI GI: 13491750 NCBI Desc: cysteine protease [ipomoea batatas]
  misc_feature (1)..(347): NCBI GI: 124484401 NCBI Desc: cysteine proteinase precursor [ipomoea nil]
  misc_feature (129)..(346): SWISSPROT Homolog: EC 3.4.22.15 Cathepsin L
MATHHSSAFLLAAIVAFAGALSTALAARDLGDQAMVARHDEWMAKYGRVYSDAAEKARRFEVFKANVVFIESVNAGNHKFELEANQFADLTDDEFRATWTGYRPRRPAAAASSRKATGFRYANVSLADVPTSVDWRTKGAVTPIKDQGECGCCWAFSAVASMEGAVKISTGKLVSLSEQELVDCDVNGMDQGCEGGEMDDAFEFVVDNGGLTTESKYPYTGSDGNCNSDEAKNDAASITGYEDVPANDETSLRKAVANQPVSVAVDGGDNLFRFYKGGVLSGACGTELDHGIAAVGYGVAGDGTKFWLMKNSWGTSWGEAGYIRMERDIADDEGLCGLAMQPSYPTA

SEQ ID NO: 6063 - DNA, 1500 bp, Sorghum bicolor
  misc_feature: Ceres ANNOT ID no. 6063876
  misc_feature: Encodes the peptide sequence at SEQ ID NO 6064
  misc_feature: Down-regulated in shoot tissues in response to salicylic acid treatment
atggagcctcaggaggtggagcggagcacgtatgtcctcctaaaggtactctacatgtgcctccccgacacgcccgtgtacgccggcgccgccctgtccgcccgcctccccgacgacgccgaggaccgcatcagcgccctccccttctccctcctccgcaacatcgtgtcccgcctccccgccaaggacgccgcccgcaccaccgcgctctcccgccgctggcgccccgtctggcgctgcacgccgctcgccttcgctgatgcgcacctcctcccgggagtcctcggtggccatcgcaggcccgcgcccgccgacacgccgaccctcgccgacaccttctcccgcgccatcgccgcgcacccgggccccttccgcgccgtccacctcgtctgcggctactacgcggacgccgcgcgccagcggcagctcgcgcgctgggtccagacgttcgtcgccaagggcgtccaggagctcatcctcgtcaaccgcccgatgccgctccacgtgcctctccccgccgcgctccttggcgtcgccaccctcacccgcctctacctcggcctctggaaattcccggacacctccgctctccgacagtgtcaaagtgacgctggcgtggtgttcccgcacctccgcgagctcgtcctctgctgggtgatggtggagagccgcgacatggacttcctcctagctgggagccccgtcctagagacctttggcataatgggaatcagggagaaggcgatgcgcctccgccacgctggccagcatctccggtgcacgcagatcctcatgtcaactgtggacagcgtcactgtggtggacgccctgagccttgagcggctcatcttgtgggaagccatgccgtgcaacagctcttgcatcagggtaaagattggcaaagtccccaagctgcaagtacttggatacttgagtcctggaagtcacatgctggagatccggaataccgtcatcaacgctgggataaaggcgacaccaagcaccatggttccaggcatcaggatcttggggttaaacatgcgcttcggagaccgcaatgattccaagatgctaccgactttcctcagatgctttccaaatgttgagagactgcatattgtgtccaaaaaaaacgatgaaattgctggcaagatcaacctcaagttctggcaggaggccggtcccattgaaagcatccggtcctccatcaagatgatgactttccgtgaattcagaatggagcgaagcgaggttgcgttcctcaagttcttcttccaaagtgcccacgtgctgaagaatgctgtaattgtggggtccaatggaagtttcacatccattcctgaggtgattgacaaagtgaagactctgattcctcaagatgggcctagtaattcttgccatgtgttggtctatgaaagttcagatccagctgggggtccagtcttgagtttgcagaaagggtttgatttttctgttagcgatcctctcaattaccagtaa

SEQ ID NO: 6064 - protein, 499 aa, Sorghum bicolor
  misc_feature: Ceres ANNOT ID no. 6063876
  misc_feature (389)..(438): Pfam Id: FBD Pfam Desc: FBD
  misc_feature (42)..(89): Pfam Id: F-box Pfam Desc: F-box domain
  misc_feature (2)..(495): NCBI GI: 38346009 NCBI Desc: osjnba0035o13.11 [oryza sativa (japonica cultivar-group)]
  misc_feature (2)..(495): NCBI GI: 115457296 NCBI Desc: os04g0208500 [oryza sativa (japonica cultivar-group)]
  misc_feature (2)..(498): NCBI GI: 38346008 NCBI Desc: osjnba0035o13.10 [oryza sativa (japonica cultivar-group)]
  misc_feature (3)..(495): NCBI GI: 115457298 NCBI Desc: os04g0208600 [oryza sativa (japonica cultivar-group)]
  misc_feature (13)..(497): NCBI GI: 53793451 NCBI Desc: ribosomal rna apurinic site specific lyase-like [oryza sativa (japonica cultivar-group)]
  misc_feature: Down-regulated in shoot tissues in response to salicylic acid treatment
MEPQEVERSTYVLLKVLYMCLPDTPVYAGAALSARLPDDAEDRISALPFSLLRNIVSRLPAKDAARTTALSRRWRPVWRCTPLAFADAHLLPGVLGGHRRPAPADTPTLADTFSRAIAAHPGPFRAVHLVCGYYADAARQRQLARWVQTFVAKGVQELILVNRPMPLHVPLPAALLGVATLTRLYLGLWKFPDTSALRQCQSDAGVVFPHLRELVLCWVMVESRDMDFLLAGSPVLETFGIMGIREKAMRLRHAGQHLRCTQILMSTVDSVTVVDALSLERLILWEAMPCNSSCIRVKIGKVPKLQVLGYLSPGSHMLEIRNTVINAGIKATPSTMVPGIRILGLNMRFGDRNDSKMLPTFLRCFPNVERLHIVSKKNDEIAGKINLKFWQEAGPIESIRSSIKMMTFREFRMERSEVAFLKFFFQSAHVLKNAVIVGSNGSFTSIPEVIDKVKTLIPQDGPSNSCHVLVYESSDPAGGPVLSLQKGFDFSVSDPLNYQ

SEQ ID NO: 6065 - DNA, 744 bp, Sorghum bicolor
  misc_feature: Ceres ANNOT ID no. 6063923
  misc_feature: Encodes the peptide sequence at SEQ ID NO 6066
atgaggcgcggctcgaggaaatcgtcgtcgtctgccgcgaccgccagcgctggtgtggaacaagtaaatgaaaaacaaaacagaaaaagaaaaggagtcagtacaaacctgaccagcaggaaagcacaacgtggccctactaaagcagtttccaaggaagtagaacggattgatcaatttttttatacttatgccgataactcatctggcatgattgacccagaaggcattgaaacactctgttctcaccttgaagttccccacaccgatgttaggattctaatgttagcatggaaaatgggctgtgagaagcaaggttattttaccttggatgaatggagaactggcttgaaagctcttcgagctgacagtatcagtaaacttaagaaagcatttccagaactggttcaagaggttacaaggccatccaatttccaggatttctacatatatgcatttcgttattgcctcacagaggataagaagaagtgtatagaaataccagttgcttgtgagttgctgaatctagtattaggcttgcagttccgccctcaggttgacaagcttaataattacctaaagtaccaaaatgactacaaggtgataaacatggaccaatggatgggatttattcggttctgtaatgagataaacttcccatcacttgacaattatgattcagaccttgcttggcctttgattctagacaattttgttgagtggctgcgagaaaataaaagctag

SEQ ID NO: 6066 - protein, 247 aa, Sorghum bicolor
  misc_feature: Ceres ANNOT ID no. 6063923
  misc_feature (22)..(247): NCBI GI: 32815875 NCBI Desc: at1g15860 [arabidopsis thaliana]
  misc_feature (22)..(247): NCBI GI: 8927664 NCBI Desc: contains similarity to rp42 from mus musculus gbaf198092 and is a member of the transposase pf00872 and utp-glucose-1-phosphate uridylyltransferase pf01704 families. est
  misc_feature (22)..(247): NCBI GI: 8927664 (continued) gbai998363 comes from this gene. [arabidopsis thaliana]
  misc_feature (55)..(246): NCBI GI: 119625830 NCBI Desc: dcn1, defective in cullin neddylation 1, domain containing 4 (s. cerevisiae), isoform cra_b [homo sapiens]
  misc_feature (55)..(246): NCBI GI: 78099236 NCBI Desc: dcn1-like protein 4 (defective in cullin neddylation protein 1-like protein 4) (dcun1 domain-containing protein 4)
  misc_feature (55)..(246): NCBI GI: 119625831 NCBI Desc: dcn1, defective in cullin neddylation 1, domain containing 4 (s. cerevisiae), isoform cra_c [homo sapiens]
  misc_feature: Useful for making plants with altered terpenoid content
  misc_feature: GREAT-hit functional homolog of the protein sequence given in SEQ ID NO 13284
  misc_feature: Useful for making plants with altered terpenoid content
  misc_feature: Functional homolog of the protein sequence given in SEQ ID NO 13284
MRRGSRKSSSSAATASAGVEQVNEKQNRKRKGVSTNLTSRKAQRGPTKAVSKEVERIDQFFYTYADNSSGMIDPEGIETLCSHLEVPHTDVRILMLAWKMGCEKQGYFTLDEWRTGLKALRADSISKLKKAFPELVQEVTRPSNFQDFYIYAFRYCLTEDKKKCIEIPVACELLNLVLGLQFRPQVDKLNNYLKYQNDYKVINMDQWMGFIRFCNEINFPSLDNYDSDLAWPLILDNFVEWLRENKS

SEQ ID NO: 6067 - DNA, 1584 bp, Sorghum bicolor
  misc_feature: Ceres ANNOT ID no. 6063925
  misc_feature: Encodes the peptide sequence at SEQ ID NO 6068
atggcttctgctttaaaaacaaatggcagtttttgtagcacacaacagcagcagtttctgcaatcaacaacggatcagtttttacatggttcttctcatttaaatttcaaacattgcaaaagcaagaagacaataaagcctgctccactgtgtgttagagctacttcctcgaaagtggaattagactttcatgatccatcttggaagcagaagtttcaggaagactgggaaagacggtttaatttgccaagtattactgatatatatgatttgaaaccaaggccaactacattctcactcaagaaaaacagaactcttacaggtgatgaaaacgtggatatgtggaatggttatgttaacaatgatgatcgggcacttttgaaggtgataaagtattcctcgcctacttctgctggagcagagtgcattgatcctgactgtagctgggtggagcaatgggtgcatcgagcaggaccacgcaaggagatatactatgagccagcggaagtaaaagctgctatagttacctgtggaggtctatgtcctggtttgaatgatgtcatcagacagatagtattcaccctagagacctatggtgttaagaatattgttggaattccatttggttatcgtggattttttgaaaagggcctcaaagaaatgccactttcacgtggtctagtggagaatataaatcttaatggtggaagttttcttggggtttctcgtggtggagctaaaactagtgagattgttgatagtatacaggccagaaggattgacatgcttttcgtactcggtggaaatggtacccatgcaggagcaaatgctatccatgaagagtgccgtaagagaaagctgaaggtttcagttgtagcagttccaaaaaccattgataatgatatacttttgatggataaaacatttggttttgatacagctgtggaagaagcccaacgagccattaattccgcatatatagaggcacgcagtgcttaccatggtatcggtttggtcaaattaatgggaagaagcagtgggtttattgcaatgcatgcttctctttcaagtgggcaggttgatgtttgcttaatacctgaggtcccattcactctagatggagaatttggtgttttgcagcaccttgaacatttgctaaagagtaagggattctgtgtggtttgtgttgcagaagctgcaggacaagatctactgcaaaagtcaggtgcaactgatgcatcaggaaatgtgatatttagcgacattggtgttcacatgcaacagaagattaagacccatttcaaggacattggtgttccagctgacgtgaaatacattgacccaacttacatggttcgtgcatgccgtgccaatgcatctgatgcaattttgtgtaccgtgcttggacaaaatgctgtccatggagcatttgctggtttcagtggcatcacttcttgcatctgcaacacacattacgtgtaccttcccatcacagaggtcatcacggcatcgaagcgtgtgaaccccaacagcaggatgtggcatcggtgcctcacgtccactggtcagcctgatttccactga

SEQ ID NO: 6068 - protein, 527 aa, Sorghum bicolor
  misc_feature: Ceres ANNOT ID no. 6063925
  misc_feature (171)..(478): Pfam Id: PFK Pfam Desc: Phosphofructokinase
  misc_feature (1)..(527): NCBI GI: 115479163 NCBI Desc: os09g0415800 [oryza sativa (japonica cultivar-group)]
  misc_feature (53)..(526): NCBI GI: 90654902 NCBI Desc: atp-utilizing phosphofructokinase [spinacia oleracea]
  misc_feature (128)..(360): NCBI GI: 115476600 NCBI Desc: os08g0439000 [oryza sativa (japonica cultivar-group)]
  misc_feature (154)..(526): NCBI GI: 10176767 NCBI Desc: pyrophosphate-dependent phosphofructo-1-kinase-like protein [arabidopsis thaliana]
  misc_feature (156)..(526): NCBI GI: 19699124 NCBI Desc: at4g26270/t25k17_80 [arabidopsis thaliana]
MASALKTNGSFCSTQQQQFLQSTTDQFLHGSSHLNFKHCKSKKTIKPAPLCVRATSSKVELDFHDPSWKQKFQEDWERRFNLPSITDIYDLKPRPTTFSLKKNRTLTGDENVDMWNGYVNNDDRALLKVIKYSSPTSAGAECIDPDCSWVEQWVHRAGPRKEIYYEPAEVKAAIVTCGGLCPGLNDVIRQIVFTLETYGVKNIVGIPFGYRGFFEKGLKEMPLSRGLVENINLNGGSFLGVSRGGAKTSEIVDSIQARRIDMLFVLGGNGTHAGANAIHEECRKRKLKVSVVAVPKTIDNDILLMDKTFGFDTAVEEAQRAINSAYIEARSAYHGIGLVKLMGRSSGFIAMHASLSSGQVDVCLIPEVPFTLDGEFGVLQHLEHLLKSKGFCVVCVAEAAGQDLLQKSGATDASGNVIFSDIGVHMQQKIKTHFKDIGVPADVKYIDPTYMVRACRANASDAILCTVLGQNAVHGAFAGFSGITSCICNTHYVYLPITEVITASKRVNPNSRMWHRCLTSTGQPDFH

SEQ ID NO: 6069 - DNA, 1077 bp, Sorghum bicolor
  misc_feature: Ceres ANNOT ID no. 6063954
  misc_feature: Encodes the peptide sequence at SEQ ID NO 6070
atggcttccccgccgtgtctcctcttccgccccagcccgccgctgtgcagccggcgccgccgcagtaggcccccctccccctacctcctttccaagcaaagccttcaccgacttccctcaccaagaacatgccgccgtccagtggtggcggcagtggcaaagcagctcgtgccgcggccgccaggtaccggccggcggacgggggcgacgggcttcgcctgtcactgttcctacgacaccaagaacggactgcccacgcctccaccggataagggaaaaagctcggatgagtggccagtccttcgcaggtgggatgttccgtgggagtggccaacgatttccctcaccatggtggcatgtgcagtaagctttcttttgacagggatggttgagcaatttattttggagcaactaggttttcaagctggggggacaactctagatgagaaggcagaaattctcttcttgggacaacttagcacgacagtagttgtacttggagttatatttggcatcaccggtacatttcgaccattctcagatgatatatttcgctatgaattcaaggaaccatttaagctgcaaaacggttggcttctgtggtctggaatcggcctatttgttgcagtagtggctattgctttagcaggtgctgcaatgacatttgtgaacggtgaaacaccacagagagagacggactcgctggtccttttgttgccgctgattggctcatcaaacgttagcactgcctgtttgctgggcatcactgggattttggcacccattctggaggaaactgtgtttcgaggatttcttatggtatccctgactatgtggttctctactccatatgctgtgcttatcactgctgcaatgtttgcctttgctcatcttacaccaggagaattcccacagctttttgtgcttggtgttgtcttaggattttcatatgctcaaacccgcaatcttctaactcctattgccatacatgctgtctggaactctggagtaatattgttgctaacctttcttcagatgcaagggtatgatatcagggagattttgcaggcatcttga

SEQ ID NO: 6070 - protein, 358 aa, Sorghum bicolor
  misc_feature: Ceres ANNOT ID no. 6063954
  misc_feature (252)..(341): Pfam Id: Abi Pfam Desc: CAAX amino terminal protease family
  misc_feature (88)..(358): NCBI GI: 30683693 NCBI Desc: caax amino terminal protease family protein [arabidopsis thaliana]
  misc_feature (123)..(358): NCBI GI: 42571465 NCBI Desc: caax amino terminal protease family protein [arabidopsis thaliana]
  misc_feature (231)..(358): NCBI GI: 115479137 NCBI Desc: os09g0413200 [oryza sativa (japonica cultivar-group)]
  misc_feature (187)..(358): NCBI GI: 115476584 NCBI Desc: os08g0436600 [oryza sativa (japonica cultivar-group)]
  misc_feature (104)..(344): NCBI GI: 75907768 NCBI Desc: abortive infection protein [anabaena variabilis atcc 29413]
MASPPCLLFRPSPPLCSRRRRSRPPSPYLLSKQSLHRLPSPRTCRRPVVAAVAKQLVPRPPGTGRRTGATGFACHCSYDTKNGLPTPPPDKGKSSDEWPVLRRWDVPWEWPTISLTMVACAVSFLLTGMVEQFILEQLGFQAGGTTLDEKAEILFLGQLSTTVVVLGVIFGITGTFRPFSDDIFRYEFKEPFKLQNGWLLWSGIGLFVAVVAIALAGAAMTFVNGETPQRETDSLVLLLPLIGSSNVSTACLLGITGILAPILEETVFRGFLMVSLTMWFSTPYAVLITAAMFAFAHLTPGEFPQLFVLGVVLGFSYAQTRNLLTPIAIHAVWNSGVILLLTFLQMQGYDIREILQAS

SEQ ID NO: 6071 - DNA, 600 bp, Sorghum bicolor
  misc_feature: Ceres ANNOT ID no. 6063956
  misc_feature: Encodes the peptide sequence at SEQ ID NO 6072
atggcggagaggcaggaggtcatctccggcgtcggtgcggcagcggcaccgatgtgcgccaacggctgcgggttcttcgggagcgcggcgaccaacaacttctgctcaacgtgctacaagcaggatcacctgatgatcaccaagaccgccggcgccggcgccgctcccctggaagcgtccggccgccgcggcctcatcgagtgcgccaacgcgtgcggttacttcgggtacccagcgaccaacaacctgtgcaccctctgctacagggacttcctcgaaagcgttcactcctcccctgccgcggcggacaaggtcgtcgtcctcgctgccgagcagccggcggcggcccagatctctgctgcaacttctagtgctacacgggcggtggaggcggcggcggcggcggcgtcgagcaggtgcgcgtcgtgccgcaagaaggtggggctgctggggtttccctgccgctgtggcggcacgttctgcgcgctgcaccggtacgcggagaagcacgcctgcggcttcgacttcaaggcggcgggccgggagaagatcgccaagaacaacccgctcgtcgtggccgccaagatcaacaagatctga

SEQ ID NO: 6072 - protein, 199 aa, Sorghum bicolor
  misc_feature: Ceres ANNOT ID no. 6063956
  misc_feature (140)..(180): Pfam Id: zf-AN1 Pfam Desc: AN1-like Zinc finger
  misc_feature (16)..(40): Pfam Id: zf-A20 Pfam Desc: A20-like zinc finger
  misc_feature (65)..(89): Pfam Id: zf-A20 Pfam Desc: A20-like zinc finger
  misc_feature (44)..(198): NCBI GI: 75133829 NCBI Desc: zinc finger a20 and an1 domain-containing stress-associated protein 12 (ossap12)
  misc_feature (68)..(199): NCBI GI: 75123399 NCBI Desc: zinc finger a20 and an1 domain-containing stress-associated protein 5 (ossap5)
  misc_feature (66)..(199): NCBI GI: 75146195 NCBI Desc: zinc finger a20 and an1 domain-containing stress-associated protein 9 (ossap9)
  misc_feature (64)..(196): NCBI GI: 75149664 NCBI Desc: zinc finger a20 and an1 domain-containing stress-associated protein 7 (ossap7)
  misc_feature (66)..(199): NCBI GI: 118424243 NCBI Desc: zinc finger protein [aeluropus littoralis]
  misc_feature: Useful for making plants with altered Lignin content
  misc_feature: Functional homolog of the protein sequence given in SEQ ID NO 12934
MAERQEVISGVGAAAAPMCANGCGFFGSAATNNFCSTCYKQDHLMITKTAGAGAAPLEASGRRGLIECANACGYFGYPATNNLCTLCYRDFLESVHSSPAAADKVVVLAAEQPAAAQISAATSSATRAVEAAAAAASSRCASCRKKVGLLGFPCRCGGTFCALHRYAEKHACGFDFKAAGREKIAKNNPLVVAAKINKI

SEQ ID NO: 6073 - DNA, 582 bp, Sorghum bicolor
  misc_feature: Ceres ANNOT ID no. 6063957
  misc_feature: Encodes the peptide sequence at SEQ ID NO 6074
atggcggagaggcaggaggtctctggcggcatggcggcgccgatgtgcgccaacgcctgcgggttcttcgggagtgcggcgaccaagaacctctgctccaagtgctacaaggagcacctgatcaagaccgccaagcaggaagcatccgccgccgtcgtcgtcggcggcgccatcgtcaagtgcgcggccgacgggtgcggtttcttcggatcctcggcgaccaacaacatgtgctccggctgctacatggacttcctcaaagacgctcacgcctcccctgctgtggcggacaaggtcgtcgtactcgctgccgagaagcagccggcggcggcccagatctctgctgcaacgtccagtactgcaccggcggcggtgaaggcggcggcggcgcccaacaggtgcgcgtcgtgccgcaagaaggtggggctgctggggttcccctgccgctgcggcggcacgttctgcgcgctgcaccggtacgcggagaagcacgcctgcgacttcgacttcaaggcggcgggccgggagaagatcgccaagaacaacccgctcgtcgtggcagccaagatcaacaagatctga

SEQ ID NO: 6074 - protein, 193 aa, Sorghum bicolor
  misc_feature: Ceres ANNOT ID no. 6063957
  misc_feature (134)..(174): Pfam Id: zf-AN1 Pfam Desc: AN1-like Zinc finger
  misc_feature (13)..(37): Pfam Id: zf-A20 Pfam Desc: A20-like zinc finger
  misc_feature (58)..(83): Pfam Id: zf-A20 Pfam Desc: A20-like zinc finger
  misc_feature (40)..(192): NCBI GI: 75133829 NCBI Desc: zinc finger a20 and an1 domain-containing stress-associated protein 12 (ossap12)
  misc_feature (45)..(193): NCBI GI: 75146195 NCBI Desc: zinc finger a20 and an1 domain-containing stress-associated protein 9 (ossap9)
  misc_feature (55)..(190): NCBI GI: 75149664 NCBI Desc: zinc finger a20 and an1 domain-containing stress-associated protein 7 (ossap7)
  misc_feature (71)..(193): NCBI GI: 75123464 NCBI Desc: zinc finger a20 and an1 domain-containing stress-associated protein 4 (ossap4)
  misc_feature (45)..(193): NCBI GI: 118424243 NCBI Desc: zinc finger protein [aeluropus littoralis]
  misc_feature: Useful for making plants with modulated drought sensitivity
  misc_feature: Useful for making plants with modulated nitrogen use efficiency
  misc_feature: Functional homolog of the protein sequence given in SEQ ID NO 13476
  misc_feature: Functional homolog of the protein sequence given in SEQ ID NO 13477
MAERQEVSGGMAAPMCANACGFFGSAATKNLCSKCYKEHLIKTAKQEASAAVVVGGAIVKCAADGCGFFGSSATNNMCSGCYMDFLKDAHASPAVADKVVVLAAEKQPAAAQISAATSSTAPAAVKAAAAPNRCASCRKKVGLLGFPCRCGGTFCALHRYAEKHACDFDFKAAGREKIAKNNPLVVAAKINKI

SEQ ID NO: 6075 - DNA, 1788 bp, Sorghum bicolor
  misc_feature: Ceres ANNOT ID no. 6063960
  misc_feature: Encodes the peptide sequence at SEQ ID NO 6076
atggcatcgtcatctcctctcgcccgtgctcacagcccctccacctccacctcttccgtcaccgccgccctcctcgcctccgcctcgcccatccccccgcgtcgcttcctccagctccacgcgcacctcctccgcacgggcctcctagccctctcccccgtcacaaccaccgccgccttcctctccctcgcggccgcctccctcccgtcccaccgcgcgctcgcggtcctcgaccaccacctcaccgccgcgtcctccctcccctccaccttccagtgcaactccatcctccgcgtcctctccgacccttccgacgcgctccgcttcctccgccgcatgcgcgcgctcggccgccgcgggaacgccttcaccctcgccatcctcctcaagccccgctgcgcgctcgcgcacgcgcgccagctccacgccaacgtcgtggcggagggtcacctccgcgacgccctcctcgccacctcgctgatggcgtgctacgcgaaccgcggcgatggggacggcgcgcgcaagctgtttggcgaaatgcccgcgagggacgcggtcgcatggaacgttctgatcagctgttgcgcgaggaaccggcggacaaaggacgctctgaagcttttcgaggagatgagaggcagggacagcggggcggagccagatgacgtcacctgcattctgctcctccaggcatgcacgagcctgggcgcgcttgatttcggggagcaggtgtgggcgtatgcggaggagcatggttatggggccaagctgaaggtgcgcaattcgttgattgcgatgtactcgaggtgcgggtgtgtggataaggcatacagggtgttctgtgggactcctcagaagagtgtggtcacatggagcgcaatgatctcaggattggcagctaatggttttggggatgatgctatctcagcattcgaggagatgattagatcagatgttgctcctgatgaacagacttttactggtgttctttctgcatgtagtcatagtgggctggttgacgagggttttaggttttttgatatgatgcgatgtgagtatgggttgaagccaaacgttcgccactatggatgcattgttgacctaatgggacgtgctggcttgcttgatgaggcttatgagcttgtgacaaatgagatgaaggttgcaccagatgcgacaatttggcgaactcttcttggtgcttgccgaatccatggtcatgttgatcttggggagcgtgtaatcagtaatctaattgaactgaaggcgcagcaagctggtgactatgttctattgctgaacacttatgcagcagttggggaatggagcaaggtatctgaagtcaggaagttgatgcaggaaaaaggaatacagactactcctggctgcacgactgtggagcataatggtgaggtttatgagttcattgcagatgatgatgcacatccaaggaaggtggagatttatgaaaagctcaatgagataaataagcagttgaggattgctggttatgttccaaatgtgtcatcagagttgcatgatttggattcagaagggaaggaaagtgccctcacctatcacagtgaaaagctggcaattgcttttgctttgcttgtgacacctcagaacaggccaataaggcttgcaaagaatcttcgtgtttgtgttgactgccacaatttcacaaaggtgttttctggtatttacaaccgactagttattgtcagggacagaacacggttccatcattttcagggaggaaaatgttcatgtaatgattattggtag

SEQ ID NO: 6076 - protein, 595 aa, Sorghum bicolor
  misc_feature: Ceres ANNOT ID no. 6063960
  misc_feature (186)..(220): Pfam Id: PPR Pfam Desc: PPR repeat
  misc_feature (289)..(323): Pfam Id: PPR Pfam Desc: PPR repeat
  misc_feature (4)..(595): NCBI GI: 42407498 NCBI Desc: pentatricopeptide (ppr) repeat-containing protein-like [oryza sativa (japonica cultivar-group)]
  misc_feature (38)..(595): NCBI GI: 145333528 NCBI Desc: binding [arabidopsis thaliana]
  misc_feature (48)..(595): NCBI GI: 92880794 NCBI Desc: tetratricopeptide-like helical [medicago truncatula]
  misc_feature (156)..(595): NCBI GI: 92886291 NCBI Desc: tetratricopeptide-like helical [medicago truncatula]
  misc_feature (145)..(595): NCBI GI: 144923302 NCBI Desc: asp/glu racemase; tetratricopeptide-like helical [medicago truncatula]
MASSSPLARAHSPSTSTSSVTAALLASASPIPPRRFLQLHAHLLRTGLLALSPVTTTAAFLSLAAASLPSHRALAVLDHHLTAASSLPSTFQCNSILRVLSDPSDALRFLRRMRALGRRGNAFTLAILLKPRCALAHARQLHANVVAEGHLRDALLATSLMACYANRGDGDGARKLFGEMPARDAVAWNVLISCCARNRRTKDALKLFEEMRGRDSGAEPDDVTCILLLQACTSLGALDFGEQVWAYAEEHGYGAKLKVRNSLIAMYSRCGCVDKAYRVFCGTPQKSVVTWSAMISGLAANGFGDDAISAFEEMIRSDVAPDEQTFTGVLSACSHSGLVDEGFRFFDMMRCEYGLKPNVRHYGCIVDLMGRAGLLDEAYELVTNEMKVAPDATIWRTLLGACRIHGHVDLGERVISNLIELKAQQAGDYVLLLNTYAAVGEWSKVSEVRKLMQEKGIQTTPGCTTVEHNGEVYEFIADDDAHPRKVEIYEKLNEINKQLRIAGYVPNVSSELHDLDSEGKESALTYHSEKLAIAFALLVTPQNRPIRLAKNLRVCVDCHNFTKVFSGIYNRLVIVRDRTRFHHFQGGKCSCNDYW

SEQ ID NO: 6077 - DNA, 816 bp, Sorghum bicolor
  misc_feature: Ceres ANNOT ID no. 6063978
  misc_feature: Encodes the peptide sequence at SEQ ID NO 6078
atggcttctgccgggttggctgggatgagcggtgcggctcgtcctctcatgaggctcgtcaccatgagcggtgtgccaatcctccagcagctgcacctggaggaggagctcctgcgctgcacttcagacaactggtgcatcatcaacaatggcacgacccctgctaccatcgtcatgggcgtgtctgggagagtctcagagcttgtaaagatacagcctgccctccgggaccaggtgccggtcgtgaggaggttcagtggaggtggcaccgtcattgttgatcagggaacggtgtttgtgactttcatttgcaacaagaatgccattgccgggctgcagccctttccacgggacatcatgtcatggagtggtcagctatatggcaaagtttttgacagatttggtgaatttcatctacgtgagaatgactatgcatttagtcatcgaaaattcggtggaaatgctcaatcaataacaaaaaatcgttgggttcatcacacatcgttcttgtgggattatgatgtgaaaaatatggattatctcaaaatcccaaagcgtgcaccggaatatcgactggcaagaaaccacacagatttcttgtgccgcatgaaggagtatataccttcacgttcagttttcaccgatggggtcattgcggccctgggagaacacttctcagttcagcccatggatctacaagcagttccttccggtgatgaagaatttgtgccttctacaaagctgctgtcacaacaagacctagaggaaattgtttcctccaaagaatcccctagagtacagaaagtcgaagcatga

SEQ ID NO: 6078 - protein, 271 aa, Sorghum bicolor
  misc_feature: Ceres ANNOT ID no. 6063978
  misc_feature (3)..(271): NCBI GI: 42407518 NCBI Desc: lipoate-protein ligase a-like [oryza sativa (japonica cultivar-group)]
  misc_feature (15)..(259): NCBI GI: 7939551 NCBI Desc: lipoate protein ligase-like protein [arabidopsis thaliana]
  misc_feature (64)..(256): NCBI GI: 140052813 NCBI Desc: biotin/lipoate a/b protein ligase [medicago truncatula]
  misc_feature (20)..(225): NCBI GI: 29834237 NCBI Desc: lipoate-protein ligase a-related protein [chlamydophila caviae gpic]
  misc_feature (22)..(220): NCBI GI: 33236485 NCBI Desc: lipoate--protein ligase a [chlamydophila pneumoniae tw-183]
MASAGLAGMSGAARPLMRLVTMSGVPILQQLHLEEELLRCTSDNWCIINNGTTPATIVMGVSGRVSELVKIQPALRDQVPVVRRFSGGGTVIVDQGTVFVTFICNKNAIAGLQPFPRDIMSWSGQLYGKVFDRFGEFHLRENDYAFSHRKFGGNAQSITKNRWVHHTSFLWDYDVKNMDYLKIPKRAPEYRLARNHTDFLCRMKEYIPSRSVFTDGVIAALGEHFSVQPMDLQAVPSGDEEFVPSTKLLSQQDLEEIVSSKESPRVQKVEA

SEQ ID NO: 6079 - DNA, 1122 bp, Sorghum bicolor
  misc_feature: Ceres ANNOT ID no. 6063992
  misc_feature: Encodes the peptide sequence at SEQ ID NO 6080
atgcccttctgtcgccactataaagcgatgatgcgaggggtggagcagcagcagcggattgaggagctcgccctgccgccgggcttccgcttcttcccgacggacgaggagctcatcacctgctacctcgccaggaaggccatggacgccagcttcaccacggcagccatccgcgacgtggacctctacaagacagagccatgggaccttccatgcgagcagcaggcggcggccggaggagacctgcaggagggctacttcttctgcatgaggggcagcaagtccccgtccggcgttcgcgcccgccgcgcaacgcagctgggctactggaagtccacgggcaaggacaaggccgtgcacagcaggtccggccgcctcgtcgtcgggacgaggaagacgctcgtgttctaccgcggcagggctccgagaggcgagaagaccgactgggtcatgcacgagtacgccatgggcgaaaggaggagcagcgccctcctcaggggagcacagagtgagtgggtcatttgcagggtgttcacgaggaagcatcatccgatgaccagcgacgacaggaagctggaaacggaggagctagctgtcgtgcaaggccaccactctcctggccatcatcatccccttgccgccatggagggagacgacggttttgacagcgagcaggaggcggcggcgccaccggccgtcgccgaaacccagcatacagcagctggaagccacctcggtagtacccaatccatggagggcgatcatcagcagcagcaccgtcaaatggcacatgatgagctactgacgacgacgatgcaccaccatggttccagtagttgcgtcgtctcgccgtgttcatgttggctcaaccagcatgatgatcaccaccagctggtgggactgggaggagcgcactccgcgttgctgccaatcatgcagatgcagtctgtcgtcgacgatgcagattactatctaccggagttgctggagtacggcgggccgctggacaccggcggtggtgaggaggaccgccgtcgccgtgccgagactaatttcacctccgttattggctcctctgacgacctcgacgggctctactggtactgggacagtggcttctga

SEQ ID NO: 6080 - protein, 373 aa, Sorghum bicolor
  misc_feature: Ceres ANNOT ID no. 6063992
  misc_feature (25)..(157): Pfam Id: NAM Pfam Desc: No apical meristem (NAM) protein
  misc_feature (10)..(210): NCBI GI: 4337200 NCBI Desc: nam (no apical meristem)-like protein [arabidopsis thaliana]
  misc_feature (21)..(187): NCBI GI: 140045718 NCBI Desc: no apical meristem (nam) protein [medicago truncatula]
  misc_feature (21)..(256): NCBI GI: 42573407 NCBI Desc: no apical meristem (nam) family protein [arabidopsis thaliana]
  misc_feature (17)..(180): NCBI GI: 20148335 NCBI Desc: nam (no apical meristem)-like protein [arabidopsis thaliana]
  misc_feature (13)..(211): NCBI GI: 30102618 NCBI Desc: at5g07680 [arabidopsis thaliana]
  misc_feature: The sequence is a functional homolog of SEQ ID NO 2418 in the 10/374,780US patent application
  misc_feature: The sequence is a functional homolog of SEQ ID NO 554 in the 10/225,066US patent application
  misc_feature: The sequence is a functional homolog of SEQ ID NO 68 in the 10/286,264US patent application
  misc_feature: Useful for making plants with modulated growth and phenotype characteristics
  misc_feature: The sequence is a functional homolog of SEQ ID NO 68 in the 20030093837 US patent application
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: Useful for making plants with altered terpenoid content
  misc_feature: Functional homolog of the protein sequence given in SEQ ID NO 13140
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with altered lignin content
  misc_feature: Functional homolog of the protein sequence given in SEQ ID NO 13250
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MPFCRHYKAMMRGVEQQQRIEELALPPGFRFFPTDEELITCYLARKAMDASFTTAAIRDVDLYKTEPWDLPCEQQAAAGGDLQEGYFFCMRGSKSPSGVRARRATQLGYWKSTGKDKAVHSRSGRLVVGTRKTLVFYRGRAPRGEKTDWVMHEYAMGERRSSALLRGAQSEWVICRVFTRKHHPMTSDDRKLETEELAVVQGHHSPGHHHPLAAMEGDDGFDSEQEAAAPPAVAETQHTAAGSHLGSTQSMEGDHQQQHRQMAHDELLTTTMHHHGSSSCVVSPCSCWLNQHDDHHQLVGLGGAHSALLPIMQMQSVVDDADYYLPELLEYGGPLDTGGGEEDRRRRAETNFTSVIGSSDDLDGLYWYWDSGF

SEQ ID NO: 6081 - DNA, 1428 bp, Sorghum bicolor
  misc_feature: Ceres ANNOT ID no. 6064057
  misc_feature: Encodes the peptide sequence at SEQ ID NO 6082
atggcgacggcacccgcacccctctcgctctccgcctccacgctgcccgcgcggctccgtgccggagcggtgccggcgggagcgcgctggaggcagcagccgcggcgcgggcggatggtggtgcgcgccaagatccgggagatcttcatgccggcgctcagctcaaccatgacggagggcaagatcgtctcctggtccgccggagagggtgatcgcgtctccaagggcgacgccgtcgtggtcgtcgagtccgacaaggccgacatggacgtcgagaccttccacgacggcatcgtggcggccgtcctcgtccaggccggcgagtccgcgccggtgggcgcacccatcgcgctgctcgcggagtcggaggaggaggtgccgctcgcggtcgccaaggctcaggagctctccaacggcaacgggcagccgcagcaggcgcctcctgctccgacggaggatgccgcagcggcgccgccccctcctcctccggctccggcggctgctcccgcgccggtggctgcggggacgaagggcatcgccagcccgcacgctaagaagctggctaagcagcacagggtggaccttgccaaggtgactggcaccgggccgtatggtcgaattacgccggcagatattgaggcggctgccggaatccagccgaagccaaagcccgcccctgctgctgctgcgccaccacctgtggctgcgccttcagtgggtgcagtgcctcaggcggcagtgctaccaccggttcctggcgccactattgttccattcactaccatgcaggctgcagtgagcaagaacatggtggagagcctggcagtgccagcattccgcgtcggctaccccattgtaaccgataagctcgatgcgctgtatgaaaaggttaagccaaagggagtgacaatgacagtgctgctggcgaaggctacagccatggctcttgtgcagcaccctgttgtcaatgctagctgcagggatggaaagagcttcacatacaacagtaacatcaacattgcagtggctgtggcaattgatggcggccttattacacccgtccttcaggatgctgacaagctggatatatatttgctctcacaaaattggaaggatctggtcaagaaagcacgtgcaaaacagctccaaccaaatgagtacagctctgggacttttacactgtccaacctgggtatgtttggtgtagatcggtttgatgcgatccttccgcctggccagggagctattatggctgttggagcctccaaacctacagtcgtggctgataaagatggtttctttagcgtcaagagcaaaatgctggtcaatgtcactgctgatcacaggattgtatatggtgctgatttggcagcattcctacaaacttttgcaaagattattgaggatcctgagagcttaactttgtaa

SEQ ID NO: 6082 - protein, 475 aa, Sorghum bicolor
  misc_feature: Ceres ANNOT ID no. 6064057
  misc_feature (251)..(475): Pfam Id: 2-oxoacid_dh Pfam Desc: 2-oxoacid dehydrogenases acyltransferase (catalytic domain)
  misc_feature (46)..(119): Pfam Id: Biotin_lipoyl Pfam Desc: Biotin-requiring enzyme
  misc_feature (176)..(214): Pfam Id: E3_binding Pfam Desc: e3 binding domain
  misc_feature (39)..(475): NCBI GI: 9279589 NCBI Desc: dihydrolipoamide s-acetyltransferase [arabidopsis thaliana]
  misc_feature (6)..(474): NCBI GI: 115487664 NCBI Desc: os12g0182200 [oryza sativa (japonica cultivar-group)]
  misc_feature (10)..(474): NCBI GI: 8778253 NCBI Desc: f12k21.24 [arabidopsis thaliana]
  misc_feature (45)..(475): NCBI GI: 67923053 NCBI Desc: biotin/lipoyl attachment:catalytic domain of components of various dehydrogenase complexes:e3 binding [crocosphaera watsonii wh 8501]
  misc_feature (45)..(475): NCBI GI: 16331208 NCBI Desc: dihydrolipoamide acetyltransferase component (e2) of pyruvate dehydrogenase complex [synechocystis sp. pcc 6803]
  misc_feature: Useful for making plants with modulated nitrogen use efficiency
  misc_feature: Functional homolog of the protein sequence given in SEQ ID NO 13720
MATAPAPLSLSASTLPARLRAGAVPAGARWRQQPRRGRMVVRAKIREIFMPALSSTMTEGKIVSWSAGEGDRVSKGDAVVVVESDKADMDVETFHDGIVAAVLVQAGESAPVGAPIALLAESEEEVPLAVAKAQELSNGNGQPQQAPPAPTEDAAAAPPPPPPAPAAAPAPVAAGTKGIASPHAKKLAKQHRVDLAKVTGTGPYGRITPADIEAAAGIQPKPKPAPAAAAPPPVAAPSVGAVPQAAVLPPVPGATIVPFTTMQAAVSKNMVESLAVPAFRVGYPIVTDKLDALYEKVKPKGVTMTVLLAKATAMALVQHPVVNASCRDGKSFTYNSNINIAVAVAIDGGLITPVLQDADKLDIYLLSQNWKDLVKKARAKQLQPNEYSSGTFTLSNLGMFGVDRFDAILPPGQGAIMAVGASKPTVVADKDGFFSVKSKMLVNVTADHRIVYGADLAAFLQTFAKIIEDPESLTL

SEQ ID NO: 6083 - DNA, 1161 bp, Sorghum bicolor
  misc_feature: Ceres ANNOT ID no. 6064067
  misc_feature: Encodes the peptide sequence at SEQ ID NO 6084
atggcggccccgccccgcgccaccgcggtcctcgcgtggggttccggggaggacggacagctgggcatgggagggaacgaggagaaggactgggcccactgcgtggaggcgctggccccctacgccgtcaccgccgtcgtcgccggcagccgcaactccctcgccatctgcgacgacggccgcctcttcacttgggggtggaaccagcgcggcacgctcgggcacccgccggagaccaagacggagagctccccgggccccgtcaacgacctcgcgggtgtcaagatcgtccaggcggcgattggcgggtggcattgcctcgcagttgacgacaaggggcgcgcctacgcctggggggggaacgagtacgggcagtgcggtgaggagccccagaggacggaggacgggacgagggcgctctggagggacatcccgaccccaaggcgctgcgcgcccaagctcaaagtccggcaagtagctgctggagggacacattcagtggttttgactcaagaaggtcacgtctggtcatggggacagccatgcaagcaaatatctaaaccagtacgtgtgcaagggcttgagaaagtgagggtcattgctgtaggtgcattccataatttggcactaacagaggatggaattttgtgggcatggggtagtaatgagtatggtcagctggggactggagatacccaaccaagatcacagccgatacgtgtcgaaggactatctgatctctcactggttgacattgctgctggaggctggcattcaactgcactaactatagagggagaggtgtatgcttgggggagaggagagcatgggaggcttggatttggagatgataagagtagtcgcatggtgcccctaaaggttgagctcctcgctggagaaaatattgttcaggtgtcatgtggaggaacacattcagttgcgctaactcaagatggccggatgttttcttatgggaggggcgaccatggccgtctgggctacggcaggaaggtgacgacggggcaccccatggaagtgcccatcgacctgccgccgcccaagagcagcagcaaccccgacgggcagtggcaggccaagtacgtggcttgtggcgggcggcacaccctggctatcgcggagtggacagagcccaccgactga

SEQ ID NO: 6084 - protein, 386 aa, Sorghum bicolor
  misc_feature: Ceres ANNOT ID no. 6064067
  misc_feature (59)..(109): Pfam Id: RCC1 Pfam Desc: Regulator of chromosome condensation (RCC1)
  misc_feature (213)..(262): Pfam Id: RCC1 Pfam Desc: Regulator of chromosome condensation (RCC1)
  misc_feature (265)..(315): Pfam Id: RCC1 Pfam Desc: Regulator of chromosome condensation (RCC1)
  misc_feature (7)..(381): NCBI GI: 9755650 NCBI Desc: uvb-resistance protein-like [arabidopsis thaliana]
  misc_feature (7)..(381): NCBI GI: 21537357 NCBI Desc: uvb-resistance protein-like [arabidopsis thaliana]
  misc_feature (7)..(305): NCBI GI: 79295482 NCBI Desc: ran gtpase binding / chromatin binding [arabidopsis thaliana]
  misc_feature (7)..(181): NCBI GI: 28416625 NCBI Desc: at3g02510 [arabidopsis thaliana]
  misc_feature (154)..(384): NCBI GI: 89286132 NCBI Desc: regulator of chromosome condensation (rcc1) [tetrahymena thermophila sb210]
MAAPPRATAVLAWGSGEDGQLGMGGNEEKDWAHCVEALAPYAVTAVVAGSRNSLAICDDGRLFTWGWNQRGTLGHPPETKTESSPGPVNDLAGVKIVQAAIGGWHCLAVDDKGRAYAWGGNEYGQCGEEPQRTEDGTRALWRDIPTPRRCAPKLKVRQVAAGGTHSVVLTQEGHVWSWGQPCKQISKPVRVQGLEKVRVIAVGAFHNLALTEDGILWAWGSNEYGQLGTGDTQPRSQPIRVEGLSDLSLVDIAAGGWHSTALTIEGEVYAWGRGEHGRLGFGDDKSSRMVPLKVELLAGENIVQVSCGGTHSVALTQDGRMFSYGRGDHGRLGYGRKVTTGHPMEVPIDLPPPKSSSNPDGQWQAKYVACGGRHTLAIAEWTEPTD

SEQ ID NO: 6085 - DNA, 819 bp, Sorghum bicolor
  misc_feature: Ceres ANNOT ID no. 6064185
  misc_feature: Encodes the peptide sequence at SEQ ID NO 6086
atgtcatattacgaaagaaggggtggagataggggtagtggccgtattcaaggaagtggtgggcgaggtggacatgtcctgcgtggaagatcaggattgcctccccgaggacctcttggggttaactcccgtccatctgcacgcactattgctaagtcatttagcagaaccaaagacatgacctggagacctgatctatttagtgatagcatggcggctagtggaatagaaactggtacaaaattgtacatttcaaacttggactatggggtttctaatgaggatataaaggagctgttttcggaagttggccatttgaaacgctttgctgttcactatgatggttatggccgcccaaatggcactgcagaggtggtgtttacacgaaggagcgatgcaattgctgcactgaagcgttacaataatgttctacttgatggaaaagctatgaagatagaagtcattggaagtgacttaggcttgcctatgacacctcgtataaatgtcgttggtgcttctaatggcagagctacaagaacagttgttatgacgcctgagtttagtcaacgtggcaggggttcaagcagtagacctctaagtaatccaagcaacaggtttaacaaccgtggtggtttccaagctggtcgaggccgtggccagttccaggcccgtggcaggggccgtggccagttccagagccggggcaggggccgtggccagttccagggccgtggcagagggaggaagcctgagaagactgcagatgagttggataaagacctggaaagctatcacgcagaggccatgaaaaccgattga

SEQ ID NO: 6086 - protein, 272 aa, Sorghum bicolor
  misc_feature: Ceres ANNOT ID no. 6064185
  misc_feature (82)..(152): Pfam Id: RRM_1 Pfam Desc: RNA recognition motif. (a.k.a. RRM, RBD, or RNP domain)
  misc_feature (6)..(271): NCBI GI: 94466659 NCBI Desc: aly protein [nicotiana benthamiana]
  misc_feature (7)..(271): NCBI GI: 9663025 NCBI Desc: dip2 protein [arabidopsis thaliana]
  misc_feature (7)..(269): NCBI GI: 9663023 NCBI Desc: dip1 protein [arabidopsis thaliana]
  misc_feature (52)..(271): NCBI GI: 46982390 NCBI Desc: hin19 [nicotiana tabacum]
  misc_feature (28)..(230): NCBI GI: 51490665 NCBI Desc: aly protein [nicotiana benthamiana]
  misc_feature: Useful for making plants with altered alkaloid content
  misc_feature: GREAT-hit functional homolog of the protein sequence given in SEQ ID NO 13119
  misc_feature: Useful for making plants with altered alkaloid content
  misc_feature: Functional homolog of the protein sequence given in SEQ ID NO 13119
  misc_feature: Useful for making plants with modulated biomass
  misc_feature: Functional homolog of the protein sequence given in SEQ ID NO 13041
  misc_feature: The sequence is a functional homolog of SEQ ID NO. 458 in the 11/188,298 US application
MSYYERRGGDRGSGRIQGSGGRGGHVLRGRSGLPPRGPLGVNSRPSARTIAKSFSRTKDMTWRPDLFSDSMAASGIETGTKLYISNLDYGVSNEDIKELFSEVGHLKRFAVHYDGYGRPNGTAEVVFTRRSDAIAALKRYNNVLLDGKAMKIEVIGSDLGLPMTPRINVVGASNGRATRTVVMTPEFSQRGRGSSSRPLSNPSNRFNNRGGFQAGRGRGQFQARGRGRGQFQSRGRGRGQFQGRGRGRKPEKTADELDKDLESYHAEAMKTD

SEQ ID NO: 6087 - DNA, 2583 bp, Sorghum bicolor
  misc_feature: Ceres ANNOT ID no. 6064188
  misc_feature: Encodes the peptide sequence at SEQ ID NO 6088
atgcggcggacgaggagccagtccgcgagcggggggaacaccccgcccgctgccggaccaagcgcggaggtcgccggtcgccggagggcttcgcctgccgcgaaagggaaatcgcctgccaccaaggtggaaacagcatcgccactgaggaatgcacgcagaaaaggtagacccaagactgagtcgaaagataattccagtgtggaaacgtgtagtgcggggagctgtgacaagaacaatttggaggaacaaacagaatcccttgataataatgatgcagctgaaatggactgggaagaggggcacctggagaagattgagtactccgatgagctcagagagaccatcactgttgagttcaacgacgtaccttcttccactaacaagaagagtgttcggaggcccactgctgaggaaaaggagttggctgaacttgttcacaaggtccatttgctttgcctaatagcaaggggtagagtaattgacaaggcttgcgatgatactcttattcaggcctcagttctctctcttgtaccgtaccacttactatggggtctttcagatgttccaaacctgaaagctgttaacctacgtagtcttgtgagctggttccatcgtactttttgtgtaactgcacaatccactgacaggggatcttttaaatcaaatttggctttcactattcaagaccatgtaggcactgctgaagaggtttgtgcactttctgtggcattattcagggcactcaacttaacagctaggtttgttacaaatctggatgttgctggactcaagcctgatactaaagtgaagggaacattcagtcaagatgcatctaggctttgtactagggcactaccatgtagttctcctttttccgatgataatatgattactactcctgctctaatgaaagataattctcaaggtagtgtcagcatgaatcaacaaagaggtgatcttggaaaattgaaacaggactcagcatgcaagagaagtttatctaaaactttgtcagtcataaaatcagatcatgaaagtagctgtgcatcaacatcaaaagataaatcagccagcaaccaatttccttccagtaatgatgctgaagtaccaaaaagaaaaggggatgtggaatttgagttgcaactggaaatggctctttcagctactgctgccgaaacccaaaatagtaaactagctactcacatgagtcaatcgactgttagcttacaaaattccagtccaccattgaagaaaatgcgtcaaaatgtggaagctgtatccagctcaagtgcaatttggtcaagaagtgctggagctccgctatattgggccgaggtatactgtggtgggcaagcatcaacaggaagatgggtgcatgttgatgttgtgaatgatctcattgatgctgaacggaaagtagaaacttcttctgctgtttgcaagaagcctttaagatatgttgttgcttttgctggaaatggagccaaggatgtaaccagaaggtattgcttgcagtggcacagaattgcacagggcagagtgaattcagagtggtgggataatgttttggcaccactaaaacatatggaactggcagcaacaaacaactatgaagacatggaacttcaaaccagagcccttacagagcctcttcctaccaatcaacaggcatacaaagaccatcacctatatgctcttgagaagtggcttcacaagaaccaaattcttcaccccaaaggtccagttcttggcttctgcaaaggacatcctgtttatccaagatcctgtgttcaaacactgcagtcaagacatggatggttgcgggagggcctgcaagtccgagaaaatgagttggctgcaaaggttgttacacgtccaaagaggactttcaatgctcagtcggttcaatcaagtggtaacgaagatggtcttaaaccaaccttggaactatatggtgaatggcaactggaacctctacagcttccccatgctgtaaatggcgttgtgccaaagaatgaacgaggccaagttgatgtatggtcagagaaatgccttccgcctggtactgtacacttgaggttaccaagattattccaggttgcaaagagacttggcatcgactatgctcctgccatggtcgggtttgattatcgcagtggtcggtgcctccctgtctttgatgggattgttgtctgtaccgaattcaaaagtgctatcctggaggcatatgcagaagaagaggagcggagacaagctgaggagaggaagcaggaggaggctcaggcactctccagatggtatcagctgctctgctccattgtaacaagacagaggttgaaggactcctacaaaacaccttcacacgggtttggtaaccaagggctgcccgaaaatgatagcacccatagaagcactcgcagcagtcgatccttggagagggagcctagttcaagcaaaccgcagacagatcatgaccatgagcatgaatttccagaggaagaccagagctttgatgaggagacctttgtgaggacaaaacgctgcccatgtggtttttctatccaagtagaggagttgtag

SEQ ID NO: 6088 - protein, 860 aa, Sorghum bicolor
  misc_feature: Ceres ANNOT ID no. 6064188
  misc_feature (402)..(785): Pfam Id: Rad4 Pfam Desc: DNA repair protein Rad4
  misc_feature (536)..(860): NCBI GI: 124360071 NCBI Desc: dna repair protein rad4 [medicago truncatula]
  misc_feature (329)..(830): NCBI GI: 30931143 NCBI Desc: xpc protein [mus musculus]
  misc_feature (329)..(830): NCBI GI: 15487337 NCBI Desc: xeroderma pigmentosum group c protein [mus musculus]
  misc_feature (329)..(830): NCBI GI: 1276473 NCBI Desc: xeroderma pigmentosum group c
  misc_feature (343)..(830): NCBI GI: 9438106 NCBI Desc: xeroderma pigmentosum group c protein [homo sapiens]
MRRTRSQSASGGNTPPAAGPSAEVAGRRRASPAAKGKSPATKVETASPLRNARRKGRPKTESKDNSSVETCSAGSCDKNNLEEQTESLDNNDAAEMDWEEGHLEKIEYSDELRETITVEFNDVPSSTNKKSVRRPTAEEKELAELVHKVHLLCLIARGRVIDKACDDTLIQASVLSLVPYHLLWGLSDVPNLKAVNLRSLVSWFHRTFCVTAQSTDRGSFKSNLAFTIQDHVGTAEEVCALSVALFRALNLTARFVTNLDVAGLKPDTKVKGTFSQDASRLCTRALPCSSPFSDDNMITTPALMKDNSQGSVSMNQQRGDLGKLKQDSACKRSLSKTLSVIKSDHESSCASTSKDKSASNQFPSSNDAEVPKRKGDVEFELQLEMALSATAAETQNSKLATHMSQSTVSLQNSSPPLKKMRQNVEAVSSSSAIWSRSAGAPLYWAEVYCGGQASTGRWVHVDVVNDLIDAERKVETSSAVCKKPLRYVVAFAGNGAKDVTRRYCLQWHRIAQGRVNSEWWDNVLAPLKHMELAATNNYEDMELQTRALTEPLPTNQQAYKDHHLYALEKWLHKNQILHPKGPVLGFCKGHPVYPRSCVQTLQSRHGWLREGLQVRENELAAKVVTRPKRTFNAQSVQSSGNEDGLKPTLELYGEWQLEPLQLPHAVNGVVPKNERGQVDVWSEKCLPPGTVHLRLPRLFQVAKRLGIDYAPAMVGFDYRSGRCLPVFDGIVVCTEFKSAILEAYAEEEERRQAEERKQEEAQALSRWYQLLCSIVTRQRLKDSYKTPSHGFGNQGLPENDSTHRSTRSSRSLEREPSSSKPQTDHDHEHEFPEEDQSFDEETFVRTKRCPCGFSIQVEEL

SEQ ID NO: 6089 - DNA, 963 bp, Sorghum bicolor
  misc_feature: Ceres ANNOT ID no. 6064228
  misc_feature: Encodes the peptide sequence at SEQ ID NO 6090
atggcgagcctgacggtgccgccggtgccgacgtggccacggcaggacgcgatcgacctccacaaggcgttccgcgggttcggctgcgacagcacgacggtgatcagcatcctggcgcaccgcgacgcggcgcagcgcgcggcgatcgcccaggagtaccgcgccgtgttcaaccaggacctcgcccgccgtctcgcgtcggagctcagcggcaaccacaagcgcgccatgctgctgtgggtcctggacccggcgacgcgcgacgccaccgtcctgaagcaggccctgacgggcgacgtcaccgacctgcgcgccgccacggaggtggtctgctcgcggacgccgtcgcagctggcggtggtgcggcacgcgtaccgcgccaggttcggctgccacctcgagcacgacgtgacggagcggacctccggcgaccaccagcggctcctgctcgcgtacctggccgtcccgcgcgccgagggcggcgcggtggtggtggacgcgtcgacggtggcgctggacgcgcgcgacctctacaaggccggcgagcggcggctgggcacggacgagcgcgccttcatccgcgtcttcagcgagcggagctggccgcacatggcggcggtggcgcgcgcgtaccaccacatgtacgaccggtccctggagagcgccgtcaagagcgagacgtcgggtaacttcggcttcggcctcctcaccgtgctccggtgcgccgacagccccgccaggtacttcgccggggtgctgcacaaggccatgaaagggctgggcacctcggactcgacgctcatcagggtcgtcgtcaccagggccgagatcgacatgcagtacatcaaggcggagtatcaccggatgtacaagcgctcgctcgccgacgccatccacgccgagacgtccggcaactaccgaaccttcctcctctccctcgtcggccgcgaccgaacctactga

SEQ ID NO: 6090 - protein, 320 aa, Sorghum bicolor
  misc_feature: Ceres ANNOT ID no. 6064228
  misc_feature (15)..(80): Pfam Id: Annexin Pfam Desc: Annexin
  misc_feature (87)..(152): Pfam Id: Annexin Pfam Desc: Annexin
  misc_feature (172)..(238): Pfam Id: Annexin Pfam Desc: Annexin
  misc_feature (248)..(313): Pfam Id: Annexin Pfam Desc: Annexin
  misc_feature (1)..(318): NCBI GI: 38606205 NCBI Desc: annexin [triticum aestivum]
  misc_feature (1)..(309): NCBI GI: 3881978 NCBI Desc: annexin-like protein [medicago sativa]
  misc_feature (1)..(315): NCBI GI: 18408941 NCBI Desc: annexin 5 (ann5) [arabidopsis thaliana]
  misc_feature (1)..(315): NCBI GI: 12667520 NCBI Desc: calcium-binding protein annexin 5 [arabidopsis thaliana]
  misc_feature (15)..(314): NCBI GI: 23956196 NCBI Desc: annexin a13 [mus musculus]
MASLTVPPVPTWPRQDAIDLHKAFRGFGCDSTTVISILAHRDAAQRAAIAQEYRAVFNQDLARRLASELSGNHKRAMLLWVLDPATRDATVLKQALTGDVTDLRAATEVVCSRTPSQLAVVRHAYRARFGCHLEHDVTERTSGDHQRLLLAYLAVPRAEGGAVVVDASTVALDARDLYKAGERRLGTDERAFIRVFSERSWPHMAAVARAYHHMYDRSLESAVKSETSGNFGFGLLTVLRCADSPARYFAGVLHKAMKGLGTSDSTLIRVVVTRAEIDMQYIKAEYHRMYKRSLADAIHAETSGNYRTFLLSLVGRDRTY

SEQ ID NO: 6091 - DNA, 1518 bp, Sorghum bicolor
  misc_feature: Ceres ANNOT ID no. 6064251
  misc_feature: Encodes the peptide sequence at SEQ ID NO 6092
atggccacgccagcgatggtcccgctgcggcagctcttcgtcgacggcgagtggcgcccgcccgcgcagggccgccgcctccccgtcgtcaaccccacaaccgaggcccacatcggcgagatcccggcgggcaccgcggaggatgtggacgccgcggtggctgcggcgcgggcggcgctcaagaggaaccgcggccgtgactgggcgcgcgcgccgggggccgtccgggccaagtacctgcgcgccatcgccgccaaggtaattgagaggaaacctgagctggctaagctagaggcacttgattgtgggaagccttacgatgaagccgtatgggacatggatgatgttgctgggtgctttgagtactttgcggatcaggcagaagccttggacaaaaggcaaaattccccagtttctcttccaatggaaacttttaaatgccacctccggagagagcctattggggtagttgggctgataactccttggaactatcctctcctgatggctacatggaaggtagctcctgctctggctgctggttgtacagctgtgctaaagccatctgaattggcttctgtgacttgcttagagcttgctgatatctgtaaagaagtcggtcttccttccggtgtcttgaacattgtgacaggattaggtcctgatgctggtgctcctttgtcagggcacccagatgttgacaaggttccctttactgggaattttgaaactggaaagaagattatggcaactgcagctcctatggtcaagcctgttacactggaacttggtggaaaaagtcctatagtagtatttgatgatgttgacattgacaaagctgttgagtggactctgtttgggtgcttttggaccaatggtcagatttgcagcgcaacatctcgtcttcttatccatacaaaaattgctaaagaatttaatgagaggatggttgcatgggccaaaaatattaaggtttcggatccacttgaagagggttgcagacttgggccagttgttagtgaaggacagtatgagaagattaagaagttcatatcgaatgccaaaagcgaaggtgctactattctgaccggaggtgttagaccggcgcatcttgagaaggggttctttattgaaccaacaattattactgatatcaccacatcaatggaaatctggagggaggaagtctttggtccagtcctgtgtgttaaagaatttagcactgaagatgaagccattgaactggccaacgatacacagtatggtttggctggtgctgtaatttctggtgatcgtgagcgctgccagagattatctgaggagatcgatgctggatgtatctgggtaaactgctcacaaccctgcttctgccaagctccctggggtgggaacaagcgcagtggatttggacgtgagcttggagaagggggcattgataactacctgagcgtcaagcaagtcacggagtacatctctgatgagccgtggggttggtaccaatccccctccaagctgtaa

SEQ ID NO: 6092 - protein, 505 aa, Sorghum bicolor
  misc_feature: Ceres ANNOT ID no. 6064251
  misc_feature (18)..(487): Pfam Id: Aldedh Pfam Desc: Aldehyde dehydrogenase family
  misc_feature (1)..(505): NCBI GI: 50086699 NCBI Desc: betaine aldehyde dehydrogenase [zea mays]
  misc_feature (1)..(505): NCBI GI: 50950087 NCBI Desc: betaine aldehyde dehydrogenase [zoysia tenuifolia]
  misc_feature (1)..(505): NCBI GI: 50950097 NCBI Desc: betaine aldehyde dehydrogenase [zoysia tenuifolia]
  misc_feature (1)..(505): NCBI GI: 50950081 NCBI Desc: betaine aldehyde dehydrogenase [zoysia tenuifolia]
  misc_feature (2)..(505): NCBI GI: 50950083 NCBI Desc: betaine aldehyde dehydrogenase [zoysia tenuifolia]
  misc_feature (1)..(503): SWISSPROT Homolog: EC 1.2.1.8 Betaine aldehyde dehydrogenase 1, chloroplast precursor
  misc_feature: The sequence is a functional homolog of SEQ ID NO. 428 in the 11/188,298 US application
  misc_feature: The sequence is a functional homolog of SEQ ID NO. 304 in the 11/188,298 US application
  misc_feature: The sequence is a functional homolog of SEQ ID NO. 475 in the 11/188,298 US application
  misc_feature: The sequence is a functional homolog of SEQ ID NO. 437 in the 11/188,298 US application
  misc_feature: The sequence is a functional homolog of SEQ ID NO. 537 in the 11/188,298 US application
  misc_feature: The sequence is a functional homolog of SEQ ID NO. 477 in the 11/188,298 US application
  misc_feature: The sequence is a functional homolog of SEQ ID NO. 442 in the 11/188,298 US application
  misc_feature: The sequence is a functional homolog of SEQ ID NO. 435 in the 11/188,298 US application
MATPAMVPLRQLFVDGEWRPPAQGRRLPVVNPTTEAHIGEIPAGTAEDVDAAVAAARAALKRNRGRDWARAPGAVRAKYLRAIAAKVIERKPELAKLEALDCGKPYDEAVWDMDDVAGCFEYFADQAEALDKRQNSPVSLPMETFKCHLRREPIGVVGLITPWNYPLLMATWKVAPALAAGCTAVLKPSELASVTCLELADICKEVGLPSGVLNIVTGLGPDAGAPLSGHPDVDKVPFTGNFETGKKIMATAAPMVKPVTLELGGKSPIVVFDDVDIDKAVEWTLFGCFWTNGQICSATSRLLIHTKIAKEFNERMVAWAKNIKVSDPLEEGCRLGPVVSEGQYEKIKKFISNAKSEGATILTGGVRPAHLEKGFFIEPTIITDITTSMEIWREEVFGPVLCVKEFSTEDEAIELANDTQYGLAGAVISGDRERCQRLSEEIDAGCIWVNCSQPCFCQAPWGGNKRSGFGRELGEGGIDNYLSVKQVTEYISDEPWGWYQSPSKL

SEQ ID NO: 6093 - DNA, 882 bp, Sorghum bicolor
  misc_feature: Ceres ANNOT ID no. 6064272
  misc_feature: Encodes the peptide sequence at SEQ ID NO 6094
atgctgctgaacccggcgtcggaggcgttggtgctggacaccatccggcagcacctgctggaggagccagcggcggcggcggcgggggacgagagcttcgggagcctggtggcggaccagtggagcggctcgctcccgttccgcaccgacgacgccgacgacatggtggtgttcggggcgctgcaggacgccttcgcctacggctggctgcccgacggctccttcgcgcacgtcaagcccgagccggcgctgtccccggactcccactcctactcctactcctacgacggctcctcctgctgcttcggcggcctcctcctggacccggcggagccgctgacgcccagcagcgaggcggccgccacgcccaggcgggaggcggccgcggcggccgtggccaggggcaagcactaccgaggggtcaggcagcggccgtggggcaagttcgcggcggagatcagggaccccgccaagaacggcgcgcgcgtctggctcgggacctacgacaccgccgaggacgccgcgctcgcctacgaccgcgccgcctaccgcatgcgcggctcccgcgcgctcctcaacttcccgctccgcatcggctccgagatcgccgccgcggccaccgccggggacaagcggccgtcgcccgagcccgccacctcctcctcggactcgtccttctcgtcctgctcctccaccacctcctcgtcttcgaccagcggctcgcccaagaggcggaagcgaggcgaggccgccgccgccaacatggccatggcgctggtgcccccgccttcccagctgaaccggccggcccagccttggttccctgccgcgccggtcgagcaggcggcgatggcgccgcgcgtggagcagctcgtcatctag

SEQ ID NO: 6094 - protein, 293 aa, Sorghum bicolor
  misc_feature: Ceres ANNOT ID no. 6064272
  misc_feature (136)..(188): Pfam Id: AP2 Pfam Desc: AP2 domain
  misc_feature (2)..(293): NCBI GI: 70663974 NCBI Desc: osjnba0079a21.16 [oryza sativa (japonica cultivar-group)]
  misc_feature (2)..(293): NCBI GI: 116310255 NCBI Desc: osigba0101c23.15 [oryza sativa (indica cultivar-group)]
  misc_feature (1)..(281): NCBI GI: 56567585 NCBI Desc: bth-induced erf transcriptional factor 3 [oryza sativa (indica cultivar-group)]
  misc_feature (1)..(281): NCBI GI: 113537145 NCBI Desc: os02g0654700 [oryza sativa (japonica cultivar-group)]
  misc_feature (111)..(251): NCBI GI: 1208498 NCBI Desc: ethylene-responsive element binding protein [nicotiana tabacum]
  misc_feature: The plant flowers significantly late compared to wild-type.
  misc_feature: The plant is abnormally large.
  misc_feature: The sequence is a functional homolog of SEQ ID NO 10 in the 10/412,699US patent application
  misc_feature: The sequence is a functional homolog of SEQ ID NO 100 in the 10/412,699US patent application
  misc_feature: The sequence is a functional homolog of SEQ ID NO 1000 in the 10/412,699US patent application
  misc_feature: The sequence is a functional homolog of SEQ ID NO 124 in the 11/479,226US patent application
  misc_feature: The sequence is a functional homolog of SEQ ID NO 1291 in the 10/374,780US patent application
  misc_feature: The sequence is a functional homolog of SEQ ID NO 1356 in the 10/666,642US patent application
  misc_feature: The sequence is a functional homolog of SEQ ID NO 1726 in the 10/412,699US patent application
  misc_feature: The sequence is a functional homolog of SEQ ID NO 191 in the 11/479,226US patent application
  misc_feature: The sequence is a functional homolog of SEQ ID NO 2230 in the 10/374,780US patent application
  misc_feature: The sequence is a functional homolog of SEQ ID NO 243 in the 11/479,226US patent application
  misc_feature: The sequence is a functional homolog of SEQ ID NO 50 in the 10/412,699US patent application
  misc_feature: The sequence is a functional homolog of SEQ ID NO 501 in the 10/374,780US patent application
  misc_feature: The sequence is a functional homolog of SEQ ID NO 503 in the 10/374,780US patent application
  misc_feature: The sequence is a functional homolog of SEQ ID NO 788 in the 10/225,066US patent application
  misc_feature: Useful for making plants with altered Lignin content
  misc_feature: Useful for making plants with altered alkaloid content
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated drought sensitivity
  misc_feature: GREAT-hit functional homolog of the protein sequence given in SEQ ID NO 12879
  misc_feature: Functional homolog of the protein sequence given in SEQ ID NO 13224
  misc_feature: Functional homolog of the protein sequence given in SEQ ID NO 13226
  misc_feature: Functional homolog of the protein sequence given in SEQ ID NO 13230
  misc_feature: Functional homolog of the protein sequence given in SEQ ID NO 13265
  misc_feature: Functional homolog of the protein sequence given in SEQ ID NO 13268
  misc_feature: The sequence is a functional homolog of SEQ ID NO 10 in the 20040045049 US patent application
  misc_feature: The sequence is a functional homolog of SEQ ID NO 100 in the 20040045049 US patent application
  misc_feature: The sequence is a functional homolog of SEQ ID NO 1000 in the 20040045049 US patent application
  misc_feature: The sequence is a functional homolog of SEQ ID NO 1726 in the 20040045049 US patent application
  misc_feature: The sequence is a functional homolog of SEQ ID NO 1291 in the 20060162006 US patent application
  misc_feature: The sequence is a functional homolog of SEQ ID NO 503 in the 20060162006 US patent application
  misc_feature: The sequence is a functional homolog of SEQ ID NO 1000 in the 10/412,699 US patent application
  misc_feature: The sequence is a functional homolog of SEQ ID NO 501 in the 10/374,780 US patent application
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 1466 in the 10/666,642 US patent application
  misc_feature: The sequence is a functional homolog of SEQ ID NO 2136 in the 10/374,780 US patent application
  misc_feature: The sequence is a functional homolog of SEQ ID NO 36 in the 10/714,887 US patent application
  misc_feature: The sequence is a functional homolog of SEQ ID NO 36 in the 11/435,388 US patent application
  misc_feature: The sequence is a functional homolog of SEQ ID NO 368 in the 10/225,066 US patent application
  misc_feature: The sequence is a functional homolog of SEQ ID NO 6 in the 10/903,236 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: Useful for making plants with altered lignin content
  misc_feature: Functional homolog of the protein sequence given in SEQ ID NO 13219
MLLNPASEALVLDTIRQHLLEEPAAAAAGDESFGSLVADQWSGSLPFRTDDADDMVVFGALQDAFAYGWLPDGSFAHVKPEPALSPDSHSYSYSYDGSSCCFGGLLLDPAEPLTPSSEAAATPRREAAAAAVARGKHYRGVRQRPWGKFAAEIRDPAKNGARVWLGTYDTAEDAALAYDRAAYRMRGSRALLNFPLRIGSEIAAAATAGDKRPSPEPATSSSDSSFSSCSSTTSSSSTSGSPKRRKRGEAAAANMAMALVPPPSQLNRPAQPWFPAAPVEQAAMAPRVEQLVI

SEQ ID NO: 6095 - DNA, 678 bp, Sorghum bicolor
  misc_feature: Ceres ANNOT ID no. 6064276
  misc_feature: Encodes the peptide sequence at SEQ ID NO 6096
atggtgaagcggtggctccccctcgaggccaatcccgacgtcatgaaccagttcatgtggggactgggggtccccgaggacgtggggttctgcgatgtgtacggcctcgatgacgagttgctcgccatggtgccccagccggtgctcgcagtcatacttctctaccctcaggaccggatcaaggaatcccaagcttcagctacctcgtcggtggagaccaaggagcccagcaagaatgtatatttcacaaaacaaactgttgggaacgcctgtggcacagttggtattattcatgcactggggaatgctacttccagaatcaagctagctgaggggtcatatttcgatagattttataaacgaactgctgacatggatcctagccagcgtgctacatttcttgaggaggacgaggaaatggagaatgctcattccattaccgctactgctggtgacacagaggccaaggatggagtaattgaacattacatttgtttctcttgcgtcgatggagaactttatgagcttgatggggggacatcacagccaataccccatgggccttccactcctgataccttgttgcaggatgctgcaaaagttataaaagcaagactttccatgtattcccagtcaaacaacttcaatgtcatggctctttcaggcaaagtgatatag

SEQ ID NO: 6096 - protein, 225 aa, Sorghum bicolor
  misc_feature: Ceres ANNOT ID no. 6064276
  misc_feature (4)..(209): Pfam Id: Peptidase_C12 Pfam Desc: Ubiquitin carboxyl-terminal hydrolase, family 1
  misc_feature (1)..(221): NCBI GI: 116310252 NCBI Desc: osigba0101c23.12 [oryza sativa (indica cultivar-group)]
  misc_feature (1)..(225): NCBI GI: 49388197 NCBI Desc: carboxyl-terminal proteinase-like [oryza sativa (japonica cultivar-group)]
  misc_feature (18)..(223): NCBI GI: 144924704 NCBI Desc: helix-turn-helix, arac type; peptidase c12, ubiquitin carboxyl-terminal hydrolase 1 [medicago truncatula]
  misc_feature (3)..(223): NCBI GI: 32488373 NCBI Desc: osjnba0043a12.3 [oryza sativa (japonica cultivar-group)]
  misc_feature (3)..(223): NCBI GI: 116308860 NCBI Desc: h1005f08.26 [oryza sativa (indica cultivar-group)]
MVKRWLPLEANPDVMNQFMWGLGVPEDVGFCDVYGLDDELLAMVPQPVLAVILLYPQDRIKESQASATSSVETKEPSKNVYFTKQTVGNACGTVGIIHALGNATSRIKLAEGSYFDRFYKRTADMDPSQRATFLEEDEEMENAHSITATAGDTEAKDGVIEHYICFSCVDGELYELDGGTSQPIPHGPSTPDTLLQDAAKVIKARLSMYSQSNNFNVMALSGKVI

SEQ ID NO: 6097 - DNA, 618 bp, Sorghum bicolor
  misc_feature: Ceres ANNOT ID no. 6064284
  misc_feature: Encodes the peptide sequence at SEQ ID NO 6098
atggataacctttggatccctgcactgcacagagaccataccatggctcaagctcgcgtcgctctggctctgttgtgcgccctgctcctcgtcgccggcgtggcaccgagagccgaggcggtctcctacaacgtcggcaacagcgccgggtgggatcccagcgccgacttgccgtcgtgggccggcggcaaaaccttctacgtcggcgacgttctagtgtttcagtactccagctaccacacgctggacgaagtcgacgaggccgggtacaacaactgcagcgccgcggacgcggtcctgtcccagaacgacggcaacacgacggtgccgctggcggcggccggcgaccggtacttcatctgcggcaaccagctgcactgcctgggcgggatgaagctgcacgtgctggtcaaccagccggcggcgggaggaggagctccggcgggcgccccgccgcagtcgccgccgcagacgggctccggggccacccttgggcctcctaccaccgacgacgacgcgggcatcccctacctcgtgctcggcgggtcccaccgagctacggtaggccccttgctggtgacctggctgctcgtattagcagcggctctgattgtatga

SEQ ID NO: 6098 - protein, 205 aa, Sorghum bicolor
  misc_feature: Ceres ANNOT ID no. 6064284
  misc_feature (51)..(131): Pfam Id: Cu_bind_like Pfam Desc: Plastocyanin-like domain
  misc_feature (15)..(205): NCBI GI: 38345959 NCBI Desc: osjnbb0038f03.17 [oryza sativa (japonica cultivar-group)]
  misc_feature (15)..(205): NCBI GI: 116310246 NCBI Desc: osigba0101c23.6 [oryza sativa (indica cultivar-group)]
  misc_feature (28)..(176): NCBI GI: 14140127 NCBI Desc: uclacyanin 3-like protein [oryza sativa]
  misc_feature (22)..(161): NCBI GI: 38260658 NCBI Desc: cu2+ plastocyanin-like [olimarabidopsis pumila]
  misc_feature (22)..(155): NCBI GI: 38260640 NCBI Desc: cu2+ plastocyanin-like [capsella rubella]
MDNLWIPALHRDHTMAQARVALALLCALLLVAGVAPRAEAVSYNVGNSAGWDPSADLPSWAGGKTFYVGDVLVFQYSSYHTLDEVDEAGYNNCSAADAVLSQNDGNTTVPLAAAGDRYFICGNQLHCLGGMKLHVLVNQPAAGGGAPAGAPPQSPPQTGSGATLGPPTTDDDAGIPYLVLGGSHRATVGPLLVTWLLVLAAALIV

SEQ ID NO: 6099 - DNA, 801 bp, Sorghum bicolor
  misc_feature: Ceres ANNOT ID no. 6064287
  misc_feature: Encodes the peptide sequence at SEQ ID NO 6100
atggaacagaacgccggctcgttcctcgccgtgcgtcgcctctccggcggcgccatccaccacaatcgccaccactcttcgcccgctgaggtcgtgggcgtgtccacggcgtggctcgggaaggggctttcgtgcgtctgcgcgcagaggagggagaccgatgcgcgcctctccttcgatttgagtcccattcaggaagagtgctttcataggttgcagaaccggatagaggtgcagtatgatggttcaaatttagagcatcagaaagcactggaagccctttggcgtgcttcttttcctggaactgaacttttaggattagtatcagaccagtggaaggagatgggatggcaagggaaagatccatctacagatttcaggggtggtggttttatatctttggagaatttactgtatttctctaggaactatccaaaatccttccaggagctcctttgtaagaagaatggtgatagagcattgtgggagtatccctttgctgtagctggtgtaaatattacattcatgctaattcagatgcttgatcttcaagcagctaagccaacgtcgttgattggagcagttttcctaaatctactgttagaaaatgatcgagcgtttgacattctttactgcataaccttcaaactgatggatcagaaatggcttgaaatgcacgccagttacatggatttcaatactgttattaaatctacacggcgccagctcgagagggagctgttgctagaagacatccagagaatcgaggacatgccatcatacaggtttctctcctgttag

SEQ ID NO: 6100 - protein, 266 aa, Sorghum bicolor
  misc_feature: Ceres ANNOT ID no. 6064287
  misc_feature (85)..(246): Pfam Id: ELMO_CED12 Pfam Desc: ELMO/CED-12 family
  misc_feature (1)..(264): NCBI GI: 38345956 NCBI Desc: osjnbb0038f03.14 [oryza sativa (japonica cultivar-group)]
  misc_feature (1)..(264): NCBI GI: 116310243 NCBI Desc: osigba0101c23.3 [oryza sativa (indica cultivar-group)]
  misc_feature (1)..(265): NCBI GI: 49387507 NCBI Desc: phagocytosis and cell motility protein elmo1-like [oryza sativa (japonica cultivar-group)]
  misc_feature (1)..(265): NCBI GI: 124359479 NCBI Desc: engulfment and cell motility, elm [medicago truncatula]
  misc_feature (1)..(265): NCBI GI: 17981659 NCBI Desc: at2g44770/f16b22.26 [arabidopsis thaliana]
MEQNAGSFLAVRRLSGGAIHHNRHHSSPAEVVGVSTAWLGKGLSCVCAQRRETDARLSFDLSPIQEECFHRLQNRIEVQYDGSNLEHQKALEALWRASFPGTELLGLVSDQWKEMGWQGKDPSTDFRGGGFISLENLLYFSRNYPKSFQELLCKKNGDRALWEYPFAVAGVNITFMLIQMLDLQAAKPTSLIGAVFLNLLLENDRAFDILYCITFKLMDQKWLEMHASYMDFNTVIKSTRRQLERELLLEDIQRIEDMPSYRFLSC

SEQ ID NO: 6101 - DNA, 747 bp, Sorghum bicolor
  misc_feature: Ceres ANNOT ID no. 6064289
  misc_feature: Encodes the peptide sequence at SEQ ID NO 6102
atggaggggagcagccagctgttggagacctgccttcctgctagtagcctctacgcgctcagtccgcatcatcctcttcttgccccgctgccgaaccagcacaagcttctgcagatgccgttggtccaggagcaggctgctgcgaataatcatggcgtgatgctctattcggaccaccaccaccacggcggcggcctcctgtacccgctgcttcttcccggcatcccgttctgccccttctccgccgccgccgacgccgccacctgcgataagaccaccaccaccggcggcttcgcggcgctcgatgccggcgaggcgggcacctcagtggcgaaagccgccggcgagatcgctagtaccaccaccacatgcaacggcccaagttcctgcaattggtggaagggcccggcggcggcgggggagaaaggcggacggatgaaggtgaggaggaagatgagggaacccaggttctgcttccagaccaggagcgacgtggatgtgctggacgacggctacaagtggaggaagtacggccagaaggttgtcaagaacagcctccatccaaggagctactaccggtgcacccacagcaactgccgcgtgaagaagcgagtggagaggctgtcggaggactgccgcatggtgatcaccacctacgagggccgccacacgcactccccctgcagcgacgacgccgacgccgccgccggcgaccacactggcagctgcgctttcacgtcgctctag

SEQ ID NO: 6102 - protein, 248 aa, Sorghum bicolor
  misc_feature: Ceres ANNOT ID no. 6064289
  misc_feature (168)..(227): Pfam Id: WRKY Pfam Desc: WRKY DNA -binding domain
  misc_feature (1)..(247): NCBI GI: 116310242 NCBI Desc: osigba0101c23.2 [oryza sativa (indica cultivar-group)]
  misc_feature (1)..(247): NCBI GI: 38345955 NCBI Desc: osjnbb0038f03.13 [oryza sativa (japonica cultivar-group)]
  misc_feature (1)..(247): NCBI GI: 115459728 NCBI Desc: os04g0545000 [oryza sativa (japonica cultivar-group)]
  misc_feature (25)..(247): NCBI GI: 14140117 NCBI Desc: wrky-like dna-binding protein [oryza sativa]
  misc_feature (137)..(247): NCBI GI: 46394322 NCBI Desc: tpa: wrky transcription factor 34 [oryza sativa]
  misc_feature: The sequence is a functional homolog of SEQ ID NO 10 in the 10/412,699US patent application
  misc_feature: The sequence is a functional homolog of SEQ ID NO 1017 in the 10/412,699US patent application
  misc_feature: The sequence is a functional homolog of SEQ ID NO 124 in the 11/479,226US patent application
  misc_feature: The sequence is a functional homolog of SEQ ID NO 204 in the 10/714,887US patent application
  misc_feature: The sequence is a functional homolog of SEQ ID NO 204 in the 11/435,388US patent application
  misc_feature: The sequence is a functional homolog of SEQ ID NO 22 in the 10/374,780US patent application
  misc_feature: The sequence is a functional homolog of SEQ ID NO 231 in the 11/479,226US patent application
  misc_feature: The sequence is a functional homolog of SEQ ID NO 521 in the 10/374,780US patent application
  misc_feature: The sequence is a functional homolog of SEQ ID NO 858 in the 10/225,066US patent application
  misc_feature: The sequence is a functional homolog of SEQ ID NO 88 in the 10/412,699US patent application
  misc_feature: Useful for making plants with modulated growth and phenotype characteristics
  misc_feature: The sequence is a functional homolog of SEQ ID NO 10 in the 20040045049 US patent application
  misc_feature: The sequence is a functional homolog of SEQ ID NO 1017 in the 20040045049 US patent application
  misc_feature: The sequence is a functional homolog of SEQ ID NO 88 in the 20040045049 US patent application
  misc_feature: The sequence is a functional homolog of SEQ ID NO 204 in the 20060015972 US patent application
  misc_feature: The sequence is a functional homolog of SEQ ID NO 1017 in the 10/412,699 US patent application
  misc_feature: The sequence is a functional homolog of SEQ ID NO 521 in the 10/374,780 US patent application
  misc_feature: The sequence is a functional homolog of SEQ ID NO 22 in the 10/374,780 US patent application
  misc_feature: The sequence is a functional homolog of SEQ ID NO 231 in the 11/479,226 US patent application
  misc_feature: The sequence is a functional homolog of SEQ ID NO 858 in the 10/225,066 US patent application
  misc_feature: The sequence is a functional homolog of SEQ ID NO 88 in the 10/412,699 US patent application
  misc_feature: The sequence is a functional homolog of SEQ ID NO 114 in the 11/375,241 US patent application
  misc_feature: The sequence is a functional homolog of SEQ ID NO 146 in the 10/286,264 US patent application
  misc_feature: The sequence is a functional homolog of SEQ ID NO 2500 in the 10/374,780 US patent application
  misc_feature: The sequence is a functional homolog of SEQ ID NO 672 in the 10/412,699 US patent application
MEGSSQLLETCLPASSLYALSPHHPLLAPLPNQHKLLQMPLVQEQAAANNHGVMLYSDHHHHGGGLLYPLLLPGIPFCPFSAAADAATCDKTTTTGGFAALDAGEAGTSVAKAAGEIASTTTTCNGPSSCNWWKGPAAAGEKGGRMKVRRKMREPRFCFQTRSDVDVLDDGYKWRKYGQKVVKNSLHPRSYYRCTHSNCRVKKRVERLSEDCRMVITTYEGRHTHSPCSDDADAAAGDHTGSCAFTSL

SEQ ID NO: 6103 - DNA, 1470 bp, Sorghum bicolor
  misc_feature: Ceres ANNOT ID no. 6064290
  misc_feature: Encodes the peptide sequence at SEQ ID NO 6104
atgccccgacccaagcctggaagcggcggcggcggcggcggctggctctcagggtgggggtgggacctcatgctcggatcgattgccgcgttctacgccgtcatggcgccctacaccaaggtggaggagagcttcaacgtgcaggccatgcatgatattctttatcacacttatcacatcgagaagtatgatcatttagaatttcctggagttgttcctcgaacatttataggagcatttgttatatctattctctcatcaccggcagtctttgtattgcgtttacttcatgttccaaagttctatagtcttcttacagttcgattaacattgagttgtgtcactttgatgagtttgagacttctcagacttcaggtaaaaaagaagtttggccatcaagcagaagcattctttgtcatactaactgctatccagtttcacttgctgttctactcaagccgtccgcttccaaatatctttgccttagctttggtcaacttggcatactctttctggttcaagggaagctacctatgtacattacaggctctgattgttgcagcagttgtttttagatgtgatatgattctgcttcttggcccaatagggcttgcacttatgctcagcagatctgtgtctctgttggaagcagtaaaatattgcataagatttaccatgctagttgactctataatgtggcggcgaatcctgtggccagaatttcaagttctctggtttaattcagttctgaatcggagttcagaatgggttcactggtactttacctcggcgcttccacgttccatgattgtggcataccctctttgcatggttggtgctcttcttgatagaaggatagtaccatacatgcttccggtcttcttatttgttgtgctctattcaaaacttccacataaggaacttcgtttcataattgcctcaattcccatgtttaatgtgtctgcttcactagcagctagcagactatataataaccgaaagaaagctgggtggaatttgctttatattctcacgcttggtgcctttcttgtcagtctaggatactctactgtgactttcatcgcatcctacaacaattatcctggtggctatgctttaaaggctctacatgaagcagattcttcagtgaaggaaaagatggtacatattgatgccttcactgcgatgagtggggtttctcgtttctgtgaaaatgaatatccttggagatactctaaggaggaagacattcccatcgaagaatttgagaaaaggaatttcacctatctactgaatgaacaccgctccattggtggctaccagtgcttgtttgctgtggatggattctccagagtaaaatttaagccccaaattcccccgctttctctggtgaaagaacccaaggtgttcgcacatgggaatatgagagaccctgacattctttcactgaattggcccggttgtccttga

SEQ ID NO: 6104 - protein, 489 aa, Sorghum bicolor
  misc_feature: Ceres ANNOT ID no. 6064290
  misc_feature (23)..(404): Pfam Id: Glyco_transf_22 Pfam Desc: Alg9-like mannosyltransferase family
  misc_feature (2)..(489): NCBI GI: 38345954 NCBI Desc: osjnbb0038f03.12 [oryza sativa (japonica cultivar-group)]
  misc_feature (2)..(489): NCBI GI: 116310241 NCBI Desc: osigba0101c23.1 [oryza sativa (indica cultivar-group)]
  misc_feature (27)..(256): NCBI GI: 56208591 NCBI Desc: novel protein similar to vertebrate asparagine-linked glycosylation 12 homolog (yeast, alpha-1,6-mannosyltransferase) (alg12) [danio rerio]
  misc_feature (24)..(417): NCBI GI: 109452174 NCBI Desc: alg12 [synthetic construct]
  misc_feature (24)..(417): NCBI GI: 119593886 NCBI Desc: asparagine-linked glycosylation 12 homolog (yeast, alpha-1,6-mannosyltransferase), isoform cra_a [homo sapiens]
MPRPKPGSGGGGGGWLSGWGWDLMLGSIAAFYAVMAPYTKVEESFNVQAMHDILYHTYHIEKYDHLEFPGVVPRTFIGAFVISILSSPAVFVLRLLHVPKFYSLLTVRLTLSCVTLMSLRLLRLQVKKKFGHQAEAFFVILTAIQFHLLFYSSRPLPNIFALALVNLAYSFWFKGSYLCTLQALIVAAVVFRCDMILLLGPIGLALMLSRSVSLLEAVKYCIRFTMLVDSIMWRRILWPEFQVLWFNSVLNRSSEWVHWYFTSALPRSMIVAYPLCMVGALLDRRIVPYMLPVFLFVVLYSKLPHKELRFIIASIPMFNVSASLAASRLYNNRKKAGWNLLYILTLGAFLVSLGYSTVTFIASYNNYPGGYALKALHEADSSVKEKMVHIDAFTAMSGVSRFCENEYPWRYSKEEDIPIEEFEKRNFTYLLNEHRSIGGYQCLFAVDGFSRVKFKPQIPPLSLVKEPKVFAHGNMRDPDILSLNWPGCP

SEQ ID NO: 6105 - DNA, 2676 bp, Sorghum bicolor
  misc_feature: Ceres ANNOT ID no. 6064297
  misc_feature: Encodes the peptide sequence at SEQ ID NO 6106
atggagatgggggcggcggcggcgaaaccggcaccgagggcggacggcgtgcggaggtacaaggtactcgtgccctggcggttccagcccggctacgtcaggcagccgctcaagcacaccgcctccgccaatggggcagcgcccaacggcggtggcggtaataccgccggcgtccctgatgctaaaaattgtggatcggatggggcgccgagcgccgtcggtgaaaccaacggtttccgagactccaaaattttcggatcgggtggggcgccgagccccggcaagagcggggcagttggtgcaggagaggagcaatcggtgagatgcactcgaggtcagagtttgaagagccctgacgtggacaatggtggttgccctggacctggaaatgcatgcaatctgggcaagcctgtaaggggtggccgggtgaagagctccccattggaaggtactggaaatagcaggggtgccaatgatggcgtcgtggctgccgctggagaggactgcaatctggggagctctaactgtgatgatagtttcaaggatgctcgcacccaggattttagtggtgctggcgatggaacagcttgcgaccctgaggtgattgagatcacagagaagtgctttgcgaagggtttgaagaagccgtctgtggatcagactgggtcaaagagcaatggttctgcttcaggactcaggtcagaggaccctgagggaaatgttggcttgggagattcctcttatcacgctgcaaaagggtgtagcatgggagatggggcagcgaaggagaataacgcaacagccaaaggttgcagctcggcgactcctggcagcaatggtaatggaacgtacgtccgcaagggacggaagacagttgtaccatggagattccaggctgggtacaagcgatcattctctgatgcttttgggtccaataatctatctcctgatcgtccagcatacgggtttgacggcagttcaacacagtgtgctccagcaactagaagctctgtgcggtgttatgcaagtgctcattctggtgttagagtttctgctatgtctaacttctcaatgaaaggtgaaaatgggactggtactgaatgtaagaagaggaaaactaatagcgattatcaggatgaagtgatgctagataatggagatccaatcgttagagaaagcatcatgcggtctctacaggatctccggttaatttatcgggagcttttagatgaagaagaagataattcgagggaagaagtgcttaacatgcggccagatctacgggcttacaaaattttcagggagcggttctccacagagtttgatgatgagaaatatattggcagtgtgcctggaatctatcctggtgatatctttcatctgagggttgagctttgtgttgttggtctccatcgcccacacagggtaggtattgattgtaccaagaaggatgatggtactactgtggctgttagtattgtgtcatgtgcacaatcttctgacatcaagtataatctggatgtcttggtatatactggaccagtggcagttacagtcaatcagaggatagagggtaccaactgggctcttaaaaagagcatggacactaatacaccagtccgtgttatccatgggttcaccactcaaaatggaaaaaaaaagtttcctacttatatatatggtggtttataccttgttgagaagtactggagggagaaagagcatggagaccgttatgtgtatatgttccgactgagaagaatgaaagggcaaaaacacattgacatccaagaaattctgcaaacagggaactctggatcaaagaacaatgttatcatcaaagatctatcacatggattggagagagttcctgtacctgttgttaacaaaatatccgatgagtgcccaatgccctatcgctacacttcacaccttcaatatccccgtaactatcgtccaactcctccagcaggttgtggttgtgtaggtgggtgctcagacacaaaaaggtgtgcatgtgcagtgaaaaatggtggagaaatccctttcaatgataaaggccgcattttagaagcaaagcctcttgtttatgagtgtgggccttcttgcaagtgccctcctacatgtcacaacagagttggccagcatgggctcaagtttcggctgcaaatcttcaaaacaaaatcaatgggttggggtgtgagaactcttgacttcataccgtctggaagctttgtgtgtgaatatataggagaagtgttggaggatgaagaagcacaaaaaaggacaaatgatgagtacttatttgctatcgggcacaattattatgatgagtcactttgggagggcctatcaagatctataccgtcacttcagaagggtccgggcaaagatgatgaaactggatttgctgttgatgcttcagagatggggaactttgcaaaatttatcaatcatagttgcaccccaaacatatatgcacaaaatgtcctttatgatcatgaagatatcagtgtgcctcatatcatgttctttgcttgcgacgatattcgacccaatcaagaactattctaccactacaattacaaaatagatcaggttcatgatgccaatgggaacatcaagaagaagaaatgcctttgtggctcggttgagtgtgatggctggctgtattaa

SEQ ID NO: 6106 - protein, 891 aa, Sorghum bicolor
  misc_feature: Ceres ANNOT ID no. 6064297
  misc_feature (714)..(868): Pfam Id: SET Pfam Desc: SET domain
  misc_feature (443)..(591): Pfam Id: YDG_SRA Pfam Desc: YDG/SRA domain
  misc_feature (615)..(712): Pfam Id: Pre-SET Pfam Desc: Pre-SET motif
  misc_feature (1)..(891): NCBI GI: 22121718 NCBI Desc: set domain-containing protein set104 [zea mays]
  misc_feature (93)..(891): NCBI GI: 38345952 NCBI Desc: osjnbb0038f03.7 [oryza sativa (japonica cultivar-group)]
  misc_feature (431)..(891): NCBI GI: 140058333 NCBI Desc: sra-ydg; set-related region; pre-set; histone h3-k9 methyltransferase [medicago truncatula]
  misc_feature (385)..(891): NCBI GI: 115476314 NCBI Desc: os08g0400200 [oryza sativa (japonica cultivar-group)]
  misc_feature (402)..(891): NCBI GI: 4314371 NCBI Desc: similar to mammalian mhc iii region protein g9a [arabidopsis thaliana]
MEMGAAAAKPAPRADGVRRYKVLVPWRFQPGYVRQPLKHTASANGAAPNGGGGNTAGVPDAKNCGSDGAPSAVGETNGFRDSKIFGSGGAPSPGKSGAVGAGEEQSVRCTRGQSLKSPDVDNGGCPGPGNACNLGKPVRGGRVKSSPLEGTGNSRGANDGVVAAAGEDCNLGSSNCDDSFKDARTQDFSGAGDGTACDPEVIEITEKCFAKGLKKPSVDQTGSKSNGSASGLRSEDPEGNVGLGDSSYHAAKGCSMGDGAAKENNATAKGCSSATPGSNGNGTYVRKGRKTVVPWRFQAGYKRSFSDAFGSNNLSPDRPAYGFDGSSTQCAPATRSSVRCYASAHSGVRVSAMSNFSMKGENGTGTECKKRKTNSDYQDEVMLDNGDPIVRESIMRSLQDLRLIYRELLDEEEDNSREEVLNMRPDLRAYKIFRERFSTEFDDEKYIGSVPGIYPGDIFHLRVELCVVGLHRPHRVGIDCTKKDDGTTVAVSIVSCAQSSDIKYNLDVLVYTGPVAVTVNQRIEGTNWALKKSMDTNTPVRVIHGFTTQNGKKKFPTYIYGGLYLVEKYWREKEHGDRYVYMFRLRRMKGQKHIDIQEILQTGNSGSKNNVIIKDLSHGLERVPVPVVNKISDECPMPYRYTSHLQYPRNYRPTPPAGCGCVGGCSDTKRCACAVKNGGEIPFNDKGRILEAKPLVYECGPSCKCPPTCHNRVGQHGLKFRLQIFKTKSMGWGVRTLDFIPSGSFVCEYIGEVLEDEEAQKRTNDEYLFAIGHNYYDESLWEGLSRSIPSLQKGPGKDDETGFAVDASEMGNFAKFINHSCTPNIYAQNVLYDHEDISVPHIMFFACDDIRPNQELFYHYNYKIDQVHDANGNIKKKKCLCGSVECDGWLY

SEQ ID NO: 6107 - DNA, 420 bp, Sorghum bicolor
  misc_feature: Ceres ANNOT ID no. 6064298
  misc_feature: Encodes the peptide sequence at SEQ ID NO 6108
atggacggcccgagaggtctcgcgccggggcgcgggcgcgggcgtgggcaagggcggacggtgccgcccgaatggaccggcgattctgggtccgggcagggcgccggccccggcggctcgtggagttacagctgggggtggacatcggggcccggaggcggctggggctacggccacggctcggcgcagggccccggcgccgcgtacgggtttggcttcggcagcggtggtggaggaagcgggcgtggggggttcgagttcagcttcggcggccacgatggcggtttcggctggggagccggcggcgggtcgtttggggttggaggataccacggcagctggagcgcgcggggtgggctcggcggcggcggcgggaggcagcggccaccgcgaggaggccgcggtcgtggcagcaactga

SEQ ID NO: 6108 - protein, 139 aa, Sorghum bicolor
  misc_feature: Ceres ANNOT ID no. 6064298
  misc_feature (3)..(138): NCBI GI: 92869574 NCBI Desc: eggshell protein [medicago truncatula]
  misc_feature (22)..(125): NCBI GI: 15724296 NCBI Desc: at5g61660/k11j9_180 [arabidopsis thaliana]
  misc_feature (22)..(125): NCBI GI: 21617992 NCBI Desc: structural protein-like protein [arabidopsis thaliana]
  misc_feature (3)..(138): NCBI GI: 225181 NCBI Desc: gly rich structural protein
  misc_feature (27)..(138): NCBI GI: 7268621 NCBI Desc: glycine-rich cell wall protein-like [arabidopsis thaliana]
MDGPRGLAPGRGRGRGQGRTVPPEWTGDSGSGQGAGPGGSWSYSWGWTSGPGGGWGYGHGSAQGPGAAYGFGFGSGGGGSGRGGFEFSFGGHDGGFGWGAGGGSFGVGGYHGSWSARGGLGGGGGRQRPPRGGRGRGSN

SEQ ID NO: 6109 - DNA, 1683 bp, Sorghum bicolor
  misc_feature: Ceres ANNOT ID no. 6064306
  misc_feature: Encodes the peptide sequence at SEQ ID NO 6110
atggcgctgcgcgacgtgctgctgtcgatagcgcagacgccgcaccggctgcgcaggagggcgctggtgacgtggacgccggcgcaggagctgaacgaggtgcgggaccggtcggggccgcgcatgaagcggcggctcgagtggtacgacctcgtggggctcggcgtcggcggcatgctcggcgcgggcgtcttcgtcaccacggggagggtggcgcgcgacaccgcggggccagccgtcttcgtgtcctacgtcatcgccggcgtctccgcgctgctgtcatccttctgctacgccgagttctccgtgcgcgtccccgtcgccggcggtgccttcagctacctcagagtaacgttcggcgagttcgtggggtttttcggcggagcgaacattctgatggagtacgtgctgtcgaacgcggcggtggcgaggagcttcacggactacctggcctcgacgttcggagtcacggagcacaacgcgtggaggatcgtcgtcgacggcatcgccgacgggtataatgccctggacgtgccggccgtcgggctcatcctcctcataaccgtatgcctgtgctatagcaccaaggagagctcgatgctgaacatggtgctcacggtgttccacctgctcttcttcgccttcatcatcgcggccggcctgtggaacggcagcgcgaggaacctcgtgcggccgcacgggctggccccctacggcgtcgccggcgtcctggacggcgccgccatcgtctacttcagctacataggctacgactcggcgtgcaccatggccgaggagatccgggaaccctcccgcgcgctccccgtcggcatcgccggctcggtgctcgtcgtgtccgcgctctactgcctcatgtccgtcgccctctgcgtgatgctgccctacaccgagatatcggaggcagccccgttctcgtcggcgttcagggagaaggtggggtggaggtgggcgagcagcgtggttggcgccggcgccagcatcggcatcgtggcgtcgctgctggtggcgatgctggggcaggccaggtacctgtgcgtcatcgccagagcgcgtctcgtgccgctgtggttcgccaaggtccacccttccacaggcactccgatgaacgccaccatctttctagggttctgcactgcagcattagcactcttcacggagctgcaaatagtgttcgagatgatatccatcggaaccctgctggtcttctacctggtcgccaacgcactcatctaccaccggtatgtgaagatcggcacaaaccggcccctgcatgtcctcctcttcctgctgctcctcacgctgagctctctcggcttctccctctcgaggaagatcgatgagtggtgccggtgggggatggcactgtttggggcgatctccatagcaatcaccaccatcttccactgcacagcacggcaggacatcacggggcccccattggagtggtcagtccctctaatgccatggcctgctgctgcatctgtcttcctgaatgtgttcctgataaccaccctcaaggtgagatcattccagaggttcggcatctggagtcttgtgatcatagttttctatgtctgctatggggtgcactccacatactctgcagaagaaaatgaaattgtcaatgcaatgatccatcatgcaaatctggacatatcttag

SEQ ID NO: 6110 - protein, 560 aa, Sorghum bicolor
  misc_feature: Ceres ANNOT ID no. 6064306
  misc_feature (50)..(483): Pfam Id: AA_permease Pfam Desc: Amino acid permease
  misc_feature (2)..(560): NCBI GI: 38345950 NCBI Desc: osjnbb0038f03.3 [oryza sativa (japonica cultivar-group)]
  misc_feature (120)..(560): NCBI GI: 115459710 NCBI Desc: os04g0543600 [oryza sativa (japonica cultivar-group)]
  misc_feature (2)..(544): NCBI GI: 115484255 NCBI Desc: os11g0155500 [oryza sativa (japonica cultivar-group)]
  misc_feature (42)..(544): NCBI GI: 62701650 NCBI Desc: amino acid transporter-like protein [oryza sativa (japonica cultivar-group)]
  misc_feature (42)..(544): NCBI GI: 77553705 NCBI Desc: al162972 amino acid transport-like protein [oryza sativa (japonica cultivar-group)]
MALRDVLLSIAQTPHRLRRRALVTWTPAQELNEVRDRSGPRMKRRLEWYDLVGLGVGGMLGAGVFVTTGRVARDTAGPAVFVSYVIAGVSALLSSFCYAEFSVRVPVAGGAFSYLRVTFGEFVGFFGGANILMEYVLSNAAVARSFTDYLASTFGVTEHNAWRIVVDGIADGYNALDVPAVGLILLITVCLCYSTKESSMLNMVLTVFHLLFFAFIIAAGLWNGSARNLVRPHGLAPYGVAGVLDGAAIVYFSYIGYDSACTMAEEIREPSRALPVGIAGSVLVVSALYCLMSVALCVMLPYTEISEAAPFSSAFREKVGWRWASSVVGAGASIGIVASLLVAMLGQARYLCVIARARLVPLWFAKVHPSTGTPMNATIFLGFCTAALALFTELQIVFEMISIGTLLVFYLVANALIYHRYVKIGTNRPLHVLLFLLLLTLSSLGFSLSRKIDEWCRWGMALFGAISIAITTIFHCTARQDITGPPLEWSVPLMPWPAAASVFLNVFLITTLKVRSFQRFGIWSLVIIVFYVCYGVHSTYSAEENEIVNAMIHHANLDIS

SEQ ID NO: 6111 - DNA, 837 bp, Sorghum bicolor
  misc_feature: Ceres ANNOT ID no. 6064313
  misc_feature: Encodes the peptide sequence at SEQ ID NO 6112
  misc_feature: Up-regulated in shoot tissues in response to salicylic acid treatment
atgcaccgagaccgaggcgtctcggcggcggcggtccccggtgaccggaagcggatcggcgagccgatggacagatcgtctccgtccacgtcatgggggttttccggaggccgcgagaaggagcggatcggcgggggcaagcagccggagatgtctcgctccggcggcggatccaccgccatctccaagagcatgctctttgacgcagaatcagaaaccgacagcgaagaatcagatgtgagtggttctgatggggaagatacttcgtggatttcatggttctgtagtttaaggggtaatgagtttttctgtgaggttgatgacgagtacatacaagatgatttcaacctgtgtgggctaagcaaccaagttccatattacgactatgcgcttgatctgatattagatgttgaatcttcccatggtgatatgttcacagaagagcaaaatgaactcattgaatcagctgctgagatgctctatggattgattcatgttcggtatattattacaagtaaagggttgtcggcaatgctggataagtacaagaacgttgatttcggtagatgccctcgagtgaattgcagcggccaaccatgtcttcctgttgggcaatcagatgttcctcgttcgagtatggtgaagatttactgccctagatgtgaagacatctacactccaagatccaaacatctaagcaacatcgacatcgacgggacttactttgggacaacattcccccacttgttcctgatgacatacccgcatgtgaagccccagaagccgttgcagcaatacgttcccagggtatttgggttcaaaattcataagccatga

SEQ ID NO: 6112 - protein, 278 aa, Sorghum bicolor
  misc_feature: Ceres ANNOT ID no. 6064313
  misc_feature (90)..(266): Pfam Id: CK_II_beta Pfam Desc: Casein kinase II regulatory subunit
  misc_feature (1)..(278): NCBI GI: 11527000 NCBI Desc: protein kinase ck2 regulatory subunit ck2b1 [zea mays]
  misc_feature (1)..(278): NCBI GI: 140058354 NCBI Desc: casein kinase ii, regulatory subunit [medicago truncatula]
  misc_feature (1)..(277): NCBI GI: 21261784 NCBI Desc: protein kinase ck2 regulatory subunit 2 [nicotiana tabacum]
  misc_feature (27)..(278): NCBI GI: 29367573 NCBI Desc: possible protein kinase ck2 regulatory subunit [oryza sativa (japonica cultivar-group)]
  misc_feature (15)..(277): NCBI GI: 113374086 NCBI Desc: casein kinase ii beta [hordeum vulgare]
  misc_feature: Useful for making plants with modulated flowering time
  misc_feature: Functional homolog of the protein sequence given in SEQ ID NO 13452
  misc_feature: Up-regulated in shoot tissues in response to salicylic acid treatment
  misc_feature: The sequence is a functional homolog of SEQ ID NO. 373 in the 11/188,298 US application
  misc_feature: The sequence is a functional homolog of SEQ ID NO. 515 in the 11/188,298 US application
MHRDRGVSAAAVPGDRKRIGEPMDRSSPSTSWGFSGGREKERIGGGKQPEMSRSGGGSTAISKSMLFDAESETDSEESDVSGSDGEDTSWISWFCSLRGNEFFCEVDDEYIQDDFNLCGLSNQVPYYDYALDLILDVESSHGDMFTEEQNELIESAAEMLYGLIHVRYIITSKGLSAMLDKYKNVDFGRCPRVNCSGQPCLPVGQSDVPRSSMVKIYCPRCEDIYTPRSKHLSNIDIDGTYFGTTFPHLFLMTYPHVKPQKPLQQYVPRVFGFKIHKP

SEQ ID NO: 6113 - DNA, 651 bp, Sorghum bicolor
  misc_feature: Ceres ANNOT ID no. 6064329
  misc_feature: Encodes the peptide sequence at SEQ ID NO 6114
atgtccacgcctcgccgccgcctggtcaccaccgcatccccgtcgctccgcttcctcggcctgctcaagcaacccgacgacgcacccagcgcccacggcggcgtccaggagccgctggagctcgacgagcgcgacgtcgtctggtcctcctcctcctcctccagcgcggcctcctcgccgtccccgaccccgtccccgtcctcgtcctcgtccgccagcagcctccggaggccgatctccacgtcgtcgcgccacttccccggcgcaggcagcatgggcctgtccgcgctcctcgccgacgacaaccaccaccacgcgctcaccaccgcgcccgtcccggccgtcgcgcgcccggagagacagcacgcgccgcagccgtaccaccagtcggcccccatggccgtgccggcctggcccaaggcgatgacggcggcggacaggcgccgccgggaggcggagctgcagaccgccgcgtactttgacgacgacgatgacgacagcgagcccgtggtgccgccgcatgagatggccgcgcgccgcgccgcggcggcggcgtcggtgatggaaggcgccggccgcacgctcaagggccgcgacctccggcgcgtgcgcaacgccgtgtggcgcaccaccggcttcctcgacctgtga

SEQ ID NO: 6114 - protein, 216 aa, Sorghum bicolor
  misc_feature: Ceres ANNOT ID no. 6064329
  misc_feature (1)..(216): NCBI GI: 21741306 NCBI Desc: osjnbb0103i08.8 [oryza sativa (japonica cultivar-group)]
  misc_feature (13)..(215): NCBI GI: 56785008 NCBI Desc: prolyl 4-hydroxylase alpha subunit-like [oryza sativa (japonica cultivar-group)]
  misc_feature (29)..(215): NCBI GI: 15983450 NCBI Desc: at3g15040/k15m2_18 [arabidopsis thaliana]
  misc_feature (49)..(215): NCBI GI: 116310726 NCBI Desc: osigba0131l05.3 [oryza sativa (indica cultivar-group)]
  misc_feature (170)..(216): NCBI GI: 94982649 NCBI Desc: prolyl 4-hydroxylase alpha subunit-like [musa acuminata]
MSTPRRRLVTTASPSLRFLGLLKQPDDAPSAHGGVQEPLELDERDVVWSSSSSSSAASSPSPTPSPSSSSSASSLRRPISTSSRHFPGAGSMGLSALLADDNHHHALTTAPVPAVARPERQHAPQPYHQSAPMAVPAWPKAMTAADRRRREAELQTAAYFDDDDDDSEPVVPPHEMAARRAAAAASVMEGAGRTLKGRDLRRVRNAVWRTTGFLDL

SEQ ID NO: 6115 - DNA, 2256 bp, Sorghum bicolor
  misc_feature: Ceres ANNOT ID no. 6064334
  misc_feature: Encodes the peptide sequence at SEQ ID NO 6116
atggacggaaccgagcttgaaaatcctacttctaggagctcatcccagaaatctagccgacgttctagtagtaggcgttctcagaagtcagctggacagcattctttgaccagtactcaagagaaaagaagcaaatcaaaatcttcaaggcagaagcacttggttattgatgacaaagagactaaaaagggaaaaaaccatgcccacaaaattgatgtagcagatgagaggtccaattttgtaggttatgaagtgtatgctggaaagctgatttttgataagaaaaatagaagtgcaagtgataataatgagttaccatcaaacagaaaagctgatgcaattgatgctagactcacaagtaaagctctgatctggggcagctctgtgctcctcctggaggatgtcgtctctgtatcatataattcgggagtcaaacattttacattgcatgcatacccaactaaaaagtctttatttggaaagacacgcagagttcagaaagacttctgctttatagcctctacccttgacgaggccattttgtgggtgacatgctttgccgaacaaagtatatatgttaatttactacctcgccctgcagcatctagtatcaatccagactcagacaatcccctcagtgagtctttattcgaccagccaccgattaaatgcaaatctccgcaaagagtacttgttatattgaaccctcgatctggacatggtagatcaagtaaagttttccatgagaaagctgaacctatatttaagcttgcaggttttcagatggaagtagttaaaactactcatgctgggcatgcaaaatctcttgtatctacatttgatttcagtgtatgccctgatggaattgtgtgtgtgggtggtgatggaattgtgaatgaggtgctcaatggtcttctcattagaagtgatagagcagaagctgtatcaattccagtaggaataattcctgcagggtctgacaactcacttgtctggactgttttgggagttagagatcctatttctgcatcattattaattgttaagggtggcttcacagctctagacatcttggctgttgagtggattcaatctgggcaaatacattttggctcaactgtttcatactatggttttcttagtgatgtcctggaactttctgagaaatatcagaagaaatttggtcctcttcgatattttgtggctggaatactgaaatttttgtgtttgcctagctacttctatgaactagaatatcttcctgtgtcaaaggagatggctgtgaatggaaaaggtacagatcaagacaagacccacttgtccaatgtctatactgatgtaatgcacagtagatcaaagagagaaggaataccaagagcctccagtttgtccagtattgattctattatgactccgagtcggatgtcacttggggatgttgatacatcaggtagtacagtggcaagcactgaaccatcagactatgtacgtggtctcgatccgaaagcaaaacgcttatctctgggaagaagtaacattgtttcagaacctgaagcagtgctacaccctcagccacatcatggatcattctggccaagaaccaggtcgaaagcaagggccgagagaaattcagttggtgtaacgtctagtaatgacacacagttgtcttgggcaaccccagcaatgcatgataaggaagacatttcctcaacaatatcagatccaggacctatttgggattgtgaaccaaagtgggacacaggaccaaaatgggatagtgagctaacttgggagcctgaccaccccattgaacttcctggaccacaagaggacatggaaatgggaacaccaatggaacttgtgccaaatttggatgagaaatgggtaattaggaaagggcactttcttggtgtcctagtatgcaaccattcatgcaagacagtgcaaagtctgagttcacaagttattgcacctaaggccacccatgatgacaacagcttggacttactcttagttggtggaaaaggaagatggaaattgctgagatttttcatacttctgcaattcggtcgccatctctctttgccttacgtcgaatatgtgaaggtgaagtcagttaagcttaaacctggagcaaacactcacaatggctgtggcatagatggtgagctttgccgtgtcaagggacaagtactctgctccctggttccggagcaatgcagactgattggccgacaatggagacaatctatttaa

SEQ ID NO: 6116 - protein, 751 aa, Sorghum bicolor
  misc_feature: Ceres ANNOT ID no. 6064334
  misc_feature (229)..(362): Pfam Id: DAGK_cat Pfam Desc: Diacylglycerol kinase catalytic domain
  misc_feature (1)..(750): NCBI GI: 38345938 NCBI Desc: osjnbb0103i08.5 [oryza sativa (japonica cultivar-group)]
  misc_feature (1)..(750): NCBI GI: 116310433 NCBI Desc: h0501d11.3 [oryza sativa (indica cultivar-group)]
  misc_feature (75)..(745): NCBI GI: 57281695 NCBI Desc: sphingosine kinase [lotus corniculatus var. japonicus]
  misc_feature (15)..(744): NCBI GI: 22654975 NCBI Desc: at5g23450/k19m13_8 [arabidopsis thaliana]
  misc_feature (15)..(702): NCBI GI: 79328532 NCBI Desc: atlcbk1 (a. thaliana long-chain base (lcb) kinase 1); diacylglycerol kinase [arabidopsis thaliana]
MDGTELENPTSRSSSQKSSRRSSSRRSQKSAGQHSLTSTQEKRSKSKSSRQKHLVIDDKETKKGKNHAHKIDVADERSNFVGYEVYAGKLIFDKKNRSASDNNELPSNRKADAIDARLTSKALIWGSSVLLLEDVVSVSYNSGVKHFTLHAYPTKKSLFGKTRRVQKDFCFIASTLDEAILWVTCFAEQSIYVNLLPRPAASSINPDSDNPLSESLFDQPPIKCKSPQRVLVILNPRSGHGRSSKVFHEKAEPIFKLAGFQMEVVKTTHAGHAKSLVSTFDFSVCPDGIVCVGGDGIVNEVLNGLLIRSDRAEAVSIPVGIIPAGSDNSLVWTVLGVRDPISASLLIVKGGFTALDILAVEWIQSGQIHFGSTVSYYGFLSDVLELSEKYQKKFGPLRYFVAGILKFLCLPSYFYELEYLPVSKEMAVNGKGTDQDKTHLSNVYTDVMHSRSKREGIPRASSLSSIDSIMTPSRMSLGDVDTSGSTVASTEPSDYVRGLDPKAKRLSLGRSNIVSEPEAVLHPQPHHGSFWPRTRSKARAERNSVGVTSSNDTQLSWATPAMHDKEDISSTISDPGPIWDCEPKWDTGPKWDSELTWEPDHPIELPGPQEDMEMGTPMELVPNLDEKWVIRKGHFLGVLVCNHSCKTVQSLSSQVIAPKATHDDNSLDLLLVGGKGRWKLLRFFILLQFGRHLSLPYVEYVKVKSVKLKPGANTHNGCGIDGELCRVKGQVLCSLVPEQCRLIGRQWRQSI

SEQ ID NO: 6117 - DNA, 1329 bp, Sorghum bicolor
  misc_feature: Ceres ANNOT ID no. 6064342
  misc_feature: Encodes the peptide sequence at SEQ ID NO 6118
atggccgcgcaatccgcgattattgctgatcgttttcaccgcgtcgaatcagatgcctacgaccccgtagatccgaacgggaacatcacgatcaactgggattttcaggtcctcaacgtcaaggacatgtccccgtacacggtcatggtgagcatccacaactaccagatgtaccggcacatcgagcacccggggtggcggctgagctggaactggaccggcaaggaggtcatctggaacacggtgggcgcggagacgacggagcagggcgactgctcccgcgtcggcgccgccaacgcccgcccgcattgctgcctgaggcggcccgtcatggtggacctcccgcccggcaccccgtacaacaggcaggtcgccaactgctgccgcggcggcgtgctgtcgtccttcgtccagaacaatctgacgtccaccgccgcgttccagatggtcgtcggcgagttcgccctcgccaaggacgacggcggcggtagtatggagcccgagaagccgtggcatttcgacatcggcgtgccagggtacacctgcagcaacgccaccacggtagccccgaccagggtcaaggtcgacaagaaccgctacgaacaagtgctcctgacatggcaggtgacctgctcgtactctcagtaccgggcgtcgggggtgccgtcgtgctgcgtctccatgtcgacgttctacagcgagacgatcgtggattgcccgcgctgcagctgcgcctgccaagggtccccaacgccaacgtcgccacaatgcgtcagcgtcgaccaaccacggacaccagcgttgccggcgagcagcgacgacgagccggcggcgccgatcgtctggtgctcggagcacatgtgcccgatccgggtgcactggcacgtgaaggtgaactaccggcagtactggcgggtgaaagtgacggtgtccaactacaacctggtgaagaactacagcgactggaacctggtgctgcagcaccccaacctgcggagcctcacgcagctgttcagcttcaattacaagcctctcgtcgagtacggcagcttcaatgacacggggatgttctgggggttacgtttctacaacgagatgctgctgcaggacgggaacgtgcagacggagatgattctggagaaggagagcgacttcacctattccggcggctgggcgttcccgaggagggtctacttcaacggccaagagtgcgtcatgccgccggcggaccagtaccccaaactgcccaacggggcctcggaattgcgggggtcgtcgctgatcgccggcaattgcttgctgctgctattcttcttcgttctcgtgtag

SEQ ID NO: 6118 - protein, 442 aa, Sorghum bicolor
  misc_feature: Ceres ANNOT ID no. 6064342
  misc_feature (46)..(215): Pfam Id: Phytochel_synth Pfam Desc: Phytochelatin synthetase-like conserved region
  misc_feature (19)..(442): NCBI GI: 119040466 NCBI Desc: tpa: tpa_inf: brittle stalk-2-like protein 9 [zea mays]
  misc_feature (17)..(442): NCBI GI: 116310381 NCBI Desc: h0115b09.4 [oryza sativa (indica cultivar-group)]
  misc_feature (17)..(442): NCBI GI: 75144076 NCBI Desc: cobra-like 7 protein precursor (brittle culm1-like 3 protein)
  misc_feature (17)..(442): NCBI GI: 38344980 NCBI Desc: osjnba0011l07.10 [oryza sativa (japonica cultivar-group)]
  misc_feature (17)..(438): NCBI GI: 38194916 NCBI Desc: phytochelatin synthetase-like protein [phaseolus vulgaris]
  misc_feature: Useful for making plants with altered Lignin content
  misc_feature: Useful for making plants with altered cell wall content and/or composition
  misc_feature: Functional homolog of the protein sequence given in SEQ ID NO 13349
  misc_feature: Useful for making plants with altered cell wall content and/or composition
  misc_feature: Useful for making plants with altered lignin content
  misc_feature: Functional homolog of the protein sequence given in SEQ ID NO 13349
  misc_feature: Useful for making plants with altered carbohydrate content
  misc_feature: Functional homolog of the protein sequence given in SEQ ID NO 13944
  misc_feature: The sequence is a functional homolog of SEQ ID NO 4 in US patent 7109001
MAAQSAIIADRFHRVESDAYDPVDPNGNITINWDFQVLNVKDMSPYTVMVSIHNYQMYRHIEHPGWRLSWNWTGKEVIWNTVGAETTEQGDCSRVGAANARPHCCLRRPVMVDLPPGTPYNRQVANCCRGGVLSSFVQNNLTSTAAFQMVVGEFALAKDDGGGSMEPEKPWHFDIGVPGYTCSNATTVAPTRVKVDKNRYEQVLLTWQVTCSYSQYRASGVPSCCVSMSTFYSETIVDCPRCSCACQGSPTPTSPQCVSVDQPRTPALPASSDDEPAAPIVWCSEHMCPIRVHWHVKVNYRQYWRVKVTVSNYNLVKNYSDWNLVLQHPNLRSLTQLFSFNYKPLVEYGSFNDTGMFWGLRFYNEMLLQDGNVQTEMILEKESDFTYSGGWAFPRRVYFNGQECVMPPADQYPKLPNGASELRGSSLIAGNCLLLLFFFVLV

SEQ ID NO: 6119 - DNA, 2826 bp, Sorghum bicolor
  misc_feature: Ceres ANNOT ID no. 6064358
  misc_feature: Encodes the peptide sequence at SEQ ID NO 6120
  misc_feature: Down-regulated in shoot tissues in response to salicylic acid treatment
atgggggcgattggaggcgacgcgccggtgcagtgggacaaggtggatggggccgaggtggccaatggcggcggtggaggtgctgcgggaaggctggagaagatactggtctcggtgaggctgaggccgctcagcgacaaggagattgcgaggggggacccggcggagtgggagtgcatcaacgacactaccatcatctcccggagcaccttcccggaccggcccactgctccgactgcatattcatttgatagggtatttcgttctgactgtaataccaaagaagtatatgatgaaggggccaaagcagttgccctctctgtagttagtggcattaactcaagtgtttttgcatatggtcaaacaagtagtggaaaaacatacaccatgactggaataacggaacatacagcagcagatatctatgattacattgccaagcatgaggagagagcatttgtattgaaattttcagcaattgaaatatataacgaagttgtaagggatcttcttagtgcagaaagcacatcacttagactctgggatgatgcagagaagggaacatatgtagaaaaccttacagaggtgatcttgagggattcaaaccacctgaaagaacttatttctgtgtgtgaagctcaaaggaggaccggagagacatacttaaatgaaaacagctccagatcacaccaaatacttaaactgactatcgaaagttctgctcgtgagttcttgggtaaggacaagtcaacaacacttgttgctagtgtgaactttgttgatttggctggaagtgaacgtgcatctcaggcattatcagctggggctaggctgaaggaaggttgtcatattaatagaagtctactgaccctaggaactgtgattcggaaactaagcaaggtaagaaatggacacataccataccgagattcaaagctcacacgcatattacagccttctctaggaggcaatgcaagaacagctattatttgtacaatgagcccagcccgaagccatatggaacagtcaaggaataccttgttgtttgcaagttgtgcaaaggaagtggtgacaaatgcccaggttaatgtggttatgtctgataaagcactagttaagcaattacaaaaagaacttgcaaggttggagagtgaattgcgatgcccaacttcatattctggtcttgaagcattagtgaaggaaaaagataatcaaatccggaagatggagaaagaaattaaggaactgaagttacaacgtgatctcgctcaatctagactgcaagatttgctcaaggttgttggagatagccacagttcgaagcatcccctggcttcttctggaagaaactttacttttgatgttcctcagccatgtgaggatgagcgatcgacgacatcagaagttgtcagcagtggccaaaattttaggcttcaaggacgccagacaatacaaagagattataggtcccagcaatctgaaaatgatgtgcagtttgctacccctcttagctattcagtcagtagtcccccattcagtgggatgcccccaactaatggcagagatgataactctcaaatatctaatgaagattcagaggatctttgcaaagaagtacggtgcatagagaccaatgaaacagaagaaaatgaatgtttagagtcatcagctgtgggaagcaatagtctgcaagattcaaatgtagcttccagcatgcaagggggtaatcatccaaatcgatctgtgaattctagacagcatgatgcatctcctattaccctggaacaacatttggagaatgtcaaaaaaccgtttgccaatcttggcatggatctgggatcctctacgcataactcatcaaggtcaagagtaattggcagaagcaggagctgtaggtctctgatgagttctactttgttggaagacttggagaaagaagattgcacccctccaagcagaagtttcatggactacccagggagaccagaaacatgtcaaagaagggtacctgcactgaactatgatgcagagagtgaaactttatccagagcaggatcaatgctatctgaaattatcaccacgagggatggactgaagggaaacagctctgttgctggtgatacagaatttgttgctggcataggtgaatttgtcgcggagctaaaagaaatggctcagggtgataatggagaattggccgaagggaccataaggagcgtgggtctggatcccattatggatgccttgcaatcgccttctcgctggccattagaattcgagaagaaacaacaagagatcattgacctgtggcatggatgcaacgtttccttggtccacaggacttactttttcctgctgttcaaaggggacccagccgacgccatttacatggaagtggagcttaggaggctatcattcctcaaaaataccacatattccaacggaagcatggggcgtaacgtggtggtagcaggcagtccgagcacttctctggtctcaagtgcaaagaagctgcaacgtgagagggagatgctctgcaggcagatgcagaagcggctgacgatccaggaacgtgagagcttgtacaccaagtggggagtctcgctgtcctccaagaggaggcgtctgcaggtcgctcgccgcctttggacggagaccaagaacctggagcatgtgagggagagcgcgtccctcgtggccagactgatcgggctcctggagcctggcaaggcgctgagggagatgtttggtctcagcttcgcgccgcagcagttcacccggagatcgcacagtagttggcgatatggccgttcttctctagactga

SEQ ID NO: 6120 - protein, 941 aa, Sorghum bicolor
  misc_feature: Ceres ANNOT ID no. 6064358
  misc_feature (40)..(357): Pfam Id: Kinesin Pfam Desc: Kinesin motor domain
  misc_feature (1)..(941): NCBI GI: 38344976 NCBI Desc: osjnba0011l07.1 [oryza sativa (japonica cultivar-group)]
  misc_feature (41)..(941): NCBI GI: 15208467 NCBI Desc: kinesin heavy chain [zea mays]
  misc_feature (120)..(449): NCBI GI: 15208447 NCBI Desc: kinesin heavy chain [zea mays]
  misc_feature (31)..(496): NCBI GI: 42567523 NCBI Desc: kinesin motor family protein [arabidopsis thaliana]
  misc_feature (1)..(441): NCBI GI: 42569214 NCBI Desc: kinesin motor family protein [arabidopsis thaliana]
  misc_feature: Down-regulated in shoot tissues in response to salicylic acid treatment
MGAIGGDAPVQWDKVDGAEVANGGGGGAAGRLEKILVSVRLRPLSDKEIARGDPAEWECINDTTIISRSTFPDRPTAPTAYSFDRVFRSDCNTKEVYDEGAKAVALSVVSGINSSVFAYGQTSSGKTYTMTGITEHTAADIYDYIAKHEERAFVLKFSAIEIYNEVVRDLLSAESTSLRLWDDAEKGTYVENLTEVILRDSNHLKELISVCEAQRRTGETYLNENSSRSHQILKLTIESSAREFLGKDKSTTLVASVNFVDLAGSERASQALSAGARLKEGCHINRSLLTLGTVIRKLSKVRNGHIPYRDSKLTRILQPSLGGNARTAIICTMSPARSHMEQSRNTLLFASCAKEVVTNAQVNVVMSDKALVKQLQKELARLESELRCPTSYSGLEALVKEKDNQIRKMEKEIKELKLQRDLAQSRLQDLLKVVGDSHSSKHPLASSGRNFTFDVPQPCEDERSTTSEVVSSGQNFRLQGRQTIQRDYRSQQSENDVQFATPLSYSVSSPPFSGMPPTNGRDDNSQISNEDSEDLCKEVRCIETNETEENECLESSAVGSNSLQDSNVASSMQGGNHPNRSVNSRQHDASPITLEQHLENVKKPFANLGMDLGSSTHNSSRSRVIGRSRSCRSLMSSTLLEDLEKEDCTPPSRSFMDYPGRPETCQRRVPALNYDAESETLSRAGSMLSEIITTRDGLKGNSSVAGDTEFVAGIGEFVAELKEMAQGDNGELAEGTIRSVGLDPIMDALQSPSRWPLEFEKKQQEIIDLWHGCNVSLVHRTYFFLLFKGDPADAIYMEVELRRLSFLKNTTYSNGSMGRNVVVAGSPSTSLVSSAKKLQREREMLCRQMQKRLTIQERESLYTKWGVSLSSKRRRLQVARRLWTETKNLEHVRESASLVARLIGLLEPGKALREMFGLSFAPQQFTRRSHSSWRYGRSSLD

SEQ ID NO: 6121 - DNA, 2406 bp, Sorghum bicolor
  misc_feature: Ceres ANNOT ID no. 6064365
  misc_feature: Encodes the peptide sequence at SEQ ID NO 6122
atggccgccgaggtgcccgtgcgagcccccgccgccgcggcgcggtccgcgcgcagccggccggccgccgccgccgccgtcgtctccgcctcgtccgcctcgcgcctcctcctcggctaccgccccttccacgcgccgcgcttcgccgctgggcgcgccgcggtggcaggccccgtggccggactccgcccgcgctcgcgcaggccgcgcctctcggtcgtcgccatggctggcagcgtgcctataatgcttgtttatcgtctgtgctctaccgggcaaattattatgggcaaatttgattatgctcagaattcaaaccgtcaagtgcctttacatgattaccgcaacattggtattatggcccatatagatgcaggaaagacaacaactactgagcgcattctgtattacactggaaggaactacaagattggtgaggttcatgagggaacagctacaatggactggatggaacaagaacaagagagaggaataaccattacatctgcagcaacgactgccttctggaacaaacacagaatcaacattatagatactcctggtcacgtcgacttcactcttgaggttgaacgtgctctcagggtgttggacggtgctatatgtctctttgacagtgttgctggggtagaaccacaatctgaaaccgtgtggcgccaggcagataaatatggggttccaagaatatgtttcgtgaacaaaatggatcgccttggagctaatttctttagaactagagacatgatagttgcaaacttgggtgccaaaccattggtgattcagttgccgattggttcggaggacaatttccaaggagttattgatctagtcagaatgaaagctattgtatggacaggggaggagctgggtgcaaaatttgaatacaaagacatacctgatgatctccaagagctggctcaagattatcgtgttcagatgctggaaactattattgaattggatgatgaagttatggagaattatcttgaaggaactgaaccagatgaggaaactgttaagaaattaatcagaaagggaacaatctctgccagctttgttccagttttatgtggttcagcattcaaaaacaaaggtgtccaaccattgcttgatgctgttgttgattacttgccatctccacttgatctaccttcaatgaagggtactgacccagaagaccctgaaataatatttgaaaggcaaccaagtgatgatgaaccattttctgggttagctttcaagatcatgactgatccatttgtggggtcattgacatttgttcgcatatactccgggaagctggtagctggttcatatgttctcaatgcaaataaagataagaaagaaagaattggaagactccttgagatgcacgcaaacagtaaggaagatataccagttgctgtgacaggtgacatagtagcgcttgctggtctgaaagacacaattactggtgaaacactctgtgacccagacaagcctgtagtgcttgaacgtatggaatttcctgatcctgtcattaaggttgctattgaacccaagaccaaagctgatgccgacaaaatggctaatgggttaattaagcttgctcaagaagacccgtcattccacttctctagagacgaggaaactaaccagactgttattgaaggaatgggagaactgcatcttgatatcattgtagacagactaaagagggagttcaaggttgaagcaaacgttggagctccacaagtcaactaccgcgaaagtatttccaaagttgcagaaatacaatatgtccacaaaaagcaatctggtggatctgggcagtttgcagacattattgtgcgttttgaacctttggaagctggaagtgggtatgagttcaagagtgaaatcaagggaggggcagtgcccaaagaatatgtaccaggagtgatgaaaggattggaagaaagcttacccaatggtgtcctcgctggttacccagttgtggacttccgggctgtgctggttgatggctcatatcatgatgtcgattcaagtgtcttagcattccaaattgcagccagaggagccttccgtgagggaatgaggaaagctggtccaaggcttctcgagcctataatgagagttgaagtgataactcctgaagagcatctgggtgatgttattggtgatttgaactctaggagaggacaagttaacagcttcggggataagcctggtggactcaaggtggttgatgcttttgtgccacttgctgagatgttccaatacgtcagcaccctccggggcatgactaaggggcgagcatcctacacgatgcagctcgccaagtttgacgtcgtcccacagcacatccagaaccagctctccaccaaaacggaggaagctactgcttaa

SEQ ID NO: 6122 - protein, 801 aa, Sorghum bicolor
  misc_feature: Ceres ANNOT ID no. 6064365
  misc_feature (112)..(385): Pfam Id: GTP_EFTU Pfam Desc: Elongation factor Tu GTP binding domain
  misc_feature (583)..(702): Pfam Id: EFG_IV Pfam Desc: Elongation factor G, domain IV
  misc_feature (704)..(792): Pfam Id: EFG_C Pfam Desc: Elongation factor G C-terminus
  misc_feature (428)..(495): Pfam Id: GTP_EFTU_D2 Pfam Desc: Elongation factor Tu domain 2
  misc_feature (102)..(801): NCBI GI: 2119927 NCBI Desc: translation elongation factor ef-g, chloroplast - soybean
  misc_feature (104)..(801): NCBI GI: 402753 NCBI Desc: translation elongation factor ef-g [glycine max]
  misc_feature (104)..(801): NCBI GI: 461999 NCBI Desc: elongation factor g, chloroplast precursor (ef-g)
  misc_feature (105)..(801): NCBI GI: 92892029 NCBI Desc: translation elongation factor g [medicago truncatula]
  misc_feature (260)..(800): NCBI GI: 38567873 NCBI Desc: osjnba0091d06.15 [oryza sativa (japonica cultivar-group)]
MAAEVPVRAPAAAARSARSRPAAAAAVVSASSASRLLLGYRPFHAPRFAAGRAAVAGPVAGLRPRSRRPRLSVVAMAGSVPIMLVYRLCSTGQIIMGKFDYAQNSNRQVPLHDYRNIGIMAHIDAGKTTTTERILYYTGRNYKIGEVHEGTATMDWMEQEQERGITITSAATTAFWNKHRINIIDTPGHVDFTLEVERALRVLDGAICLFDSVAGVEPQSETVWRQADKYGVPRICFVNKMDRLGANFFRTRDMIVANLGAKPLVIQLPIGSEDNFQGVIDLVRMKAIVWTGEELGAKFEYKDIPDDLQELAQDYRVQMLETIIELDDEVMENYLEGTEPDEETVKKLIRKGTISASFVPVLCGSAFKNKGVQPLLDAVVDYLPSPLDLPSMKGTDPEDPEIIFERQPSDDEPFSGLAFKIMTDPFVGSLTFVRIYSGKLVAGSYVLNANKDKKERIGRLLEMHANSKEDIPVAVTGDIVALAGLKDTITGETLCDPDKPVVLERMEFPDPVIKVAIEPKTKADADKMANGLIKLAQEDPSFHFSRDEETNQTVIEGMGELHLDIIVDRLKREFKVEANVGAPQVNYRESISKVAEIQYVHKKQSGGSGQFADIIVRFEPLEAGSGYEFKSEIKGGAVPKEYVPGVMKGLEESLPNGVLAGYPVVDFRAVLVDGSYHDVDSSVLAFQIAARGAFREGMRKAGPRLLEPIMRVEVITPEEHLGDVIGDLNSRRGQVNSFGDKPGGLKVVDAFVPLAEMFQYVSTLRGMTKGRASYTMQLAKFDVVPQHIQNQLSTKTEEATA

SEQ ID NO: 6123 - DNA, 1482 bp, Sorghum bicolor
  misc_feature: Ceres ANNOT ID no. 6064367
  misc_feature: Encodes the peptide sequence at SEQ ID NO 6124
atggcagctgcggcgtggctgtgtggactcctgtggctcctggcccacgccgccgctgtggcgtcggcggcggatggggcggatggtgggtgggagccgctgatacggatgccgacggggaaggggggtgacgctgctgctcgggcggttgaggaggatgatgaagtggggacgaggtgggccgtgctcgtcgccggctcctccggatacgggaactaccggcaccaggccgatgtgtgccatgcgtaccagatactgcggaagggaggagtgaaggaggagaacattgtggtgttcatgtatgatgacattgcccataacattctgaacccgaggcctggggttatcattaaccatccaaaaggcgaaaatgtttataatggtgttccaaaggattacacaggtgatcaggtcactaccgaaaacttctttgctgtcctcttgggcaataaaagtgctatcacaggagggagtaagaaggtgatagacagcaaacctaatgaccacatcttcatctattactcagatcatgggggtcctggagttcttggtatgccgaacttgccatatctgtatgctggcgacttcatcaaggttttgaaaaagaagcatgcttgcaatagctactcaaaaatggttatatatgttgaagcatgtgagagtggcagtatcttcgagggattaatgcctgaagatctgaatatttatgtcacaacagcctcaaatccagttgaaaatagttggggaacatactgccctgggatggaaccatcaccccctcctgagtacattacctgtttaggtgatttgtacagtgtttcttggatggaagatagtcaaacccacaatctaaagaaggaaaccatcaaggatcagtatgaagtggtgaaaacaagaacctcaaactcgaataagtacaaagagggttctcatgttatggagtatggtgataagaccttcaaggatgagaagcttttcctttatcaaggttttgatcctgctaatgccaacatcgcaaacatgctgctttggccaggcccaaagggtgcagtcaatcaaagagatgctgatcttctcttcatgtggaagaggtatgagcagttaaatggggagtctgtagagaagctgagggctctcatagagattaaagaaactgttcaacataggaagcatcttgacagcagtatcgatttcattgggaggcttctcttcggatttgagaaagggccttcaatgcttgaggctgttagagcctcgggtctaccattagtcgatgattgggattgcttgaagaggatggtgcgcattttcgaatcccagtgtggttcactcactcagtatggcatgaagtacatgcgagcatttgcaaacatttgcaacagcggtatatctgagatgaaaatgagggagtccagcatcagcgcttgcagcagctacaactccgcgaggtggagcccgatggctcagggacacagcgcttga

SEQ ID NO: 6124 - protein, 493 aa, Sorghum bicolor
  misc_feature: Ceres ANNOT ID no. 6064367
  misc_feature (59)..(331): Pfam Id: Peptidase_C13 Pfam Desc: Peptidase C13 family
  misc_feature (1)..(493): NCBI GI: 115459656 NCBI Desc: os04g0537900 [oryza sativa (japonica cultivar-group)]
  misc_feature (3)..(493): NCBI GI: 37542690 NCBI Desc: vacuolar processing enzyme 1 [zea mays]
  misc_feature (77)..(493): NCBI GI: 115447565 NCBI Desc: os02g0644000 [oryza sativa (japonica cultivar-group)]
  misc_feature (32)..(493): NCBI GI: 17864752 NCBI Desc: c13 cysteine proteinase precursor [oryza sativa subsp. indica]
  misc_feature (4)..(493): NCBI GI: 2414681 NCBI Desc: cysteine proteinase precursor [vicia narbonensis]
  misc_feature (31)..(493): SWISSPROT Homolog: EC 3.4.22.34 Legumain precursor
MAAAAWLCGLLWLLAHAAAVASAADGADGGWEPLIRMPTGKGGDAAARAVEEDDEVGTRWAVLVAGSSGYGNYRHQADVCHAYQILRKGGVKEENIVVFMYDDIAHNILNPRPGVIINHPKGENVYNGVPKDYTGDQVTTENFFAVLLGNKSAITGGSKKVIDSKPNDHIFIYYSDHGGPGVLGMPNLPYLYAGDFIKVLKKKHACNSYSKMVIYVEACESGSIFEGLMPEDLNIYVTTASNPVENSWGTYCPGMEPSPPPEYITCLGDLYSVSWMEDSQTHNLKKETIKDQYEVVKTRTSNSNKYKEGSHVMEYGDKTFKDEKLFLYQGFDPANANIANMLLWPGPKGAVNQRDADLLFMWKRYEQLNGESVEKLRALIEIKETVQHRKHLDSSIDFIGRLLFGFEKGPSMLEAVRASGLPLVDDWDCLKRMVRIFESQCGSLTQYGMKYMRAFANICNSGISEMKMRESSISACSSYNSARWSPMAQGHSA

SEQ ID NO: 6125 - DNA, 1992 bp, Sorghum bicolor
  misc_feature: Ceres ANNOT ID no. 6064373
  misc_feature: Encodes the peptide sequence at SEQ ID NO 6126
atgatcccggccgttgctgatccggcgacgttggacgacgtgggcgcgagcacaccgttgctcccggagacggaccctcgggggcgtgccggcgcagggcagaagcggccgccgccgccggcggcgacgacgaccgttctccccgccgtcgtctccgccgtgctcctgctcgtcctcgttgcggtcaccgtcctcgcgtcgcagcacgtcgacgacgggcaggccgggggcgtcgccgtcgtcgttcccgcgggcggcagcggcggcggcggccatgccgtcgtgcaggaggtggccgcctcccgtggcgtggccgagggcgtgtcggagaaatccacggccccgctcctcggcgccggcgccggcgcggtcgaggacttttcctggaccaacgcgatgctggcgtggcagcgcacggcgttccatttccagccccccaagaactggatgaacggtcctctgtaccacaagggctggtaccacctgttctaccagtggaacccggactcggcggtgtggggcaacatcacctggggccacgccgtgtcgcgcgacctcctccactggctgcacctaccgctggccatggtgccggatcacccgtacgacgccaacggcgtctggtcgggatccgccacgcggctcccggacggccggatcgtcatgctctacacgggctccacggcggagtcggtgcaggtgcagaacctcgcggagcccgccgacgcgtcggacccgctgctgcgggagtgggtcaagtcggacgccaacccggtgctggtgccgccgccgggcatcggggcgacggacttccgcgacccgacgacggcgtggcgggtcgccatcgggtccaaggaccgggaccacgccggcctggcgctggtgtaccggacggaggacttcgtgcggtacgacccggtgccggcgctgatgcacgtcgtccccggcaccggcatgtgggagtgcgtcgacttctacccggtggccgtggcggccaacaacggggacgggctggagacgtccgtgccgccggggcccggcgtgaagcacgtggtcaaggccagcctcgacgacgacaagcacgactactacgccatcggcacctacgacccggcgacggacacgtggacgcccgacgacgcggagaacgacgtcgggatcggactccggtacgactacggcaagtactacgcgtccaagaccttctacgaccccgtgcttcgccggcgggtgctctgggggtgggtcggcgagaccgacagcgagcgcgctgacatcctcaagggctgggcatccgtgcagtcaatccccaggacggtcctcctggacacgaagacgggcagcaaccttctccagtggccggtggtggaggtggagaacctccggatgagcggcaagcgcttcgacgacgtcgcgctgcaccgcggatcggtcgtgcccctcgacgtcggcaaggcgacacagttggacatcgaggccgtgttcgaggtggacgcggcggccgtggagggcgtgacggaggccgacgtgacgttcaactgcagcaccagcgccggcgcggcggggcggggcctgctcggcccgttcggccttctcgtgctggcggacgaggacttgtccgagcagaccgccgtgtacttctacctggtcaagggcacggacggcagcctccaaacgttcttctgccaagacgagctcagggcatccaaggcgaacgatctggttaagagagtatacggaagcttggtccctgtgctagatggggagaatctttcagtcagaatactggttgaccactccatcgtggagagctttgctcaaggcggaaggacgtgcatcacgtcgcgcgtgtaccctacacgagccatctacgactccgcccgcgtgttcctcttcaacaacgccacagatgtgcacgtcaaagcaaaatccgtcaagatctggcagctcaactccgcctacatccggccgtatgaagcgagttctctatga

SEQ ID NO: 6126 - protein, 663 aa, Sorghum bicolor
  misc_feature: Ceres ANNOT ID no. 6064373
  misc_feature (142)..(454): Pfam Id: Glyco_hydro_32N Pfam Desc: Glycosyl hydrolases family 32 N terminal
  misc_feature (495)..(609): Pfam Id: Glyco_hydro_32C Pfam Desc: Glycosyl hydrolases family 32 C terminal
  misc_feature (1)..(662): NCBI GI: 1122439 NCBI Desc: invertase
  misc_feature (1)..(658): NCBI GI: 115459644 NCBI Desc: os04g0535600 [oryza sativa (japonica cultivar-group)]
  misc_feature (15)..(658): NCBI GI: 116310092 NCBI Desc: h0502g05.3 [oryza sativa (indica cultivar-group)]
  misc_feature (15)..(658): NCBI GI: 9392663 NCBI Desc: vacuolar acid invertase [oryza sativa]
  misc_feature (37)..(658): NCBI GI: 1304362 NCBI Desc: invertase 5 [tulipa gesneriana]
  misc_feature (1)..(662): SWISSPROT Homolog: EC 3.2.1.26 Beta-fructofuranosidase 1 precursor
  misc_feature: Useful for making plants with altered carbohydrate content
  misc_feature: Functional homolog of the protein sequence given in SEQ ID NO 13945
  misc_feature: The sequence is a functional homolog of SEQ ID NO 4 in US patent 7253335
MIPAVADPATLDDVGASTPLLPETDPRGRAGAGQKRPPPPAATTTVLPAVVSAVLLLVLVAVTVLASQHVDDGQAGGVAVVVPAGGSGGGGHAVVQEVAASRGVAEGVSEKSTAPLLGAGAGAVEDFSWTNAMLAWQRTAFHFQPPKNWMNGPLYHKGWYHLFYQWNPDSAVWGNITWGHAVSRDLLHWLHLPLAMVPDHPYDANGVWSGSATRLPDGRIVMLYTGSTAESVQVQNLAEPADASDPLLREWVKSDANPVLVPPPGIGATDFRDPTTAWRVAIGSKDRDHAGLALVYRTEDFVRYDPVPALMHVVPGTGMWECVDFYPVAVAANNGDGLETSVPPGPGVKHVVKASLDDDKHDYYAIGTYDPATDTWTPDDAENDVGIGLRYDYGKYYASKTFYDPVLRRRVLWGWVGETDSERADILKGWASVQSIPRTVLLDTKTGSNLLQWPVVEVENLRMSGKRFDDVALHRGSVVPLDVGKATQLDIEAVFEVDAAAVEGVTEADVTFNCSTSAGAAGRGLLGPFGLLVLADEDLSEQTAVYFYLVKGTDGSLQTFFCQDELRASKANDLVKRVYGSLVPVLDGENLSVRILVDHSIVESFAQGGRTCITSRVYPTRAIYDSARVFLFNNATDVHVKAKSVKIWQLNSAYIRPYEASSL

SEQ ID NO: 6127 - DNA, 507 bp, Sorghum bicolor
  misc_feature: Ceres ANNOT ID no. 6064374
  misc_feature: Encodes the peptide sequence at SEQ ID NO 6128
atgaggaagaccttctgcttcgggggcagccgcttggccaggaggatgtcggagcgggcgccgatggtcgacgggtgcgtgttctgcgacatcgcccgccgcggccccacctccaccactgctcttctctactccgatgacaaggtcgtggccttccgcgacatcaacccgtcggcgttcaggcactatcttgtcatacccattgatcatataccaactgtaaatagcctccataaaaccaaagatgatcaccagttagtcagtcacatggtgaaggtggggaaagacttgctcaatcaagatgctcccaattctgaggaacacaggtttgggttccatcagcccccatttaatagtgtcaatcaccttcatcttcattgcctggcacttccctttatgcccagttggaggcaagtaaaatatacccctctgggacctttagggggttttatcgaagctgaaaagctattggaaagaataaaaccagaagcggaagtatacagttag

SEQ ID NO: 6128 - protein, 168 aa, Sorghum bicolor
  misc_feature: Ceres ANNOT ID no. 6064374
  misc_feature (38)..(133): Pfam Id: HIT Pfam Desc: HIT domain
  misc_feature (1)..(162): NCBI GI: 115459642 NCBI Desc: os04g0535400 [oryza sativa (japonica cultivar-group)]
  misc_feature (22)..(162): NCBI GI: 116310091 NCBI Desc: h0502g05.2 [oryza sativa (indica cultivar-group)]
  misc_feature (46)..(162): NCBI GI: 38605895 NCBI Desc: osjnbb0020o11.7 [oryza sativa (japonica cultivar-group)]
  misc_feature (26)..(129): NCBI GI: 89272536 NCBI Desc: histidine triad nucleotide binding protein 3 [xenopus tropicalis]
  misc_feature (17)..(129): NCBI GI: 21654864 NCBI Desc: histidine triad protein 4 [rattus norvegicus]
MRKTFCFGGSRLARRMSERAPMVDGCVFCDIARRGPTSTTALLYSDDKVVAFRDINPSAFRHYLVIPIDHIPTVNSLHKTKDDHQLVSHMVKVGKDLLNQDAPNSEEHRFGFHQPPFNSVNHLHLHCLALPFMPSWRQVKYTPLGPLGGFIEAEKLLERIKPEAEVYS

SEQ ID NO: 6129 - DNA, 690 bp, Sorghum bicolor
  misc_feature: Ceres ANNOT ID no. 6064376
  misc_feature: Encodes the peptide sequence at SEQ ID NO 6130
atgggcaccggcgacacgctcgacaagctggtggtgttcctggcgaagcgcgatggcatcgacaagctggtgaagacgttccagtacgtgtccaagctggcgcactggggcgccgagtcgtcctccctcccggagctcgccaggcgcgccaagagctgggagacggcgtccgggctgagccgcaaggcgttccggtcgggccggttcctgacgggcttcaacgcgctgcgccggggcccgccgccgccgggggacgagttcggcgcgctcgccgtgctggccaacgccggcgagatggtctacttcttcttcgaccacttcacgtggctgtcccgcgtgggcgtcctcgatccctggatagctccccgggccagctacgtgtcggccttcggcgaggccgtcggctacgtcttcttcgtcgccatggatctcatcatgatcaggcggggcctgcggcgggagaggaagctgttgaaggagaaggacggcggcgaggacgcggagaaggaggtgcggaggatccgggtggacagggtgatgcggctcatggcgacggcggccaacgccgccgacttcatcatctgcatcgcggaaaccgatcccaacccgttctgcaaccacgccgtcacgctggggattagcggcctcgtctcagcgtgggccggctggtacagaaactggccctcgtga

SEQ ID NO: 6130 - protein, 229 aa, Sorghum bicolor
  misc_feature: Ceres ANNOT ID no. 6064376
  misc_feature (7)..(227): Pfam Id: PEX11 Pfam Desc: Peroxisomal biogenesis factor 11 (PEX11)
  misc_feature (1)..(229): NCBI GI: 38605902 NCBI Desc: osjnbb0020o11.14 [oryza sativa (japonica cultivar-group)]
  misc_feature (6)..(185): NCBI GI: 109639284 NCBI Desc: pex11p [pichia angusta]
  misc_feature (7)..(117): NCBI GI: 92886312 NCBI Desc: peroxisomal biogenesis factor 11 [medicago truncatula]
  misc_feature (13)..(223): NCBI GI: 55585501 NCBI Desc: peroxin-11 [penicillium chrysogenum]
  misc_feature (7)..(115): NCBI GI: 125811851 NCBI Desc: ga20979-pa [drosophila pseudoobscura]
MGTGDTLDKLVVFLAKRDGIDKLVKTFQYVSKLAHWGAESSSLPELARRAKSWETASGLSRKAFRSGRFLTGFNALRRGPPPPGDEFGALAVLANAGEMVYFFFDHFTWLSRVGVLDPWIAPRASYVSAFGEAVGYVFFVAMDLIMIRRGLRRERKLLKEKDGGEDAEKEVRRIRVDRVMRLMATAANAADFIICIAETDPNPFCNHAVTLGISGLVSAWAGWYRNWPS

SEQ ID NO: 6131 - DNA, 750 bp, Sorghum bicolor
  misc_feature: Ceres ANNOT ID no. 6064378
  misc_feature: Encodes the peptide sequence at SEQ ID NO 6132
atggggtctgactccaagggcttgctcgagatcgagcccctcgagctccgattcccattcgagacaaagaagcagatctcgtgctctatgcagttgacgaacagaacagatgactacatcggctttaaggttaagacaacgagcccgaagaagtactgtgtccggccgaacagcggcattgtgccacctcggtccaccagcgatgtcatcgtggcaatgcaagcacaaaaggaggcaccaccagacatgcagtgcaaggacaagtttcttgtgcaaagtgtaattgtggcggaagggacgttagtcaaggacatcactggacatatgtttctcaaagaatcaggtaatgtggtggatgaggttaagctgaaggttgtctacgtcccgccacccaaaccaccatccccagtgcgtgagggatctgaagaaggctcatcaccccgagcttcattatctgatggtagtaacttgaattatctagagatgcagacaacgagggaatctgatgagccactgttttccgctgttaaaactcacaaagatcaagaagactacacctctgagacatctgctttgatttcaaagttgacagaagagagaaactctgccgttcagcagaacaataagcttcgagaggaactggaccttttgaggagggaagtcagcaagcagaatggtggattctcctttgtggtcgtggtggccattgctctcctgggaatgctactaggatatatcatgaagagatag

SEQ ID NO: 6132 - protein, 249 aa, Sorghum bicolor
  misc_feature: Ceres ANNOT ID no. 6064378
  misc_feature (8)..(115): Pfam Id: Motile_Sperm Pfam Desc: MSP (Major sperm protein) domain
  misc_feature (1)..(249): NCBI GI: 115459632 NCBI Desc: os04g0534400 [oryza sativa (japonica cultivar-group)]
  misc_feature (1)..(249): NCBI GI: 116310461 NCBI Desc: osigba0159i10.10 [oryza sativa (indica cultivar-group)]
  misc_feature (8)..(249): NCBI GI: 92872094 NCBI Desc: major sperm protein [medicago truncatula]
  misc_feature (1)..(249): NCBI GI: 6688926 NCBI Desc: vap27 [nicotiana plumbaginifolia]
  misc_feature (1)..(156): NCBI GI: 79315832 NCBI Desc: vap27-1 (vamp/synaptobrevin-associated protein 27-1); structural molecule [arabidopsis thaliana]
  misc_feature: The sequence is a functional homolog of SEQ ID NO. 356 in the 11/188,298 US application
MGSDSKGLLEIEPLELRFPFETKKQISCSMQLTNRTDDYIGFKVKTTSPKKYCVRPNSGIVPPRSTSDVIVAMQAQKEAPPDMQCKDKFLVQSVIVAEGTLVKDITGHMFLKESGNVVDEVKLKVVYVPPPKPPSPVREGSEEGSSPRASLSDGSNLNYLEMQTTRESDEPLFSAVKTHKDQEDYTSETSALISKLTEERNSAVQQNNKLREELDLLRREVSKQNGGFSFVVVVAIALLGMLLGYIMKR

SEQ ID NO: 6133 - DNA, 639 bp, Sorghum bicolor
  misc_feature: Ceres ANNOT ID no. 6064386
  misc_feature: Encodes the peptide sequence at SEQ ID NO 6134
atggctgaggaggcggccaagaaggtggaggtggaggtcaccaaggacaaggagcccgaggcggcgcccgcggaggccgtgccggaggcggcggccaaggaggacgtcgccgaggagaaggccgtcatccccgcgaccgagccgccggccgccgaggagaagccgccggccgacgattccaaggccctcgccatcgtcgagaaagttgcagatgaacctgctccagagaagcctgctgctgagaagcaagggggttccaatgacagagatcttgctcttgcaagggtggaaacagagaagaggaactctttgatcaaagcatgggaagagaatgagaagacaaaagctgagaacaaggctgctaagaaagtatccgctattctttcatgggagaacacaaagaaagcaaacatagaagctcaactgaagaagattgaggaacaactggaaaagaagaaggccgaatatgctgagaagatgaagaacaaggttgcaatgatccacaaggaagccgaggagaagcgagcgatggtggaggcaaagcgcggtgaggaggtcctgaaggccgaggagatggctgccaaataccgggccaccgggcacgctcctaagaagctcatcgggtgcttcggagcctaa

SEQ ID NO: 6134 - protein, 212 aa, Sorghum bicolor
  misc_feature: Ceres ANNOT ID no. 6064386
  misc_feature (98)..(207): Pfam Id: Remorin_C Pfam Desc: Remorin, C-terminal region
  misc_feature (34)..(96): Pfam Id: Remorin_N Pfam Desc: Remorin, N-terminal region
  misc_feature (1)..(210): NCBI GI: 34925093 NCBI Desc: remorin (pp34)
  misc_feature (1)..(210): NCBI GI: 4731573 NCBI Desc: remorin 1 [lycopersicon esculentum]
  misc_feature (1)..(209): NCBI GI: 42573455 NCBI Desc: remorin family protein [arabidopsis thaliana]
  misc_feature (1)..(209): NCBI GI: 21555669 NCBI Desc: remorin [arabidopsis thaliana]
  misc_feature (26)..(210): NCBI GI: 601843 NCBI Desc: dna-binding protein
  misc_feature: The sequence is a functional homolog of SEQ ID NO 1492 in the 11/479,226US patent application
  misc_feature: The sequence is a functional homolog of SEQ ID NO 1773 in the 11/479,226US patent application
  misc_feature: The sequence is a functional homolog of SEQ ID NO 2 in the 10/286,264US patent application
  misc_feature: The sequence is a functional homolog of SEQ ID NO 20 in the 10/286,264US patent application
  misc_feature: The sequence is a functional homolog of SEQ ID NO 2658 in the 10/374,780US patent application
  misc_feature: The sequence is a functional homolog of SEQ ID NO 438 in the 10/666,642US patent application
  misc_feature: The sequence is a functional homolog of SEQ ID NO 496 in the 11/435,388US patent application
  misc_feature: The sequence is a functional homolog of SEQ ID NO 644 in the 11/435,388US patent application
  misc_feature: The sequence is a functional homolog of SEQ ID NO 652 in the 10/225,066US patent application
  misc_feature: The sequence is a functional homolog of SEQ ID NO 716 in the 10/412,699US patent application
  misc_feature: The sequence is a functional homolog of SEQ ID NO 876 in the 10/412,699US patent application
  misc_feature: The sequence is a functional homolog of SEQ ID NO 922 in the 10/412,699US patent application
  misc_feature: Useful for making plants with modulated growth and phenotype characteristics
  misc_feature: The sequence is a functional homolog of SEQ ID NO 2 in the 20030093837 US patent application
  misc_feature: The sequence is a functional homolog of SEQ ID NO 20 in the 20030093837 US patent application
  misc_feature: The sequence is a functional homolog of SEQ ID NO 716 in the 20040045049 US patent application
  misc_feature: The sequence is a functional homolog of SEQ ID NO 496 in the 20060272060 US patent application
  misc_feature: The sequence is a functional homolog of SEQ ID NO 438 in the 20070033671 US patent application
  misc_feature: The sequence is a functional homolog of SEQ ID NO 1773 in the 11/479,226 US patent application
  misc_feature: The sequence is a functional homolog of SEQ ID NO 20 in the 10/286,264 US patent application
  misc_feature: The sequence is a functional homolog of SEQ ID NO 876 in the 10/412,699 US patent application
MAEEAAKKVEVEVTKDKEPEAAPAEAVPEAAAKEDVAEEKAVIPATEPPAAEEKPPADDSKALAIVEKVADEPAPEKPAAEKQGGSNDRDLALARVETEKRNSLIKAWEENEKTKAENKAAKKVSAILSWENTKKANIEAQLKKIEEQLEKKKAEYAEKMKNKVAMIHKEAEEKRAMVEAKRGEEVLKAEEMAAKYRATGHAPKKLIGCFGA

SEQ ID NO: 6135 - DNA, 612 bp, Sorghum bicolor
  misc_feature: Ceres ANNOT ID no. 6064391
  misc_feature: Encodes the peptide sequence at SEQ ID NO 6136
atgtctttcaccggcacgcaggacaagtgcacggcgtgcgacaagaccgtccatttcatcgacctcctcacggccgacggcgtcatctaccacaagacatgcttcaagtgcagccactgcaaggggatcctctcgatgtgcagctactcttccatggacggtgtgctgtactgcaagacccacttcgagcagctcttcaaggagaccgggagcttctccaagaagttcacgccaggttgcaagtcagacaagggtgaactggcaagggccccaagcaagctatcgtctgcattttctggtactcaggataagtgtgcagcatgccagaaaacagtgtacccgctggagaagttaactttggaaggcgaggcctaccacaagagctgcttcaagtgctcacacgggggctgcatcctgaccacctcctcctacgccgcgctcaacggcgtcttgtactgcaagatccacttcgggcagctgttcatggagaaggggagctacaaccacatgaagaagaagagcacgtcccaggaggtgctgccggacttggctgccgaggagcaacctccgcaaccagcggcaccggaagatgagaaaggagaggacaactag

SEQ ID NO: 6136 - protein, 203 aa, Sorghum bicolor
  misc_feature: Ceres ANNOT ID no. 6064391
  misc_feature (10)..(66): Pfam Id: LIM Pfam Desc: LIM domain
  misc_feature (105)..(161): Pfam Id: LIM Pfam Desc: LIM domain
  misc_feature (1)..(202): NCBI GI: 117950165 NCBI Desc: lim domain protein plim2a [populus tremula x populus alba]
  misc_feature (1)..(201): NCBI GI: 8515104 NCBI Desc: lim domain protein plim-2 [nicotiana tabacum]
  misc_feature (2)..(203): NCBI GI: 42566107 NCBI Desc: lim domain-containing protein [arabidopsis thaliana]
  misc_feature (2)..(203): NCBI GI: 6850890 NCBI Desc: lim domain protein [arabidopsis thaliana]
  misc_feature (1)..(200): NCBI GI: 15223476 NCBI Desc: lim domain-containing protein [arabidopsis thaliana]
  misc_feature: The sequence is a functional homolog of SEQ ID NO 1308 in the 11/479,226US patent application
  misc_feature: The sequence is a functional homolog of SEQ ID NO 612 in the 10/412,699US patent application
  misc_feature: Useful for making plants with modulated growth and phenotype characteristics
  misc_feature: The sequence is a functional homolog of SEQ ID NO 612 in the 20040045049 US patent application
  misc_feature: The sequence is a functional homolog of SEQ ID NO 1308 in the 11/479,226 US patent application
  misc_feature: The sequence is a functional homolog of SEQ ID NO 612 in the 10/412,699 US patent application
  misc_feature: Useful for making plants with modulated heat sensitivity
  misc_feature: Functional homolog of the protein sequence given in SEQ ID NO 13762
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
  misc_feature: Useful for making plants with altered carbohydrate content
  misc_feature: Functional homolog of the protein sequence given in SEQ ID NO 13763
MSFTGTQDKCTACDKTVHFIDLLTADGVIYHKTCFKCSHCKGILSMCSYSSMDGVLYCKTHFEQLFKETGSFSKKFTPGCKSDKGELARAPSKLSSAFSGTQDKCAACQKTVYPLEKLTLEGEAYHKSCFKCSHGGCILTTSSYAALNGVLYCKIHFGQLFMEKGSYNHMKKKSTSQEVLPDLAAEEQPPQPAAPEDEKGEDN

SEQ ID NO: 6137 - DNA, 900 bp, Sorghum bicolor
  misc_feature: Ceres ANNOT ID no. 6064393
  misc_feature: Encodes the peptide sequence at SEQ ID NO 6138
atggcggccgctatcggcacaagggttgctgttgtcaccggcgggaacaaaggtatcgggctggaggtgtgcaggcagctggccagcaatggcatcaccgtcgtcttgacagccagggacgagaagaggggcgcagccgccgtagaggagctcaaagacgcggggctctccgatgtcattttccatcagctggaggtcaccgatgctcagagcatcgctagattggccggtttcttgaaggcgcgttttggaaagctagacatcctggtaaacaatgccgctatcggtggggttgagacacttcccatcgaaaatcctgctgagatcaagggcctggatgcgtttcagatgatgcaatggatggggaaacaatgccggccgacaagcgacgctgctaaggcaggcattcagacaaactactacggggtgaagaacgtgaccgaagcgctgctgccgctgctgcaagcctcctccgacggaagggtcgtcaacgtctcctccgacttcggcctgctaagtcatatcaggaacgaggaggtgaagcaggagctggacgacatcgagaacctgacggaggagaggctggacgagctgctgagcgcgttcctccgggacttcgaggccggcgcgctggacgcccgcgggtggccgacggagttctcggcgtacaaggtggccaaggtggccctgaactcgtactcgagggtgctggcgaggaggcacccggagctgcgcatcaactgcgcgcatcccgggtacgtgaagaccgacatgaccaggcagactggcctgctgacgcccgcggagggcgcggccaacatcgtgaaggtggcgctgcttccggaaggtggccagaccggcgctttcttcgcgttaggccaggaggcgccgttcgtgtga

SEQ ID NO: 6138 - protein, 299 aa, Sorghum bicolor
  misc_feature: Ceres ANNOT ID no. 6064393
  misc_feature (8)..(181): Pfam Id: adh_short Pfam Desc: short chain dehydrogenase
  misc_feature (7)..(299): NCBI GI: 38346994 NCBI Desc: osjnbb0039l24.4 [oryza sativa (japonica cultivar-group)]
  misc_feature (8)..(299): NCBI GI: 38346993 NCBI Desc: osjnbb0039l24.1 [oryza sativa (japonica cultivar-group)]
  misc_feature (8)..(299): NCBI GI: 38346995 NCBI Desc: osjnbb0039l24.6 [oryza sativa (japonica cultivar-group)]
  misc_feature (8)..(299): NCBI GI: 38346768 NCBI Desc: osjnba0081c01.19 [oryza sativa (japonica cultivar-group)]
  misc_feature (2)..(299): NCBI GI: 38346767 NCBI Desc: osjnba0081c01.18 [oryza sativa (japonica cultivar-group)]
  misc_feature: The sequence is a functional homolog of SEQ ID NO. 453 in the 11/188,298 US application
MAAAIGTRVAVVTGGNKGIGLEVCRQLASNGITVVLTARDEKRGAAAVEELKDAGLSDVIFHQLEVTDAQSIARLAGFLKARFGKLDILVNNAAIGGVETLPIENPAEIKGLDAFQMMQWMGKQCRPTSDAAKAGIQTNYYGVKNVTEALLPLLQASSDGRVVNVSSDFGLLSHIRNEEVKQELDDIENLTEERLDELLSAFLRDFEAGALDARGWPTEFSAYKVAKVALNSYSRVLARRHPELRINCAHPGYVKTDMTRQTGLLTPAEGAANIVKVALLPEGGQTGAFFALGQEAPFV

SEQ ID NO: 6139 - DNA, 933 bp, Sorghum bicolor
  misc_feature: Ceres ANNOT ID no. 6064394
  misc_feature: Encodes the peptide sequence at SEQ ID NO 6140
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
atggaggccgctattcccaatcccagtgccctgaaaacaaggattgccgtggtcaccggcgggaacaaagggattgggctagaggtttgccggcagctggccggcgacggcgccaccgtggtcttaacagccagggacgagacgaggggcgcagccgctgcagagaagctcagagaagcagggctctccaatgttattttccatcagctggagattactgatgctccgagcatcgctcggttggctgagttcctcaagactcgttttgggaagctagacatactgataaataatgccgcaattggtgctgttgagtacgtccaagatcctgccgacagtccagcaagcgaggaaaagttcagtggcatggatcagggccaaaggcttgaatgcatgtttaaaggtgtccgggagacctacgacgctgcaagagaaggcgtgaagaccaactactatggcgtaaagcatgtgattgaagccttactgcctctgctgcaggcttcctccgatgggaggatcgtcaatgtctcctctgaatttgggctgctaaggctaatcaacaacgaggagctaaggcaggagctgaacgatgtggagaagctgaccgaggagaggctggacgaggtgctggccacgttcctaagagacttcgaggccggcgaggtggaggcgcgtgggtggccgatggctttctcggcgtacaaggtggccaaggtggccatgaacgcgtactcgaggatcctggcaagaaggcaccccgaactgcgcatcaactgcgcgcaccccggctacgtgagcaccgacatgaccatccacaccggacccctgacgcccgaggaaggcgcggccaacttggtgaaggtggcgctgctgccggaaggcggcccgaccggcgcatacttcgcgtggggagtggaggcgtcctttgtgtga

SEQ ID NO: 6140 - protein, 310 aa, Sorghum bicolor
  misc_feature: Ceres ANNOT ID no. 6064394
  misc_feature (14)..(191): Pfam Id: adh_short Pfam Desc: short chain dehydrogenase
  misc_feature (9)..(310): NCBI GI: 38346993 NCBI Desc: osjnbb0039l24.1 [oryza sativa (japonica cultivar-group)]
  misc_feature (1)..(310): NCBI GI: 38346995 NCBI Desc: osjnbb0039l24.6 [oryza sativa (japonica cultivar-group)]
  misc_feature (9)..(310): NCBI GI: 38346994 NCBI Desc: osjnbb0039l24.4 [oryza sativa (japonica cultivar-group)]
  misc_feature (9)..(310): NCBI GI: 38346768 NCBI Desc: osjnba0081c01.19 [oryza sativa (japonica cultivar-group)]
  misc_feature (1)..(310): NCBI GI: 38346767 NCBI Desc: osjnba0081c01.18 [oryza sativa (japonica cultivar-group)]
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
  misc_feature: The sequence is a functional homolog of SEQ ID NO. 453 in the 11/188,298 US application
MEAAIPNPSALKTRIAVVTGGNKGIGLEVCRQLAGDGATVVLTARDETRGAAAAEKLREAGLSNVIFHQLEITDAPSIARLAEFLKTRFGKLDILINNAAIGAVEYVQDPADSPASEEKFSGMDQGQRLECMFKGVRETYDAAREGVKTNYYGVKHVIEALLPLLQASSDGRIVNVSSEFGLLRLINNEELRQELNDVEKLTEERLDEVLATFLRDFEAGEVEARGWPMAFSAYKVAKVAMNAYSRILARRHPELRINCAHPGYVSTDMTIHTGPLTPEEGAANLVKVALLPEGGPTGAYFAWGVEASFV

SEQ ID NO: 6141 - DNA, 933 bp, Sorghum bicolor
  misc_feature: Ceres ANNOT ID no. 6064395
  misc_feature: Encodes the peptide sequence at SEQ ID NO 6142
atggagggcgatctccccactcctgcgaacgccagggtcgccgtggtcaccggcggcaacaaagggatcgggctggaggtgtgccggcagctggccggcaacggggtcaccgtcgtcttaacagccagggacgaggcgaggggcgctgcggccgtggagaagctcagagacctggggctctccgatgtccttttccaccaactggacattatcgatgctccgagcatcgctcgaattgctgagttcctcaagacccgtttcgggaagctagatatcctggtgatcactgaaccgtctacggtaaataatgccgcgattggtgggattgagtatgttcatgaccaagatcgtgactcagtaacgagcgaggaaaaggcaaagaggcttggatggctgtggcaaaattgccgggagacttacgatgatgcaaagacaggcctgcgcacaaactactacggcacaaagcaactaatccaagttttactccctctgctgcaggcctcctccgatgggaggatcgttaacgtctcctcccacttcgggcagctcaggcttttccgaaacgaggagctgaagcgggagctgaacgacattgataacctcaccccggagaggctggatggcctgctggacatgttcctgaaagacttcgaggccggcgcggtggaatccaacggctggccgatgtatttctcggcgtacaaggtggccaaggcggccatgaacgcgtactcgaggatcctggcgaggcggcaccccgagctgcgcgtcaactgtgcgcatcctggctacgtgaagaccgacatgaccatacactcggggctgttgacgccggaggaaggcggcagcagggtggccatggtggcgctgctgccggaaggcgggccgaccggcgcgttctttgaagactttgcagagtcctcgttcgtgtga

SEQ ID NO: 6142 - protein, 310 aa, Sorghum bicolor
  misc_feature: Ceres ANNOT ID no. 6064395
  misc_feature (12)..(191): Pfam Id: adh_short Pfam Desc: short chain dehydrogenase
  misc_feature (1)..(310): NCBI GI: 38346993 NCBI Desc: osjnbb0039l24.1 [oryza sativa (japonica cultivar-group)]
  misc_feature (1)..(310): NCBI GI: 38346994 NCBI Desc: osjnbb0039l24.4 [oryza sativa (japonica cultivar-group)]
  misc_feature (1)..(310): NCBI GI: 38346768 NCBI Desc: osjnba0081c01.19 [oryza sativa (japonica cultivar-group)]
  misc_feature (1)..(310): NCBI GI: 38346995 NCBI Desc: osjnbb0039l24.6 [oryza sativa (japonica cultivar-group)]
  misc_feature (5)..(310): NCBI GI: 38346767 NCBI Desc: osjnba0081c01.18 [oryza sativa (japonica cultivar-group)]
  misc_feature: The sequence is a functional homolog of SEQ ID NO. 453 in the 11/188,298 US application
MEGDLPTPANARVAVVTGGNKGIGLEVCRQLAGNGVTVVLTARDEARGAAAVEKLRDLGLSDVLFHQLDIIDAPSIARIAEFLKTRFGKLDILVITEPSTVNNAAIGGIEYVHDQDRDSVTSEEKAKRLGWLWQNCRETYDDAKTGLRTNYYGTKQLIQVLLPLLQASSDGRIVNVSSHFGQLRLFRNEELKRELNDIDNLTPERLDGLLDMFLKDFEAGAVESNGWPMYFSAYKVAKAAMNAYSRILARRHPELRVNCAHPGYVKTDMTIHSGLLTPEEGGSRVAMVALLPEGGPTGAFFEDFAESSFV

SEQ ID NO: 6143 - DNA, 963 bp, Sorghum bicolor
  misc_feature: Ceres ANNOT ID no. 6064400
  misc_feature: Encodes the peptide sequence at SEQ ID NO 6144
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
atggagtaccgcgacaagctggtgctcgcgcccatggtccgcgtgggcaccttgccatttaggctactggctgctgaatatggtgctgatattacttatggagaagagattattgatcacaaattgttgaagtgtgagcgtgttacaaatgaatctcttgggactactgattttgtggagaaagggactgacagtgtagttttccgtacatgcccagaagaaaggggtagggttgtattccaaatgggcacatcaaatgctgtgagggcacttaaagctgctcagcttgtgtgtcaggatgttactgctatagatatcaacatgggctgtccaaagtctttttcgcttagtggagggatgggtgctgcattactctccaagcctgagcttatacatgatattttgacaacattgcggaggaacttggacacaacagtgacatgtaaaatccgtcttctgaacacacctaaagacactgtggagttggcgcgccggattgagaaaactggtgttccagctcttgctgtccatggaagaaagattaaagatagaccaagagatcctgccaagtgggatgagatagccgatgttgtgtcagcgctgtcaattcctgttatagctaatggagatgtctttgagtatgaggattttaagagaattaaagatgctacaggtgctgcttctattatggttgctagaggtgccatgtggaatgcctctatcttttgtgccaaaggaaaaacaccttgggaggatgtcaagagagagtatgtacgaaagagcatattgtgggacaacgatgtgaagagcacgaaacataccttgaaagaaatgataatgcactattcttgccttgaacttcctgaggggaaaggtgttattaagtgtgatacatcagaagatttagcgagactatatggggaggaggactactataattttgttgtttcaaataggaaatga

SEQ ID NO: 6144 - protein, 320 aa, Sorghum bicolor
  misc_feature: Ceres ANNOT ID no. 6064400
  misc_feature (8)..(316): Pfam Id: Dus Pfam Desc: Dihydrouridine synthase (Dus)
  misc_feature (1)..(319): NCBI GI: 38346764 NCBI Desc: osjnba0081c01.15 [oryza sativa (japonica cultivar-group)]
  misc_feature (1)..(318): NCBI GI: 145339295 NCBI Desc: fad binding / oxidoreductase [arabidopsis thaliana]
  misc_feature (1)..(312): NCBI GI: 62859019 NCBI Desc: loc548984 [xenopus tropicalis]
  misc_feature (1)..(311): NCBI GI: 55238028 NCBI Desc: ensangp00000010262 [anopheles gambiae str. pest]
  misc_feature (1)..(311): NCBI GI: 108871488 NCBI Desc: trna-dihydrouridine synthase [aedes aegypti]
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
MEYRDKLVLAPMVRVGTLPFRLLAAEYGADITYGEEIIDHKLLKCERVTNESLGTTDFVEKGTDSVVFRTCPEERGRVVFQMGTSNAVRALKAAQLVCQDVTAIDINMGCPKSFSLSGGMGAALLSKPELIHDILTTLRRNLDTTVTCKIRLLNTPKDTVELARRIEKTGVPALAVHGRKIKDRPRDPAKWDEIADVVSALSIPVIANGDVFEYEDFKRIKDATGAASIMVARGAMWNASIFCAKGKTPWEDVKREYVRKSILWDNDVKSTKHTLKEMIMHYSCLELPEGKGVIKCDTSEDLARLYGEEDYYNFVVSNRK

SEQ ID NO: 6145 - DNA, 2301 bp, Sorghum bicolor
  misc_feature: Ceres ANNOT ID no. 6064404
  misc_feature: Encodes the peptide sequence at SEQ ID NO 6146
atgcctctcgccctcctcctctgcctcctcgcctgcggcgcagcaggcgccgccgccaccgcgcgcccgtgcgcgtcgccttattccggcagcagcgcctacccgttctgcgacgcgtcgctctccatcccggcccgcgcgcgcgcgctcgtctcgctgctcaccctggacgagaagatcgcgcagctgtccaacacggcgggcggggtcccgcgcctgggcatcccgccctaccagtggtggtccgagtcgctccacggcctcgccgacaacgggcccggggtcaacttctcctcgggccccgtccgcgccgccaccacgttcccgcaggtcatcctgtccaccgccgccttcaaccgctcgctgtggcgcgccgtcgccgaggccgttgcgacggaggcgctcggcatgcacaacgccggccaggccggcctcacgtactgggcgcccaacatcaacatcttccgagacccgaggtggggccgtggccaggagacgtccggggaggaccccgctgtcgccgccgcgtactccctcgagtatgtcaagggcttccagggggagcaaggggaggaaggcagaatcaggctctctgcgtgctgcaagcactatacagcgtatgacatggagaaatgggaaggattctcgaggtacaccttcaatgccaaggtaaatgcacaagatttggaagacacgtaccagccgcctttcaagacctgcatccaggaggctcgtgctagctgcttgatgtgtgcatataaccaggtcaatggcgtgcctatgtgtgctaacaaagatcttctacagaagaccagggatgaatggggcttccaggggtatattacatctgattgtgatgctgtggcaattattcatgaaaaccagacatacactaaatcagatgaagattcgatagcaattgttcttaaggcaggaatggatatcaactgtggttctttcctagttcggcatactaagtcagcagttgagaagggaaaggttcaagaacaagatatcgaccgtgccctttttaatctattctctgttcaattgcgtcttggaatatttgataagcccaacaacaaccaatggtccactcaactagggcccaacaatgtgtgcacgaaagagcatagagagcttgcagcagaagctgtaaggcagggtgctgtccttctgaagaatgaccatagttttttgcctctgaagagaagcgaagttagacatgttgccatcattggaccatctgcaaatgatgtgtatgcgatgggtggagactatacaggtgtagcctgcaacccgacgaccttccttaagggcattcaagcctatgctacacaaacaacctttgccgctggatgcaaggatgtttcctgtaactcaacagaattgtttggcgaagctattgctgcagctaaaagagccgatattgttgttgtagttgctggcttgaacctgacagaagagcgtgaagacttcgatagagtgagccttctccttccaggcaagcagatgagcctcatacatgccgttgctagtgtagcgaagaagccccttgtgttggttctcttaggtggtggtcctgttgatgtttcatttgctaagcaagatccacgaattgcaagcattctttggctcggatatcctggtgaggttggtggacaggtccttccggaaattctttttggagagtacaacccaggaggaaagctggctatgacttggtatcccgaatcctttactgctattccgatgactgatatgaacatgagagctgacccttcacgaggctaccctgggagaacatatcgattttacactggcgatgtagtgtatggttttggatacggtttaagttactccaaatattcgtatagcatcttgtcggctccaaagaagatcaccatgtcgcgttcatcagttttggacattattagtagaaagccttcatacataaggagggatggactagacttcgtgaaaactgaagatattgcatcatgtgaagctctggcattctctgttcatgtcgctgtttcaaatcatggtagcatggatgggagtcatgctgttcttctgtttgcgagatcgaaatcaagcgttccgggctttcctatcaaacagctggttgggttcgagcgtgtccacacggcggctggcagtgcatccaatgtggagattagcgtcgacccttgcaagcatatgagcgcagccaatcctgaaggcaaaagggtactgttattgggtgaccatgttctgacggtgggtgatgaagagttcgaattattcattgaactctga

SEQ ID NO: 6146 - protein, 766 aa, Sorghum bicolor
  misc_feature: Ceres ANNOT ID no. 6064404
  misc_feature (390)..(622): Pfam Id: Glyco_hydro_3_C Pfam Desc: Glycosyl hydrolase family 3 C terminal domain
  misc_feature (67)..(318): Pfam Id: Glyco_hydro_3 Pfam Desc: Glycosyl hydrolase family 3 N terminal domain
  misc_feature (1)..(765): NCBI GI: 38346760 NCBI Desc: osjnba0081c01.11 [oryza sativa (japonica cultivar-group)]
  misc_feature (192)..(765): NCBI GI: 7671447 NCBI Desc: beta-xylosidase-like protein [arabidopsis thaliana]
  misc_feature (1)..(762): NCBI GI: 18025342 NCBI Desc: beta-d-xylosidase [hordeum vulgare]
  misc_feature (3)..(765): NCBI GI: 62734696 NCBI Desc: beta-d-xylosidase [oryza sativa (japonica cultivar-group)]
  misc_feature (7)..(762): NCBI GI: 115485163 NCBI Desc: os11g0297300 [oryza sativa (japonica cultivar-group)]
  misc_feature: The sequence is a functional homolog of SEQ ID NO. 525 in the 11/188,298 US application
MPLALLLCLLACGAAGAAATARPCASPYSGSSAYPFCDASLSIPARARALVSLLTLDEKIAQLSNTAGGVPRLGIPPYQWWSESLHGLADNGPGVNFSSGPVRAATTFPQVILSTAAFNRSLWRAVAEAVATEALGMHNAGQAGLTYWAPNINIFRDPRWGRGQETSGEDPAVAAAYSLEYVKGFQGEQGEEGRIRLSACCKHYTAYDMEKWEGFSRYTFNAKVNAQDLEDTYQPPFKTCIQEARASCLMCAYNQVNGVPMCANKDLLQKTRDEWGFQGYITSDCDAVAIIHENQTYTKSDEDSIAIVLKAGMDINCGSFLVRHTKSAVEKGKVQEQDIDRALFNLFSVQLRLGIFDKPNNNQWSTQLGPNNVCTKEHRELAAEAVRQGAVLLKNDHSFLPLKRSEVRHVAIIGPSANDVYAMGGDYTGVACNPTTFLKGIQAYATQTTFAAGCKDVSCNSTELFGEAIAAAKRADIVVVVAGLNLTEEREDFDRVSLLLPGKQMSLIHAVASVAKKPLVLVLLGGGPVDVSFAKQDPRIASILWLGYPGEVGGQVLPEILFGEYNPGGKLAMTWYPESFTAIPMTDMNMRADPSRGYPGRTYRFYTGDVVYGFGYGLSYSKYSYSILSAPKKITMSRSSVLDIISRKPSYIRRDGLDFVKTEDIASCEALAFSVHVAVSNHGSMDGSHAVLLFARSKSSVPGFPIKQLVGFERVHTAAGSASNVEISVDPCKHMSAANPEGKRVLLLGDHVLTVGDEEFELFIEL

SEQ ID NO: 6147 - DNA, 1632 bp, Sorghum bicolor
  misc_feature: Ceres ANNOT ID no. 6064415
  misc_feature: Encodes the peptide sequence at SEQ ID NO 6148
atgtcaccgccgtcgtcgctcaagcacctgcccccggcaaccgccgccgcggcctctccgcgcgcggtcgccaccccgagagccaccgggattcgcggcctctgtgcactcccgacttggcgcctccggtgctcagcctccgccgccgtggccgccaccgagatggttggtgctccgctggactgggcggggaggtcgctggaggagttgcgcagcttgccggaccacgacacgttctgcctgatggcgctctcgccgctggacgggcgatacgatcgcttcgtcaaggagctgatgcccttcttcagcgagttcggcctaatcagataccgtgttctcatcgagatcaagtggctactgaaactttctcaaattcctgagatcactgaggtgcctcagttcagcaaggaagcccaggctttcttgaatgctattattgaggatttttgcattgacgatgcaaaagaagtaaagaaaattgagaaagtaaccaaccatgatgtgaaagctgtcgaatactttctgaagcaaaggtgcagctcaaatccagagattgcaaaggtgtcggagttcttccattttggttgtacctctgaagatatcaacaatttgtcacatgcattggctctgaaagagggggtaaatagagttatgttccctgccatgatcgacatatgcagagcattgtgttccttggcaacacaaaattcaggctatcctatgttggctcgaactcatgggcagccagcatcaccaacaaccgtgggaaaggagatggcaaactttgcggccagattatctgatataggaaagagtttctcagaggtgaagatactagggaaatttgctggcgctgttggcaattacaatgctgatgtggttgcatatcctgaagttgactggcctaaggtggcagaagaatttgttagatccttgggtttgcagtttaatccctacgttactcagattgagcctcatgactacatatcaaagctcttcaatctattcacccagttcaacaatgtgttgactgattttgatagagacatgtggtcctatatatcattaggctacttcaagcagataccaaaggctggtgaagttggttcttccactatgcctcataaaatcaaccccattgattttgaaaacagtgatggcaatttatgtcaggcgaattctatattatctggtataagcatgaaactgccaatatcccggatgcagcgtgacctgacagactcaactgttttgagaaacttgggtatgggattaggtcattctctattggcttacaaagctaccatacgtggaatcagcaaagttcaggtgaatgaatcacgtttagctgaagacttggagcaaacttgggaggtccttgctgagccaatacagacagtgatgcgaagatatggaatacctgaaccttatgagaagctgaaggaactgacgagaggtcaagctgtgaccaaggacagcatgcagcaattcattgatggtctagacataccagaggaggttcgatcaaagctttcgaagctaaccccccattcttatactgggctagcggaggatttggccagagacatcgagaagtgggttgatctggaatctggatttcaaatcaagtga

SEQ ID NO: 6148 - protein, 543 aa, Sorghum bicolor
  misc_feature: Ceres ANNOT ID no. 6064415
  misc_feature (406)..(520): Pfam Id: ASL_C Pfam Desc: Adenylosuccinate lyase C-terminal
  misc_feature (89)..(396): Pfam Id: Lyase_1 Pfam Desc: Lyase
  misc_feature (75)..(542): NCBI GI: 17978590 NCBI Desc: adenylosuccinate-amp lyase [vigna unguiculata]
  misc_feature (75)..(535): NCBI GI: 124360652 NCBI Desc: fumarate lyase; adenylosuccinate lyase [medicago truncatula]
  misc_feature (75)..(539): NCBI GI: 37983647 NCBI Desc: adenylosuccinate lyase [nicotiana tabacum]
  misc_feature (75)..(536): NCBI GI: 12322476 NCBI Desc: adenylosuccinate lyase-like protein; 104558-106845 [arabidopsis thaliana]
  misc_feature (81)..(530): NCBI GI: 63257128 NCBI Desc: adenylosuccinate lyase [pseudomonas syringae pv. syringae b728a]
  misc_feature (81)..(530): SWISSPROT Homolog: EC 4.3.2.2 Adenylosuccinate lyase
MSPPSSLKHLPPATAAAASPRAVATPRATGIRGLCALPTWRLRCSASAAVAATEMVGAPLDWAGRSLEELRSLPDHDTFCLMALSPLDGRYDRFVKELMPFFSEFGLIRYRVLIEIKWLLKLSQIPEITEVPQFSKEAQAFLNAIIEDFCIDDAKEVKKIEKVTNHDVKAVEYFLKQRCSSNPEIAKVSEFFHFGCTSEDINNLSHALALKEGVNRVMFPAMIDICRALCSLATQNSGYPMLARTHGQPASPTTVGKEMANFAARLSDIGKSFSEVKILGKFAGAVGNYNADVVAYPEVDWPKVAEEFVRSLGLQFNPYVTQIEPHDYISKLFNLFTQFNNVLTDFDRDMWSYISLGYFKQIPKAGEVGSSTMPHKINPIDFENSDGNLCQANSILSGISMKLPISRMQRDLTDSTVLRNLGMGLGHSLLAYKATIRGISKVQVNESRLAEDLEQTWEVLAEPIQTVMRRYGIPEPYEKLKELTRGQAVTKDSMQQFIDGLDIPEEVRSKLSKLTPHSYTGLAEDLARDIEKWVDLESGFQIK

SEQ ID NO: 6149 - DNA, 1602 bp, Sorghum bicolor
  misc_feature: Ceres ANNOT ID no. 6064420
  misc_feature: Encodes the peptide sequence at SEQ ID NO 6150
atggcggacgccggcgacgcggccaatggcggcaggaacaagtacgcggttcttgatcggagcgaggagcgggagccgaacgcggggacggaggggcggaggaggccggcggcacccgagagcgagaggaggagaagggagcggttcgtgtatgcctgcgcggtcttcgcctcgctcaacgccatcctcctcggctacgatgttggcgtaatgagtggcgcgatcatctacatgcagaaagatctccacataaccgagtttcagcaagaaattctagtaggctgtctgagcgtggtctcactcttgggaagcctatcagggggacgaacatctgatgcaattggcagaaaatggacaatgggcctcggtgcaattgtgttccagataggcgcagccatcatgacgtttgctccatcattcactgtgcttatgatcgggaggctccttgctggagttggcattggctttggtgccatggtatctggagtgtacattgctgagatctcccctgcaggtgcccgtgggactctcacatcacttcctgagatttgcatcaattttgggatcctccttggctatgtatccaattatgccttctcaggcctttctgagcacatcaattggaggattatgcttggtgttggcatcctcccgtcagtcttcattggctttgcgcttttcgtgatcccagagtcccctaggtggttgatgatggagaagagagtttcagaagcaagggcagtgctgctgcagattagcgagtctgaagctgaagctgaagaacggctggctgagatcgaggaagccgcaggtcttatgaaatcaatgaaatctgaggacaaagaagtgtggagagaacttttgaacccttctcccgctgttcgtaggatgctgtatgctggctgcggtattcagttgttccaacagatcacaggaattgacgctactgtctattacagcccaacaattttcaaagatgctgggatcaagtctgatcaggagcttcttgctgcaactgttgcggtgggtttcactaagacagtgtttatcttggttgcaattttcctaattgatagagttggacggaagccacttctttatgtgagcaccatcggcatgactatctgcttatttctcttgggggttgcacttacacttcaaaagcatgctgtggggcttatgtctccacgtatcggtatcgacctagcaatttttgcagtttgtggcaatgtggcattcttttcaattggcatgggaccaatatgttgggtcttgtcttcagaggtatttcctttaagattacgagctcaagggtcagcacttggtcaagtaggtggtagagtgagcagtggtttggtttccatgtcattcctttctatggcccgtgctatatcagtggcaggaatgttctttgtctttgctgcaatatccactatctctgtgctgtttgtgtacttttgtgtgccagaaacaaaagggaaaacactggagcagatcgaaatgatgtttgaaagtggggacgaatggggaggaggtgaaattgagcttgaggatacacagcatttaataccgagtaacaagaagtctgtgcctcttggttga

SEQ ID NO: 6150 - protein, 533 aa, Sorghum bicolor
  misc_feature: Ceres ANNOT ID no. 6064420
  misc_feature (53)..(503): Pfam Id: Sugar_tr Pfam Desc: Sugar (and other) transporter
  misc_feature (57)..(454): Pfam Id: MFS_1 Pfam Desc: Major Facilitator Superfamily
  misc_feature (10)..(523): NCBI GI: 140042949 NCBI Desc: general substrate transporter [medicago truncatula]
  misc_feature (10)..(523): NCBI GI: 90398979 NCBI Desc: h0801d08.9 [oryza sativa (indica cultivar-group)]
  misc_feature (10)..(523): NCBI GI: 32487389 NCBI Desc: osjnbb0017i01.3 [oryza sativa (japonica cultivar-group)]
  misc_feature (40)..(527): NCBI GI: 92876816 NCBI Desc: sugar transporter superfamily; major facilitator superfamily mfs_1 [medicago truncatula]
  misc_feature (48)..(529): NCBI GI: 32487390 NCBI Desc: osjnbb0017i01.4 [oryza sativa (japonica cultivar-group)]
  misc_feature: The sequence is a functional homolog of SEQ ID NO. 488 in the 11/188,298 US application
  misc_feature: The sequence is a functional homolog of SEQ ID NO. 449 in the 11/188,298 US application
  misc_feature: The sequence is a functional homolog of SEQ ID NO. 331 in the 11/188,298 US application
  misc_feature: The sequence is a functional homolog of SEQ ID NO. 296 in the 11/188,298 US application
MADAGDAANGGRNKYAVLDRSEEREPNAGTEGRRRPAAPESERRRRERFVYACAVFASLNAILLGYDVGVMSGAIIYMQKDLHITEFQQEILVGCLSVVSLLGSLSGGRTSDAIGRKWTMGLGAIVFQIGAAIMTFAPSFTVLMIGRLLAGVGIGFGAMVSGVYIAEISPAGARGTLTSLPEICINFGILLGYVSNYAFSGLSEHINWRIMLGVGILPSVFIGFALFVIPESPRWLMMEKRVSEARAVLLQISESEAEAEERLAEIEEAAGLMKSMKSEDKEVWRELLNPSPAVRRMLYAGCGIQLFQQITGIDATVYYSPTIFKDAGIKSDQELLAATVAVGFTKTVFILVAIFLIDRVGRKPLLYVSTIGMTICLFLLGVALTLQKHAVGLMSPRIGIDLAIFAVCGNVAFFSIGMGPICWVLSSEVFPLRLRAQGSALGQVGGRVSSGLVSMSFLSMARAISVAGMFFVFAAISTISVLFVYFCVPETKGKTLEQIEMMFESGDEWGGGEIELEDTQHLIPSNKKSVPLG

SEQ ID NO: 6151 - DNA, 1389 bp, Sorghum bicolor
  misc_feature: Ceres ANNOT ID no. 6064429
  misc_feature: Encodes the peptide sequence at SEQ ID NO 6152
atggacgcgtcgagcgagagcggtggcggtggcgcggggagtggtcgtgggggcaggaggtggaagggcaaaggcgtcacgcccatacagccgcggcggcagctggctccggtgatggaggacgcgtcggcggcactgctgcgcccgctcaagaagatcgggcgggcgccggaccgcttccagcggtccgccgcgtcgtcgctgtcgacgacgacgtctttgtcggccccgccttcccctcgcgccagcgctgcaggcgccacctcgcacgcgccggtgtcgccgccctcggcgcggcatatgttcccgttcgcgtacgagccctccgcggcggtgggcagcgccccgcggctggagctcccgccgtggcagcagcactccgccagcgagtcatcacagccggcgtcgccacaccagcagcagcaggctcatcaagcgcctttgcagcgccaccagcagcagcagcagatgatatcgttcggcgcgccgactcagtaccaggcgcagctgttgctgccggagggcccgcagcagcagcatcatctgctgcggtactggagcgaggcgctgaacctgagcccgcgcggcgggcaggccgcggccgtgctgccttcgctgtaccagcacctgctgcgcgctccgccgccgccgccgcctcagaagctgtaccgcggcgtgcggcagcggcactgggggaagtgggtggccgagatcaggctgccgcggaaccgcacgcgactctggctcggcaccttcgactccgccgaggacgccgccatggcgtacgaccgcgaggccttcaagctccgcggcgagaacgcgcggctcaacttcccggaccggttcttcgggaagggccacgccgggggaagcggccgcaccagcgccacagccgcggccgcgcccacagctgccgccgcgtcgggctccacgtcgtcgtcgtcgcctccacagactcctgacgaggaaaacacgcaccaaacgccgccggacgcagaaggatcgtcgggcaagcagccacagcctccggttgcgacatcgtcgcagctagaaggaagctctggtggtgagacgaccttgccagactcgggtcaaatgattcactcgccggaggctcctgctggcagtgagtggggtccggccgacgaggcatggttcaacacgtggggcccaggaagctccttctgggacgactacgacattgatagcactcgcggcctctttctccatcacgggcgcttcgccggcgacgaggccggcataaacacagcgacaacagcggcggcaaccgggacggacatgtcatgcgatcacgtcccggtaacacctgcttcttcttcttccccactgcactcacagtctcctcattcgcctaccttcatggactaa

SEQ ID NO: 6152 - protein, 462 aa, Sorghum bicolor
  misc_feature: Ceres ANNOT ID no. 6064429
  misc_feature (221)..(272): Pfam Id: AP2 Pfam Desc: AP2 domain
  misc_feature (94)..(461): NCBI GI: 115459558 NCBI Desc: os04g0529100 [oryza sativa (japonica cultivar-group)]
  misc_feature (1)..(460): NCBI GI: 49388716 NCBI Desc: ap2 domain-containing transcription factor-like [oryza sativa (japonica cultivar-group)]
  misc_feature (127)..(373): NCBI GI: 32140997 NCBI Desc: dre binding factor 2 [oryza sativa (japonica cultivar-group)]
  misc_feature (173)..(373): NCBI GI: 49388786 NCBI Desc: dre binding factor 2 [oryza sativa (japonica cultivar-group)]
  misc_feature (161)..(373): NCBI GI: 70797539 NCBI Desc: dre binding factor [triticum aestivum]
  misc_feature: The sequence is a functional homolog of SEQ ID NO 1194 in the 10/666,642US patent application
  misc_feature: The sequence is a functional homolog of SEQ ID NO 1288 in the 10/374,780US patent application
  misc_feature: The sequence is a functional homolog of SEQ ID NO 1289 in the 10/374,780US patent application
  misc_feature: The sequence is a functional homolog of SEQ ID NO 1290 in the 10/374,780US patent application
  misc_feature: The sequence is a functional homolog of SEQ ID NO 1291 in the 10/374,780US patent application
  misc_feature: The sequence is a functional homolog of SEQ ID NO 1434 in the 10/412,699US patent application
  misc_feature: The sequence is a functional homolog of SEQ ID NO 1435 in the 10/412,699US patent application
  misc_feature: The sequence is a functional homolog of SEQ ID NO 1436 in the 10/412,699US patent application
  misc_feature: The sequence is a functional homolog of SEQ ID NO 1749 in the 11/479,226US patent application
  misc_feature: Useful for making plants with modulated growth and phenotype characteristics
  misc_feature: Useful for making plants with modulated light quality response
  misc_feature: Functional homolog of the protein sequence encoded by LOCUS at4g28140
  misc_feature: The sequence is a functional homolog of SEQ ID NO 1434 in the 20040045049 US patent application
  misc_feature: The sequence is a functional homolog of SEQ ID NO 1435 in the 20040045049 US patent application
  misc_feature: The sequence is a functional homolog of SEQ ID NO 1436 in the 20040045049 US patent application
  misc_feature: The sequence is a functional homolog of SEQ ID NO 1291 in the 20060162006 US patent application
  misc_feature: The sequence is a functional homolog of SEQ ID NO 1749 in the 20070022495 US patent application
  misc_feature: The sequence is a functional homolog of SEQ ID NO 1194 in the 20070033671 US patent application
  misc_feature: The sequence is a functional homolog of SEQ ID NO 1354 in the 10/666,642 US patent application
  misc_feature: The sequence is a functional homolog of SEQ ID NO 171 in the 11/479,226 US patent application
  misc_feature: The sequence is a functional homolog of SEQ ID NO 18 in the 10/714,887 US patent application
  misc_feature: The sequence is a functional homolog of SEQ ID NO 18 in the 11/435,388 US patent application
  misc_feature: The sequence is a functional homolog of SEQ ID NO 1954 in the 10/374,780 US patent application
  misc_feature: The sequence is a functional homolog of SEQ ID NO 8 in the 10/666,642 US patent application
  misc_feature: The sequence is a functional homolog of SEQ ID NO 8 in the 10/903,236 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: Useful for making plants with altered lignin content
  misc_feature: Functional homolog of the protein sequence given in SEQ ID NO 13219
  misc_feature: The sequence is a functional homolog of SEQ ID NO. 274 in the 11/188,298 US application
MDASSESGGGGAGSGRGGRRWKGKGVTPIQPRRQLAPVMEDASAALLRPLKKIGRAPDRFQRSAASSLSTTTSLSAPPSPRASAAGATSHAPVSPPSARHMFPFAYEPSAAVGSAPRLELPPWQQHSASESSQPASPHQQQQAHQAPLQRHQQQQQMISFGAPTQYQAQLLLPEGPQQQHHLLRYWSEALNLSPRGGQAAAVLPSLYQHLLRAPPPPPPQKLYRGVRQRHWGKWVAEIRLPRNRTRLWLGTFDSAEDAAMAYDREAFKLRGENARLNFPDRFFGKGHAGGSGRTSATAAAAPTAAAASGSTSSSSPPQTPDEENTHQTPPDAEGSSGKQPQPPVATSSQLEGSSGGETTLPDSGQMIHSPEAPAGSEWGPADEAWFNTWGPGSSFWDDYDIDSTRGLFLHHGRFAGDEAGINTATTAAATGTDMSCDHVPVTPASSSSPLHSQSPHSPTFMD

SEQ ID NO: 6153 - DNA, 990 bp, Sorghum bicolor
  misc_feature: Ceres ANNOT ID no. 6064432
  misc_feature: Encodes the peptide sequence at SEQ ID NO 6154
atgaagttcaaggccttcttcaccgacgatggcatctccctcctcgacaagcggttcctaccggccatggacaaggtgggtcgcgtctgccacgttttcttcacgcccacgcacgccatgctcctccacaacctgctcggcgccacggccgccgggcccgacggcggcggcccgcagtgcgtcgcgcagttcgccaaggacctcctcttccgtgagtacaacgtgtcctcgcgaaacgggaaccaaatcgccttctccgtcgaagtcgcgctgcttcaccgcgcgctccgcagcgtgctcgccgtccacgcgcagccgccggccgccggggacgccaccggtgcccccgctatacaggtgaagctcgtcaacaagctgcccgcagggtcacgaaccgccacgccattcctcactttcgaaaccaagggcgcccgcgcggccgtcgtgcaggatgtgcccatctcgcgccctctctcacgctccgacatcgagcggttgcaggccgcccttgacgctgccaaggatctccctcagactctagtccaggttcctgatctgccacaactgcaaagcttagtggatcgtttgaaaaatgttggtgacctgctaacagtggctgtcactcaatatggtgatctccatctacaagtttccacttctcttgttactgttggctctgaatttcggaagcttcgggttattggtgatcgtgcaaatgcacctgttggtgatcaaaatctgacttcttcgactcgtatggatatggctgttgagagaggggaagcactttcagtgcaagtgaatatgaagcaccttgttaagagtctacactgtcatttggccaagccagactgtaccttctatggtattgctcctggtggtgcttgtttaacagtcgtattccaatatttcatcccaggaactagattggcagacaagtccattagcttctactgcaggcttccagtcctcgaccctggatccaattaa

SEQ ID NO: 6154 - protein, 329 aa, Sorghum bicolor
  misc_feature: Ceres ANNOT ID no. 6064432
  misc_feature (1)..(309): Pfam Id: Hus1 Pfam Desc: Hus1-like protein
  misc_feature (1)..(328): NCBI GI: 38346613 NCBI Desc: osjnba0074l08.4 [oryza sativa (japonica cultivar-group)]
  misc_feature (1)..(328): NCBI GI: 116310977 NCBI Desc: osigba0115k01-h0319f09.19 [oryza sativa (indica cultivar-group)]
  misc_feature (1)..(329): NCBI GI: 5903067 NCBI Desc: f6d8.25 [arabidopsis thaliana]
  misc_feature (135)..(241): NCBI GI: 7644413 NCBI Desc: lig1 [physarum polycephalum]
  misc_feature (70)..(297): NCBI GI: 17137664 NCBI Desc: cg2525-pa [drosophila melanogaster]
MKFKAFFTDDGISLLDKRFLPAMDKVGRVCHVFFTPTHAMLLHNLLGATAAGPDGGGPQCVAQFAKDLLFREYNVSSRNGNQIAFSVEVALLHRALRSVLAVHAQPPAAGDATGAPAIQVKLVNKLPAGSRTATPFLTFETKGARAAVVQDVPISRPLSRSDIERLQAALDAAKDLPQTLVQVPDLPQLQSLVDRLKNVGDLLTVAVTQYGDLHLQVSTSLVTVGSEFRKLRVIGDRANAPVGDQNLTSSTRMDMAVERGEALSVQVNMKHLVKSLHCHLAKPDCTFYGIAPGGACLTVVFQYFIPGTRLADKSISFYCRLPVLDPGSN

SEQ ID NO: 6155 - DNA, 1143 bp, Sorghum bicolor
  misc_feature: Ceres ANNOT ID no. 6064441
  misc_feature: Encodes the peptide sequence at SEQ ID NO 6156
atggtgggaggcggcaagccgctgggggacagcgtgttcgcgggccacgcggccgccggtgcggcggcgataagcgcctccgccgtcgccgtgcacccgctcgacacggtcaagacactcctccagctgggggcggcggggcagaaggagaagatggggctccggcaggtggtggaccggctcttggccgcttctggccctgcaggtttttacagtggcatcggatggtccataatgggtaaacttcctgggttgggagcacgttttgggacctatgaacttttaacagccttctataaagacggaagggaggacaattatgtctattattctgaggctatgttggctggcatagctgctggtgctggagaggctgttttctgcacaccatttgaacttttcaaacttcgaaaccaagttagttcagtgattccttcaaaagttatgggccctgcaaatgttgctcaagaatcatttccactgctttccaaactgttgcctggctatgttcctgatctaagggtgtggaacaacacagtgagccttttatctgatctttctcccaagcatcctgacatgttgggtgctctgaaacagcacccatggatgcttactggctgtgggaaacccccattaccatctgatgtgcatctaccttctagagtgatattgcttgaaggatggggtgctctttggagaggtctcagatcagggatagctcgagattgtgtatatggtggtattttcttttctacttggcaattcctgcactcagcgatgctcacctggaaggcagttaatatgagccctgaacctaggaatctagaagaagcgggtcctgtacccccttttgcctctagtgttgctgcaggcttcgcaggagtcgtagcggctgccgcttcacatacatttgatactgccaaaagtcgttcagaatgtactgtggtgcctaagtatatcgcaatggagaggaagtttcttaagtggaaaccaccaggaacatggatagagaggaagacaggaatatcccctgctgataggaatgtattgttccgtggcattggcctacgaatggcccgtagtggaattgcatcgtttgtgttagtcgggtcatactatctcgctgtgaatcacctcttgtag

SEQ ID NO: 6156 - protein, 380 aa, Sorghum bicolor
  misc_feature: Ceres ANNOT ID no. 6064441
  misc_feature (12)..(102): Pfam Id: Mito_carr Pfam Desc: Mitochondrial carrier protein
  misc_feature (109)..(264): Pfam Id: Mito_carr Pfam Desc: Mitochondrial carrier protein
  misc_feature (5)..(380): NCBI GI: 38344448 NCBI Desc: osjnba0038o10.20 [oryza sativa (japonica cultivar-group)]
  misc_feature (5)..(380): NCBI GI: 116310969 NCBI Desc: osigba0115k01-h0319f09.11 [oryza sativa (indica cultivar-group)]
  misc_feature (257)..(380): NCBI GI: 115459536 NCBI Desc: os04g0527500 [oryza sativa (japonica cultivar-group)]
  misc_feature (19)..(142): NCBI GI: 3378495 NCBI Desc: mitochondrial carrier protein [ribes nigrum]
  misc_feature (4)..(139): NCBI GI: 115385705 NCBI Desc: succinate/fumarate mitochondrial transporter [aspergillus terreus nih2624]
MVGGGKPLGDSVFAGHAAAGAAAISASAVAVHPLDTVKTLLQLGAAGQKEKMGLRQVVDRLLAASGPAGFYSGIGWSIMGKLPGLGARFGTYELLTAFYKDGREDNYVYYSEAMLAGIAAGAGEAVFCTPFELFKLRNQVSSVIPSKVMGPANVAQESFPLLSKLLPGYVPDLRVWNNTVSLLSDLSPKHPDMLGALKQHPWMLTGCGKPPLPSDVHLPSRVILLEGWGALWRGLRSGIARDCVYGGIFFSTWQFLHSAMLTWKAVNMSPEPRNLEEAGPVPPFASSVAAGFAGVVAAAASHTFDTAKSRSECTVVPKYIAMERKFLKWKPPGTWIERKTGISPADRNVLFRGIGLRMARSGIASFVLVGSYYLAVNHLL

SEQ ID NO: 6157 - DNA, 603 bp, Sorghum bicolor
  misc_feature: Ceres ANNOT ID no. 6064455
  misc_feature: Encodes the peptide sequence at SEQ ID NO 6158
atgccgcctcccgccaccacgtacaccaagtacgagacgcgccgccgagacccggacccgcgcgcggccgcgctcctcgttatcgacgtgcagggccacttcgcgtcgctggcggccccgatcatgccggccatcgcgtccaccgtcgcgctatgccgcgccgcgggcatgcccgtggtgtacacccgccacgtggactccgtcccgcgacggcccccgctcggcgagtggtggcccggcgaccgcatcgacgccggcacgcccgcggccgagctgctcccgggtgccggccgcgtcgagggggccgacctcgtggtggagaagagcacgtacagcgccttcgcgggcacggggctggaggaggcgctgcggcgggtgggcgccgaggaggtgatcgtggcgggcgtcatgaccaacctgtgctgcgagaccaccgcgcgggacgccttcgtgagggggttccgcgtgttcttctccgccgacgccacggccacggccacccaggagctgcaggaagccacgctcgccaacatggcgtacgggttcgcctacatcgtcgactgcaagcggctcgaggcggcgctggggaaggcggccaagtga

SEQ ID NO: 6158 - protein, 200 aa, Sorghum bicolor
  misc_feature: Ceres ANNOT ID no. 6064455
  misc_feature (18)..(196): Pfam Id: Isochorismatase Pfam Desc: Isochorismatase family
  misc_feature (2)..(197): NCBI GI: 38344437 NCBI Desc: osjnba0038o10.9 [oryza sativa (japonica cultivar-group)]
  misc_feature (2)..(197): NCBI GI: 116310956 NCBI Desc: osigba0153e02-osigba0093i20.22 [oryza sativa (indica cultivar-group)]
  misc_feature (7)..(195): NCBI GI: 102139936 NCBI Desc: isochorismatase hydrolase family protein [musa acuminata]
  misc_feature (24)..(195): NCBI GI: 15642907 NCBI Desc: isochorismatase-related protein [thermotoga maritima msb8]
  misc_feature (24)..(195): NCBI GI: 119885550 NCBI Desc: isochorismatase hydrolase [thermotoga petrophila rku-1]
MPPPATTYTKYETRRRDPDPRAAALLVIDVQGHFASLAAPIMPAIASTVALCRAAGMPVVYTRHVDSVPRRPPLGEWWPGDRIDAGTPAAELLPGAGRVEGADLVVEKSTYSAFAGTGLEEALRRVGAEEVIVAGVMTNLCCETTARDAFVRGFRVFFSADATATATQELQEATLANMAYGFAYIVDCKRLEAALGKAAK

SEQ ID NO: 6159 - DNA, 1260 bp, Sorghum bicolor
  misc_feature: Ceres ANNOT ID no. 6064486
  misc_feature: Encodes the peptide sequence at SEQ ID NO 6160
  misc_feature: Up-regulated in shoot tissues in response to salicylic acid treatment
atggcgatccctctcctcttgctcctcctcgttctctcctcagcttctgcggatgagtatggggacgagctgctgcagcgcgcgtggggggagcgggagtggatggtgagtgtgcggcggcgcatccacgcgcaccccgagctcgcgttccgggagcaccgcaccgcagccctcgtccgcgaggagctcgagcgcctcggcctctccacccgcgccgtcgccggaacgggcgtcgtcgctgatgtaggctccggggcgctccccttcgtggcgctccgcgccgacatggacgcgctcccgctccaggaattagtggagtgggagcataagagcaaggtggacggagtgatgcacgcctgcgggcatgatgtccacacagcgatgcttctgggggcagcaaagttactcagtcagcgtaaggatcagctcaagggaacagtgagactcctttttcaacctgccgaggaaggtggtgcaggtgcatctcatatgataagagaaggggttctggatggtgttaaagccatatttgcaatgcatgttgactaccagataccaactggtgtaatagcagctcacccaggaccaacacaagccgctgtatgtttctttgcagcaaaaatagaaggtaacactgggccgtctgaaaccccacacttaaatgtggatcctattgtcgctgcatctttggccatcctgtccctgcagcagcttatttccagagaagatgatcctcttcacagccaagtggtctcggttacctatgtgaaagctggaaaagcccttgatgctacccctgatgttgttgaatttggaggtactttgaggagcctcaccactgaaggcctttaccgtctgcagagaagggttaaagaggtagtagaaggccaggctgcagtacatagatgcaagggagctgtcgacatgaaggctgaggactacccaatgtaccctgctgttgtgaacgacgagaggctgcatcggcacgtagaggatgtcggcagaggcttgcttggcccgggcaacgtgagaccaggggaaaagatcatggccggcgaagacttcgctttctaccagcagctggttcccggtgttatgtttggcatcggcattagaaacgagaaagctggttctgtttactcggttcacaacccctatttcttcgttgatgaggacgtcattcctgttggtgctgctttgcatgctgcgattgcagaactgtacttcactgagggctcctctctcaacaaagactcgtag

SEQ ID NO: 6160 - protein, 419 aa, Sorghum bicolor
  misc_feature: Ceres ANNOT ID no. 6064486
  misc_feature (91)..(407): Pfam Id: Peptidase_M20 Pfam Desc: Peptidase family M20/M25/M40
  misc_feature (1)..(418): NCBI GI: 21741848 NCBI Desc: osjnba0019d11.19 [oryza sativa (japonica cultivar-group)]
  misc_feature (1)..(413): NCBI GI: 92878648 NCBI Desc: peptidase m20 [medicago truncatula]
  misc_feature (33)..(413): NCBI GI: 92890174 NCBI Desc: peptidase m20 [medicago truncatula]
  misc_feature (33)..(411): NCBI GI: 92870502 NCBI Desc: peptidase m20 [medicago truncatula]
  misc_feature (33)..(419): NCBI GI: 85687554 NCBI Desc: iaa-amino acid hydrolase ilr1-like 4 precursor
  misc_feature: Up-regulated in shoot tissues in response to salicylic acid treatment
MAIPLLLLLLVLSSASADEYGDELLQRAWGEREWMVSVRRRIHAHPELAFREHRTAALVREELERLGLSTRAVAGTGVVADVGSGALPFVALRADMDALPLQELVEWEHKSKVDGVMHACGHDVHTAMLLGAAKLLSQRKDQLKGTVRLLFQPAEEGGAGASHMIREGVLDGVKAIFAMHVDYQIPTGVIAAHPGPTQAAVCFFAAKIEGNTGPSETPHLNVDPIVAASLAILSLQQLISREDDPLHSQVVSVTYVKAGKALDATPDVVEFGGTLRSLTTEGLYRLQRRVKEVVEGQAAVHRCKGAVDMKAEDYPMYPAVVNDERLHRHVEDVGRGLLGPGNVRPGEKIMAGEDFAFYQQLVPGVMFGIGIRNEKAGSVYSVHNPYFFVDEDVIPVGAALHAAIAELYFTEGSSLNKDS

SEQ ID NO: 6161 - DNA, 1023 bp, Sorghum bicolor
  misc_feature: Ceres ANNOT ID no. 6064500
  misc_feature: Encodes the peptide sequence at SEQ ID NO 6162
atgtcagctggtttccagctcggtgtgatcgggtcacttgcactctctgttgcatcttcagttgccattgtcatctgcaacaaagctctcatcagcacacttggttttccattcgctacaacattaacaagctggcatctgatggtaaccttctgcaccctccatgtggcacagcgcttacatttcttcgagcccaaggcaattgatggacatacagtgatactctttggattgctgaatggcacgtcaattggccttctcaacctgagtttaggattcaactccattggattctaccagatgacaaaattggcgatcatacctttcactgtgctattggagactatcttcttgaagaaaagattcagcgagagtatcaagctttctcttctggtcttacttcttggagtaggaattgcttcagttactgatctcaagctaaatatgcttgggtccatcctttctggcctcgccattgccaccacttgtgttggccaaattctcacaaatacaatacagaagaagttgaaggtctcctcaacccagcttctgtaccaatctgcgccttaccaggcggcaattctgtttgcaactggcccttttgtggatcaactccttactaaccggagtgtctttgcacacaaatactctgctccagttctgggtttcattgtcctatcttgcttgattgcggtgtctgtgaacttcagtacatttcttgtgattggaacaacatccccagtgacataccaggtgcttggtcacctgaagacatgtctggttctatcatttggctacactctattacacgatcctttcactctaaggaacatattgggcattctaattgccatatttgggatggcactgtactcctacttctttgtaagagagggcaagaagaagtcagcaaatgatgctctgccagtttcacagatgtcagataaggaggctgaaccacttttggcaactaaagacagcaccgacagcaagaaagcaaatggtttatctcacgactgctaa

SEQ ID NO: 6162 - protein, 340 aa, Sorghum bicolor
  misc_feature: Ceres ANNOT ID no. 6064500
  misc_feature (151)..(293): Pfam Id: TPT Pfam Desc: Triose-phosphate Transporter family
  misc_feature (1)..(340): NCBI GI: 48717036 NCBI Desc: phosphate translocator-like [oryza sativa (japonica cultivar-group)]
  misc_feature (1)..(221): NCBI GI: 115468244 NCBI Desc: os06g0506200 [oryza sativa (japonica cultivar-group)]
  misc_feature (101)..(332): NCBI GI: 42570326 NCBI Desc: transporter-related [arabidopsis thaliana]
  misc_feature (12)..(292): NCBI GI: 145355238 NCBI Desc: dmt family transporter: glucose-6-phosphate/phosphate [ostreococcus lucimarinus cce9901]
  misc_feature (1)..(170): NCBI GI: 115440755 NCBI Desc: os01g0823200 [oryza sativa (japonica cultivar-group)]
  misc_feature: The sequence is a functional homolog of SEQ ID NO. 484 in the 11/188,298 US application
  misc_feature: The sequence is a functional homolog of SEQ ID NO. 360 in the 11/188,298 US application
MSAGFQLGVIGSLALSVASSVAIVICNKALISTLGFPFATTLTSWHLMVTFCTLHVAQRLHFFEPKAIDGHTVILFGLLNGTSIGLLNLSLGFNSIGFYQMTKLAIIPFTVLLETIFLKKRFSESIKLSLLVLLLGVGIASVTDLKLNMLGSILSGLAIATTCVGQILTNTIQKKLKVSSTQLLYQSAPYQAAILFATGPFVDQLLTNRSVFAHKYSAPVLGFIVLSCLIAVSVNFSTFLVIGTTSPVTYQVLGHLKTCLVLSFGYTLLHDPFTLRNILGILIAIFGMALYSYFFVREGKKKSANDALPVSQMSDKEAEPLLATKDSTDSKKANGLSHDC

SEQ ID NO: 6163 - DNA, 780 bp, Sorghum bicolor
  misc_feature: Ceres ANNOT ID no. 6064501
  misc_feature: Encodes the peptide sequence at SEQ ID NO 6164
atggacgccgcagaacatcacatggagatggagatcaaggaggaggaggaggaggaagcagcggaggtgatggacatgacgacgacggtgctctctcctcggttcaggaggatctgcgtcttctgcggaagcagccaggggaagaagaagacctaccaggatgctgccgtcgagctcggccaggagctggtctcaaggaacattgatctggtctacggcgggggaagtgtcgggctaatgggcctggtctctcgagcagtctacaatggagggaggcacgtcataggggtgattcccaagaccctcatgcctagagagattacaggtgagacggttggggaggtgaaggccgtggcagatatgcatcagaggaaggctgagatggccaggcaatctgatgccttcatagcacttcctggaggctatggaacccttgaagagctgctggaagtgatcgcttgggcgcagcttggcattcacgacaagccggttgggctgctaaatgtggacggatactacaactccctcctatccttcatcgacaaagctgtagaggaagagttcatcagcccgactgctcgccacatcatcgtcttggcaccgacaccgaaagagctgctcgacaagttagaggagtattccccccagcacgagaaggtggtgccgaagacgaagtgggagatggagcagctgagctactgcaagagctgcgagatcccgccggggctcaaagaagggaagccggtggtcatccaagcacagcgaggagccatgctctga

SEQ ID NO: 6164 - protein, 259 aa, Sorghum bicolor
  misc_feature: Ceres ANNOT ID no. 6064501
  misc_feature (80)..(213): Pfam Id: Lysine_decarbox Pfam Desc: Possible lysine decarboxylase
  misc_feature (7)..(259): NCBI GI: 115459456 NCBI Desc: os04g0518800 [oryza sativa (japonica cultivar-group)]
  misc_feature (30)..(259): NCBI GI: 32487858 NCBI Desc: osjnbb0061c13.8 [oryza sativa (japonica cultivar-group)]
  misc_feature (31)..(239): NCBI GI: 19548083 NCBI Desc: t3b23.2/t3b23.2 [arabidopsis thaliana]
  misc_feature (34)..(233): NCBI GI: 73536067 NCBI Desc: chain b, x-ray structure of a lysine decarboxylase-like protein from arabidopsis thaliana gene at2g37210
  misc_feature (34)..(239): NCBI GI: 79507209 NCBI Desc: carboxy-lyase [arabidopsis thaliana]
MDAAEHHMEMEIKEEEEEEAAEVMDMTTTVLSPRFRRICVFCGSSQGKKKTYQDAAVELGQELVSRNIDLVYGGGSVGLMGLVSRAVYNGGRHVIGVIPKTLMPREITGETVGEVKAVADMHQRKAEMARQSDAFIALPGGYGTLEELLEVIAWAQLGIHDKPVGLLNVDGYYNSLLSFIDKAVEEEFISPTARHIIVLAPTPKELLDKLEEYSPQHEKVVPKTKWEMEQLSYCKSCEIPPGLKEGKPVVIQAQRGAML

SEQ ID NO: 6165 - DNA, 381 bp, Sorghum bicolor
  misc_feature: Ceres ANNOT ID no. 6064510
  misc_feature: Encodes the peptide sequence at SEQ ID NO 6166
atgaaggcagggtcgtccaaggggagattcctcaatctcaaggccttcctccatgcgtggaagaaactcgccgccgctgagacggcgacggccagcgccgctgggtgggcacagctcgacggcgacggcgaaaccatccccagggacgtgcccaagggccacacggtggtgtacgtcggggaggagctgaggcggtacgtggtcagggtgtcctccctcgaccacccgctgttccgcgagctgctcgaccgggcgcgggacgagtacggcttcgccgccgccgacacgaggctgtgcctcccctgcgacgaggacatgttcctcgccgtcctctgccatgtcgacgccgagcgagagtggagcctggcactgtgcagctga

SEQ ID NO: 6166 - protein, 126 aa, Sorghum bicolor
  misc_feature: Ceres ANNOT ID no. 6064510
  misc_feature (23)..(115): Pfam Id: Auxin_inducible Pfam Desc: Auxin responsive protein
  misc_feature (1)..(125): NCBI GI: 38568063 NCBI Desc: osjnba0073e02.12 [oryza sativa (japonica cultivar-group)]
  misc_feature (7)..(125): NCBI GI: 140068585 NCBI Desc: auxin responsive saur protein [medicago truncatula]
  misc_feature (46)..(111): NCBI GI: 92885510 NCBI Desc: auxin responsive saur protein [medicago truncatula]
  misc_feature (44)..(107): NCBI GI: 92888355 NCBI Desc: auxin responsive protein [medicago truncatula]
  misc_feature (41)..(111): NCBI GI: 20149050 NCBI Desc: auxin-induced saur-like protein [capsicum annuum]
  misc_feature: Useful for making plants with modulated cold sensitivity
  misc_feature: Functional homolog of the protein sequence given in SEQ ID NO 13946
  misc_feature: Useful for making plants with modulated salt sensitivity
  misc_feature: Functional homolog of the protein sequence given in SEQ ID NO 13813
  misc_feature: The sequence is a functional homolog of SEQ ID NO. 505 in the 11/188,298 US application
  misc_feature: The sequence is a functional homolog of SEQ ID NO. 402 in the 11/188,298 US application
MKAGSSKGRFLNLKAFLHAWKKLAAAETATASAAGWAQLDGDGETIPRDVPKGHTVVYVGEELRRYVVRVSSLDHPLFRELLDRARDEYGFAAADTRLCLPCDEDMFLAVLCHVDAEREWSLALCS

SEQ ID NO: 6167 - DNA, 1632 bp, Sorghum bicolor
  misc_feature: Ceres ANNOT ID no. 6064517
  misc_feature: Encodes the peptide sequence at SEQ ID NO 6168
atgcggtcgccggcgctcctggccgccgccctagtcgcggcggtgctcctcgctgccggtgccggggtcgcggcggccgcgacggaggaggcctacgtcacgctgctgtacggcgacgagttcgtgctcggcgtgcgcgtcctgggcaagtccctccgcgacaccggcacgcggcgcgacatggtcgtgctcgtctccgacggcgtctccgagtactcgaggaagctcctccaggcagatggttggattgtgaatcgtataacattactggctaatccgaaccaagttagaccaaagagattttggggtgtctacaccaagctaaagatatttaacatgacaaactacaaaaaagatactatagttgtgaaaagtatcgaggatcttttcaagtgtggcaagttttgtggaaacctgaagcattctgaaagaatgaattctggtgtgatggttgttgaaccctctgaaactcttttcaatgatatgatcaacaaagtgggtcaattgccttcttacactggtggggaccaaggttttctaaattcatattattctgattttgccaactcccgtgtctatgagccagactcgcctttaactcctgaaccggagacacaacgcctttctaccttgtataatgctgatgttggtctttacatgctagcaaacaagtggatggttgatgagaaggaattaagaatcatccattacacgctgggtcccctaaaaccctgggactggttcacagcgtggcttgtaaaacctgttgaaacatggcaggatattaggcaaaaacttgaagaatctcttccaggaactggtgggggaaggaaccctcatgaccagctggttgtcaaaatattgttcattctcccattttgcttgctgttatttggttattaccaatcatgttttcagatttcctgccttctcattcgtttatatgattttctgacagacaaacaaggagtgataagtataagatcactatgtgcatttgctagaagagctcgccacaaatacaagtctgaagagtcacttccatcttattcagtggtgggttcatcgtctgtatttggtatttcaaaccaaaggttatcaaatggacatttgaagctaccttcttattttggggtaatcgcggtgctagtctgcttcatgtctgctggtttctctctcgcatttgctttcattatcattccacggcaggttatgccatggacaggtttgctactgatgcttgagtggacctttgtggcattcttcttattgtttgggagttatctccgttttgtctaccggtggggaagtattagtgcaaaccatgtgggctttagcaattccgatgcatcagagaatcatatgggtccaggccatcagcgaaatatgtctgactgcgacatggatgcaacattttactggatagggatggcaactatagctactattactgtattgttaccaactatcttgggcataactgcactgttcacaaagctaggattaatggtcgctggtggtattgtgctggcatcttttatgacatacgcagcggagcatcttgcaatctcagccttcaacaagggtcagaaagacagaaatgcgtcaagaactcgaagcttttgtttttaa

SEQ ID NO: 6168 - protein, 543 aa, Sorghum bicolor
  misc_feature: Ceres ANNOT ID no. 6064517
  misc_feature (32)..(249): Pfam Id: Glyco_transf_8 Pfam Desc: Glycosyl transferase family 8
  misc_feature (1)..(224): NCBI GI: 57834149 NCBI Desc: osjnba0073e02.8 [oryza sativa (japonica cultivar-group)]
  misc_feature (22)..(543): NCBI GI: 140049083 NCBI Desc: glycosyl transferase, family 8 [medicago truncatula]
  misc_feature (1)..(303): NCBI GI: 23506001 NCBI Desc: at5g18480/f20l16_200 [arabidopsis thaliana]
  misc_feature (1)..(373): NCBI GI: 116310214 NCBI Desc: osigba0145m07.6 [oryza sativa (indica cultivar-group)]
  misc_feature (251)..(504): NCBI GI: 115459440 NCBI Desc: os04g0517400 [oryza sativa (japonica cultivar-group)]
  misc_feature: Useful for making plants with altered cell wall content and/or composition
  misc_feature: GREAT-hit functional homolog of the protein sequence encoded by LOCUS at5g18480
  misc_feature: Useful for making plants with altered carbohydrate content
  misc_feature: Functional homolog of the protein sequence given in SEQ ID NO 13947
  misc_feature: Useful for making plants with altered cell wall content and/or composition
  misc_feature: Functional homolog of the protein sequence given in SEQ ID NO 13948
MRSPALLAAALVAAVLLAAGAGVAAAATEEAYVTLLYGDEFVLGVRVLGKSLRDTGTRRDMVVLVSDGVSEYSRKLLQADGWIVNRITLLANPNQVRPKRFWGVYTKLKIFNMTNYKKDTIVVKSIEDLFKCGKFCGNLKHSERMNSGVMVVEPSETLFNDMINKVGQLPSYTGGDQGFLNSYYSDFANSRVYEPDSPLTPEPETQRLSTLYNADVGLYMLANKWMVDEKELRIIHYTLGPLKPWDWFTAWLVKPVETWQDIRQKLEESLPGTGGGRNPHDQLVVKILFILPFCLLLFGYYQSCFQISCLLIRLYDFLTDKQGVISIRSLCAFARRARHKYKSEESLPSYSVVGSSSVFGISNQRLSNGHLKLPSYFGVIAVLVCFMSAGFSLAFAFIIIPRQVMPWTGLLLMLEWTFVAFFLLFGSYLRFVYRWGSISANHVGFSNSDASENHMGPGHQRNMSDCDMDATFYWIGMATIATITVLLPTILGITALFTKLGLMVAGGIVLASFMTYAAEHLAISAFNKGQKDRNASRTRSFCF

SEQ ID NO: 6169 - DNA, 819 bp, Sorghum bicolor
  misc_feature: Ceres ANNOT ID no. 6064520
  misc_feature: Encodes the peptide sequence at SEQ ID NO 6170
atggggagggctccgtgctgcgagaagatggggctcaagaaggggccatggacgcccgaggaggacaagatcctggtcaaccacatccagagcttcggccacagcaactggcgcgcgctgcccaagcaagccgggctgctgcggtgcggcaagagctgccggctccggtggatcaactacctgcgcccggacatcaagcgcggcaacttcagcaaggaggaagaggacgccatcatcaccctccacgagcagctcggcaacaggtggtccgcgatcgccgccaggctgcccgggcggacggacaacgagatcaagaacgtctggcacacgcacctcaagaagcggctggagcccaccaccaagccggaggagcagcacggggcgcaggcaggtggcgccggcaagaagcacaggcccaagcgcggggccgccaagaagacgacggccgacgacgtcgccgtcgtcccagctaccaccgcgccggtgtcgcctgaacggtcgccggcctcgtcgtcggtgaccgagtcgtcgtccatgacggagcaggagcaggagcagggcaacacggggagctcggccggcgggttccccatcaaggaggagagcttcacctcctccgcctcggacgccgaggagttccagttcgacgacaccttctggtcggagacgctgtccatgccgctcgagagcttcgacgtccccatggagccctacgacgcgttgggcgcgtcgtcggttggcgccgacggcgacttggactactggctcggagtgttcatggagtccggcgacgtgcaccaagaattgccgcagatttag

SEQ ID NO: 6170 - protein, 272 aa, Sorghum bicolor
  misc_feature: Ceres ANNOT ID no. 6064520
  misc_feature (14)..(61): Pfam Id: Myb_DNA-binding Pfam Desc: Myb-like DNA-binding domain
  misc_feature (67)..(112): Pfam Id: Myb_DNA-binding Pfam Desc: Myb-like DNA-binding domain
  misc_feature (1)..(272): NCBI GI: 73921025 NCBI Desc: myb-related protein myb4 (osmyb4) (transcription factor rltr1)
  misc_feature (1)..(272): NCBI GI: 116310212 NCBI Desc: osigba0145m07.4 [oryza sativa (indica cultivar-group)]
  misc_feature (1)..(272): NCBI GI: 33087073 NCBI Desc: myb-related protein [oryza sativa (japonica cultivar-group)]
  misc_feature (1)..(263): NCBI GI: 89145385 NCBI Desc: myb-related protein [triticum aestivum]
  misc_feature (1)..(272): NCBI GI: 47680447 NCBI Desc: transcription factor myb2 [triticum aestivum]
  misc_feature: Useful for making plants with altered alkaloid content
  misc_feature: Useful for making plants with altered lignin content
  misc_feature: Useful for making plants with modulated nitrogen use efficiency
  misc_feature: Functional homolog of the protein sequence given in SEQ ID NO 13600
  misc_feature: The sequence is a functional homolog of SEQ ID NO 1004 in the 11/435,388 US patent application
  misc_feature: The sequence is a functional homolog of SEQ ID NO 1010 in the 11/435,388 US patent application
  misc_feature: The sequence is a functional homolog of SEQ ID NO 1056 in the 11/479,226 US patent application
  misc_feature: The sequence is a functional homolog of SEQ ID NO 144 in the 10/374,780 US patent application
  misc_feature: The sequence is a functional homolog of SEQ ID NO 458 in the 10/412,699 US patent application
  misc_feature: The sequence is a functional homolog of SEQ ID NO 756 in the 10/225,066 US patent application
  misc_feature: The sequence is a functional homolog of SEQ ID NO 1914 in the 10/412,699 US patent application
  misc_feature: The sequence is a functional homolog of SEQ ID NO 2174 in the 10/374,780 US patent application
  misc_feature: The sequence is a functional homolog of SEQ ID NO 956 in the 10/225,066 US patent application
  misc_feature: The sequence is a functional homolog of SEQ ID NO 1688 in the 11/479,226 US patent application
  misc_feature: The sequence is a functional homolog of SEQ ID NO 1852 in the 10/412,699 US patent application
  misc_feature: The sequence is a functional homolog of SEQ ID NO 2094 in the 10/374,780 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 126 in the 10/412,699 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 36 in US patent 7193132
  misc_feature: The sequence is a functional homolog of SEQ ID NO 1564 in the 10/374,780 US patent application
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: Useful for making plants with altered cell wall content and/or composition
  misc_feature: Functional homolog of the protein sequence given in SEQ ID NO 13602
  misc_feature: The sequence is a functional homolog of SEQ ID NO 1071 in the 11/479,226 US patent application
  misc_feature: The sequence is a functional homolog of SEQ ID NO 1408 in the 10/666,642 US patent application
  misc_feature: The sequence is a functional homolog of SEQ ID NO 148 in the 10/374,780 US patent application
  misc_feature: The sequence is a functional homolog of SEQ ID NO 1808 in the 10/412,699 US patent application
  misc_feature: The sequence is a functional homolog of SEQ ID NO 234 in the 10/714,887 US patent application
  misc_feature: The sequence is a functional homolog of SEQ ID NO 234 in the 11/435,388 US patent application
  misc_feature: The sequence is a functional homolog of SEQ ID NO 286 in the 10/714,887 US patent application
  misc_feature: The sequence is a functional homolog of SEQ ID NO 42 in the 10/225,068 US patent application
  misc_feature: The sequence is a functional homolog of SEQ ID NO 468 in the 10/412,699 US patent application
  misc_feature: The sequence is a functional homolog of SEQ ID NO 758 in the 10/225,066 US patent application
  misc_feature: The sequence is a functional homolog of SEQ ID NO 1087 in the 10/374,780 US patent application
  misc_feature: The sequence is a functional homolog of SEQ ID NO 2165 in the 10/666,642 US patent application
  misc_feature: The sequence is a functional homolog of SEQ ID NO 378 in the 11/435,388 US patent application
  misc_feature: The sequence is a functional homolog of SEQ ID NO 380 in the 10/714,887 US patent application
  misc_feature: The sequence is a functional homolog of SEQ ID NO. 395 in the 11/188,298 US application
MGRAPCCEKMGLKKGPWTPEEDKILVNHIQSFGHSNWRALPKQAGLLRCGKSCRLRWINYLRPDIKRGNFSKEEEDAIITLHEQLGNRWSAIAARLPGRTDNEIKNVWHTHLKKRLEPTTKPEEQHGAQAGGAGKKHRPKRGAAKKTTADDVAVVPATTAPVSPERSPASSSVTESSSMTEQEQEQGNTGSSAGGFPIKEESFTSSASDAEEFQFDDTFWSETLSMPLESFDVPMEPYDALGASSVGADGDLDYWLGVFMESGDVHQELPQI

SEQ ID NO: 6171 - DNA, 1113 bp, Sorghum bicolor
  misc_feature: Ceres ANNOT ID no. 6064525
  misc_feature: Encodes the peptide sequence at SEQ ID NO 6172
atggcgagcaaggtggtggacctccggtcggacacggtgaccaagccctccgaggcgatgcgggccgccatggccgccgccgtcgtcgacgacgacgtcctgggcgccgacccgaccgcgcagcgcttcgaggcggagatggccgcgatcatgggcaaggaggccgcgctcttcgtgccgtcgggcaccatgggcaacctcatctccgtcctcgtgcactgcgacgtcaggggcagcgaggccatcctcggcgacaactcgcacatccacgtctacgagaacggcggcatctccaccatcggcggcgtgcaccccaggaccgtcaagaataaccccgacggcaccatggatgttgacaagatcgtcgccgccatcaggcatccggatcttcattacccgacgaccaggctcatctgcttggagaacacacacgggaattctggtggaaaatgtttatcagtagaatacactgacaaggttggtgaaattgccaagagccatggcttgaagcttcatattgatggagctcgcatctttaacgcgtctgtggcacttggagttcctgtagatagacttgtgaaagctgctgattcagtttcggtatgcctatcaaaaggattaggcgcacccgtgggatcaattattgttggttcgaaggccttcattgacaaggccaaaattctccgaaagaccctaggtggtggaatgagacaggtgggagttctttgtgctgctgctcatgttgccattcgtgacactgtgggaaagctcgcggatgaccacagaaaggctaaagttttggcagagggactgaagaaaattgaacagcttacagtggattcggcttcggtccagacaaatatggtattctttgatatcatggatccaagaatatcacctgacaaactgtgtgcagtcttggaacaacacaatgtgcttgcaatgccagctagttcaaaaaggattaggttcgtgatccattaccaaatttcagatagcgatgttcagtatgcattgacatgtgtcgagaaagctgttgaagaactactgaaaggcagtactgaattcgagcatctgacaaacggaactaccaaaagctcatatgggcactag

SEQ ID NO: 6172 - protein, 370 aa, Sorghum bicolor
  misc_feature: Ceres ANNOT ID no. 6064525
  misc_feature (7)..(294): Pfam Id: Beta_elim_lyase Pfam Desc: Beta-eliminating lyase
  misc_feature (3)..(342): Pfam Id: Aminotran_1_2 Pfam Desc: Aminotransferase class I and II
  misc_feature (1)..(370): NCBI GI: 38344656 NCBI Desc: osjnbb0072m01.18 [oryza sativa (japonica cultivar-group)]
  misc_feature (1)..(370): NCBI GI: 116310209 NCBI Desc: osigba0145m07.1 [oryza sativa (indica cultivar-group)]
  misc_feature (24)..(370): NCBI GI: 38568056 NCBI Desc: osjnba0073e02.3 [oryza sativa (japonica cultivar-group)]
  misc_feature (1)..(346): NCBI GI: 82400126 NCBI Desc: l-allo-threonine aldolase-related protein [solanum tuberosum]
  misc_feature (1)..(346): NCBI GI: 9802578 NCBI Desc: f22o13.11 [arabidopsis thaliana]
MASKVVDLRSDTVTKPSEAMRAAMAAAVVDDDVLGADPTAQRFEAEMAAIMGKEAALFVPSGTMGNLISVLVHCDVRGSEAILGDNSHIHVYENGGISTIGGVHPRTVKNNPDGTMDVDKIVAAIRHPDLHYPTTRLICLENTHGNSGGKCLSVEYTDKVGEIAKSHGLKLHIDGARIFNASVALGVPVDRLVKAADSVSVCLSKGLGAPVGSIIVGSKAFIDKAKILRKTLGGGMRQVGVLCAAAHVAIRDTVGKLADDHRKAKVLAEGLKKIEQLTVDSASVQTNMVFFDIMDPRISPDKLCAVLEQHNVLAMPASSKRIRFVIHYQISDSDVQYALTCVEKAVEELLKGSTEFEHLTNGTTKSSYGH

SEQ ID NO: 6173 - DNA, 1368 bp, Sorghum bicolor
  misc_feature: Ceres ANNOT ID no. 6064535
  misc_feature: Encodes the peptide sequence at SEQ ID NO 6174
atggagcacgtggtcgggggcaagttcaagctcgggaagaagatcgggagcggatcctttggggagctctacctcgccgtgaacgtgcagaatggcgaggaggtggctgtcaaactggaatcggtcaaatcacgacatccacagcttcactatgaatcaaaactatacatgcttttgcagggtggaactgggattccacatcttaagtggttcggggtggagggggagtacaatgtcatggtgattgatctgcttggtccaagtctggaggacttatttaactactgcagcagaaagttctcccttaaaacagtactaatgcttgctgatcagatgatcagtagagtagaatatatgcacacgagggggtttctacatcgtgatatcaagcctgataatttcctcatgggtttaggacgtaaagcaaaccaggtatttgtcattgactatggccttgcgaaaaagtatcgagatctccaaactcataagcacataccatacagggaaaacaaaaatctcacaggaacagcacgatatgccagtgtaaatacccatcttggagtagagcaaagcagaagagatgatctggaatctcttggttatgtgctgatgtatttcttaagaggaagtcttccttggcaaggcctgaaagctggcacaaagaagcaaaagtatgacagaatcagtgaaaagaaaatgctgacaccagttgaggtcctctgtaaatcgtatccatcagagtttactgcatactttcattactgtagatcactacgatttgaagataaaccggattactcctatttgaagagactcttccgtgacttatttatccgcgaggggtaccaactagattatgtatttgactggaccattatgaagtatcctcagtttagagataaaagcaaacttcagtctagtggcaagattagtgggttggcaggcccttctgcagaaaggactgatagaactgcagctgaagctttgtttagaagaactggatctggttctggtcacaatcgagaacacaccaagcacagaagtcttctagagtcactgatgccatccaaggtgactgttgattcggataaaacaaggccatcatcatcatcgcgcaacggaagcacgtcaagaagagccgtgctttcatcaagcaaaccaagctcttctggagatccaagcgacccaaaccgcatgggtcgcctggtcccaagtagcagcagccgtccaccgactgcccaaagggcacatccttcaggtggagctgagatgagatcatcgtctttgtcaaaaatcggaaggtcttcacatgatgatgctatcaggaactttgagctcctctcacttggtgcagacaggagaaaataa

SEQ ID NO: 6174 - protein, 455 aa, Sorghum bicolor
  misc_feature: Ceres ANNOT ID no. 6064535
  misc_feature (9)..(278): Pfam Id: Pkinase Pfam Desc: Protein kinase domain
  misc_feature (9)..(273): Pfam Id: Pkinase_Tyr Pfam Desc: Protein tyrosine kinase
  misc_feature (1)..(455): NCBI GI: 1103318 NCBI Desc: casein kinase i [arabidopsis thaliana]
  misc_feature (1)..(415): NCBI GI: 21536851 NCBI Desc: protein kinase adk1-like protein [arabidopsis thaliana]
  misc_feature (27)..(455): NCBI GI: 1197461 NCBI Desc: casein kinase i [arabidopsis thaliana]
  misc_feature (1)..(407): NCBI GI: 18087640 NCBI Desc: at5g44100/mln1_2 [arabidopsis thaliana]
  misc_feature (1)..(310): NCBI GI: 1216484 NCBI Desc: dual specificity kinase 1
  misc_feature (1)..(452): SWISSPROT Homolog: EC 2.7.11.1 Casein kinase I isoform delta-like
  misc_feature: The sequence is a functional homolog of SEQ ID NO 32 in US patent 7179962
  misc_feature: The sequence is a functional homolog of SEQ ID NO. 332 in the 11/188,298 US application
  misc_feature: The sequence is a functional homolog of SEQ ID NO. 312 in the 11/188,298 US application
  misc_feature: The sequence is a functional homolog of SEQ ID NO. 340 in the 11/188,298 US application
  misc_feature: The sequence is a functional homolog of SEQ ID NO. 399 in the 11/188,298 US application
  misc_feature: The sequence is a functional homolog of SEQ ID NO. 310 in the 11/188,298 US application
  misc_feature: The sequence is a functional homolog of SEQ ID NO. 520 in the 11/188,298 US application
  misc_feature: The sequence is a functional homolog of SEQ ID NO. 464 in the 11/188,298 US application
  misc_feature: The sequence is a functional homolog of SEQ ID NO. 498 in the 11/188,298 US application
  misc_feature: The sequence is a functional homolog of SEQ ID NO. 323 in the 11/188,298 US application
  misc_feature: The sequence is a functional homolog of SEQ ID NO. 441 in the 11/188,298 US application
  misc_feature: The sequence is a functional homolog of SEQ ID NO. 358 in the 11/188,298 US application
  misc_feature: The sequence is a functional homolog of SEQ ID NO. 446 in the 11/188,298 US application
  misc_feature: The sequence is a functional homolog of SEQ ID NO. 311 in the 11/188,298 US application
MEHVVGGKFKLGKKIGSGSFGELYLAVNVQNGEEVAVKLESVKSRHPQLHYESKLYMLLQGGTGIPHLKWFGVEGEYNVMVIDLLGPSLEDLFNYCSRKFSLKTVLMLADQMISRVEYMHTRGFLHRDIKPDNFLMGLGRKANQVFVIDYGLAKKYRDLQTHKHIPYRENKNLTGTARYASVNTHLGVEQSRRDDLESLGYVLMYFLRGSLPWQGLKAGTKKQKYDRISEKKMLTPVEVLCKSYPSEFTAYFHYCRSLRFEDKPDYSYLKRLFRDLFIREGYQLDYVFDWTIMKYPQFRDKSKLQSSGKISGLAGPSAERTDRTAAEALFRRTGSGSGHNREHTKHRSLLESLMPSKVTVDSDKTRPSSSSRNGSTSRRAVLSSSKPSSSGDPSDPNRMGRLVPSSSSRPPTAQRAHPSGGAEMRSSSLSKIGRSSHDDAIRNFELLSLGADRRK

SEQ ID NO: 6175 - DNA, 1872 bp, Sorghum bicolor
  misc_feature: Ceres ANNOT ID no. 6064572
  misc_feature: Encodes the peptide sequence at SEQ ID NO 6176
atggagaacctgaggaggctcctgaatccgctggtgctcaacctgcagaagatggagctggagctcacctgccccgtctgcctgaagttgctcacctcgccgacaacgctgccgtgctaccacacatcctgcagcaagtgtgcccttacaccgacttcaaaaggttacagctgcgccatttgcaaatctggctattgttctcaagatttaaggccagcttctcatctcgagtcgatagtgagcattcacaggagcctcagctctaccgtatgcaccatgattgaacagcaggatgctcaagttaacattcctgttgcaaagacagcatctcatggaacaccagagtcaggaaacagaagtggggtgatggagaaatatgaccagatgaaatcttacaaccctgttgcttcaaagctagtatatgatcagtcaactggacctgcatttgggaacatggagggtgttcaagcaaaagatcctgcagtagagaacaatgctggtgctgcagctgttgcaccaacggctatagtacaaaagggtcattctgggtcacaatcttctgacggccctggggatttggattgtgacagcaatgaccttgaaggagaactgataacaagcagatcacttcttcaaactgcattgaaaagagagacaaatgtaatggatgaccataccagagaattgaagaggcaaaaatcaaatgaccaggttcaaagacaaacaaccatggccagtgcttggaaatgtgagttctgtcattcttcccaagtcactgagtgtactggacctttgtcacattatctgaatggggagccaatagaagctgatcaagcttggaaatcaagtgttcatcatgtccatgagaaatgtgttgaatgggctcctcaagcattctttactggtgacattgcaaataacttggagcctgagttggcccgtgcttctaagatcaaatgcagtgtttgtggcttgaaaggtgcagcacttggctgccttgtgaagagctgccgcaatagttttcatgtcccatgtgcctacaacatcaaaggctgcaaatgggatcaagagaacttcgttatgctgtgttctacacattcttcaaaaaagttgccttgtgaaagatcaaagtcaaaaaagaaggccaagttacagcaaccatcttctgacactgatggtctgaattcaccctctccaatgcaaagggatgaactttggactgcctcaccttttctgactagtggatgggtgatatgtggatctgccctcattggccatgagaaggaaatcttggatcaatttgagtgtcacactggcatcactgtaactaacacttggagttcggatgtgactcatgtgattgctaatacggatgaacgtggggcatgtgctaggacactcaaggttctcatggcaattttagctgggaagtgggttctcaatgtgaactggctgaaagactgtattgaggctaggaaaccaatcccagaagagccctatgagataagctgtgatgttcatggctctgttaatgggcctcgctcaggaaggcttcgagcaatgcagcaggcaccaaacctgtttgctgggttgaccttctatttcagtggccatttcatgccgggatacaaggccaaccttgaagatttgattgccgcaggagggggttccattttggagaagactcagctctcttgtgcatccttgattctttacagcatggagccaccacaaggaaacagtcccaacacccttgagaccatcaataagagaatagctgaggctcaagaactggcagccacggttggctgcaaagccattcctcatacatggcttctggattctattgcatcctgcaatttgagcgtgtga

SEQ ID NO: 6176 - protein, 623 aa, Sorghum bicolor
  misc_feature: Ceres ANNOT ID no. 6064572
  misc_feature (408)..(489): Pfam Id: BRCT Pfam Desc: BRCA1 C Terminus (BRCT) domain
  misc_feature (24)..(61): Pfam Id: zf-C3HC4 Pfam Desc: Zinc finger, C3HC4 type (RING finger)
  misc_feature (1)..(623): NCBI GI: 38345319 NCBI Desc: osjnba0004n05.16 [oryza sativa (japonica cultivar-group)]
  misc_feature (1)..(623): NCBI GI: 116311082 NCBI Desc: osigba0157k09-h0214g12.23 [oryza sativa (indica cultivar-group)]
  misc_feature (152)..(621): NCBI GI: 42561677 NCBI Desc: zinc finger (c3hc4-type ring finger) family protein / brct domain-containing protein [arabidopsis thaliana]
  misc_feature (223)..(621): NCBI GI: 145362227 NCBI Desc: atbard1/bard1 (breast cancer associated ring 1); transcription coactivator [arabidopsis thaliana]
  misc_feature (250)..(621): NCBI GI: 115464839 NCBI Desc: os05g0512000 [oryza sativa (japonica cultivar-group)]
MENLRRLLNPLVLNLQKMELELTCPVCLKLLTSPTTLPCYHTSCSKCALTPTSKGYSCAICKSGYCSQDLRPASHLESIVSIHRSLSSTVCTMIEQQDAQVNIPVAKTASHGTPESGNRSGVMEKYDQMKSYNPVASKLVYDQSTGPAFGNMEGVQAKDPAVENNAGAAAVAPTAIVQKGHSGSQSSDGPGDLDCDSNDLEGELITSRSLLQTALKRETNVMDDHTRELKRQKSNDQVQRQTTMASAWKCEFCHSSQVTECTGPLSHYLNGEPIEADQAWKSSVHHVHEKCVEWAPQAFFTGDIANNLEPELARASKIKCSVCGLKGAALGCLVKSCRNSFHVPCAYNIKGCKWDQENFVMLCSTHSSKKLPCERSKSKKKAKLQQPSSDTDGLNSPSPMQRDELWTASPFLTSGWVICGSALIGHEKEILDQFECHTGITVTNTWSSDVTHVIANTDERGACARTLKVLMAILAGKWVLNVNWLKDCIEARKPIPEEPYEISCDVHGSVNGPRSGRLRAMQQAPNLFAGLTFYFSGHFMPGYKANLEDLIAAGGGSILEKTQLSCASLILYSMEPPQGNSPNTLETINKRIAEAQELAATVGCKAIPHTWLLDSIASCNLSV

SEQ ID NO: 6177 - DNA, 1173 bp, Sorghum bicolor
  misc_feature: Ceres ANNOT ID no. 6064573
  misc_feature: Encodes the peptide sequence at SEQ ID NO 6178
atggcgttcttcagcagtggatcccgggttctggtcgaaatcctgacgaggatgcagagcgccgaaagaccaatgcctgttgaccacaccttcttcgagtttggatcgattcgatatcatgtggaggcttcagtgtcggatcctgagaacgtgttcctgtcgatatcgacgccgtcgctctcccacgaggcggctgcaccctcgtcgtcgtcggcggcgagccgcctgcctgaactgaccctgcaggagacgaggaagacgtatggcaggttcgcggagatcgtggagccgccgagggaaggatacgccctgacgctcaagctcaacttctccggcctcgcccggccgaaagatcgcgtgaaggccattaaccaggtgtcgctgctgcaatccgtggtgctgagctcgcagctgaaggagatgctggggagcctcggctcgtcgccgggcaccatgaggctcgtgtacaaccagagggagcccttcttcgtcagcaggacggctgatgagacgataaacgccatcttccccatgcgcttcagggacgacacggacctggccatcgccacctccttcttccaggagctacaggacgtcgggaactcgttcgcgtgggcgcccaagtgcagctggtcgccgatcccgccgccggagctgcgcggggagaaggtgcaccacctcaccaccaacggcggcttcgtctccttcggcgtcctgtcgcgccacgtgagggggaagcgggccgccaagaccgcgtggatcctgctcaacttccagtcctacgtcaagtaccacatcaagtgcacccggagccacgtccagagccggatgcgggagcggctggagacgctgacggaggccgtccagaacgcgaggctacgcgggacgaatagccacgacaagaagcgggcgtcacaagttgtgaagaagaggagcagcaagagacggctcgttagcctggcgaaagcgagcaagaagctgcacaagggtttcagggccgtcctggacaagatcatgaagcggctgcggcagaggatcagggtgaaaggcctggaccggctccggcggcagttccggtgccggtgcttcgcggtgcctaggctcccggccgcgccacctcgcgctcacagtcgcagcaggaaggcgcacagataccacaagctggccgagtaa

SEQ ID NO: 6178 - protein, 390 aa, Sorghum bicolor
  misc_feature: Ceres ANNOT ID no. 6064573
  misc_feature (59)..(297): Pfam Id: P34-Arc Pfam Desc: Arp2/3 complex, 34 kD subunit p34-Arc
  misc_feature (1)..(388): NCBI GI: 38345318 NCBI Desc: osjnba0004n05.15 [oryza sativa (japonica cultivar-group)]
  misc_feature (1)..(388): NCBI GI: 116311081 NCBI Desc: osigba0157k09-h0214g12.22 [oryza sativa (indica cultivar-group)]
  misc_feature (1)..(372): NCBI GI: 30685673 NCBI Desc: actin-related protein 2/3 complex 34kda subunit family / arp2/3 complex 34kda subunit family [arabidopsis thaliana]
  misc_feature (20)..(267): NCBI GI: 4926828 NCBI Desc: t17h7.13 [arabidopsis thaliana]
  misc_feature (28)..(311): NCBI GI: 119640033 NCBI Desc: actin related protein 2/3 complex subunit 2 [suberites domuncula]
MAFFSSGSRVLVEILTRMQSAERPMPVDHTFFEFGSIRYHVEASVSDPENVFLSISTPSLSHEAAAPSSSSAASRLPELTLQETRKTYGRFAEIVEPPREGYALTLKLNFSGLARPKDRVKAINQVSLLQSVVLSSQLKEMLGSLGSSPGTMRLVYNQREPFFVSRTADETINAIFPMRFRDDTDLAIATSFFQELQDVGNSFAWAPKCSWSPIPPPELRGEKVHHLTTNGGFVSFGVLSRHVRGKRAAKTAWILLNFQSYVKYHIKCTRSHVQSRMRERLETLTEAVQNARLRGTNSHDKKRASQVVKKRSSKRRLVSLAKASKKLHKGFRAVLDKIMKRLRQRIRVKGLDRLRRQFRCRCFAVPRLPAAPPRAHSRSRKAHRYHKLAE

SEQ ID NO: 6179 - DNA, 2202 bp, Sorghum bicolor
  misc_feature: Ceres ANNOT ID no. 6064581
  misc_feature: Encodes the peptide sequence at SEQ ID NO 6180
atgtctgacatcaattttgatgagattcttgaggttcctgacactcctgaccaacatcagtcaaaataccatgtttccagctctattgttgggagggattatacaatggcagctgctaatccatcaccacggcgcaaacttagaattagattcaagaacaattccctggatggttcatcaagtcagaataatgcttgtagtgtattgcctgcagcttcagatattgatcatattttcaaacaagctaaagcagcacaggttctggaactgtcaaaagattataatgcaaaattttccctaaagaaatctgacaggacagggatatctgttgacaatgaaaagagggctgaaaaacatggcttggatcagagcagaagcatttcgaacaacataagttgtagtgtgacggtaggaaggaaccctaccttccaagttaaagatggagaggttgttcagcaagatgcaggtcatcagaatgcaaactttcttggcataggatcaggtcttcctactatcccagtgggaaaaccaggaaacaggacatgcactagcactacgaaaggtgtaacaggtgctgatgtttgtctaggatcaagttctggagaggtcaaaggggaagtgatcactgacaaggtcattacaggacctacaagccctctgtgtgttgttcctcgaaggcatgttggccaaaaaaggctggtccacaatggatgtatttctccctctaacatagccaagacaaatgtaaaagtggatgcaaaacgggaaatgtgctcttcaagtgaacatttgcaccatccacatcctcagcttgatgcatttgacagaagcagtgtgattgacctcactgataattcaccaataatgacaaggcagagatctaaagtgaacaataaatttatccctggacacaatatggacacaagggccacaaaaaaactgagaacagagacaactggcaggacttcggttccactgtccaaatatcatgcaaacagcagcaattgttctgaagctaatttatcaggccacaacaacaaaggaaaaggaattagcattgatatcttggatagtgatcagattggagaagctgacttgaggggggttgatcttagtactgctggaacttgtgtaaacaaaaacagttctgatataaacacagagcaaggttggagaacaacacacaaccacacaagtaaattacccatttcgtttatgggtaacacaactactagttccagacgagaacctggatcttccacgcgatctaatcaaaaccatggatctgctggaggcaatcatacctcagttagtggagcaaccatgatggttcctgataggttggggaataaaacaataatgaatcataaaggatggagaaaagaaacctcaacttcttgtcatactggtgaaagctctagtgctgttgacgaacctagaggttctcttcaatcatcaaaaatatcagccggcagaaatcataccagtcatcagcataatattcctgtaataaccatagatgacatatcccctgaagctagacctagttcgagtggattcactaatggaacctctgttgatcctaacatagaagcacaattggagtcggatgagttattggctcgccaactccaggagcaactttacaatgaatctcctcgttttgccccaacagaagagattgatgcaatcgtagcaatgtcacttcaacatgaagaagatgcacatcggacatctaggcctgtaaggaggttccaaaacaatattagagatgcccgggctgctcgttcgagttcttatcgaaatgctcttagggctcgattggcgacagcagacgatatgatttcccgtctgcggaatactgctccaagaacactgggattgggagctgctttagcaagatattctggtgctttgcacattcaaccaaacattgacttaaatgactatgacgcactgcttgcactggatgaaaataaccaccagcacactggtgcttcagaaagccagatcaataatttgccgcagtcagtagttcagtccaatagcattgaagatccatgttctgtctgccttgaaaatccttctgtgggagatactatccgccatctgccatgctttcacaagttccataaagagtgtattgacgagtggcttaaaagaaagaaactgtgcccagtctgcaagtttgggattaattga

SEQ ID NO: 6180 - protein, 733 aa, Sorghum bicolor
  misc_feature: Ceres ANNOT ID no. 6064581
  misc_feature (688)..(728): Pfam Id: zf-C3HC4 Pfam Desc: Zinc finger, C3HC4 type (RING finger)
  misc_feature (1)..(732): NCBI GI: 38345315 NCBI Desc: osjnba0004n05.9 [oryza sativa (japonica cultivar-group)]
  misc_feature (1)..(732): NCBI GI: 116311076 NCBI Desc: osigba0157k09-h0214g12.17 [oryza sativa (indica cultivar-group)]
  misc_feature (235)..(713): NCBI GI: 7211986 NCBI Desc: contains similarity to the regulatory protein (g1) gbm97204 goliath from d. melanogaster. est gbt76547 comes from this gene. [arabidopsis thaliana]
  misc_feature (644)..(733): NCBI GI: 3822225 NCBI Desc: ring-h2 finger protein rhg1a [arabidopsis thaliana]
  misc_feature (658)..(732): NCBI GI: 89308928 NCBI Desc: zinc finger protein [tetrahymena thermophila sb210]
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 468 in the 11/188,298 US application
MSDINFDEILEVPDTPDQHQSKYHVSSSIVGRDYTMAAANPSPRRKLRIRFKNNSLDGSSSQNNACSVLPAASDIDHIFKQAKAAQVLELSKDYNAKFSLKKSDRTGISVDNEKRAEKHGLDQSRSISNNISCSVTVGRNPTFQVKDGEVVQQDAGHQNANFLGIGSGLPTIPVGKPGNRTCTSTTKGVTGADVCLGSSSGEVKGEVITDKVITGPTSPLCVVPRRHVGQKRLVHNGCISPSNIAKTNVKVDAKREMCSSSEHLHHPHPQLDAFDRSSVIDLTDNSPIMTRQRSKVNNKFIPGHNMDTRATKKLRTETTGRTSVPLSKYHANSSNCSEANLSGHNNKGKGISIDILDSDQIGEADLRGVDLSTAGTCVNKNSSDINTEQGWRTTHNHTSKLPISFMGNTTTSSRREPGSSTRSNQNHGSAGGNHTSVSGATMMVPDRLGNKTIMNHKGWRKETSTSCHTGESSSAVDEPRGSLQSSKISAGRNHTSHQHNIPVITIDDISPEARPSSSGFTNGTSVDPNIEAQLESDELLARQLQEQLYNESPRFAPTEEIDAIVAMSLQHEEDAHRTSRPVRRFQNNIRDARAARSSSYRNALRARLATADDMISRLRNTAPRTLGLGAALARYSGALHIQPNIDLNDYDALLALDENNHQHTGASESQINNLPQSVVQSNSIEDPCSVCLENPSVGDTIRHLPCFHKFHKECIDEWLKRKKLCPVCKFGIN

SEQ ID NO: 6181 - DNA, 1794 bp, Sorghum bicolor
  misc_feature: Ceres ANNOT ID no. 6064582
  misc_feature: Encodes the peptide sequence at SEQ ID NO 6182
atggagggcggtgtgactgtagcagataaggcagaattcaaggagtgcctgcggctgtcctggacacagccttacatccttcagcttgtgctgtctgctggcatcggtggtcttcttttcggatatgatacaggtgtcatatctggagcccttctctacattagagatgattttgctgcagtggaaaagagcactgtattaagggagacaatagtcagtatggctgttgctggagctatagttggagctgcatttggtggttggatgaatgacaaatttggaaggaggccttccatcataattgccgatgccttgttctttgcaggcgccgtaatcatggccttttccccaacacctaatgttatcattgttgggagggtatttgttggtcttggtgttgggatggcatccatgacagctcctctgtacatctctgaagcctcccctgctagaatcagaggtgctctagtgagcaccaacgggcttctcatcactggtggccagttcttggcatacctcattaatctagcgttcactaaggtgccggggacctggcggtggatgcttggcattgcaggggttcctgccctggtccaattcgtactgatgctgatgcttccagaatcaccaagatggctctacaggaagggcaggaaagaggaagctgcagcaatcttgcagaagatttaccctgcgaatgaggtcgagcaagagattgacgcaatgcgcctgtctgttgaagaagaggtgctccttgagggctccatcggcgagcagggactgattggcaagctgaggaaggcgctgggcagcaaggtcgttcgccgcgggctattggccggcgtcatcgtccaggtcgcgcagcagttcgtgggcatcaataccgtcatgtactacagcccgacgatcgtgcagctggccggctatgcgtccaacaacacagccatggcactgtccctcatcacctcgggcctgaacgccatcggctccattgtcagcatgttcttcgtggacagggcaggccggaggcgcctgatgctgatcagcctggtcggcatcgtcgtgtggctcgccgtgctcggcggcacgttcctgggcgccgcgcaccacgccccacccgtcagcgacgtggagacccgagtgctggcgaaccagacccaggcgtgtcccgagttcaacccaaacgtcccctggagctgcatgaactgcctcaaggccgcgtccacgtgcggcttctgtgctcaccagggagacgaggcaagtgcaccatttcttgttcttgcctgcaatcttcttccgggggcgtgcttggtgctgaacgacgcgtctcggcatgcgtgccgggcggatcgccgtgagttctacacggaggggtgcccgaacaacttcgggtggctggcgctgatcggcctgggcgcgtacatcgtctcctactcgcccggcatgggcacggtgccgtggatcgtcaactcggagatctacccgctgcggttcaggggcatctgcggcggcatcgcggccgtcgccaactgggtctccaatctcatcgtgacgcagacgttcctgtccctgaccaaggcgctcgggacatcggccacattcttcctcttctgctgtgtctccttcctggctctcatcgtcgtcttcctcaccgtgccggagaccaagggcctgcagttcgaggaagtggagcggatgctggaaaggaaggactacaagccctggaagagataccatggtggcagcagcatcgagccggcgaaaaacagtgagattggcctcaccacgccatga

SEQ ID NO: 6182 - protein, 597 aa, Sorghum bicolor
  misc_feature: Ceres ANNOT ID no. 6064582
  misc_feature (29)..(567): Pfam Id: Sugar_tr Pfam Desc: Sugar (and other) transporter
  misc_feature (33)..(518): Pfam Id: MFS_1 Pfam Desc: Major Facilitator Superfamily
  misc_feature (1)..(597): NCBI GI: 116311075 NCBI Desc: osigba0157k09-h0214g12.16 [oryza sativa (indica cultivar-group)]
  misc_feature (2)..(575): NCBI GI: 92886243 NCBI Desc: sugar transporter [medicago truncatula]
  misc_feature (25)..(364): NCBI GI: 126635785 NCBI Desc: sugar transporter protein [ananas comosus]
  misc_feature (1)..(418): NCBI GI: 87240579 NCBI Desc: sugar transporter superfamily; major facilitator superfamily mfs_1 [medicago truncatula]
  misc_feature (24)..(364): NCBI GI: 92896786 NCBI Desc: major facilitator superfamily [medicago truncatula]
  misc_feature: The sequence is a functional homolog of SEQ ID NO. 488 in the 11/188,298 US application
  misc_feature: The sequence is a functional homolog of SEQ ID NO. 449 in the 11/188,298 US application
  misc_feature: The sequence is a functional homolog of SEQ ID NO. 331 in the 11/188,298 US application
  misc_feature: The sequence is a functional homolog of SEQ ID NO. 296 in the 11/188,298 US application
MEGGVTVADKAEFKECLRLSWTQPYILQLVLSAGIGGLLFGYDTGVISGALLYIRDDFAAVEKSTVLRETIVSMAVAGAIVGAAFGGWMNDKFGRRPSIIIADALFFAGAVIMAFSPTPNVIIVGRVFVGLGVGMASMTAPLYISEASPARIRGALVSTNGLLITGGQFLAYLINLAFTKVPGTWRWMLGIAGVPALVQFVLMLMLPESPRWLYRKGRKEEAAAILQKIYPANEVEQEIDAMRLSVEEEVLLEGSIGEQGLIGKLRKALGSKVVRRGLLAGVIVQVAQQFVGINTVMYYSPTIVQLAGYASNNTAMALSLITSGLNAIGSIVSMFFVDRAGRRRLMLISLVGIVVWLAVLGGTFLGAAHHAPPVSDVETRVLANQTQACPEFNPNVPWSCMNCLKAASTCGFCAHQGDEASAPFLVLACNLLPGACLVLNDASRHACRADRREFYTEGCPNNFGWLALIGLGAYIVSYSPGMGTVPWIVNSEIYPLRFRGICGGIAAVANWVSNLIVTQTFLSLTKALGTSATFFLFCCVSFLALIVVFLTVPETKGLQFEEVERMLERKDYKPWKRYHGGSSIEPAKNSEIGLTTP

SEQ ID NO: 6183 - DNA, 2535 bp, Sorghum bicolor
  misc_feature: Ceres ANNOT ID no. 6064596
  misc_feature: Encodes the peptide sequence at SEQ ID NO 6184
atggccgagagcgagcatccgccgcaggtgtcatcggaacctaccactccgccgcaggaaggtagcggaagggctaagaaaaagaacaagaagaatcgttccaagaagcaaccaaagcgagccgccgccgccgccgacaccgacgggttttcctcaggcgccagcaccatggttgaggaccccttcctcgtccttgccggcggaaaggaaggagggtttctggatttggaggagatcgatgaggcagacttcggcatcttcggaaacgtcttggatgacgtaggagagggcgtcaaggaagcagggaaggatcatgggaagaagaataagaagaagaaaacgaagaagcggaagcgtgggggtgatgacgagggcttcaatgccgacagtgctttggtagttgagaatgagcaggtggatggcgagaaagcggagaaaaaggtcgaggatggagagaaaggggagaagaagggaaagagaaagaggaacaggaagaagaggaaggtgaaggataatgagacaagcagggagagtgatgaggatgtcgctagcgacaatgcagaagacatgcaagatgacactgagaaattggaacaagataaggatgatgagctgattttgggtgaggatgatgtttctgaatggcgtgagcttaggctgcaccctctgcttctcaaggcgatgcgcagacttggattcaaagagccaacacctatacaaaagtcttgctttcctgcagcagctcatcaaggcaaggatgttatcggtgcagcagagacaggttctggaaagacacttgcttttggcctcccaattttgcaacgtctccttgaagagcgagaaaaggccgcaagattgcaccaggaaggcgataaaatggatgaacgttctggtggaagccctcttcgtgctcttattctgacacccaccagggagcttgccaaacaggtatgcgatcatctaaaagatgcggccaagttcttaggaatccatgttgttccaattgttggtggtctatccatggaaaagcaagagcggcttttgaaaaagaagcctgaaattgttgttggaactcctggaagattgtgggagcacatgtcgatgaacaatcaacacctagttgagctgcattcattgtcattcttcgtcttggatgaggctgatagaatgattgaacgaggccatttccgtgaattgcaatctatcattgagatgcttccactgaccaatggttctgatgagcaatctgcaaaaaccatgccaaactgtgagactgtaccaaatttgcaaataaagaagaggcaaacatttgtgttctcagccacacttgcactttcatctaattttcggaagaagttgaagcgcggcctatctacctcaaaggcatcgacgcctgatgatgtaagctctattgaagcattgtcgaaacaagctggaatgaaacctaatgctgaaatagttgatttgacaaaggcttcaatcttgcctgagaagcttgaagaatcttttattgagtgcagtgaagaggataaggatgcatatctgtattatatattgagtgttcatgggcaaggtcgcacaataatattttgtacatcaatcgccgcattacgtcacatttcttctatattgcgcattcttggaattaatgtattgacaaaccatgctcaaatgcaacaaagagctcgcatgaaggctgtggatcgcttccgtggaagtgaaaattccattttggtcgcgactgatggttttgcaaggggtatggattttgatgatgtccgaacagttatccattatcagttgccacactcaactgatgtttatatccacagaagtggcaggacagcacgtaagtcattggctggctgcagcattgcattaatctctcctactgacaagtccaagttttattctctttgcaagtctttgtcaaaggagaatctccagcagtttcctatagatcatacttacatgtctggagtaatgaataggctctcacttgctcggcagattgacaagattgcacgtaaaacttcacaggaaaatgctaacaaatcctggcttcaaagaaatgctgaatcgatgggattgattttggacgctagtgacagtgaagaagaacgtgtgcagggacagaagaaacgaaagggaacttctgcacatctccaaaagcttcaacaggaattgagtgatctcttgcaacgtccattgcagcctaagactttctctcgccgctatttggctggggctggtgtctcacccttacttcagaagcaactagaagagttggccaagagaaaagcaagcaacaatagctgcaaaggatctgggtttgttgttattggtcaggatcgtgttgatcccttgcaagcacttcaaaattctgggcaagaggtctgtgtcaacatcgacaaacaaagagaaaagcgaagagtcgctgagaactggaggcggaaaaaatatgaagaaaagaaacgtaggattctttttccttctctttcttttgcttcacttgcagtgtggtctcacctttga

SEQ ID NO: 6184 - protein, 844 aa, Sorghum bicolor
  misc_feature: Ceres ANNOT ID no. 6064596
  misc_feature (237)..(449): Pfam Id: DEAD Pfam Desc: DEAD/DEAH box helicase
  misc_feature (543)..(619): Pfam Id: Helicase_C Pfam Desc: Helicase conserved C-terminal domain
  misc_feature (1)..(825): NCBI GI: 32488303 NCBI Desc: osjnbb0065l13.12 [oryza sativa (japonica cultivar-group)]
  misc_feature (1)..(825): NCBI GI: 122162170 NCBI Desc: dead-box atp-dependent rna helicase 13
  misc_feature (136)..(826): NCBI GI: 92887347 NCBI Desc: helicase, c-terminal [medicago truncatula]
  misc_feature (22)..(824): NCBI GI: 7939577 NCBI Desc: atp-dependent rna helicase [arabidopsis thaliana]
  misc_feature (22)..(824): NCBI GI: 79404523 NCBI Desc: atp binding / atp-dependent helicase/ helicase/ nucleic acid binding [arabidopsis thaliana]
MAESEHPPQVSSEPTTPPQEGSGRAKKKNKKNRSKKQPKRAAAAADTDGFSSGASTMVEDPFLVLAGGKEGGFLDLEEIDEADFGIFGNVLDDVGEGVKEAGKDHGKKNKKKKTKKRKRGGDDEGFNADSALVVENEQVDGEKAEKKVEDGEKGEKKGKRKRNRKKRKVKDNETSRESDEDVASDNAEDMQDDTEKLEQDKDDELILGEDDVSEWRELRLHPLLLKAMRRLGFKEPTPIQKSCFPAAAHQGKDVIGAAETGSGKTLAFGLPILQRLLEEREKAARLHQEGDKMDERSGGSPLRALILTPTRELAKQVCDHLKDAAKFLGIHVVPIVGGLSMEKQERLLKKKPEIVVGTPGRLWEHMSMNNQHLVELHSLSFFVLDEADRMIERGHFRELQSIIEMLPLTNGSDEQSAKTMPNCETVPNLQIKKRQTFVFSATLALSSNFRKKLKRGLSTSKASTPDDVSSIEALSKQAGMKPNAEIVDLTKASILPEKLEESFIECSEEDKDAYLYYILSVHGQGRTIIFCTSIAALRHISSILRILGINVLTNHAQMQQRARMKAVDRFRGSENSILVATDGFARGMDFDDVRTVIHYQLPHSTDVYIHRSGRTARKSLAGCSIALISPTDKSKFYSLCKSLSKENLQQFPIDHTYMSGVMNRLSLARQIDKIARKTSQENANKSWLQRNAESMGLILDASDSEEERVQGQKKRKGTSAHLQKLQQELSDLLQRPLQPKTFSRRYLAGAGVSPLLQKQLEELAKRKASNNSCKGSGFVVIGQDRVDPLQALQNSGQEVCVNIDKQREKRRVAENWRRKKYEEKKRRILFPSLSFASLAVWSHL

SEQ ID NO: 6185 - DNA, 1296 bp, Sorghum bicolor
  misc_feature: Ceres ANNOT ID no. 6064614
  misc_feature: Encodes the peptide sequence at SEQ ID NO 6186
atgtacggcgtcggcggcggtgggggcggcttcaacgcgccctccaccactgccggtcggcgccgcaacccgggcgacgaggaggaggacgaggaggaggagggcggtgagggccgcgtcctggaggcgtgggagcgcgcgtacgcggacgaacggtcgtgggagtcactgcaggaggatgagtcgggcctcctccatcccatcgacaccaaggccctcgtacactcgcagtaccgccgtcgcctcctactccgctccgccgcggcagccgctgcccgcatccaaaaggggctcatccgctacctctacatcgtcatagacctctcccgggcggcttcagagatggattatcgtcctagtcgaatggcagttgttgcaaaacatgctgaggctttcataagagaattctttgaccagaatccgttgagccatgttggcctagtgacaattaaagatggtattgcccatcgacttacagaaattggagggagcccagagtcacagattaaggctttgatggggaagcttgagtgttccggtgattcatccctgcagaatgctctagaacttgttcatggttatttagatcaagtaccatcatatggtcacaaggaagttctgattttatactctgccctgaatacatttgatcctggtgatatcatggagacaataacaaaatgtaagaagtcaaaaattagatgctctgtcattggtcttgctgcagagatcttcatttgcaaacatctatgtgaagagactggtggatcctacacagttgcgctggatgagtctcatttcaaagagttgttactggaacatgctcccccacctccagcaatagcagaatatgctgcagctaatttgattaagatgggctttccacaaaggggtgctgaggatcttatatctatttgctcttgtcacaagaagataaagtctggggctgaaggttacatatgtcctagatgcaaagttaatgtgtgtgagcttccaactgaatgtcgaacttgtggtcttacactagttagttctccacacttggcaaggtcatatcatcatctcttccctgtagcaccgttcgatgaggtcacccctgttccaaatagaatccaaaggggaggacagatctgtttcagctgccagcagagcctttttaacccagatggccaatctaacctccatgttcgctgcccaaaatgcaaccagcacttctgccttgattgtgatatttacatccacgagagcttgcacaactgccctggctgtgagagccaacgcaacatcactttatag

SEQ ID NO: 6186 - protein, 431 aa, Sorghum bicolor
  misc_feature: Ceres ANNOT ID no. 6064614
  misc_feature (40)..(295): Pfam Id: Ssl1 Pfam Desc: Ssl1-like
  misc_feature (377)..(425): Pfam Id: C1_4 Pfam Desc: TFIIH C1-like domain
  misc_feature (1)..(428): NCBI GI: 32489532 NCBI Desc: osjnba0043l24.23 [oryza sativa (japonica cultivar-group)]
  misc_feature (1)..(428): NCBI GI: 116310777 NCBI Desc: osigba0101p20.13 [oryza sativa (indica cultivar-group)]
  misc_feature (18)..(428): NCBI GI: 140046489 NCBI Desc: von willebrand factor, type a; zinc finger, c2h2-type [medicago truncatula]
  misc_feature (27)..(428): NCBI GI: 3560161 NCBI Desc: spcc1682.07 [schizosaccharomyces pombe]
  misc_feature (27)..(428): NCBI GI: 19075300 NCBI Desc: tfiih subunit p47 [schizosaccharomyces pombe]
MYGVGGGGGGFNAPSTTAGRRRNPGDEEEDEEEEGGEGRVLEAWERAYADERSWESLQEDESGLLHPIDTKALVHSQYRRRLLLRSAAAAAARIQKGLIRYLYIVIDLSRAASEMDYRPSRMAVVAKHAEAFIREFFDQNPLSHVGLVTIKDGIAHRLTEIGGSPESQIKALMGKLECSGDSSLQNALELVHGYLDQVPSYGHKEVLILYSALNTFDPGDIMETITKCKKSKIRCSVIGLAAEIFICKHLCEETGGSYTVALDESHFKELLLEHAPPPPAIAEYAAANLIKMGFPQRGAEDLISICSCHKKIKSGAEGYICPRCKVNVCELPTECRTCGLTLVSSPHLARSYHHLFPVAPFDEVTPVPNRIQRGGQICFSCQQSLFNPDGQSNLHVRCPKCNQHFCLDCDIYIHESLHNCPGCESQRNITL

SEQ ID NO: 6187 - DNA, 1419 bp, Sorghum bicolor
  misc_feature: Ceres ANNOT ID no. 6064631
  misc_feature: Encodes the peptide sequence at SEQ ID NO 6188
atggctcgtgcctccgtctccggctccgccgccgcggccaaagcactgctccccttaaaccccgtccgcggcggccgcctcccttccctgcttcccgcgcgcctccctgtgcccgggagcgcccgcgtgctccgcggcgcctcgctccgctgctacgccgccgccgccgcggtggctgagcagagccgcatcaaggtgcagaaccccatcgtcgagatggacggggatgagatgacgcgggtcatctggaaattgattaaggataagctcatcttcccgtacctggagctggatgtgaagtactatgatcttggaattctcaatcgcgatgccaccaatgatgaggtcacggtcgagagtgccgaggctacattgaagtataatgttgctgttaagtgtgcaacaattacgcctgatgagactagagtaaaagagtttaaactcaagtctatgtggcggagtccaaacggcacaataaggaatattctaaatgggactgtttttcgtgagcctatcttgtgtcaaaacatcccaagaattctttctggttggaagaaacctatttgcataggaaggcatgcttttggtgaccagtatcgagctactgatatgattattaatggtccaggaaagctaaagatggtatttgtgcctgatggagctgacccgatggagctggacgtttatgattttaaaggacctggtgtggcattatcaatgtacaatgtggatgagtctattagggcttttgctgagtcgtctatggctatggcactttcgaaaaagtggcctctctatctcagcaccaaaaatacaatcctgaagaagtatgacggcaggttcaaagacatcttccaggaggtatatgaagaacaatggaaggagaagtttgaagcaaactcaatatggtatgagcacaggttgattgatgacatggtggcctatgctgtgaaaagtgatggtgggtatgtttgggcatgcaaaaactatgacggagacgtacagagcgattttcttgcccaaggttttggttctctgggtttgatgacgtctgtgctgttgtcttctgatgggaaaacattagaggctgaggctgctcatgggactgtcactagacatttcaggctacatcagaaaggacaggagacaagtaccaacagtattgcctctatattcgcttggacccgtggactagaacacagggcaaagctggataaaaatgatagtctgttggatttcacacacaaacttgaatctgcatgtgtggaaacggtggaatctgggaaaatgactaaggaccttgcacttcttatccatggccccaaggtaacaagggagttctacctgagcaccgaagagttcatcgatgcagtcgcacagcagctgcgaggaaagattcaattaccaactatggtgtaa

SEQ ID NO: 6188 - protein, 472 aa, Sorghum bicolor
  misc_feature: Ceres ANNOT ID no. 6064631
  misc_feature (65)..(458): Pfam Id: Iso_dh Pfam Desc: Isocitrate/isopropylmalate dehydrogenase
  misc_feature (7)..(472): NCBI GI: 116310770 NCBI Desc: osigba0101p20.6 [oryza sativa (indica cultivar-group)]
  misc_feature (7)..(472): NCBI GI: 32489525 NCBI Desc: osjnba0043l24.16 [oryza sativa (japonica cultivar-group)]
  misc_feature (7)..(472): NCBI GI: 115459338 NCBI Desc: os04g0508200 [oryza sativa (japonica cultivar-group)]
  misc_feature (28)..(472): NCBI GI: 31339162 NCBI Desc: nadp-specific isocitrate dehydrogenase [lupinus albus]
  misc_feature (1)..(466): NCBI GI: 5738864 NCBI Desc: isocitrate dehydrogenase (nad+) [solanum tuberosum]
  misc_feature (63)..(466): SWISSPROT Homolog: EC 1.1.1.42 Isocitrate dehydrogenase [NADP]
  misc_feature: The sequence is a functional homolog of SEQ ID NO. 301 in the 11/188,298 US application
  misc_feature: The sequence is a functional homolog of SEQ ID NO. 317 in the 11/188,298 US application
MARASVSGSAAAAKALLPLNPVRGGRLPSLLPARLPVPGSARVLRGASLRCYAAAAAVAEQSRIKVQNPIVEMDGDEMTRVIWKLIKDKLIFPYLELDVKYYDLGILNRDATNDEVTVESAEATLKYNVAVKCATITPDETRVKEFKLKSMWRSPNGTIRNILNGTVFREPILCQNIPRILSGWKKPICIGRHAFGDQYRATDMIINGPGKLKMVFVPDGADPMELDVYDFKGPGVALSMYNVDESIRAFAESSMAMALSKKWPLYLSTKNTILKKYDGRFKDIFQEVYEEQWKEKFEANSIWYEHRLIDDMVAYAVKSDGGYVWACKNYDGDVQSDFLAQGFGSLGLMTSVLLSSDGKTLEAEAAHGTVTRHFRLHQKGQETSTNSIASIFAWTRGLEHRAKLDKNDSLLDFTHKLESACVETVESGKMTKDLALLIHGPKVTREFYLSTEEFIDAVAQQLRGKIQLPTMV

SEQ ID NO: 6189 - DNA, 1125 bp, Sorghum bicolor
  misc_feature: Ceres ANNOT ID no. 6064643
  misc_feature: Encodes the peptide sequence at SEQ ID NO 6190
  misc_feature: Up-regulated in root tissues in response to methyl jasmonate treatment
  misc_feature: Up-regulated in shoot tissues in response to methyl jasmonate treatment
  misc_feature: Down-regulated in root tissues in response to salicylic acid treatment
  misc_feature: Up-regulated in shoot tissues in response to salicylic acid treatment
atggccttgcaggtcaccggcggagtgggctgctgctgccctcgtcctcaaccgggctgtggcggccggcggttggcgcaggcggcggcggcgctctgtcgcccgccccgcgctgtagcgtcgtccggcacgaccacgacggtggtggaggaggacgagggcaaggtgaggctgggcggctcaagcgtcgccgtcaccaagctcggcatcggcgcgtggtcctggggcgacaccacctactggaacgactccgagtgggacgataggagactgagggaggcacaggacgcgttcgatgcgagcatcgataacgggatgaccttcttcgataccgcagaagtatacgtcaattctgaaagtttactgggaggattcatcaaggaaaggcaacagaaggaccagatcgaggtggccgtcgcaacaaagttcgctgcccttccttggagatttggaaggggtagtgttctttccgcgctgaagaaatcactagaccgtcttggcctatcgtcggttgagctctaccaactccactggccagggatttgggggaacgaaggataccttgatggtctcgcagatgcttatgagcaaggcctagtaaaggctgttggagtctcaaactacaatgagaagcgccttcgggatgcgcatgctcgtctcaagaagaggggtgttccacttgctgcaaatcaggtgaattacagcctcatatacagaaccccggagctgaatggtgtgaaggcagcttgtgatgagctcggtatcaccttgattgcttattcaccgatagcccaaggtgttctgacaggtaagtacactccagaaaagccccctactggtcctcgagcaaatacatacacccctgagttcctcaccaagctccaaccacttatgaacaggattaaagagattggagcaagctatggcaagagtccaacccaggtgtctctgaactggctgacctgccaggggaatgtggtgccaatccccggagccaagaatgccagccaggccaaggagttcgctggtgcactcggttggagcctgacaggagacgaggtcgaagagctacgaactctggcacgcgagatcaagggcatcaagatgcctatcgaggagtcgtag

SEQ ID NO: 6190 - protein, 374 aa, Sorghum bicolor
  misc_feature: Ceres ANNOT ID no. 6064643
  misc_feature (59)..(362): Pfam Id: Aldo_ket_red Pfam Desc: Aldo/keto reductase family
  misc_feature (3)..(373): NCBI GI: 24059944 NCBI Desc: aldo/keto reductase family-like protein [oryza sativa (japonica cultivar-group)]
  misc_feature (3)..(373): NCBI GI: 115470553 NCBI Desc: os07g0143000 [oryza sativa (japonica cultivar-group)]
  misc_feature (37)..(372): NCBI GI: 24111265 NCBI Desc: at1g06690/f4h5_17 [arabidopsis thaliana]
  misc_feature (187)..(330): NCBI GI: 6692675 NCBI Desc: f12k11.2 [arabidopsis thaliana]
  misc_feature (56)..(364): NCBI GI: 16332043 NCBI Desc: auxin-induced protein [synechocystis sp. pcc 6803]
  misc_feature: Up-regulated in root tissues in response to methyl jasmonate treatment
  misc_feature: Up-regulated in shoot tissues in response to methyl jasmonate treatment
  misc_feature: Down-regulated in root tissues in response to salicylic acid treatment
  misc_feature: Up-regulated in shoot tissues in response to salicylic acid treatment
MALQVTGGVGCCCPRPQPGCGGRRLAQAAAALCRPPRAVASSGTTTTVVEEDEGKVRLGGSSVAVTKLGIGAWSWGDTTYWNDSEWDDRRLREAQDAFDASIDNGMTFFDTAEVYVNSESLLGGFIKERQQKDQIEVAVATKFAALPWRFGRGSVLSALKKSLDRLGLSSVELYQLHWPGIWGNEGYLDGLADAYEQGLVKAVGVSNYNEKRLRDAHARLKKRGVPLAANQVNYSLIYRTPELNGVKAACDELGITLIAYSPIAQGVLTGKYTPEKPPTGPRANTYTPEFLTKLQPLMNRIKEIGASYGKSPTQVSLNWLTCQGNVVPIPGAKNASQAKEFAGALGWSLTGDEVEELRTLAREIKGIKMPIEES

SEQ ID NO: 6191 - DNA, 4329 bp, Sorghum bicolor
  misc_feature: Ceres ANNOT ID no. 6064645
  misc_feature: Encodes the peptide sequence at SEQ ID NO 6192
atggaatccgcgctggaggcggcgcgcgccaaggacaccaaggagcgcctggccggcgtcgagcggctgcacgaggcgcttgacgccacggcgcgccgcgggctggcggcggccgaggtcaccgcgctggtcgacacctgcatggatctgacgcgcgacgccaacttccgcatcgcccagggcggcctccaggcgctctccgccgccgccgtcgtcgccggcgaccacttcaagatccacctcaacgccctcgtcccggccgccgtcgagcgcctcggcgacggcaagcagcccgtgcgcgacgccgcgcgccagctcctcatcacgctaatggaggtttcttcaccaacaatcatagttgaaagagctggtagttatgcatggactcataggagttggagggtgcgggaagagtttgtacgtacagtggcaactgcagttgggctatttgcttctacagagatttccttgcaacgagttttgctttcacctgttctgcaattgatgaatgattcgaaccaaagtgtgcgagatgctgctatctcttgtattgaggagatgtacaagcacatggggtcacaatttcatgaagagttgcagcgccataatctgccttcctacatgctaaaagaaataaattcaaggttggataaaatagaaccaaaggttcgctcatctgatacagcgatgcagtataaggctgtagaatcaagatctgttagtgctaatccgaaaagaggcagcccaagaacaaaaagcataccaagggaaagtacactgtttggaggtgacactgatgttacagaaaaacctgtggaaccagtaaaagttcattctgagaaagaattacttcgggagtttgagaagatcgcggctacccttgttccagaaaaggattggtctttacgtattgctgccatgcaaaggattgaagccctggtttatggaggtgcgatcgattatccatcattccttatgctcttgaagcaactggttcctccattgtctactcagctgtctgatcgacgttctagtattgtcaaacaggcatgccacctacttaatatactatccaaagaactcctcggcgattttgagccatgtgctgaacaattcatcccgatgctttttaagcttgttgtcataacagtgcttgttatcgctgaatctgcagatacatgcataaaaactatcctgcggaattgcaaggttgctaggattcttcctcgcatagttgacacagcaaagaatgaccgaagtgcaatcctccgtgcaaggtgctgtgagtatgcacttctggtactggagtattgggctgatgccccagaaatacaacgttcagctgatttatatgaggatatgataaaatgctgtgtagcagatgcgatgagcgaggttcgtgcaactgcaagaacttgctatagaatgtttgcaaagacatggcccgagcgctcacgccgtctttttatgtcatttgatcctgcgatacagaggataataaatgatgaagatggtggtgtgcacaaaaggtatgcttctccctcattgcgtgatagggttgtgcagccttcacgtgcttcctctcattcaagtagtacacatgtacctggatatggcacttcggctatcgttgcaatggacaagagtgcagctatttcttcagattcatcttttccatcaaacaatcttcggttatcacagtcaaagacgattggcagaagttctgagagaagcctggagagtgtgcttagctccagcaaagaaaaagtttctgccattgaaagtttgctgaaaggtgtcagcatgtcagggcaaaatttcactgcagcgcgctcaacaagcttagatcttggagttgatcctccatcatctcgtgatcctcctgtgccgcttgcagcaccagcatcaaatgttctgtcattgcagaactcagcactgttggactcatcccttcctaccatcccacctagttcacgaaatggtggttcccgcttattggatacgatgacaacacacttgcctaccaaagaacggtcaaggtcaccgtatttgagtaatatgtcatctgagtccatgtctggcttatcattgccttactcaagaagatcttcggagaggcttcaagaaggaggccgcatggatgagagctatgatatccgttcagctaggcgaatccctcaaatgcattttgagagaaactatgctgatatgtcttatagggattccagccacagagattcacataacaaccatgtcccaaatttccagagacctcttctaaggaagcaagtaatgtcaagggcttctgcaagtggcagacacagctttgatgatagccatgtaccatcaggtgatgtgtctggctatacagattctctggcttctctaaatgatgcactttctgagggtctcagccctagttctgactgggtagcaagagtttcagcttttgagtttattcggaatttattgaaacaaggccagaaaggcattcaagaaattactcaaaattttgagaaggttatgaagctgtttttccgtcatttggatgatcctcaccataaggttgcacaggcagccttctctgcacttgcagagattatcccagcctgcaagaagccatttgaaagttatgtcgagcgaattctaccatatgtattttcgcggcttattgatccaaaagagttggtgaaaaaaccatgctctgtaacattggagattgttggtcgaacatatgctattgatatgttgctacctgcgctagtacgatcattagatgaacagaggtccccaaaggcaaaattggctgttcttgagtttgcaaataaatctttcagcaagtacactgttgactctgatggttatagtaacagtggcttccttaaactatggctttcaaaattggcacctttggtaaatgaaaagaatgcaaaattgaaggaggcatctatttctggtatcatatctgtttattctcactttgattcaacagcagtgctaaattttattctcagtttgtcagttgaagatcaaaacctcttgaggagagccctgaagatcaaaacccctcgtattgaggttgatctggtgaactacttgcagagcaagaaagaacgttcacgccccaaatcttatgaccaggcggattttggaacttcttcggaggatggctatgcactgacatccaagaacagctatccatttgggcggttttcttctagttcccttgatgctgaagggggaaagaagatcaattcaatgcaagaaccagtgctgcataatgtctctataggtcgaacagcttctgatatgagcatggatcatgctattcaaagtttagagtcatctacaggagctgaagttcatttaactaggagtagagaaccaaagactaacagtaactcagttgtggaagctgctcgctcttggacaaactaccctgaaaaaactgatgcctccttagatggtgaaactgctaccggtactcctcggttagatttcagccggtttcttacttctgatgggcataatactgttggttcaacccccgaagaaagtgttcaagagggtgatatgattgtgaatcttagttctataaagaccagccttcaaacagataacggtctgagcataccacaacttctccatcagataagcaatgacactgaagtttcaagctcggaaaagcgggaagcattgcaacagttggttgatgcttcccttgataataacagctccatctgggcaaagtacttcaatcaaatcttaacggctgtgctcgaggtattagatgactctgattcatccacgagggagcttgctttatctttgattgctgagatgctcaacaaccagaaagattcaattgaagactctatggagattgttcttgaaaaactcctgcatgtaaccaaagatgcagtggccaagatttcaaatgaggcaaaccaatgcttaaatgttctattggcaaaatatgatcctttcagatgtcttgctattattgtacctttattggtcagtgatgatgagaagatacttgtcgtgtgtatcaactgtttgacaaagcttgttgggcgcctttctcaagaggaattgattgatcagttgcctacatttctgccagcattatttgatgcttttaacaaccaaagtccagatgtccgaaagactgttgtgttctgcctggtggatatctacatcatgcttgggaaagcattcgctccatacttggaagggcttagcagcacgcagctccgcctagtaaccatctacgctaaccggatttcgcaggcgaggtccggcaagccaatcgattctaaccaatga

SEQ ID NO: 6192 - protein, 1442 aa, Sorghum bicolor
  misc_feature: Ceres ANNOT ID no. 6064645
  misc_feature (155)..(191): Pfam Id: HEAT Pfam Desc: HEAT repeat
  misc_feature (1368)..(1403): Pfam Id: HEAT Pfam Desc: HEAT repeat
  misc_feature (1)..(1442): NCBI GI: 38346560 NCBI Desc: osjnba0043l24.9 [oryza sativa (japonica cultivar-group)]
  misc_feature (1)..(1442): NCBI GI: 116310322 NCBI Desc: osigba0157a06.7 [oryza sativa (indica cultivar-group)]
  misc_feature (547)..(1433): NCBI GI: 38567848 NCBI Desc: osjnbb0002j11.18 [oryza sativa (japonica cultivar-group)]
  misc_feature (1)..(745): NCBI GI: 47847664 NCBI Desc: clip-associating protein 1-like [oryza sativa (japonica cultivar-group)]
  misc_feature (209)..(569): NCBI GI: 47848182 NCBI Desc: clip-associating protein-like [oryza sativa (japonica cultivar-group)]
MESALEAARAKDTKERLAGVERLHEALDATARRGLAAAEVTALVDTCMDLTRDANFRIAQGGLQALSAAAVVAGDHFKIHLNALVPAAVERLGDGKQPVRDAARQLLITLMEVSSPTIIVERAGSYAWTHRSWRVREEFVRTVATAVGLFASTEISLQRVLLSPVLQLMNDSNQSVRDAAISCIEEMYKHMGSQFHEELQRHNLPSYMLKEINSRLDKIEPKVRSSDTAMQYKAVESRSVSANPKRGSPRTKSIPRESTLFGGDTDVTEKPVEPVKVHSEKELLREFEKIAATLVPEKDWSLRIAAMQRIEALVYGGAIDYPSFLMLLKQLVPPLSTQLSDRRSSIVKQACHLLNILSKELLGDFEPCAEQFIPMLFKLVVITVLVIAESADTCIKTILRNCKVARILPRIVDTAKNDRSAILRARCCEYALLVLEYWADAPEIQRSADLYEDMIKCCVADAMSEVRATARTCYRMFAKTWPERSRRLFMSFDPAIQRIINDEDGGVHKRYASPSLRDRVVQPSRASSHSSSTHVPGYGTSAIVAMDKSAAISSDSSFPSNNLRLSQSKTIGRSSERSLESVLSSSKEKVSAIESLLKGVSMSGQNFTAARSTSLDLGVDPPSSRDPPVPLAAPASNVLSLQNSALLDSSLPTIPPSSRNGGSRLLDTMTTHLPTKERSRSPYLSNMSSESMSGLSLPYSRRSSERLQEGGRMDESYDIRSARRIPQMHFERNYADMSYRDSSHRDSHNNHVPNFQRPLLRKQVMSRASASGRHSFDDSHVPSGDVSGYTDSLASLNDALSEGLSPSSDWVARVSAFEFIRNLLKQGQKGIQEITQNFEKVMKLFFRHLDDPHHKVAQAAFSALAEIIPACKKPFESYVERILPYVFSRLIDPKELVKKPCSVTLEIVGRTYAIDMLLPALVRSLDEQRSPKAKLAVLEFANKSFSKYTVDSDGYSNSGFLKLWLSKLAPLVNEKNAKLKEASISGIISVYSHFDSTAVLNFILSLSVEDQNLLRRALKIKTPRIEVDLVNYLQSKKERSRPKSYDQADFGTSSEDGYALTSKNSYPFGRFSSSSLDAEGGKKINSMQEPVLHNVSIGRTASDMSMDHAIQSLESSTGAEVHLTRSREPKTNSNSVVEAARSWTNYPEKTDASLDGETATGTPRLDFSRFLTSDGHNTVGSTPEESVQEGDMIVNLSSIKTSLQTDNGLSIPQLLHQISNDTEVSSSEKREALQQLVDASLDNNSSIWAKYFNQILTAVLEVLDDSDSSTRELALSLIAEMLNNQKDSIEDSMEIVLEKLLHVTKDAVAKISNEANQCLNVLLAKYDPFRCLAIIVPLLVSDDEKILVVCINCLTKLVGRLSQEELIDQLPTFLPALFDAFNNQSPDVRKTVVFCLVDIYIMLGKAFAPYLEGLSSTQLRLVTIYANRISQARSGKPIDSNQ

SEQ ID NO: 6193 - DNA, 3396 bp, Sorghum bicolor
  misc_feature: Ceres ANNOT ID no. 6064648
  misc_feature: Encodes the peptide sequence at SEQ ID NO 6194
atgcaccgggtgctcgtgagctcgctcgtggccgccacgccgcggtggctccccctcgccgactccatcctccggcgccgccgcccgcgctgctctcctcttcccatgctgctattcgaccggagggcttggtccaagccaaggaaggtctcacgaggcatctcagtggcgtctaggaaagctaacaaacagggagaatattgtgatgaaagcatgctatcgcatatcatgtggtggaaagagaaaatggagaagtgcagaaaaccatcatccgtacaattgactcagaggcttgtgtattcaaatatattagggttggatccaaatctaagaaatggaagcttgaaagatggaaccctgaacatggagattttgctatttaaatcaaaatttcctcgtgaggttctactttgcagagtaggagacttctatgaagctattggttttgatgcctgtattctcgtagagcatgcaggcttaaatccttttggaggtttgcgttctgacagtatccctaaagctgggtgtccagtcgtgaatttacggcagacattggatgatttgactcgatgtggttattctgtgtgcatagttgaggaaattcaaggcccaacacaagcccgttcccggaaaagtcgatttatttctgggcatgcccatcctggtagtccttatgtatttggtcttgctgaagtagaccatgatgtagagttccctgatccgatgcctgttgttgggatttcacattctgcaaaaggttattgcttgatatctgtgctagagacaatgaaaacttattcagctgaggagggcttaacagaagaggctattgttactaagctccgcatatgtcgttatcatcatctataccttcacaattctttgaagaataattcttcagggacatcacgctggggtgaattcggtgaaggagggctcttgtggggagagtgcagtgggaagtcctttgagtggtttgatggtttacctattgaagaacttttatgcaaggtacgggaaatatatggccttgatgagaaaactgtttttcgcaatgtcaccgtctcattggaaggcaggccccaacctctttatcttggaactgctactcaaattggagtcataccaactgagggaataccgagtttgctaaaaatggcactcccttcaagttgtggcgggcttccatcaatgtatattagagatcttcttcttaatcctccatcatttgatgttgcggcagcggtccaagaggcttgcaggcttatggggagcataacttgttctgttcctgaatttacttgcatatcagcagcaaagcttgtgaagctacttgagtctaaagaggtcaatcacattgaattttgtagaataaaaaatgtccttgatgagattatgctcatgaacaggaatgctgagctttctgcaatcctgaacaaattgctggtacctggttctgtggctactggtttgaaagttgaagctgatatgctaatgaacgaatgtagcattatttcacaacgaataggtgaagtgatttctttaggggttgaaagtgatcaggccataacctcattggaatatattccaaaggagttcttcaatgatatggagtcatcttggaaggggcgtgtgaaaagaatccatgctgaagaagagtttgcaaatgttgatagagctgctgaggcattatcaattgcggtcattgaagattttatgccaattatttcaagggtgaaatctgtagtgtcctcaaatggaggttcgaaaggagaaatctgttatgcaaaagaacatgaagctgtttggtttaaaggaaagcgattcacaccaactgtatgggctaacacacctggtgagcagcaaataaaacaactgaagcctgcaattgattcgaaaggcagaaaggttggggaggaatggtttacaacaagcaaagttgagaatgctttagccaggtaccatgaagcttgtgataatgcaagaaataaagttgttgagctgttgagagggctttcaagtgaattgcaggacaaaattaacatacttgtcttttgctcaacactgctcatcattgcaaaagcactttttggtcatgttagtgaggctcggagaagaggctggatgcttcctactatatttcccttgtcaaaggactgtgttgcagaggaaagttcaaatgcaatggatttagtaggactctttccttactggcttgatgttaatcaaggaaatgcaatattgaatgatgtccacatgcactctttatttgttcttactggtccaaatggtggtggtaaatctagtatgttgcgatcagtctgtgcagctgcgctgcttggaatatgtggcctgatggtaccttcaacttcagctgtaatcccgcattttgattccattatgctgcatatgaaagcctacgatagcccagccgatgggaaaagttcatttcagattgaaatgtcggagatacgtgctttagtcagccgagctactgctaggagtcttgtcctgattgatgaaatatgtaggggcacagaaactgcaaaaggaacctgtattgctggtagcatcatcgaaaggctggataatgttggctgcctaggcatcatatcaactcacctgcatgggatttttgacttgcctctctcactcagcactactgatttcaaagctatgggaactgaagtggtcgacgggtgcattcatccaacatggaaactgatggatggcatctgtagagaaagccttgcttttcaaacagccaggagggaaggcatgcctgagttcataatcagaagggctgaggagctatatttgactatgagtacaaataacaagcagaccgcatcaatggtccacaatgagcctcgtaatgacagccccagtgtaaatggcttggttgagaagcctgaatatctgaaatacagactagaaattctgcctggtacctttgagccgttgcggagggaagttgagagtgctgttactatgatatgcaagaaaaaactgttggatctttacaataaaagtagcatcccagaactggttgaggtggtctgtgttgctgtaggtgctagagagcaaccaccaccttccactgttggcaggtctagcatctatgtgattatcagaagcgacaacaagctttatgttggacagacggatgatcttctggggcgccttcacgcccacagatcgaaggaaggcatgcaggatgctacgatattatacatcttggttcctggcaagagcgttgcctgccagctggaaacccttctcataaatcagcttccttcgaggggcttcaagctcatcaacaaggcagacggaaagcataggaacttcggtatatctcgaatctctggagaggcaatcgccacccagctaaactaa

SEQ ID NO: 6194 - protein, 1131 aa, Sorghum bicolor
  misc_feature: Ceres ANNOT ID no. 6064648
  misc_feature (708)..(945): Pfam Id: MutS_V Pfam Desc: MutS domain V
  misc_feature (1037)..(1110): Pfam Id: GIY-YIG Pfam Desc: GIY-YIG catalytic domain
  misc_feature (125)..(228): Pfam Id: MutS_I Pfam Desc: MutS domain I
  misc_feature (1)..(1131): NCBI GI: 61696671 NCBI Desc: dna mismatch repair protein [zea mays]
  misc_feature (1)..(1127): NCBI GI: 115459322 NCBI Desc: os04g0507000 [oryza sativa (japonica cultivar-group)]
  misc_feature (1)..(1127): NCBI GI: 116310318 NCBI Desc: osigba0157a06.3 [oryza sativa (indica cultivar-group)]
  misc_feature (92)..(1127): NCBI GI: 32489513 NCBI Desc: osjnba0043l24.4 [oryza sativa (japonica cultivar-group)]
  misc_feature (1)..(1117): NCBI GI: 61696673 NCBI Desc: dna mismatch repair protein [lycopersicon esculentum]
MHRVLVSSLVAATPRWLPLADSILRRRRPRCSPLPMLLFDRRAWSKPRKVSRGISVASRKANKQGEYCDESMLSHIMWWKEKMEKCRKPSSVQLTQRLVYSNILGLDPNLRNGSLKDGTLNMEILLFKSKFPREVLLCRVGDFYEAIGFDACILVEHAGLNPFGGLRSDSIPKAGCPVVNLRQTLDDLTRCGYSVCIVEEIQGPTQARSRKSRFISGHAHPGSPYVFGLAEVDHDVEFPDPMPVVGISHSAKGYCLISVLETMKTYSAEEGLTEEAIVTKLRICRYHHLYLHNSLKNNSSGTSRWGEFGEGGLLWGECSGKSFEWFDGLPIEELLCKVREIYGLDEKTVFRNVTVSLEGRPQPLYLGTATQIGVIPTEGIPSLLKMALPSSCGGLPSMYIRDLLLNPPSFDVAAAVQEACRLMGSITCSVPEFTCISAAKLVKLLESKEVNHIEFCRIKNVLDEIMLMNRNAELSAILNKLLVPGSVATGLKVEADMLMNECSIISQRIGEVISLGVESDQAITSLEYIPKEFFNDMESSWKGRVKRIHAEEEFANVDRAAEALSIAVIEDFMPIISRVKSVVSSNGGSKGEICYAKEHEAVWFKGKRFTPTVWANTPGEQQIKQLKPAIDSKGRKVGEEWFTTSKVENALARYHEACDNARNKVVELLRGLSSELQDKINILVFCSTLLIIAKALFGHVSEARRRGWMLPTIFPLSKDCVAEESSNAMDLVGLFPYWLDVNQGNAILNDVHMHSLFVLTGPNGGGKSSMLRSVCAAALLGICGLMVPSTSAVIPHFDSIMLHMKAYDSPADGKSSFQIEMSEIRALVSRATARSLVLIDEICRGTETAKGTCIAGSIIERLDNVGCLGIISTHLHGIFDLPLSLSTTDFKAMGTEVVDGCIHPTWKLMDGICRESLAFQTARREGMPEFIIRRAEELYLTMSTNNKQTASMVHNEPRNDSPSVNGLVEKPEYLKYRLEILPGTFEPLRREVESAVTMICKKKLLDLYNKSSIPELVEVVCVAVGAREQPPPSTVGRSSIYVIIRSDNKLYVGQTDDLLGRLHAHRSKEGMQDATILYILVPGKSVACQLETLLINQLPSRGFKLINKADGKHRNFGISRISGEAIATQLN

SEQ ID NO: 6195 - DNA, 1227 bp, Sorghum bicolor
  misc_feature: Ceres ANNOT ID no. 6064654
  misc_feature: Encodes the peptide sequence at SEQ ID NO 6196
atgactgtgatcaaggcaggtggagcggcggagccgcgcggaggcggcggcgcgtacgacgcgaggcggcggcagtcgctgcgggcgcggtacgcgtacgggttcgtcttcttcgccaccaacctgctggcctggttcgtcagggactacggggccagggcgctccgcggcctgcatcatgtgccggtctgcggagcaggggactccaagtgcttccagtccggaggagtgcttcgggtcagcttgggctgcttcatatttttctgggtgatgtttgcaacaacatttggaactcgcaagctccatgaagctcgtaattcgtggcattctggatgctggattctgaagtctcttgtgtatgccatgtcgatcggcatcccatttatcatccctaacatcttcatccaactttatggtgaaatcgctcgactgggtgccgggatatttctcctcctccagctcataagcatgctccacttcatatcatggtgcaataaacggtggatgccagatcctggatcaaatcaatgtgggttgtttgggttattcttgtcaaccatctcctacattgcttcctttgctggaattggcgtgctgtatgttctgtatgtccccaactcctcttgtgcattcaacatcttcactattacatggacagcaatcttggtgactgtaatgatgacagtatcactgcactccaagttcactttgtttgctgagaaggttaacgagggtcttctctcttctgggatcatgagttcctatattgtcttcctttgttggtctgcactccacagtgagccacaaaccgggaagtgccactctcatatgaaaatttccagggatggtgattcagctactatcgttagcttcattatcgcaatttgttccattgtaatggccacgttttctactggaatcgacaccaaatccttccaatttcggaatgatgaagtacaattggaagaggacaccccctacagctatgagattttccacattgtgtttgcaatgggagctatgtattttgcaatgctgttcattagctgggagcttaatcatccaacacgaaagtggagcatagatgttgggtgggctagtacatgggtgaagatcatcaacgagtggttcgcggctagcatatacatctggaggttgatctccccagccgtattgaggaaccaacttgtcaatgaagagttcatgccacatagacctacaatatag

SEQ ID NO: 6196 - protein, 408 aa, Sorghum bicolor
  misc_feature: Ceres ANNOT ID no. 6064654
  misc_feature (14)..(395): Pfam Id: Serinc Pfam Desc: Serine incorporator (Serinc)
  misc_feature (17)..(403): NCBI GI: 115459316 NCBI Desc: os04g0506300 [oryza sativa (japonica cultivar-group)]
  misc_feature (17)..(403): NCBI GI: 116310261 NCBI Desc: osigba0145c12.5 [oryza sativa (indica cultivar-group)]
  misc_feature (77)..(277): NCBI GI: 119596321 NCBI Desc: serine incorporator 3, isoform cra_a [homo sapiens]
  misc_feature (77)..(277): NCBI GI: 123993433 NCBI Desc: serine incorporator 3 [synthetic construct]
  misc_feature (59)..(328): NCBI GI: 108878597 NCBI Desc: membrane protein tms1d [aedes aegypti]
MTVIKAGGAAEPRGGGGAYDARRRQSLRARYAYGFVFFATNLLAWFVRDYGARALRGLHHVPVCGAGDSKCFQSGGVLRVSLGCFIFFWVMFATTFGTRKLHEARNSWHSGCWILKSLVYAMSIGIPFIIPNIFIQLYGEIARLGAGIFLLLQLISMLHFISWCNKRWMPDPGSNQCGLFGLFLSTISYIASFAGIGVLYVLYVPNSSCAFNIFTITWTAILVTVMMTVSLHSKFTLFAEKVNEGLLSSGIMSSYIVFLCWSALHSEPQTGKCHSHMKISRDGDSATIVSFIIAICSIVMATFSTGIDTKSFQFRNDEVQLEEDTPYSYEIFHIVFAMGAMYFAMLFISWELNHPTRKWSIDVGWASTWVKIINEWFAASIYIWRLISPAVLRNQLVNEEFMPHRPTI

SEQ ID NO: 6197 - DNA, 1995 bp, Sorghum bicolor
  misc_feature: Ceres ANNOT ID no. 6064670
  misc_feature: Encodes the peptide sequence at SEQ ID NO 6198
atggcggcgcaagtggcggcggcggcggcgtcggtggcggtggcggtgccgaatgggagcccgggcgctgtccccgcggtggtttcaccgggagcggtcggcgtcggcgtcggcgtggcgcagccgctcccgaccacgtcgctctacgtgggcgacctggagggctccgtctcggactcgcagctgtacgagctcttcagccaggccgggcaggtggtgtcggtgcgcgtctgcagggacgtcacctcgcgccgctcgctcggatacgcctacgtcaacttcagcaaccccttggatgctgcaagagcattggaagtgctgaactttgctgttcttaacaacaagcctatcagggtgatgtattcaaaccgtgacccaagcagccgtaggagtggatctgctaacattttcataaagaatcttgacaagacaatagacaataaaacccttcatgagaccttttcttcatttggaaccattctctcatgtaaggtagccatggatgaagcaggccaatccaaaggctttggttttgttcagtatgaaaaagaagaagctgcacagaatgctataaaaagtctaaacgggatgcttataaatgataagcctgtttttgttggaccttttcttcgcaagcaagaaagagatcattcttttgacaagacaaaatttaacaatgtctttgtgaaaaatttgtccgagtctaccacaaaggaagatttactcaaagtatttggtgaatatgggagtattacaagtgctgttgtaatgattggcatggatggtaaatcaaggtgctttggtttcatcaattttgagaatccagatgcagcttcccgtgctgttcaggaacttaatggtaagaagataaatgacaaagagtggtatgttggaagagctcagaagaagtcagaaagagagatggaactaaaaaggagatttgagcaaagcttgaaagatgctgctgacaaatatcaaggactgaacttgtacctcaagaacttggatgatagcattggagatgatcaacttcgtgagttgttctccaactttggcaaaattacttcgtacaaggtgatgcgtgaccaaaatggtctcagcaaaggctctggatttgttgctttctcaactcgtgaggaagcatctcaggctttaactgaaatgaatggcaaaatgatatctggaaaaccattgtatgttgcatttgcacagcgcaaagaagatagaaaagcgatgttgcaggcacagttttctcagatgcgccctgcagtaccaatgacacccactttagccccacggcttccaatgtaccctcctatggctcctcagcaactcttctatggacaagcaccgccagctatgataccccctcagccaggatttggtttccagcaacagcttgttccaggcatgaggcctggtggtccccatatgccaaattatttcgttccggttgtccaacagggccaacagggtccacgcccaggtatgaggcgtggagctggagcccagggccagcaacctgtgccaccatttcagcagcagattgttccgcgcggacggatgtaccgttatccaactggtcgcaacatgcctgaagctccagcgatgccaggggttgctggaggtatgatccaggcatatgatatgggaggcttccctgtgagagatgcagccgtatcaccggccgcccaaattgggactctgacttctgcccttgcaaatgctaatcctgagcagcaaagaacgatacttggtgaaaatctatacccactggttgagcaactggaaccaaaccaagcagcaaaggtcactggaatgcttttggagatggatcagactgaggtcctgcacctgctcgagtcccctgatgctctcaagtccaaggttgctgaggcgatggatgttctacgcaatgtggcccatcagcaaaacccaaacaccccgaccaatcagcttgctgcattatcactgaccgaaggcattatctcctaa

SEQ ID NO: 6198 - protein, 664 aa, Sorghum bicolor
  misc_feature: Ceres ANNOT ID no. 6064670
  misc_feature (48)..(119): Pfam Id: RRM_1 Pfam Desc: RNA recognition motif. (a.k.a. RRM, RBD, or RNP domain)
  misc_feature (136)..(206): Pfam Id: RRM_1 Pfam Desc: RNA recognition motif. (a.k.a. RRM, RBD, or RNP domain)
  misc_feature (227)..(297): Pfam Id: RRM_1 Pfam Desc: RNA recognition motif. (a.k.a. RRM, RBD, or RNP domain)
  misc_feature (330)..(400): Pfam Id: RRM_1 Pfam Desc: RNA recognition motif. (a.k.a. RRM, RBD, or RNP domain)
  misc_feature (566)..(637): Pfam Id: PABP Pfam Desc: Poly-adenylate binding protein, unique domain
  misc_feature (8)..(664): NCBI GI: 32490269 NCBI Desc: osjnbb0116k07.11 [oryza sativa (japonica cultivar-group)]
  misc_feature (8)..(664): NCBI GI: 70663933 NCBI Desc: osjnba0014k14.19 [oryza sativa (japonica cultivar-group)]
  misc_feature (10)..(664): NCBI GI: 92873940 NCBI Desc: rna-binding region rnp-1 (rna recognition motif) [medicago truncatula]
  misc_feature (31)..(664): NCBI GI: 7673355 NCBI Desc: poly(a)-binding protein [nicotiana tabacum]
  misc_feature (25)..(664): NCBI GI: 7528270 NCBI Desc: poly(a)-binding protein [cucumis sativus]
  misc_feature: The sequence is a functional homolog of SEQ ID NO. 339 in the 11/188,298 US application
  misc_feature: The sequence is a functional homolog of SEQ ID NO. 458 in the 11/188,298 US application
MAAQVAAAAASVAVAVPNGSPGAVPAVVSPGAVGVGVGVAQPLPTTSLYVGDLEGSVSDSQLYELFSQAGQVVSVRVCRDVTSRRSLGYAYVNFSNPLDAARALEVLNFAVLNNKPIRVMYSNRDPSSRRSGSANIFIKNLDKTIDNKTLHETFSSFGTILSCKVAMDEAGQSKGFGFVQYEKEEAAQNAIKSLNGMLINDKPVFVGPFLRKQERDHSFDKTKFNNVFVKNLSESTTKEDLLKVFGEYGSITSAVVMIGMDGKSRCFGFINFENPDAASRAVQELNGKKINDKEWYVGRAQKKSEREMELKRRFEQSLKDAADKYQGLNLYLKNLDDSIGDDQLRELFSNFGKITSYKVMRDQNGLSKGSGFVAFSTREEASQALTEMNGKMISGKPLYVAFAQRKEDRKAMLQAQFSQMRPAVPMTPTLAPRLPMYPPMAPQQLFYGQAPPAMIPPQPGFGFQQQLVPGMRPGGPHMPNYFVPVVQQGQQGPRPGMRRGAGAQGQQPVPPFQQQIVPRGRMYRYPTGRNMPEAPAMPGVAGGMIQAYDMGGFPVRDAAVSPAAQIGTLTSALANANPEQQRTILGENLYPLVEQLEPNQAAKVTGMLLEMDQTEVLHLLESPDALKSKVAEAMDVLRNVAHQQNPNTPTNQLAALSLTEGIIS

SEQ ID NO: 6199 - DNA, 636 bp, Sorghum bicolor
  misc_feature: Ceres ANNOT ID no. 6064676
  misc_feature: Encodes the peptide sequence at SEQ ID NO 6200
atgggggagcaggagaacaacaagatcggcggcggcggcggcaaccacgccatggcggtggacgaggcggccgcggcggccaaggggaagagccttggcgccgcggacccgcgcctgcagggcatttccgacgccatccgcgtcgtcccccacttccccaagccagggatcatgttcaacgacatcacggagctgctgctgcggccgggcgtgttcaaggacgccgtggacatgttcgtcgagcgctaccgcggcatgggcatcgccgccgtcgcaggcattgaagctagaggattcatctttggcccagccattgcgctagccataggagcaaagttcataccactacgcaaacctaagaagcttccaggtgaggtattttctgaaagttatgtacttgagtatggaatggattgtttggagatgcatgttggagctattgaacccggggagcgtgtagtggttgttgatgatttggttgcaactggaggaactctttctgctgcaataagacttcttgagcgcgcaggagctaacgtggttgagtgtgcatgcctcattgggcttcccaagtttaaggatttctacaagctcaacgggaaaccagtttacatcctggtggagtcccgcaaatag

SEQ ID NO: 6200 - protein, 211 aa, Sorghum bicolor
  misc_feature: Ceres ANNOT ID no. 6064676
  misc_feature (61)..(195): Pfam Id: Pribosyltran Pfam Desc: Phosphoribosyl transferase domain
  misc_feature (1)..(211): NCBI GI: 40019121 NCBI Desc: adenine phosphoribosyltransferase [zea mays]
  misc_feature (1)..(211): NCBI GI: 32490261 NCBI Desc: osjnbb0116k07.3 [oryza sativa (japonica cultivar-group)]
  misc_feature (1)..(211): NCBI GI: 32693279 NCBI Desc: adenine phosphoribosyltransferase [triticum aestivum]
  misc_feature (1)..(211): NCBI GI: 29826070 NCBI Desc: adenine phosphoribosyltransferase form 2 [oryza sativa (indica cultivar-group)]
  misc_feature (1)..(193): NCBI GI: 70663925 NCBI Desc: osjnba0014k14.11 [oryza sativa (japonica cultivar-group)]
  misc_feature (36)..(208): SWISSPROT Homolog: EC 2.4.2.7 Adenine phosphoribosyltransferase 2
  misc_feature: The sequence is a functional homolog of SEQ ID NO. 524 in the 11/188,298 US application
MGEQENNKIGGGGGNHAMAVDEAAAAAKGKSLGAADPRLQGISDAIRVVPHFPKPGIMFNDITELLLRPGVFKDAVDMFVERYRGMGIAAVAGIEARGFIFGPAIALAIGAKFIPLRKPKKLPGEVFSESYVLEYGMDCLEMHVGAIEPGERVVVVDDLVATGGTLSAAIRLLERAGANVVECACLIGLPKFKDFYKLNGKPVYILVESRK

SEQ ID NO: 6201 - DNA, 1518 bp, Sorghum bicolor
  misc_feature: Ceres ANNOT ID no. 6064677
  misc_feature: Encodes the peptide sequence at SEQ ID NO 6202
atgggaaggctggtcgtcgcggcggcggtggccgcgtgggcgttcccggttgcggctttggtgaactccgtagtgccagagccctacatggatgagatcttccatgttccacaggcacagcagtattgccgtggggatttctggaaatgggatcccatgatcaccacccctcctggactgtattatgtttcactagcatatattgcttctttctttcctgttgcctggatgtttcgggtagcaaaaacatttgatgttctttgctccacagcagctttcagatcaactaatgttatcttggcaatggtctgcactgttctttttcatgacctgcttttgtgcatccggccgggaattggggaaaggaaggcagctacgtacgctatacttgtagcattgtatcctgttcactggttcttcacttttctttattacactgatgttgcatcattagctgcagttcttgcaatgtacctattctgcttgaagaaacggttctggatcagcgcaacatttggtgttttttcaatcctttttcgtcagacaaatgtaatatgggttatattttttgctgccaatggtgctatcacatacgtaaaagacttgtattccaaggacaatgtttctcatgagaacagtgaaccaacacatcagtcaaaaaaaacttctgtcatggataacaacattagtgctcaaggtttgagaagacggcgaatcgatagtcccataagtaagaaggtcactgtttctgaatctgctaacccttacaacagtcttacagaggaagtgtgggacatcagcttgaagttatggaaatcgaagtgtgaaattgtgattgcctttgcaccatttgtagttgtcatggtggcatttgtagcattcataatctggaatggtggtatagtactaggtgctaaggaagctcatgttgtttcgccacactttgcacagtttctgtactttggtcttgtgtcagctgctgccctcctaccatggcatttcactcccaaccgagtattggacctattccacttgtctggaaagaataaaacctgtagttctctggcagtattgatgggtcttggtttaagcttcgtcgctgtacattttttcagcattgctcatccgtatcttcttgctgacaatagacactataccttctatatttggaggaaggttatccaagtaaactggatgatgaaatacatgttgattccactttatgtgtactcatggctctcaatcatcaacatcttagggaaatcacagacaaggatttgggtgttatcatttgtgctgtcagttgcactggtccttgtacctgcgccactggttgaattcagatactacacaattccatttgtgatactggttcttcactctccagcaattggcaacggcaaattgcttgctatggggtcactttatgcagctgttgacttgtctactctggtgatgtttctgttccgaccattccattgggaacatgagtctggaacacaaaggtttatgtggtag

SEQ ID NO: 6202 - protein, 505 aa, Sorghum bicolor
  misc_feature: Ceres ANNOT ID no. 6064677
  misc_feature (22)..(459): Pfam Id: DIE2_ALG10 Pfam Desc: DIE2/ALG10 family
  misc_feature (1)..(505): NCBI GI: 38347574 NCBI Desc: osjnbb0116k07.1 [oryza sativa (japonica cultivar-group)]
  misc_feature (44)..(505): NCBI GI: 115459284 NCBI Desc: os04g0503700 [oryza sativa (japonica cultivar-group)]
  misc_feature (283)..(505): NCBI GI: 47682311 NCBI Desc: mgc84574 protein [xenopus laevis]
  misc_feature (271)..(505): NCBI GI: 119608914 NCBI Desc: asparagine-linked glycosylation 10 homolog (yeast, alpha-1,2-glucosyltransferase) [homo sapiens]
  misc_feature (271)..(505): NCBI GI: 123982482 NCBI Desc: asparagine-linked glycosylation 10 homolog (yeast, alpha-1,2-glucosyltransferase) [synthetic construct]
MGRLVVAAAVAAWAFPVAALVNSVVPEPYMDEIFHVPQAQQYCRGDFWKWDPMITTPPGLYYVSLAYIASFFPVAWMFRVAKTFDVLCSTAAFRSTNVILAMVCTVLFHDLLLCIRPGIGERKAATYAILVALYPVHWFFTFLYYTDVASLAAVLAMYLFCLKKRFWISATFGVFSILFRQTNVIWVIFFAANGAITYVKDLYSKDNVSHENSEPTHQSKKTSVMDNNISAQGLRRRRIDSPISKKVTVSESANPYNSLTEEVWDISLKLWKSKCEIVIAFAPFVVVMVAFVAFIIWNGGIVLGAKEAHVVSPHFAQFLYFGLVSAAALLPWHFTPNRVLDLFHLSGKNKTCSSLAVLMGLGLSFVAVHFFSIAHPYLLADNRHYTFYIWRKVIQVNWMMKYMLIPLYVYSWLSIINILGKSQTRIWVLSFVLSVALVLVPAPLVEFRYYTIPFVILVLHSPAIGNGKLLAMGSLYAAVDLSTLVMFLFRPFHWEHESGTQRFMW

SEQ ID NO: 6203 - DNA, 1404 bp, Sorghum bicolor
  misc_feature: Ceres ANNOT ID no. 6064684
  misc_feature: Encodes the peptide sequence at SEQ ID NO 6204
atggctcctctgcccagcgcggctcgcctccttcgatcgaccctcgggcggctgagatcgccaccgccggcccgggccttctccagcgccgcggcgaccgagacgggggcggggaacggacgcgaggccgcgatcgccgccgccgccgtggcggtggccgtgtccgggctcgggctgtggctgaaaccgccgtcgcttgccgactctggcgaggtgcccggcggtcagatctcggtcgccggcgctggcgccggcgccacggaggcgcgggaggaggagaaggggtggttcctgtttgcagactcattccggagaagggtgttctttaactatgagaagaggatacggcttctcagtcctcctgagaagatttttgagtacttcgcatctgtgaggaacccagaaggggaagtttacatgttgcctgatgacttgatgagagcagtagtccctgtttttcctccatcagagtccaccatagttcgtgaaggaagattaaggggggagcggagccctggagagttgcattgtgctccatcggagttctttatgctgttcgacacaaatagtgatggtctcatctcctttgctgagtacatcttttttgtgacattgctcagcattcctgagtcgaatttcactgtggccttcaaaatgttcgacgttgaccacagcggggtgatagacagagaagagtttaagaaagtaatggcactgatgcggtcctttaacagacaagggtccactcataaggatggtttacgtattggacttaaagttggccagcctgtggaaaatggtggggtggttgagtacttctttgggagtgatgggaatgaacctctacactgtgacaagttttcaaaatttttgaaggaattgcatgatgagattattcgactggagttcagtcattatgatgtcaagtcgtctaaaacaataccagcaaaggattttgcattgtccatggttgcttctgctgacatgaaccatatcaacaagctgctcgatagagttgatagtttggtcaaggagccagatctcaaggacatacgcatcacctttgaggagtttaaggcatttgctgacttgcgacgaagattggagccactgtcgatggctatcttcgcttacgggaaagtgaatgggttattgacaaaggaggatctaaaacgtgcggcgcaacacgtttgtggggtccgcttaactgatagagtggtagacattattttccatgtgttcgacacaaatcaggatgggaacctgagctcggaagagttcttaagagcattacaaagaagagaaaatgatattcgtcaaccaacaataccaggtccattggggttcttgtcttgctggttcagcggtaggaagtgttcttcacttcaacaggtggttctctga

SEQ ID NO: 6204 - protein, 467 aa, Sorghum bicolor
  misc_feature: Ceres ANNOT ID no. 6064684
  misc_feature (212)..(240): Pfam Id: efhand Pfam Desc: EF hand
  misc_feature (406)..(434): Pfam Id: efhand Pfam Desc: EF hand
  misc_feature (1)..(467): NCBI GI: 116310795 NCBI Desc: osigba0112m24.3 [oryza sativa (indica cultivar-group)]
  misc_feature (1)..(467): NCBI GI: 115459274 NCBI Desc: os04g0502900 [oryza sativa (japonica cultivar-group)]
  misc_feature (1)..(449): NCBI GI: 70663918 NCBI Desc: osjnba0014k14.4 [oryza sativa (japonica cultivar-group)]
  misc_feature (63)..(467): NCBI GI: 115447275 NCBI Desc: os02g0613000 [oryza sativa (japonica cultivar-group)]
  misc_feature (28)..(455): NCBI GI: 92896653 NCBI Desc: calcium-binding ef-hand [medicago truncatula]
MAPLPSAARLLRSTLGRLRSPPPARAFSSAAATETGAGNGREAAIAAAAVAVAVSGLGLWLKPPSLADSGEVPGGQISVAGAGAGATEAREEEKGWFLFADSFRRRVFFNYEKRIRLLSPPEKIFEYFASVRNPEGEVYMLPDDLMRAVVPVFPPSESTIVREGRLRGERSPGELHCAPSEFFMLFDTNSDGLISFAEYIFFVTLLSIPESNFTVAFKMFDVDHSGVIDREEFKKVMALMRSFNRQGSTHKDGLRIGLKVGQPVENGGVVEYFFGSDGNEPLHCDKFSKFLKELHDEIIRLEFSHYDVKSSKTIPAKDFALSMVASADMNHINKLLDRVDSLVKEPDLKDIRITFEEFKAFADLRRRLEPLSMAIFAYGKVNGLLTKEDLKRAAQHVCGVRLTDRVVDIIFHVFDTNQDGNLSSEEFLRALQRRENDIRQPTIPGPLGFLSCWFSGRKCSSLQQVVL

SEQ ID NO: 6205 - DNA, 3492 bp, Sorghum bicolor
  misc_feature: Ceres ANNOT ID no. 6064687
  misc_feature: Encodes the peptide sequence at SEQ ID NO 6206
atggagcccgggctgagcatcgagtccggttccgccatccgcgtcgcggtgctccccgtgggcggcccgatcccgccgccgcgcctgcgcgagtacgcggcgctggtggcgcgccacgcgcgcgtcgacctcgcctcgctccgcacctactacgcggagcaccagaagagccccttccaacaccagccctgggagaccgggtgcctccgcctcaagttcgtgctcggcggctgcgtgccttcgccctgggaggacttccagtcctcgcgcaaggtgctcgccgtgatcggcatctgccacctaccgtcctcgcccgacctcgaccgcgtcgcggcggacttcatagactctgcgcggtcgtacccgtcagcgctcgccaaccggtgcttcgccttctgccccacggatgcacagttgtcggggaagaagagggacgatattattatgctccctccttctgatcagcaatcactggaacttcatatgcttacaatgatccaagatcttgctgcttctttgttgatggagtttgagaagtgggtcttgcgtgcagaatccacaggaactattttgaagaccccattggattcacaatccagtcttggctcagaggaggtaattaaggctaaaaaaagaagactcggccgtgcgcaaaagataataggagattattgcctcttggctggatcgcctgtggacgctaatgcacattacaccaccgctatagagcttgcaagactgactggtgatgttttctggcatgctggagcccttgagggtagtgtctgtgcattagtggtagataggatgggccaaagtgatcctgttttggaggatgaagtcaaatatcgctattacaccattatccagctatacagaagagccactttacaagataatgctcaaagagtttcacctgtgagctttgagcttgaagctgccttgaagttggcaagatacttgtgcaggcaagaacttgccaaggaggtctcagatttgttaatgggagccgcagatggtgccaaggctctgattgatgccagtgaccggctcatcctatatattgaaatcgcaagactttttggtacacttggttataagcgcaaggcggcctttttttcaagacaagttgcacagttgtaccttcagcaagacaatgcatatgctgctatgagtgctatgcaggttctaactatgactacaaatgcataccatgtccaaagccgaaagactatgaaaatgaatcatgatttgtccaagtctatagtctcattgtttgagtcacaatggagtacccttcaaatggtggttctaagagaaatattgatgtcatcaatccgggccgctgatccactctcatcatggagcgctgcagctcgtcttcttcgatccttttacccactcatcacaccagctggtcagagtggcctagcaagctcacttgcaaactctgctgacaagcttccaacaggcacacggtgtgccgatccatgtcttccttttatcaggttgcattctttcccacttcacccttctcaaagggatatagtaaagcggaatccgcataaaaaggagtggtggaccggtgcaggtccttcaggacctttcatttatactcctttcagcaaagcaggagcttctgggacttccaagcaagaggttagttggattgtgggggagccggttcaagtcatggttgagttagcaaacccttgcagcttcgacctagttgtggagagcatctatctctctgtccattctgggaattttgatgcctttccagttagcgttagtcttccacctaacacttcaaaattagttttattatctggtattccaacaaaagtcggacaaatatcaattcctgggtgcattgttcattgctttggtgttattacagaacacctattcaaagaggttgattgtttgctccttggagctgcacaagggcttgtcctttctgatcctttcagatgctgtggctctagcaagtttaagagtgtcaactttcctagcatttctgttgttcctcctctgccattgttagttgccaatgttgtgggtggagatggttctattcttctttatgaaggagaaattcgtgatgttctgataacactgacaaatgccggaaccgtacctgctgaagaagcaaatgttgccttgtcagggaagaatcaggattctgttatttcgattgcccatagcacatggaaatctgcgctacctattaaaccaggtggagaagtgacatttgcagtaactctaagagcctggcatctcagctcagcagatttggaaacagatggcagtagatctcctgcaaattcaaggagaatagcaagagaaggaatcaatccattcttggatattcactatgctggtcctgctgcgaatcttgaaaacggagacgtttcacttccacctggaagacgcctggttgttcccttgaatatctgtgttgtgcagggcatgcgtcttgtaagagcacgcctgttgtccatggaaatacctgctcgatttactgaaacacacttaaaacctgtcagtggcgaagacattaacttattgaagattgatccctataaaggaagctgggggctccgccttctggaacttgagctttttaatcctactgatgtcgtttttgatgttgatgttgctgtacatttggatgacgcggatgtggatcaagaagtaatttcagagggcgatgctgcttgtcataaaactagaattgatcgcgactactctgccagagttctcatacctcttgagaacttcaaattgcctgttcttgatgcttccttctttgtaaaggaaagtagtagtgatgaacctcttggatccagggctgccgccatagcagaaaggaatgccaaggcagagctaaatgcgtctatcaacaacttgatttcaaaaataaaagtgaaatggcactctggaagaaatagctcaggtgagctgaatattaaagatgctatccaggcggcattacaagcatctataatggacatactgttgccagatccccttacgtttagctttaagcttgctaagaatggaactgtgatcaatgatgattcttcaaaggattttggcagtgttctgaggtgcaaagatcctatatctgctcatgaaatgacccatatggaagttcaaattcgcaacaacacaaaggaaattattcagatgaaccttagcatttcatgcaaagatgttgcaggagagaattgcttcgatgaaaatagtgcaactgtcctctgggctggtgttcttagcgatatacacctggaagttccaccgttgcaagaggtgatacatcctttttccatgtacttcctcgtaccaggtgactactcgctccaagctgcttctgttataatcgacgccacagatgttctccgtgctcgcgcaaaggcagagtcaccagatgaacctatactgtgtcgcggatccccgttccatatccgggtagtcggtacagcatag

SEQ ID NO: 6206 - protein, 1163 aa, Sorghum bicolor
  misc_feature: Ceres ANNOT ID no. 6064687
  misc_feature (1)..(194): Pfam Id: Trs120 Pfam Desc: Transport protein Trs120
  misc_feature (1)..(1034): NCBI GI: 115459268 NCBI Desc: os04g0502200 [oryza sativa (japonica cultivar-group)]
  misc_feature (1)..(1034): NCBI GI: 116310763 NCBI Desc: h0311c03.11 [oryza sativa (indica cultivar-group)]
  misc_feature (477)..(1034): NCBI GI: 32479981 NCBI Desc: osjnba0029h02.30 [oryza sativa (japonica cultivar-group)]
  misc_feature (1)..(198): NCBI GI: 28829312 NCBI Desc: similar to dictyostelium discoideum (slime mold). histidine kinase dhkg
  misc_feature (288)..(805): NCBI GI: 68264926 NCBI Desc: ikk2 binding protein isoform 2 [mus musculus]
MEPGLSIESGSAIRVAVLPVGGPIPPPRLREYAALVARHARVDLASLRTYYAEHQKSPFQHQPWETGCLRLKFVLGGCVPSPWEDFQSSRKVLAVIGICHLPSSPDLDRVAADFIDSARSYPSALANRCFAFCPTDAQLSGKKRDDIIMLPPSDQQSLELHMLTMIQDLAASLLMEFEKWVLRAESTGTILKTPLDSQSSLGSEEVIKAKKRRLGRAQKIIGDYCLLAGSPVDANAHYTTAIELARLTGDVFWHAGALEGSVCALVVDRMGQSDPVLEDEVKYRYYTIIQLYRRATLQDNAQRVSPVSFELEAALKLARYLCRQELAKEVSDLLMGAADGAKALIDASDRLILYIEIARLFGTLGYKRKAAFFSRQVAQLYLQQDNAYAAMSAMQVLTMTTNAYHVQSRKTMKMNHDLSKSIVSLFESQWSTLQMVVLREILMSSIRAADPLSSWSAAARLLRSFYPLITPAGQSGLASSLANSADKLPTGTRCADPCLPFIRLHSFPLHPSQRDIVKRNPHKKEWWTGAGPSGPFIYTPFSKAGASGTSKQEVSWIVGEPVQVMVELANPCSFDLVVESIYLSVHSGNFDAFPVSVSLPPNTSKLVLLSGIPTKVGQISIPGCIVHCFGVITEHLFKEVDCLLLGAAQGLVLSDPFRCCGSSKFKSVNFPSISVVPPLPLLVANVVGGDGSILLYEGEIRDVLITLTNAGTVPAEEANVALSGKNQDSVISIAHSTWKSALPIKPGGEVTFAVTLRAWHLSSADLETDGSRSPANSRRIAREGINPFLDIHYAGPAANLENGDVSLPPGRRLVVPLNICVVQGMRLVRARLLSMEIPARFTETHLKPVSGEDINLLKIDPYKGSWGLRLLELELFNPTDVVFDVDVAVHLDDADVDQEVISEGDAACHKTRIDRDYSARVLIPLENFKLPVLDASFFVKESSSDEPLGSRAAAIAERNAKAELNASINNLISKIKVKWHSGRNSSGELNIKDAIQAALQASIMDILLPDPLTFSFKLAKNGTVINDDSSKDFGSVLRCKDPISAHEMTHMEVQIRNNTKEIIQMNLSISCKDVAGENCFDENSATVLWAGVLSDIHLEVPPLQEVIHPFSMYFLVPGDYSLQAASVIIDATDVLRARAKAESPDEPILCRGSPFHIRVVGTA

SEQ ID NO: 6207 - DNA, 417 bp, Sorghum bicolor
  misc_feature: Ceres ANNOT ID no. 6064688
  misc_feature: Encodes the peptide sequence at SEQ ID NO 6208
atggatgaagaaaacgatagctctacgaagagcatcacaatagaaatgaaagtatacatgcattgtgatgcttgcgaaagaaaagtgcgccgtaccatcagcaaagtcgaaggcgtcgagacggtggaggtggacagggaagagaacaaggtcacggtgacaggagatttcgagcctgagaaggtggtgaggaagatcaagaagaagactgggaagaaggcggagatcttgccccccgaggaagacgaggaggaggaaggcaagggagaagaaacttacgttccttacgcttacggtgaaccattgttctaccctgacgatgcagatgttcccgatgagtttcagagctataggtcggaaagatggaacttccattactttgatgacgagaacgcacaagcgtgtatggtaatgtag

SEQ ID NO: 6208 - protein, 138 aa, Sorghum bicolor
  misc_feature: Ceres ANNOT ID no. 6064688
  misc_feature (14)..(76): Pfam Id: HMA Pfam Desc: Heavy-metal-associated domain
  misc_feature (14)..(95): NCBI GI: 116309351 NCBI Desc: osigba0096p03.8 [oryza sativa (indica cultivar-group)]
  misc_feature (2)..(137): NCBI GI: 15233077 NCBI Desc: copper-binding family protein [arabidopsis thaliana]
  misc_feature (14)..(95): NCBI GI: 38344582 NCBI Desc: osjnba0053b21.14 [oryza sativa (japonica cultivar-group)]
  misc_feature (13)..(138): NCBI GI: 4097573 NCBI Desc: gmfp7 [glycine max]
  misc_feature (10)..(138): NCBI GI: 140062659 NCBI Desc: heavy metal transport/detoxification protein [medicago truncatula]
MDEENDSSTKSITIEMKVYMHCDACERKVRRTISKVEGVETVEVDREENKVTVTGDFEPEKVVRKIKKKTGKKAEILPPEEDEEEEGKGEETYVPYAYGEPLFYPDDADVPDEFQSYRSERWNFHYFDDENAQACMVM

SEQ ID NO: 6209 - DNA, 2085 bp, Sorghum bicolor
  misc_feature: Ceres ANNOT ID no. 6064690
  misc_feature: Encodes the peptide sequence at SEQ ID NO 6210
atggatcccgcgccggcgaccccgcgctggaatctggagcgaccgtacctcactggacgcttccaccaggaggcgaaggctgctgcggcggcgcagggacccggatccaagtccttctccctcgaatccttcagccgcggcgctggcgccggcaccggaagtgtcatcggatcgtacgcagtatcggagcttttggttatcgatgatttgctatcagctctggtgggtattgagggacgatatatttctattaagagagttcgtggaaaggagggctatgttgtctttcagattgattcttcgatggaccttgccctccaggaattgactcgccggattttccctttgtgtgaggattatgtgttggtaagccagtttgtggagtccaggtcacatttcaagaatggtttggtcaaccatgctttggctgcagctctaagggcattcctactggactatcaggcaatggttgctcaactggagcaccagttccgtcttggaaggctttctgttcagggattatggttcttttgtcagaggatgatgagttcactgaatgcactggcagttctagtggagaaggctacctccaacaatactaatggttctgcaacacttaatctacttcaaagccaggcaaaggcgatgggtggtgatagtgctgttcggtctttactggagaagatgacagaatatgcaagtggagcatacctcaggatgctagaaaggtgggtgtatgagggactaatagacgatccttatggtgaattcttcattgctgaaaacaaatctctgcagaaggagagcctcactcaagattatgatgccaaatattggcagcaacgatacagcctaaaagaaggaattcctagtttccttacgaatgttgctgcaatgattctaacaacaggaaagtatcttaatgttatgagagaatgtgggcacaatgttcaggtttccttgtcagacaatactaagcttatgagctttggctcaaaccaccaatatcttgaatgtataaaatctgcatatgattttgcaagtggtgaattgttgactctgatgaaagataagtatgatctcatcgggaaactgcgatccctgaagcgctatctactccttgaccaaggtgactttttggttcattttatggatattgctcgagaggagcttacaaagaaaccagaagaaatatctgctgaaaaacttcagtctctgcttgacattgctttgcggagtactgcagctgcttcagatccaagccatgaggaattaatctgctgcgtggaaagaagttccctccttaagaaactgggcactctgaaagacttggattgtgcttaccctgcagataagcttgctgcagcagatgttgatcagtcaatgcaattaagcattacgggtttggaaacattctgccttagcaataaggtccagtggcctttatctcttgtaatttcaaggaaggctttgacaaaataccaattgatctttcgcctattgttccactgcaagcatgtattccggtctgtcaagattctagggacaccaattttacggtcatcaattctctgtcgtagcatgctcaagtttgtaaatagccttttgcattatctaacatttgaggttcttgaaccaaattggcatttgatgcatgaccgccttcaaacagcaaggagcatagatgaggttatccagatccatgatttcttcctccagaagtgtctaaaagaatgcttgctgttgtcgcctgaactccttgtgaaaattgagaagctgaaaggtttatgccttcagtatgccacttccatccagctcttgatgccatccatcgatgtcactaactccgagaacacatcaaagtctgggaagtcgagatcaaggatcaataaatcacaggacagagaccagcagctgaaactagcatcagagaatgttgtcatgtcagagtcgatcctgaaatttgaagcagcgttcaattcagagctccagagtcttgctcctacattgagtaacagttcacatgcggagccgtatctgactcatctcgcacagtgcattcttggtgtgcgaatcgaccaatga

SEQ ID NO: 6210 - protein, 694 aa, Sorghum bicolor
  misc_feature: Ceres ANNOT ID no. 6064690
  misc_feature (66)..(552): Pfam Id: Spc97_Spc98 Pfam Desc: Spc97 / Spc98 family
  misc_feature (1)..(694): NCBI GI: 115459262 NCBI Desc: os04g0501700 [oryza sativa (japonica cultivar-group)]
  misc_feature (1)..(694): NCBI GI: 116310759 NCBI Desc: h0311c03.7 [oryza sativa (indica cultivar-group)]
  misc_feature (5)..(690): NCBI GI: 30686344 NCBI Desc: tubulin family protein [arabidopsis thaliana]
  misc_feature (5)..(690): NCBI GI: 9755764 NCBI Desc: spindle pole body protein-like [arabidopsis thaliana]
  misc_feature (44)..(661): NCBI GI: 19526968 NCBI Desc: tubulin, gamma complex associated protein 2 [mus musculus]
MDPAPATPRWNLERPYLTGRFHQEAKAAAAAQGPGSKSFSLESFSRGAGAGTGSVIGSYAVSELLVIDDLLSALVGIEGRYISIKRVRGKEGYVVFQIDSSMDLALQELTRRIFPLCEDYVLVSQFVESRSHFKNGLVNHALAAALRAFLLDYQAMVAQLEHQFRLGRLSVQGLWFFCQRMMSSLNALAVLVEKATSNNTNGSATLNLLQSQAKAMGGDSAVRSLLEKMTEYASGAYLRMLERWVYEGLIDDPYGEFFIAENKSLQKESLTQDYDAKYWQQRYSLKEGIPSFLTNVAAMILTTGKYLNVMRECGHNVQVSLSDNTKLMSFGSNHQYLECIKSAYDFASGELLTLMKDKYDLIGKLRSLKRYLLLDQGDFLVHFMDIAREELTKKPEEISAEKLQSLLDIALRSTAAASDPSHEELICCVERSSLLKKLGTLKDLDCAYPADKLAAADVDQSMQLSITGLETFCLSNKVQWPLSLVISRKALTKYQLIFRLLFHCKHVFRSVKILGTPILRSSILCRSMLKFVNSLLHYLTFEVLEPNWHLMHDRLQTARSIDEVIQIHDFFLQKCLKECLLLSPELLVKIEKLKGLCLQYATSIQLLMPSIDVTNSENTSKSGKSRSRINKSQDRDQQLKLASENVVMSESILKFEAAFNSELQSLAPTLSNSSHAEPYLTHLAQCILGVRIDQ

SEQ ID NO: 6211 - DNA, 1170 bp, Sorghum bicolor
  misc_feature: Ceres ANNOT ID no. 6064698
  misc_feature: Encodes the peptide sequence at SEQ ID NO 6212
atgtccggggctagcgcgagggggcggctgtcgccagcgtccggcggcggcggggactccgaaccacggtccgcgggtggcaggacgcgctcggtgtctgctactcgcggccggaagccctcaccgaggcctgggagggatgtggccgcggcggcaggggcaacggaggagaagaaaccggccgccgtgcctacattgctgccctcgctcagcgtgccggcggggatgcgtcggcaggagctgctgctgcgctcggggctgtctcttgacgcgtcctgctcctcggacgcgtccacggattcgttctgcagccgggcatccactggccggattgggaggccggcatttggggctaggaagaagaagaccctctctcagactgattacaagcctgtttccatgctggaaagggagggtggattagcttcccagattgatgctgctggtgtgaagaggaggtgtgcatgggtgacagcaaatactgatccctgttatgctgcatttcatgatgaagagtggggagttcctgttcacgatgacaaaaagttatttgagctgctggtgctgtcaggggcattggctgaactgacatggccagcaattctgaataagagggacatattcagggaagttttcatggattttgacccagtattggtctcaaaattaagtgagaagaagattattgcacctggaagtcctagcagctccttgttatctgaacagaaactgcgtggtgttattgaaaatgcacgccaaatactcaagatcatagaggaatttggatcatttgataaatactgttggagctttgtgaaccacaaacctatattgagccgattcaggtactcccgtcaagtgcctgtcaaaacatcgaaagcagatgccataagcaaagacttggttcgaaggggtttccgcagcgtcggcccaacagtcgtttataccttcatgcaagtctctggcatgactaacgaccaccttatctcctgctaccgttttgccgaatgcgcggcctcctctgacggtaccggtaaacttaccgatggaaacctagcaaactcgagtgatagcaaccatgccacggcagagcagaagatgaacaggacgaatgggctggattcagacattgaactctccaggactatagatgagctcagcatttcatag

SEQ ID NO: 6212 - protein, 389 aa, Sorghum bicolor
  misc_feature: Ceres ANNOT ID no. 6064698
  misc_feature (156)..(336): Pfam Id: Adenine_glyco Pfam Desc: Methyladenine glycosylase
  misc_feature (1)..(389): NCBI GI: 90265145 NCBI Desc: h0711g06.19 [oryza sativa (indica cultivar-group)]
  misc_feature (5)..(389): NCBI GI: 92895786 NCBI Desc: protein prenyltransferase, alpha subunit [medicago truncatula]
  misc_feature (2)..(383): NCBI GI: 51534979 NCBI Desc: methyladenine glycosylase protein-like [oryza sativa (japonica cultivar-group)]
  misc_feature (2)..(383): NCBI GI: 115469240 NCBI Desc: os06g0649800 [oryza sativa (japonica cultivar-group)]
  misc_feature (24)..(345): NCBI GI: 6503296 NCBI Desc: contains similarity to gi1168217 dna-3-methyladenine glycosidase (tag) protein from haemophilus influenzae. [arabidopsis thaliana]
MSGASARGRLSPASGGGGDSEPRSAGGRTRSVSATRGRKPSPRPGRDVAAAAGATEEKKPAAVPTLLPSLSVPAGMRRQELLLRSGLSLDASCSSDASTDSFCSRASTGRIGRPAFGARKKKTLSQTDYKPVSMLEREGGLASQIDAAGVKRRCAWVTANTDPCYAAFHDEEWGVPVHDDKKLFELLVLSGALAELTWPAILNKRDIFREVFMDFDPVLVSKLSEKKIIAPGSPSSSLLSEQKLRGVIENARQILKIIEEFGSFDKYCWSFVNHKPILSRFRYSRQVPVKTSKADAISKDLVRRGFRSVGPTVVYTFMQVSGMTNDHLISCYRFAECAASSDGTGKLTDGNLANSSDSNHATAEQKMNRTNGLDSDIELSRTIDELSIS

SEQ ID NO: 6213 - DNA, 1326 bp, Sorghum bicolor
  misc_feature: Ceres ANNOT ID no. 6064700
  misc_feature: Encodes the peptide sequence at SEQ ID NO 6214
atggaccacgaccacctcaaggaccgcctcctcctcccgtcctcccgcgccgccgcgacgaacgggccccaccaccaccgccgcgccacgcccgcgccgggcagtactggcgccggaggcccaccatgtggcggcggaggagcaggcggcgtgtccatcgacgtcaacggcctgaagcggcgcggcggcgggaggcgctcgtgggtgcgcgtggacgcggcgacgggcgccgcggaggcggtcgaggtcgccaagccggcgctgatgcggcgcctggacctgcccgcgcgggacctccgcctcctcgacccgctcttcgtctacccgtccgccatcctcggccgcgagcgcgccgttgtctgcaacctcgagcgcctgcggtgcatcatcaccgccgacgaggcgctcgtcctgcgcgaacccgacgccgctgggggcgccgcggcggaggaggccgtgcggaggtacgtcgacgagctgcagcggcgcctcgtcgaccgcgccgacgacctgcctttcgagttcatcgcgctggaggtcgcgctcgaggccgcctgctccttcctggactcgcaggctattgaattagaggctgaagcttaccccttactggatgagctgacagccaaaattagtaccctcaacttggaacgagtccggcgcctaaagagcaagctggttgcattgacaaggagagttcagaaggtcagagacgagatagagcagctgatggatgacgatggtgatatggctgaaatgtatctcactgagaagaagatgaggatggaagcatcaatgttagatgacgaggaccttcagggaattgacaatagtcataatgggttgggttcatctctgtcggctccagtttcaccagtttcgacaccccctgcaactcggaggcttgagaaggaattcagttttgccagaagcaggcacagcagcttcaagagctcagatagcagccagtacaatatagaagaactggaaatgttgttggaggcctactttgttgttatcgactacaccctcagcaagttgacttcgctaaaggagtatattgatgatacagaagatttcatcaacatacagctggataacgtccggaaccaactgatccaattcgagctgctcctgaccacggccacattcgtggtggccatcttcggggtggtatcgggggttttcggcatgaacttcgaggtccctcttttctcggtgccccacgcgttcgagtggaccctcgccataacgggggtctgcgccgccgtcgtcttctgctgcttcctctggtacttcaagaagaggaggtttttcccactgtag

SEQ ID NO: 6214 - protein, 441 aa, Sorghum bicolor
  misc_feature: Ceres ANNOT ID no. 6064700
  misc_feature (63)..(439): Pfam Id: CorA Pfam Desc: CorA-like Mg2+ transporter protein
  misc_feature (1)..(441): NCBI GI: 90265144 NCBI Desc: h0711g06.18 [oryza sativa (indica cultivar-group)]
  misc_feature (1)..(441): NCBI GI: 70663910 NCBI Desc: osjnba0029h02.22 [oryza sativa (japonica cultivar-group)]
  misc_feature (1)..(441): NCBI GI: 115459254 NCBI Desc: os04g0501100 [oryza sativa (japonica cultivar-group)]
  misc_feature (1)..(441): NCBI GI: 116310755 NCBI Desc: h0311c03.3 [oryza sativa (indica cultivar-group)]
  misc_feature (25)..(441): NCBI GI: 51534988 NCBI Desc: magnesium transporter cora-like [oryza sativa (japonica cultivar-group)]
MDHDHLKDRLLLPSSRAAATNGPHHHRRATPAPGSTGAGGPPCGGGGAGGVSIDVNGLKRRGGGRRSWVRVDAATGAAEAVEVAKPALMRRLDLPARDLRLLDPLFVYPSAILGRERAVVCNLERLRCIITADEALVLREPDAAGGAAAEEAVRRYVDELQRRLVDRADDLPFEFIALEVALEAACSFLDSQAIELEAEAYPLLDELTAKISTLNLERVRRLKSKLVALTRRVQKVRDEIEQLMDDDGDMAEMYLTEKKMRMEASMLDDEDLQGIDNSHNGLGSSLSAPVSPVSTPPATRRLEKEFSFARSRHSSFKSSDSSQYNIEELEMLLEAYFVVIDYTLSKLTSLKEYIDDTEDFINIQLDNVRNQLIQFELLLTTATFVVAIFGVVSGVFGMNFEVPLFSVPHAFEWTLAITGVCAAVVFCCFLWYFKKRRFFPL

SEQ ID NO: 6215 - DNA, 762 bp, Sorghum bicolor
  misc_feature: Ceres ANNOT ID no. 6064708
  misc_feature: Encodes the peptide sequence at SEQ ID NO 6216
atggcaatggcatccaccccctccaaccccaccagccgcctccgccgcgaggccgtggtccgtgcggtagccgcgctcctccgctggctccagaagcaccctaccccggcgccggagcccatatacctcatcgtcaccctcaagcgcgctcccgtccggcgcttcgagcaccaactccgcctcccgcactccccgttcccgtccatctcccttgtctccgaccgcctccccgccgacctccccgacgacatcgacccgctcccttcctccgcgctccggtccctccccgccgccacgcggcgcggcctggtactcgtcgaccgccgcctcagggtccctgccggcggcaaggcggcgggcgccaagcgcggcgtgaccttgcccgtggacctgtcggacccagcgtgggcggagtccgcgagggaggcggcgcgccgcgtggagctgcgggtggagggcgggacctgccgcgccgtgcgcgtgggccacggcgccatggcgcgggaggaggccgtggagaacgtggtggccgcggtggaggcggccgccgcgtgcgtgccgaggaagtggcggaacgtgcgggcgctgcacgtcaagtcccccgaatccaccgcgttgccgctctactccacgcccggcaccggcggcgaggacaacgacggtgacggcggcatgggggctgcgaagccggagggcacgccgacgatggaggagcagggaagaacgaagaggaggaagaagagtagcatgggctgtaattag

SEQ ID NO: 6216 - protein, 253 aa, Sorghum bicolor
  misc_feature: Ceres ANNOT ID no. 6064708
  misc_feature (8)..(249): NCBI GI: 70663903 NCBI Desc: osjnba0029h02.15 [oryza sativa (japonica cultivar-group)]
  misc_feature (8)..(249): NCBI GI: 90265137 NCBI Desc: h0711g06.11 [oryza sativa (indica cultivar-group)]
  misc_feature (8)..(104): NCBI GI: 115459242 NCBI Desc: os04g0500200 [oryza sativa (japonica cultivar-group)]
  misc_feature (73)..(211): NCBI GI: 8927675 NCBI Desc: contains similarity to a pbk1 protein from homo sapiens gbaj007398. [arabidopsis thaliana]
  misc_feature (107)..(211): NCBI GI: 19310375 NCBI Desc: at2g42650/f14n22.8 [arabidopsis thaliana]
MAMASTPSNPTSRLRREAVVRAVAALLRWLQKHPTPAPEPIYLIVTLKRAPVRRFEHQLRLPHSPFPSISLVSDRLPADLPDDIDPLPSSALRSLPAATRRGLVLVDRRLRVPAGGKAAGAKRGVTLPVDLSDPAWAESAREAARRVELRVEGGTCRAVRVGHGAMAREEAVENVVAAVEAAAACVPRKWRNVRALHVKSPESTALPLYSTPGTGGEDNDGDGGMGAAKPEGTPTMEEQGRTKRRKKSSMGCN

SEQ ID NO: 6217 - DNA, 1590 bp, Sorghum bicolor
  misc_feature: Ceres ANNOT ID no. 6064711
  misc_feature: Encodes the peptide sequence at SEQ ID NO 6218
atggagcaccgggaggacggccccctccaactccaagaaacagccgccgatgaccgtggcaaatgctgtgtcgcgtccccctgcgggtggctggggcggctgtcccgcgagctgcactggagcttcgtgctcgcggtcgtcgccgtctacggcgcctgccagggcgtcggcaacgccatcggcggagtcgccgcggcgtactactggaaggacgtgcagcgcgtgcagccttcggcggcccagttctaccagggcgtcacggacgcgccgtggatcgtcaaacccatctggggcctgctcaccgatgtcgtccccgtggtcgggttccgccgccgcccatacttcgttctcgcaggcgtgattggcgtgtcatctatgctcatgctttccctaaaccacgagctggggatcgttccggcattgctgatgctgatagcgcagagtgcgggtgccgcaatagccgacgtgacggtggacgctctggttgctcagaatagcatcacgcacccgccccttgctgctgatatgcaaagcttgtgtgggtttagctcctctgttggggcgttgcttggattctccttaagtggcttgcttgtgcactcgatgggctcccagggggctcttggtctgttgagtatcccatctgcactggtgttattagctggcattctgctgaaggagaaccgtggtacagaatttgattacatgcaggttcacaagaagttctacaaagcaatacaatccatgggaagaacactgaagtgccccgaggtctggagaccatgtgtatatatttttgtttctctcaatttaagcctggatattcaaggaggaatgttctattggtacacggatgctgttgttggaccaggattttctgagggatatattggtctcatctattcaattggttcagttggttcactaattggagttttactataccaaagcgcactaaaggactatccttttcggagcatgctattatggggtcaagtgctctcaagtctagcaggaatgcttgatctggtgttagtgacccggctaaacctgaaaattggcatgccggattacttctttgcagtggctgataacgcagtttcccaaatggttggtaggctccaatggctaccactacttgtgctttgctccaagctttgtcctcccggcactgaaggaacattttatgcattactcatgtctctacaaaatgccgggttgctgatgtctgcttggtggggtggcctgctgctgcacatgctgaacgtgacccgaatggagttcagtaacctctggatcatcgtcttgattagaaacacatcaaggcttgtccctttaatgctactgtttcttgtgcctgattgtgatcagaactcaacactcctgcctgcagagatgcttcatggcaatgaatcaacagaaaccacaaaaaatggatcaaatcagttttctattcttgttggggacaattctggctgcatttctcctggtgtggcagttgataacgagcaaatcaaaatgatagatgctgaaactgatgatgtcgaattgatcccattggttaacaagagcgggctgaccgtctcatga

SEQ ID NO: 6218 - protein, 529 aa, Sorghum bicolor
  misc_feature: Ceres ANNOT ID no. 6064711
  misc_feature (54)..(466): Pfam Id: BT1 Pfam Desc: BT1 family
  misc_feature (47)..(411): Pfam Id: MFS_1 Pfam Desc: Major Facilitator Superfamily
  misc_feature (27)..(523): NCBI GI: 70663896 NCBI Desc: osjnba0029h02.8 [oryza sativa (japonica cultivar-group)]
  misc_feature (4)..(524): NCBI GI: 55773865 NCBI Desc: integral membrane transporter-like protein [oryza sativa (japonica cultivar-group)]
  misc_feature (23)..(465): NCBI GI: 92897812 NCBI Desc: biopterin transport-related protein bt1; major facilitator superfamily mfs_1 [medicago truncatula]
  misc_feature (24)..(485): NCBI GI: 15238691 NCBI Desc: integral membrane transporter family protein [arabidopsis thaliana]
  misc_feature (292)..(523): NCBI GI: 115463565 NCBI Desc: os05g0376400 [oryza sativa (japonica cultivar-group)]
MEHREDGPLQLQETAADDRGKCCVASPCGWLGRLSRELHWSFVLAVVAVYGACQGVGNAIGGVAAAYYWKDVQRVQPSAAQFYQGVTDAPWIVKPIWGLLTDVVPVVGFRRRPYFVLAGVIGVSSMLMLSLNHELGIVPALLMLIAQSAGAAIADVTVDALVAQNSITHPPLAADMQSLCGFSSSVGALLGFSLSGLLVHSMGSQGALGLLSIPSALVLLAGILLKENRGTEFDYMQVHKKFYKAIQSMGRTLKCPEVWRPCVYIFVSLNLSLDIQGGMFYWYTDAVVGPGFSEGYIGLIYSIGSVGSLIGVLLYQSALKDYPFRSMLLWGQVLSSLAGMLDLVLVTRLNLKIGMPDYFFAVADNAVSQMVGRLQWLPLLVLCSKLCPPGTEGTFYALLMSLQNAGLLMSAWWGGLLLHMLNVTRMEFSNLWIIVLIRNTSRLVPLMLLFLVPDCDQNSTLLPAEMLHGNESTETTKNGSNQFSILVGDNSGCISPGVAVDNEQIKMIDAETDDVELIPLVNKSGLTVS

SEQ ID NO: 6219 - DNA, 972 bp, Sorghum bicolor
  misc_feature: Ceres ANNOT ID no. 6064712
  misc_feature: Encodes the peptide sequence at SEQ ID NO 6220
atgcagcccaagatcagcgcgttcttcaagcggcaggaagcggacccagatccgaacagtggcgacggtgaggggaacgggcatggaagcgacatcgcggcgacggaggcgaaacggaaggccaagggctgcaggcgcgacgagctcgtcagcaagaagaggaactacgcgcagttccatctggagctggggcagcctgatttcctacaccacacgtgctccgtctgcggcatgatgtacgcccgagggaacgacgaggacgagaaggttcacagggcctaccacaagaactactcagagggggtccctttcaagggctggaaaaatgagacagtgatggcgaggtccgagggtggtgatcgcgttattcttgcaactgatgagaactcttgtgtgtggaaaagtaaggtcagagaggtgatcacagtggtggagaaggagctgggatttggtgaagggaaacttctgcataagctttgcaaggtgtatctatacatatctggacaaaggatcgtggggtgccttgtcactgaaccaataaaagcagcacatagagtcatcccaagatccacggaagaaagccatagcagtttgccagttaatagtaatgagccaggaaaaaatggtcatacattagagtttggcgaaattagtttcaagagggaaatcataaggcgtcacaatcattcaatcaagaacaaagaagagtgccaggaccctggtgccataatttgtgaaacagaagctgttcctgcactttgtggatttcgagccatctgggtggtaccatcacgcagaagaaaacgaattgcctcaaaactaatggatgttgcaaggaaaaccttctgcgaaggcaggactttggggatttcacagtttgctttcactcccccgacctcctctggcaaggggctagcatgccgttactgcaagaccagctcattcttagtctataaagacggacctgtgtaa

SEQ ID NO: 6220 - protein, 323 aa, Sorghum bicolor
  misc_feature: Ceres ANNOT ID no. 6064712
  misc_feature (1)..(320): NCBI GI: 115463563 NCBI Desc: os05g0376300 [oryza sativa (japonica cultivar-group)]
  misc_feature (1)..(278): NCBI GI: 70663895 NCBI Desc: osjnba0029h02.7 [oryza sativa (japonica cultivar-group)]
  misc_feature (51)..(197): NCBI GI: 62131654 NCBI Desc: establishment of cohesion 1 homolog 2 [homo sapiens]
  misc_feature (51)..(197): NCBI GI: 119583942 NCBI Desc: establishment of cohesion 1 homolog 2 (s. cerevisiae) [homo sapiens]
  misc_feature (58)..(193): NCBI GI: 54311141 NCBI Desc: riken cdna 2410004i17 [mus musculus]
MQPKISAFFKRQEADPDPNSGDGEGNGHGSDIAATEAKRKAKGCRRDELVSKKRNYAQFHLELGQPDFLHHTCSVCGMMYARGNDEDEKVHRAYHKNYSEGVPFKGWKNETVMARSEGGDRVILATDENSCVWKSKVREVITVVEKELGFGEGKLLHKLCKVYLYISGQRIVGCLVTEPIKAAHRVIPRSTEESHSSLPVNSNEPGKNGHTLEFGEISFKREIIRRHNHSIKNKEECQDPGAIICETEAVPALCGFRAIWVVPSRRRKRIASKLMDVARKTFCEGRTLGISQFAFTPPTSSGKGLACRYCKTSSFLVYKDGPV

SEQ ID NO: 6221 - DNA, 1695 bp, Sorghum bicolor
  misc_feature: Ceres ANNOT ID no. 6064713
  misc_feature: Encodes the peptide sequence at SEQ ID NO 6222
atgagcacggcgagcgtcagcgacgacggcggttgggtaagcggcggaaagtcggccgacgggtggcgggcggaggaggctgtcgcgggcaaccgtagggcactggaggcccttcgggagctcgtggcttatccattcctctacgcccgcgagtcccggctgctcggactcaagtggcccagaggattgctgctccacggcccccctggcaccggaaagacaagcctggttcgagctattgttcgagaatgcaacgcacacctgataatgatcaatccttattctgtacacaaagcccatgtgggagagggagaaaagttcctgcgtgaagctttttctgaagcatattctcaggcttcgcggggtaaaccagctgtgatattcatcgacgaacttgatgccatatgtccacggagagagaatgagtcccgcattgttggccaacttcttactctgatggatggaaacaagaaatcgtcaaagatgcttcctcacatagttgttgttgcatcgactaacagggtagatgccattgatccagcattgagaagagcaggacgttttgactcagaagtagaggtttctgttcctacagttgaagagcggctgcaaattctaaagctttatgccaaaaacctacatatggatgaaaaggtcgatcttcaaaccgttgctgcattctgcaatggctatgttggagctgatttagaagcattatgtcgagaagctgccaagcttgcatatcatagaatgttaaacatatctgagggtgacagagtacttaaactacatatggaggactgggagtctgctagatctatggtgggaccaagcataacaagagggataaccaaagaaatttcaactgtttcatgggatgatataggaggcttgaaagatctaaagaaagagcttcagaaagctgttgagtggcccatcaagcatgctgatgcattttctagacttggaataccaccagtccggggggtgcttttgcatggtccgccagggtgctcaaagactacccttgccaaggctgcagcgcatgcttcccgagcttctttcttttctttgagtggtgcagatttatattccaagtatgttggagaaggtgaagctctgttacgtagaacatttcagaaagcacgtcttgcttctccaagcattatattttttgacgaggctgatgccattgcccccaagagaactggctctggtgggaattctagtggcaatgccactgttggagaaagacttttgtcaactttattgaccgaaatggatggtttagaactggctacgggaattctcgtattgggtgctacaaatcgcccaaatgcaattgatgctgctcttctgcgcccaggacgttttgataaggtgctgtatgtcccgccaccagatgtggaagggcgatatgagatactacgcatccatacacagaaaatgaaattgggagaggatgtagatctatggaagattgcagagtgtactgagttgttcaccggtgctgatcttgaaggcctttgccgggaagctggaatggcagctctgagggaagatatctcagcaagttcgatatgtaatacccacttccaagccgcacgaagttcattgaacccctctcttacaaaagcattagttgacgagtactcaaaggcagctataaatgatccatcaagtaggaaacattaa

SEQ ID NO: 6222 - protein, 564 aa, Sorghum bicolor
  misc_feature: Ceres ANNOT ID no. 6064713
  misc_feature (62)..(249): Pfam Id: AAA Pfam Desc: ATPase family associated with various cellular activities(AAA)
  misc_feature (329)..(519): Pfam Id: AAA Pfam Desc: ATPase family associated with various cellular activities(AAA)
  misc_feature (62)..(197): Pfam Id: AAA_5 Pfam Desc: ATPase family associated with various cellular activities(AAA)
  misc_feature (10)..(564): NCBI GI: 115459230 NCBI Desc: os04g0498800 [oryza sativa (japonica cultivar-group)]
  misc_feature (10)..(564): NCBI GI: 90265129 NCBI Desc: h0711g06.3 [oryza sativa (indica cultivar-group)]
  misc_feature (23)..(552): NCBI GI: 124361206 NCBI Desc: aaa atpase, central region [medicago truncatula]
  misc_feature (34)..(551): NCBI GI: 119719222 NCBI Desc: aaa family atpase, cdc48 subfamily [thermofilum pendens hrk 5]
  misc_feature (26)..(553): NCBI GI: 126014442 NCBI Desc: aaa family atpase, cdc48 subfamily [staphylothermus marinus f1]
  misc_feature: The sequence is a functional homolog of SEQ ID NO. 462 in the 11/188,298 US application
  misc_feature: The sequence is a functional homolog of SEQ ID NO. 471 in the 11/188,298 US application
MSTASVSDDGGWVSGGKSADGWRAEEAVAGNRRALEALRELVAYPFLYARESRLLGLKWPRGLLLHGPPGTGKTSLVRAIVRECNAHLIMINPYSVHKAHVGEGEKFLREAFSEAYSQASRGKPAVIFIDELDAICPRRENESRIVGQLLTLMDGNKKSSKMLPHIVVVASTNRVDAIDPALRRAGRFDSEVEVSVPTVEERLQILKLYAKNLHMDEKVDLQTVAAFCNGYVGADLEALCREAAKLAYHRMLNISEGDRVLKLHMEDWESARSMVGPSITRGITKEISTVSWDDIGGLKDLKKELQKAVEWPIKHADAFSRLGIPPVRGVLLHGPPGCSKTTLAKAAAHASRASFFSLSGADLYSKYVGEGEALLRRTFQKARLASPSIIFFDEADAIAPKRTGSGGNSSGNATVGERLLSTLLTEMDGLELATGILVLGATNRPNAIDAALLRPGRFDKVLYVPPPDVEGRYEILRIHTQKMKLGEDVDLWKIAECTELFTGADLEGLCREAGMAALREDISASSICNTHFQAARSSLNPSLTKALVDEYSKAAINDPSSRKH

SEQ ID NO: 6223 - DNA, 156 bp, Sorghum bicolor
  misc_feature: Ceres ANNOT ID no. 6064722
  misc_feature: Encodes the peptide sequence at SEQ ID NO 6224
atgcctttcactccgggcccctactccggcgtcagcaccctcgcccttgtggccagggcgtctgccttcagcgtcggtgtcgtctacgggagcatcaagctctcaatcctcaaggcaacaaaacctaaaaaggaggaagcacatgctcatcactaa

SEQ ID NO: 6224 - protein, 51 aa, Sorghum bicolor
  misc_feature: Ceres ANNOT ID no. 6064722
  misc_feature: Useful for making plants with altered cell wall content and/or composition
  misc_feature: Functional homolog of the protein sequence encoded by LOCUS at5g15320
  misc_feature: Useful for making plants with altered carbohydrate content
  misc_feature: Functional homolog of the protein sequence given in SEQ ID NO 13949
  misc_feature: Useful for making plants with altered cell wall content and/or composition
  misc_feature: Functional homolog of the protein sequence given in SEQ ID NO 13950
MPFTPGPYSGVSTLALVARASAFSVGVVYGSIKLSILKATKPKKEEAHAHH

SEQ ID NO: 6225 - DNA, 1383 bp, Sorghum bicolor
  misc_feature: Ceres ANNOT ID no. 6064725
  misc_feature: Encodes the peptide sequence at SEQ ID NO 6226
atggcagccgccgccgccgccaccccgcttgacgacgccaaggccaagaatgttatccgccaggtggagttctattttagcgacagcaacctcccccgcgacgggttcctacgtaggaccgtcgaggaaagcgagaatgggtgtaagaatgctctcgtcttcatctacgatgatcttgctgtggtgagcttggctctcatttgttccttctcgcggatgaggtcacacctaggtctcgaaggggatgtgaaaccggatactgtgccagaggagaccgtacttgcagttgctgacgtcttgcgccgttccacagccctccgtgtatcagaggatgggaagaaagttggtaggtctaaggagttgttgaagccagatgaggttatagatcaagtggactctaggacagttgctgcatcaccgcttccttacaatgtaaaactggaggaagttgaatctttttttgctcaatgtggcaaggtaaatagtgtgaggctgcctcgacatgtttctgacaaaagacatttctgtggtactgctttagttgaattttcagacgaagatgaagcaaaaggtgttttcgagaaaaaactcgtatttgctggggccgacctgcaaataagaccaaagaaggaatttgatactgaaagagaggcaaagaaagaagcatatgaaaagtcacatcctaataagagcggtcatggtgaaggctatccaaaaggtctgattctggccttcaagctgaagaaaattgcagttgatagtgagacagaaaaaaatggtgggggcaaagtagatgacactgaccttactaagaatgaaggagcttccgatgctacagagaaatctagcgtagagaatgaagagaagatccctgagaataaaggcaatgtgagtgaggagcagtcagatgctgttgaggaattgaaaggggtatctgctggggaaacttcacaatctgttgacaaggatgataaaagcccttcagacaatgctcaagataaaatctcgagggaggacttaaaagaagaattcactaaatttggcacagtgcggtatgtggactttagcattggggaagattctggattcattcggttcgaggattccacagcagctgacaaggcccgtgcatttgcagccattgcagatgaaggtggtttgactatgaaaggccacatagtcactttggaacctgtgtctggtcaagccgaaaaggattattggagtgcaattcgaggtggtcaggagaaatataaagatagccgaaacaacagaggacgagactggaggaataatagaggcggaaagccgtttggtggtgggaagcgggggcgacacttcgactcccgtgacagggcctccaataaagctcagaaagtttag

SEQ ID NO: 6226 - protein, 460 aa, Sorghum bicolor
  misc_feature: Ceres ANNOT ID no. 6064725
  misc_feature (331)..(427): Pfam Id: RRM_3 Pfam Desc: RNA binding motif
  misc_feature (18)..(103): Pfam Id: La Pfam Desc: La domain
  misc_feature (136)..(206): Pfam Id: RRM_1 Pfam Desc: RNA recognition motif. (a.k.a. RRM, RBD, or RNP domain)
  misc_feature (2)..(454): NCBI GI: 38345389 NCBI Desc: osjnba0067k08.18 [oryza sativa (japonica cultivar-group)]
  misc_feature (10)..(425): NCBI GI: 79326195 NCBI Desc: rna binding / nucleic acid binding [arabidopsis thaliana]
  misc_feature (7)..(286): NCBI GI: 30699461 NCBI Desc: la domain-containing protein [arabidopsis thaliana]
  misc_feature (7)..(286): NCBI GI: 110736337 NCBI Desc: rna-binding protein like [arabidopsis thaliana]
  misc_feature (73)..(286): NCBI GI: 42572187 NCBI Desc: la domain-containing protein [arabidopsis thaliana]
MAAAAAATPLDDAKAKNVIRQVEFYFSDSNLPRDGFLRRTVEESENGCKNALVFIYDDLAVVSLALICSFSRMRSHLGLEGDVKPDTVPEETVLAVADVLRRSTALRVSEDGKKVGRSKELLKPDEVIDQVDSRTVAASPLPYNVKLEEVESFFAQCGKVNSVRLPRHVSDKRHFCGTALVEFSDEDEAKGVFEKKLVFAGADLQIRPKKEFDTEREAKKEAYEKSHPNKSGHGEGYPKGLILAFKLKKIAVDSETEKNGGGKVDDTDLTKNEGASDATEKSSVENEEKIPENKGNVSEEQSDAVEELKGVSAGETSQSVDKDDKSPSDNAQDKISREDLKEEFTKFGTVRYVDFSIGEDSGFIRFEDSTAADKARAFAAIADEGGLTMKGHIVTLEPVSGQAEKDYWSAIRGGQEKYKDSRNNRGRDWRNNRGGKPFGGGKRGRHFDSRDRASNKAQKV

SEQ ID NO: 6227 - DNA, 2268 bp, Sorghum bicolor
  misc_feature: Ceres ANNOT ID no. 6064732
  misc_feature: Encodes the peptide sequence at SEQ ID NO 6228
atggcctcgagggctatcgtcaggaggaggaaggacattctacggcacactaatgtgcctattttgtccccctcattcactagcacaattgggaaaggacagtttggttgtgaggttgatcatcaaagatctgtatttttcttttcgaaggaaagtttagcagattctaatcatgctacggcacattatactttaagtaagcgaaagctttgtcgcctcagtagcggtttcacatggcgttcaacttgtgaggtttctcttcccacttatggttctagagcacagaactttgtattcccattgggagtcaggtgtttcctgcagtcaatcagcaccacatcaaacacaactggacagggtcaagttaatattatggacaagcagattgaggatgagaagcagaagcaacaaaaaaaggaggcatcccctgaagaatgtgatcaggcagtggaaggattaagcactgcaaaagcaaaagcaaaagctaagctggaggaagtgcaaaagactgaccaatcaatggtacagaaattttgggcaaagcttctgggtattggccctgctttacgacttattgcttcaatgagcagagctgattgggctgcaaagttgaagcattggaaggatgaatttatttctacactgcagcattattggttgggcactaagctgctctgggcagatgttagaatctcatcaaggttgttagtgaaacttgctactggaaagagcctcacaagacgagagaggcagcagctcacacgcacaacagcagatctattcaggctagtaccttttgcagtttttattatcgttccattcatggaactcttgctgccagtgttcctcaagttgttcccaaacatgttgccatccactttccaggacaagatgaaagaagaggaggccctaaaaaggaaactgaaagcaaggatggaatatgcaaagtttttacaagacactgctaaagaaatggcaaaggaagttcaaacatcacgtagtggagaaatgaaacaaactgctgaagatctggatgagttcttgaataaggttaggaaaggtggacatgcctccaatgacgaaattttgagctttgcacagctatttaatgacgagctgactttggataacatgagcagaccacggcttgttaatatgtgtaaatacatggggatccaaccttttggcacagaccactacttgcaattcatgctccgaaagaaactacaagacattaagaatgatgataagatgattcaagctgaaggtgtggagtctctttctgaatatgagcttcgacaagcatgtcgtgagcgtgggcaccttggtttgttgtcaacagaggagatgcgccaacagctcagagactggctggatctatcactcaatcattctgtgccatcgtctcttctaatactctcaagagcttttactgtatctggtaaaatgaaacctgaggaggccgttgtagcaaccttatcttccctgccagatgaagttgtcgatacagttgggactgtactgccttctgaagattctgtttcagagaggaagagaaaattggaatttctggagatgcaggaagaacttatcaaggaagaggagaaaaggcaagagaaagaagacaaggcaaaactggaggagaagaccactgaagaagatttggctttgaaggaaatgactgagcctactgttagggaggaagaggaactaaagaaagcgaaaacacatgataagaaagagcagctttgtaatatcagtcaagcattggctgtgcttgcatctgcttcttctgttaccaaggagcgacaagagtttttaagccttgtcaacaaggagatagaactatacaacaacatgctcgcaaaggagggcacagatggtgaagaagaagccaggagagcatacaaggctgctagggaggaatcagaccatgctgcagaggcagctgtgggagaaaaggtctcttcagctttgattgatagggttgatgctatgcttcaaaagttagagaaggagattgatgatgttgatgctcgaattggcaatcgctggcagctgctggatagggaccgtgatggcaaggtgactcctgaagaggtagctgcagctgcaaattatctcaaagacaccataggagcagaaggcgtccaggagcttatcagcaatctttctaaagacaacgaagggaatatccttgtggaagacattgtaaagctggcgtcacaaacagatgaaaacaatgaacatgaagaaacggcacgatga

SEQ ID NO: 6228 - protein, 755 aa, Sorghum bicolor
  misc_feature: Ceres ANNOT ID no. 6064732
  misc_feature (204)..(474): Pfam Id: LETM1 Pfam Desc: LETM1-like protein
  misc_feature (1)..(755): NCBI GI: 116310694 NCBI Desc: h0306b06.8 [oryza sativa (indica cultivar-group)]
  misc_feature (1)..(755): NCBI GI: 58198731 NCBI Desc: ca2+ binding protein cbp1 [triticum aestivum]
  misc_feature (65)..(753): NCBI GI: 42562974 NCBI Desc: calcium-binding ef hand family protein [arabidopsis thaliana]
  misc_feature (212)..(755): NCBI GI: 62510844 NCBI Desc: leucine zipper-ef-hand containing transmembrane protein 1, mitochondrial precursor
  misc_feature (212)..(755): NCBI GI: 123993861 NCBI Desc: leucine zipper-ef-hand containing transmembrane protein 1 [synthetic construct]
MASRAIVRRRKDILRHTNVPILSPSFTSTIGKGQFGCEVDHQRSVFFFSKESLADSNHATAHYTLSKRKLCRLSSGFTWRSTCEVSLPTYGSRAQNFVFPLGVRCFLQSISTTSNTTGQGQVNIMDKQIEDEKQKQQKKEASPEECDQAVEGLSTAKAKAKAKLEEVQKTDQSMVQKFWAKLLGIGPALRLIASMSRADWAAKLKHWKDEFISTLQHYWLGTKLLWADVRISSRLLVKLATGKSLTRRERQQLTRTTADLFRLVPFAVFIIVPFMELLLPVFLKLFPNMLPSTFQDKMKEEEALKRKLKARMEYAKFLQDTAKEMAKEVQTSRSGEMKQTAEDLDEFLNKVRKGGHASNDEILSFAQLFNDELTLDNMSRPRLVNMCKYMGIQPFGTDHYLQFMLRKKLQDIKNDDKMIQAEGVESLSEYELRQACRERGHLGLLSTEEMRQQLRDWLDLSLNHSVPSSLLILSRAFTVSGKMKPEEAVVATLSSLPDEVVDTVGTVLPSEDSVSERKRKLEFLEMQEELIKEEEKRQEKEDKAKLEEKTTEEDLALKEMTEPTVREEEELKKAKTHDKKEQLCNISQALAVLASASSVTKERQEFLSLVNKEIELYNNMLAKEGTDGEEEARRAYKAAREESDHAAEAAVGEKVSSALIDRVDAMLQKLEKEIDDVDARIGNRWQLLDRDRDGKVTPEEVAAAANYLKDTIGAEGVQELISNLSKDNEGNILVEDIVKLASQTDENNEHEETAR

SEQ ID NO: 6229 - DNA, 741 bp, Sorghum bicolor
  misc_feature: Ceres ANNOT ID no. 6064740
  misc_feature: Encodes the peptide sequence at SEQ ID NO 6230
atgggcgccaacggccacccgccgccggcgagcaccgccgcacagaacgggtcccactccggcggcggcggaggaggaggagggggagggggagggggagctaaccctagcaacggcggcacggcggcggcgcttcggcacgaccctggcctggcgcgggagtggtcgccggaggagcaggccatcctcgacgagctgctggtcaagtatgcatccgatttacctgtggtacgttatgcaaaaattgcgatgaagttgccagagaaaacagttcgggatgtagccttgcgctgccgatggatgaataaaaaggagagtgccaaaagaaagaaagaggatcacagctcgtctaagaaaagcaaggacaaaaaggagaaggtttcagattcttcatcaaaaccacctgtccatatggctggtaggcctagtgttcctccataccctcttccagttcttccaatggacgatgatgaaatctcatccaaagccattggaggtccaacaggcgaaatccttgaaactaatgcccaggttttgagtcaaatttcgtcaaaccttagcaacatgcagatacaggacaacatctctctgctgtgccaaactcgagataatatactcagggtcttgaaagagataaacgatgctccagagatcatgaagcagatgcccccgctacctgtgaagataaacgaggacctcgtcaactcgttgctccccagaccaactgtacctatgcagtag

SEQ ID NO: 6230 - protein, 246 aa, Sorghum bicolor
  misc_feature: Ceres ANNOT ID no. 6064740
  misc_feature (44)..(239): NCBI GI: 115447439 NCBI Desc: os02g0631200 [oryza sativa (japonica cultivar-group)]
  misc_feature (45)..(244): NCBI GI: 32489845 NCBI Desc: osjnbb0065j09.5 [oryza sativa (japonica cultivar-group)]
  misc_feature (7)..(245): NCBI GI: 4874266 NCBI Desc: t16b5.4 [arabidopsis thaliana]
  misc_feature (15)..(238): NCBI GI: 115461260 NCBI Desc: os04g0673000 [oryza sativa (japonica cultivar-group)]
  misc_feature (50)..(238): NCBI GI: 90265235 NCBI Desc: h0322f07.7 [oryza sativa (indica cultivar-group)]
  misc_feature: Useful for making plants with altered Lignin content
  misc_feature: Useful for making plants with altered terpenoid content
  misc_feature: Functional homolog of the protein sequence given in SEQ ID NO 12932
  misc_feature: GREAT-hit functional homolog of the protein sequence given in SEQ ID NO 13062
  misc_feature: GREAT-hit functional homolog of the protein sequence given in SEQ ID NO 13105
  misc_feature: Useful for making plants with altered lignin content
  misc_feature: Functional homolog of the protein sequence given in SEQ ID NO 13105
MGANGHPPPASTAAQNGSHSGGGGGGGGGGGGGANPSNGGTAAALRHDPGLAREWSPEEQAILDELLVKYASDLPVVRYAKIAMKLPEKTVRDVALRCRWMNKKESAKRKKEDHSSSKKSKDKKEKVSDSSSKPPVHMAGRPSVPPYPLPVLPMDDDEISSKAIGGPTGEILETNAQVLSQISSNLSNMQIQDNISLLCQTRDNILRVLKEINDAPEIMKQMPPLPVKINEDLVNSLLPRPTVPMQ

SEQ ID NO: 6231 - DNA, 1152 bp, Sorghum bicolor
  misc_feature: Ceres ANNOT ID no. 6064741
  misc_feature: Encodes the peptide sequence at SEQ ID NO 6232
atggcggcctcttccgggacgacgacgcgctccgtgcgcctgctgctgctctccctgctcggcttctgcgtcgcgctgagccaccaggagtcgtcgtcgtcgtccacggactcgtgcgccacggccaaggtcgccgtcgccagcctcgtgcccttcgactccacctccttccgctgcaccgccgcctggaagcagcaggacttcgtcctcaggtacaagaacacggggcccagcgagtggagcttcatcctctcggcgccggacaagggctcgtacgtggcggtcggcttctcgggcaagggcgccatggtcgggagcagcgccgtcgtcgggtgggcgtccaacggcaagggcaccgtcaagcagtactacctcggcggcaagagccccgaggactgcgccccgaacaagggactcctcaagctcgtcaagaacaggtccgtcgtcgtctcgcgctcggggcgcctctacgtcgccttccagctcagcaccgactacccgcagccgtacctgatcttcgccgtcgggcccgacggcaacctgccgcagtccgactccctgcggctgccgatgcaccagaacatggcctcccgctccttcaactacacctccgggatgtcttacaacaccgccggctcgtccggcgaccaggcggcgttcccgacggagaggaagcacgggctgctgggcatgatggggtggggcgtgctgatgcccatcggcatgatcaccgcgcgctacttccggcagctggacccgtgctggttctacacccacatggccatccaggtgtgcggctacgccatcggcatcgcgggcatcgtcctcggcttccgcatcaacgaggacgggctcaagaacgtggacgtgcacaaggcgctcggcatcgccgtcttggccatggcgtctcttcaggtgctggcgatcctggcgcggccggacaagacgtccaaggtgcggcggttctggaactggtaccaccacaacatcggccgcgcgacgatcctgctggccatcggcaacatcttcctgggcctgtccatcgcgcaggaggtcagcgcctacgtcgtctcctacggcgtgttcgtcgccgtgtgggtggtcgccgtcgccgccttcgagatgaagcggtgctacgccgacgacgactga

SEQ ID NO: 6232 - protein, 383 aa, Sorghum bicolor
  misc_feature: Ceres ANNOT ID no. 6064741
  misc_feature (66)..(176): Pfam Id: DOMON Pfam Desc: DOMON domain
  misc_feature (16)..(376): NCBI GI: 21952847 NCBI Desc: p0696g06.19 [oryza sativa (japonica cultivar-group)]
  misc_feature (10)..(214): NCBI GI: 115441589 NCBI Desc: os01g0895200 [oryza sativa (japonica cultivar-group)]
  misc_feature (10)..(214): NCBI GI: 21952844 NCBI Desc: p0696g06.16 [oryza sativa (japonica cultivar-group)]
  misc_feature (103)..(376): NCBI GI: 57899814 NCBI Desc: membrane protein-like [oryza sativa (japonica cultivar-group)]
  misc_feature (10)..(375): NCBI GI: 21644691 NCBI Desc: membrane protein-like [oryza sativa (japonica cultivar-group)]
MAASSGTTTRSVRLLLLSLLGFCVALSHQESSSSSTDSCATAKVAVASLVPFDSTSFRCTAAWKQQDFVLRYKNTGPSEWSFILSAPDKGSYVAVGFSGKGAMVGSSAVVGWASNGKGTVKQYYLGGKSPEDCAPNKGLLKLVKNRSVVVSRSGRLYVAFQLSTDYPQPYLIFAVGPDGNLPQSDSLRLPMHQNMASRSFNYTSGMSYNTAGSSGDQAAFPTERKHGLLGMMGWGVLMPIGMITARYFRQLDPCWFYTHMAIQVCGYAIGIAGIVLGFRINEDGLKNVDVHKALGIAVLAMASLQVLAILARPDKTSKVRRFWNWYHHNIGRATILLAIGNIFLGLSIAQEVSAYVVSYGVFVAVWVVAVAAFEMKRCYADDD

SEQ ID NO: 6233 - DNA, 819 bp, Sorghum bicolor
  misc_feature: Ceres ANNOT ID no. 6064753
  misc_feature: Encodes the peptide sequence at SEQ ID NO 6234
atgccaaactcgccaacgatgctgacggttctggctctcgggctagcgctcctcagcgccgcaggtccggccaccgcgcagaactgcagctgcccgccaggctactgctgcagccagttcggttactgcggcacgagcttcgactactgcaacggcaacacgtgccagtccggcccctgcacgggatccggcggtagcagcggcgcgaacgtaagcggcgtcgtcaccgacgcatttttcaacggcatcaagtcccaggccgggagcgggtgcgagggcagtaacttctactcgcggagggcgttcctgcgcgctgccagcagctcgtaccccgccttcgcccatggcggcacggaagccgacggcaagcgcgagatcgccgccttcttcgcgcacgtcacgcacgagacccgacatctctgctacataagcgagatcaacgagaacagcgcctactgcaactcgagcaacgcacaatggccgtgcgccccggggaagaagtactacgggcgcggcccgctgcagatctcgtggaactacaactacggtcctgccgggagggagatcggcttcgacgggctcgggaacccggacatggtggcgcaggaccccgtgatcgcgttcaagacggcgctctggttctggatgaacaacgtgcacggggtgatgccgcaagggttcggcgccaccatcagggccatcgacggcgccctcgagtgcaacggaaacaaccctgcgcaaatgaacgcgcgggtgggctactacaagcagtactgccagcagttcggcgtcgacccggggaacagtctcacctgctag

SEQ ID NO: 6234 - protein, 272 aa, Sorghum bicolor
  misc_feature: Ceres ANNOT ID no. 6064753
  misc_feature (74)..(272): Pfam Id: Glyco_hydro_19 Pfam Desc: Chitinase class I
  misc_feature (26)..(60): Pfam Id: Chitin_bind_1 Pfam Desc: Chitin recognition protein
  misc_feature (1)..(272): NCBI GI: 48093326 NCBI Desc: chitinase [zea mays subsp. parviglumis]
  misc_feature (1)..(272): NCBI GI: 48093330 NCBI Desc: chitinase [zea mays subsp. parviglumis]
  misc_feature (1)..(272): NCBI GI: 48093328 NCBI Desc: chitinase [zea mays subsp. parviglumis]
  misc_feature (1)..(272): NCBI GI: 48093316 NCBI Desc: chitinase [tripsacum dactyloides]
  misc_feature (1)..(272): NCBI GI: 48093340 NCBI Desc: chitinase [zea mays subsp. parviglumis]
  misc_feature (1)..(272): SWISSPROT Homolog: EC 3.2.1.14 Endochitinase A precursor
  misc_feature: The sequence is a functional homolog of SEQ ID NO 12 in US patent 7087810
MPNSPTMLTVLALGLALLSAAGPATAQNCSCPPGYCCSQFGYCGTSFDYCNGNTCQSGPCTGSGGSSGANVSGVVTDAFFNGIKSQAGSGCEGSNFYSRRAFLRAASSSYPAFAHGGTEADGKREIAAFFAHVTHETRHLCYISEINENSAYCNSSNAQWPCAPGKKYYGRGPLQISWNYNYGPAGREIGFDGLGNPDMVAQDPVIAFKTALWFWMNNVHGVMPQGFGATIRAIDGALECNGNNPAQMNARVGYYKQYCQQFGVDPGNSLTC

SEQ ID NO: 6235 - DNA, 483 bp, Sorghum bicolor
  misc_feature: Ceres ANNOT ID no. 6064763
  misc_feature: Encodes the peptide sequence at SEQ ID NO 6236
atgatgatggctgaggtggccaaccacagcaaaaggaaccacaccgacagctacttcagtggcaaagccgccgccgtcgccgtcgcggccaccggcccagaggagttcgcaagcatgtcctcgaagaagccgaggaataccagcccgagaatcgcgcccgtatcaccaaaggagaagaaggacaagatcggcgagagagtcgcggcgctccagcagctagtgtcaccatttggaaagaccgatacggcttctgttctgcaggaagcatcgggctacatcaagttcctgcaccagcaactcgaggtcctgagctccccttacatgcgtgctcctccggctcccggcgctgtgcctgaggaccccgagcactacagcctccggaaccgcgggctgtgcctggtgccggtggacctgacgctgcagctgacccagagcaatggggccgacctgtgggcgccggcgaacacgaccaggcgcaggtga

SEQ ID NO: 6236 - protein, 160 aa, Sorghum bicolor
  misc_feature: Ceres ANNOT ID no. 6064763
  misc_feature (57)..(156): NCBI GI: 21593443 NCBI Desc: er33 protein [arabidopsis thaliana]
  misc_feature (34)..(158): NCBI GI: 5669656 NCBI Desc: er33 protein [lycopersicon esculentum]
  misc_feature (36)..(157): NCBI GI: 140070027 NCBI Desc: helix-loop-helix dna-binding [medicago truncatula]
  misc_feature (33)..(108): NCBI GI: 140051379 NCBI Desc: helix-loop-helix dna-binding [medicago truncatula]
  misc_feature (31)..(108): NCBI GI: 50252498 NCBI Desc: ethylene-responsive family protein-like [oryza sativa (japonica cultivar-group)]
  misc_feature: The sequence is a functional homolog of SEQ ID NO 16 in the 10/412,699US patent application
  misc_feature: The sequence is a functional homolog of SEQ ID NO 1658 in the 10/374,780US patent application
  misc_feature: The sequence is a functional homolog of SEQ ID NO 1679 in the 10/412,699US patent application
  misc_feature: Useful for making plants with altered Lignin content
  misc_feature: Useful for making plants with modulated growth and phenotype characteristics
  misc_feature: Useful for making plants with modulated nitrogen use efficiency
  misc_feature: Useful for making plants with modulated heat sensitivity
  misc_feature: GREAT-hit functional homolog of the protein sequence given in SEQ ID NO 12956
  misc_feature: GREAT-hit functional homolog of the protein sequence given in SEQ ID NO 13154
  misc_feature: The sequence is a functional homolog of SEQ ID NO 16 in the 20040045049 US patent application
  misc_feature: The sequence is a functional homolog of SEQ ID NO 1679 in the 20040045049 US patent application
  misc_feature: Useful for making plants with modulated heat sensitivity
  misc_feature: Functional homolog of the protein sequence given in SEQ ID NO 12956
  misc_feature: Useful for making plants with altered lignin content
  misc_feature: Useful for making plants with modulated nitrogen use efficiency
  misc_feature: Functional homolog of the protein sequence given in SEQ ID NO 13645
  misc_feature: The sequence is a functional homolog of SEQ ID NO 564 in the 10/666,642 US patent application
MMMAEVANHSKRNHTDSYFSGKAAAVAVAATGPEEFASMSSKKPRNTSPRIAPVSPKEKKDKIGERVAALQQLVSPFGKTDTASVLQEASGYIKFLHQQLEVLSSPYMRAPPAPGAVPEDPEHYSLRNRGLCLVPVDLTLQLTQSNGADLWAPANTTRRR

SEQ ID NO: 6237 - DNA, 807 bp, Sorghum bicolor
  misc_feature: Ceres ANNOT ID no. 6064765
  misc_feature: Encodes the peptide sequence at SEQ ID NO 6238
atgaggatccagtgcgacgcgtgcgaggccgcggcagccacggtggtgtgctgcgccgacgaggcggcgctgtgcgcgcgctgcgacgtcgagatccacgccgccaacaagctcgccagcaagcaccagcggctcccgctcgcgctcggcgacgccaccgccgccagcgccagcagcctcccgcgctgcgacgtctgccaggagaagccggccttcatcttctgcgtcgaggacagggcgctcttctgccgcgactgcgacgagcccatccacgtccccggcacgctctccggcaaccaccagcgctacctcgccaccggcatccgcgtcggcttcagctccgtctgcggcgccggcgccggcgctgagggcctcccgccgccggcgccgcccaagggcagctccaagcccgcggccgtcgtcagcgcgccagctgccggggccaccaagacaacgacgacggtcaaggacacgctgccgcaggaggtgccgtcgtcgccgttcctgccaccgtccggttgggctgtcgaggacctcctgcagctgtccgactacgaatccagcgacaagaaagactcgcctcttgggttcaaggagctggagtggttcgcggacatcgacctgttccacgcccattcgcccgctaaaaccactacggcggaggtccccgagttgttcgcctcgccgcagccagcgagcaacgccgggttctacaagacgaacggagtagcgcgccagagcaagaagccacggatggaggtgcctgaggacgacgaggactacttcatcgttcctgatcttggctga

SEQ ID NO: 6238 - protein, 268 aa, Sorghum bicolor
  misc_feature: Ceres ANNOT ID no. 6064765
  misc_feature (1)..(47): Pfam Id: zf-B_box Pfam Desc: B-box zinc finger
  misc_feature (58)..(105): Pfam Id: zf-B_box Pfam Desc: B-box zinc finger
  misc_feature (1)..(268): NCBI GI: 90265170 NCBI Desc: h0522a01.9 [oryza sativa (indica cultivar-group)]
  misc_feature (1)..(268): NCBI GI: 38346228 NCBI Desc: oj990528_30.8 [oryza sativa (japonica cultivar-group)]
  misc_feature (1)..(268): NCBI GI: 47497925 NCBI Desc: zinc finger protein [oryza sativa (japonica cultivar-group)]
  misc_feature (1)..(159): NCBI GI: 78173056 NCBI Desc: salt-tolerance protein [glycine max]
  misc_feature (1)..(190): NCBI GI: 30679541 NCBI Desc: zinc finger (b-box type) family protein / salt-tolerance protein (sto) [arabidopsis thaliana]
  misc_feature: The sequence is a functional homolog of SEQ ID NO 1023 in the 10/666,642US patent application
  misc_feature: The sequence is a functional homolog of SEQ ID NO 1024 in the 10/666,642US patent application
  misc_feature: The sequence is a functional homolog of SEQ ID NO 16 in the 10/412,699US patent application
  misc_feature: The sequence is a functional homolog of SEQ ID NO 1645 in the 10/374,780US patent application
  misc_feature: The sequence is a functional homolog of SEQ ID NO 1646 in the 10/374,780US patent application
  misc_feature: The sequence is a functional homolog of SEQ ID NO 1671 in the 10/412,699US patent application
  misc_feature: The sequence is a functional homolog of SEQ ID NO 1672 in the 10/412,699US patent application
  misc_feature: The sequence is a functional homolog of SEQ ID NO 465 in the 11/479,226US patent application
  misc_feature: Useful for making plants with modulated growth and phenotype characteristics
  misc_feature: The sequence is a functional homolog of SEQ ID NO 16 in the 20040045049 US patent application
  misc_feature: The sequence is a functional homolog of SEQ ID NO 1671 in the 20040045049 US patent application
  misc_feature: The sequence is a functional homolog of SEQ ID NO 1672 in the 20040045049 US patent application
  misc_feature: The sequence is a functional homolog of SEQ ID NO 465 in the 20070022495 US patent application
  misc_feature: The sequence is a functional homolog of SEQ ID NO. 370 in the 11/188,298 US application
MRIQCDACEAAAATVVCCADEAALCARCDVEIHAANKLASKHQRLPLALGDATAASASSLPRCDVCQEKPAFIFCVEDRALFCRDCDEPIHVPGTLSGNHQRYLATGIRVGFSSVCGAGAGAEGLPPPAPPKGSSKPAAVVSAPAAGATKTTTTVKDTLPQEVPSSPFLPPSGWAVEDLLQLSDYESSDKKDSPLGFKELEWFADIDLFHAHSPAKTTTAEVPELFASPQPASNAGFYKTNGVARQSKKPRMEVPEDDEDYFIVPDLG

SEQ ID NO: 6239 - DNA, 1434 bp, Sorghum bicolor
  misc_feature: Ceres ANNOT ID no. 6064766
  misc_feature: Encodes the peptide sequence at SEQ ID NO 6240
atggccagccgtctcttccttctccggcggcacacaaggttgtggcggcgacaggaaccacggtctcgctcgctttgcccatcgtcttacggtgggagcttggcgtcttcccatgggacgctggagctgctcgcttatactttccacaaggttttcaaccgagatgctgggttcttcagttggttgcaaagttgtaacattcaagcctaccattgtattcatacaagtcggtcagtcaatagtggaaatcaggctactgcagggcctcaacaaaatccaggagtgtctgtaccagttgatgaatctagtgaactaaaacccaagaggaaaaaactgaaaggaaggagggcagtaacaagatttttgaaatccttgagatggaaaaagaaaaaggagattcaaagaatgactgcagaggagaagattttgtacaaactgaagctagctcgaaagaaggaagagcggcttgttgcagcactgaaaaaaattgaaccagaagatccatcagaacctacacatgatcctgaggtgcttacacctgaagagcacttctatttcctcaagatgggccaaaaatgtaaaaattatgtgcctgttggaagacgtggaatttaccagggagtgatcttgaacatgcacttgcattggaaaaagcatcaaactctccaggtaattgtgaaaacattcacaccagaggaggtcaaggaaatcgccactgagttagccagactaagtggtgggattgtgcttgacattcaagatgggaacacaattatcatgtacagagggaaaaactatgcacagccaccaccagaaatcatgtctccaaaagtttcactctctaggaaaaaggcactggataaatccaaatatatggaaaagctcagagctcttaggcggtacattcccaggcttgagcaggagcttgaagatcttcatgcgcagatgaagttagctggagagcataaaggacaaagtgtagggaaacatattgcttcaatttcacacgatacaaacagtgtgccagcgagaaaagaaccttgtagttcagttcacagcaaaaccgtatctgatctcctgtcaggaagtgtagagggatccaagaggttagaggatgaaagttctgaggttgaggacgactcagcttcggagtctttgtcattttcagagtctgaggatctctctgacatttttgagacagaatcagaggagcaggaagaggacaagaaggatcaccccctgtatctcgataggctggataagtttccctcagaaaaaaatgataatgaaccagatgatttcgaggagcatctacggaagatcgcttcactttcagataagactgattcaccttcgaaagaactgaaagtgtcagagctcgatgagattgataaaatctttctgcgagctagttcattgttgaagaaaaggtga

SEQ ID NO: 6240 - protein, 477 aa, Sorghum bicolor
  misc_feature: Ceres ANNOT ID no. 6064766
  misc_feature (178)..(262): Pfam Id: CRS1_YhbY Pfam Desc: CRS1 / YhbY domain
  misc_feature (1)..(477): NCBI GI: 90265163 NCBI Desc: h0522a01.2 [oryza sativa (indica cultivar-group)]
  misc_feature (1)..(477): NCBI GI: 38346227 NCBI Desc: oj990528_30.7 [oryza sativa (japonica cultivar-group)]
  misc_feature (1)..(477): NCBI GI: 115459160 NCBI Desc: os04g0492900 [oryza sativa (japonica cultivar-group)]
  misc_feature (106)..(354): NCBI GI: 89212802 NCBI Desc: cfm6 [zea mays]
  misc_feature (104)..(386): NCBI GI: 57900276 NCBI Desc: group ii intron splicing factor crs1-like [oryza sativa (japonica cultivar-group)]
MASRLFLLRRHTRLWRRQEPRSRSLCPSSYGGSLASSHGTLELLAYTFHKVFNRDAGFFSWLQSCNIQAYHCIHTSRSVNSGNQATAGPQQNPGVSVPVDESSELKPKRKKLKGRRAVTRFLKSLRWKKKKEIQRMTAEEKILYKLKLARKKEERLVAALKKIEPEDPSEPTHDPEVLTPEEHFYFLKMGQKCKNYVPVGRRGIYQGVILNMHLHWKKHQTLQVIVKTFTPEEVKEIATELARLSGGIVLDIQDGNTIIMYRGKNYAQPPPEIMSPKVSLSRKKALDKSKYMEKLRALRRYIPRLEQELEDLHAQMKLAGEHKGQSVGKHIASISHDTNSVPARKEPCSSVHSKTVSDLLSGSVEGSKRLEDESSEVEDDSASESLSFSESEDLSDIFETESEEQEEDKKDHPLYLDRLDKFPSEKNDNEPDDFEEHLRKIASLSDKTDSPSKELKVSELDEIDKIFLRASSLLKKR

SEQ ID NO: 6241 - DNA, 1770 bp, Sorghum bicolor
  misc_feature: Ceres ANNOT ID no. 6064775
  misc_feature: Encodes the peptide sequence at SEQ ID NO 6242
  misc_feature: Up-regulated in shoot tissues in response to salicylic acid treatment
atggaatccgaggacgacatgcacgacgcgaacgattccgccgaagacgacttctacagcggcggggaggctggtctcgccgccagcgacgacggagacgccgactacgacttcgcggaccacgactccgacgactccgcggaactcctctcccacagacagcagcaaaattacagtatattgagtgaagttgatataaagcggcgccaagaggatgacataaatagggtttcaactgttctttcaatttccaaaccagaagcatgtgttcttctccgcaactataactggagtgttagtaaggtgcatgacgaatggtttgctgatgaagagcgtgttcggaaggttgttggtttaccagagaagcataatgaaatgccaaatgacagagaagtaacatgtggaatatgtttcgaaagttgccctcgtgggtccatgagtgctgctgcatgtggtcatcctttctgcggtacatgttggagaggttacattagcactgctataagtgatggtccaggatgcttgatgttgaggtgtcctgatccatcctgtgctgctgctgttggacaagatatgataaattcactggctgatgatgaggataaggaaaagtatgggcgatatctttgcagatcttacattgaagataatagaaagacaaaatggtgtcctgcacctggatgcgaatatgcagtggaattcgtcatgggcagtggcagctatgatgttaattgcaactgttcatatgggttttgttggaattgcaccgaggaagcgcatcgtccagtagactgtgccactgtttcgaagtggatcctcaagaacagtgccgagtcagagaatatgaactggatactggctaattcaaagccttgtcccaaatgcaagcgtcctattgaaaaaaatcagggatgcatgcacatcacatgcactccaccatgcaaatttgagttctgctggctatgtcttggtccatggtcagagcatggagagaggactggtggattttatgcttgcaaccgctatgagtcagcaaggcaagaaggagcgtatgatgaatctgaaaggagaagagaaatggcaaagaactctcttgagagatatacacattattatgaacgatgggcagccaatcagtcgtcgaggcaaaaggcactgggggaccttcaaagcctacagaatgacaagcttgaaaagttaagtgacatacaaagtcaacctgagtcacagctgaagttcattatagaggcatggttacagattgtcgaatgcagaagggtattgaagtggacttatgcctatggattttacctgccagagcatgagcatgccaaaagacagttctttgaatatctgcaaggtgaggcagaatcaggtttggagcggctacatcagtgtgcagagaaagaacttcaaatataccttgacgcagaatgtccctcgaaagacttcaatgatttccgtacaaagttggctggattaactagtgtgactcgcaattattttgaaaatctcgtccgggctctggaaactggattaaatgatgtaggtccttccactagccatggcacatgcagtaaaagtgcaacttccaagagccttggtggtaaaagtaagagtggcaagaacagggcatcaagcaccagttccaaatctggcggctcaagccgaggtggggatgatagtaatatctggacgtgcgatcagtgcacatatgcaaaccccagatctgccagagcctgccaggcttgtgatcgccagcatcgatag

SEQ ID NO: 6242 - protein, 589 aa, Sorghum bicolor
  misc_feature: Ceres ANNOT ID no. 6064775
  misc_feature (203)..(265): Pfam Id: IBR Pfam Desc: IBR domain
  misc_feature (1)..(589): NCBI GI: 38347453 NCBI Desc: osjnba0076n16.22 [oryza sativa (japonica cultivar-group)]
  misc_feature (1)..(589): NCBI GI: 116310337 NCBI Desc: osigba0130b08.12 [oryza sativa (indica cultivar-group)]
  misc_feature (118)..(589): NCBI GI: 115459148 NCBI Desc: os04g0492100 [oryza sativa (japonica cultivar-group)]
  misc_feature (14)..(585): NCBI GI: 3335347 NCBI Desc: contains similarity to ari, ring finger protein gbx98309 from drosophila melanogaster. ests gbt44383, gbw43120, gbn65868, gbh36013, gbaa042241, gbt76869 and gbaa042359 come from
  misc_feature (14)..(585): NCBI GI: 3335347 (continued) this gene. [arabidopsis thaliana]
  misc_feature (1)..(562): NCBI GI: 29125028 NCBI Desc: ariadne-like protein ari7 [arabidopsis thaliana]
  misc_feature: The sequence is a functional homolog of SEQ ID NO 1727 in the 10/374,780US patent application
  misc_feature: The sequence is a functional homolog of SEQ ID NO 546 in the 11/435,388US patent application
  misc_feature: Useful for making plants with modulated growth and phenotype characteristics
  misc_feature: The sequence is a functional homolog of SEQ ID NO 1727 in the 20060162006 US patent application
  misc_feature: The sequence is a functional homolog of SEQ ID NO 546 in the 20060272060 US patent application
  misc_feature: The sequence is a functional homolog of SEQ ID NO 546 in the 11/435,388 US patent application
  misc_feature: Up-regulated in shoot tissues in response to salicylic acid treatment
  misc_feature: The sequence is a functional homolog of SEQ ID NO. 493 in the 11/188,298 US application
MESEDDMHDANDSAEDDFYSGGEAGLAASDDGDADYDFADHDSDDSAELLSHRQQQNYSILSEVDIKRRQEDDINRVSTVLSISKPEACVLLRNYNWSVSKVHDEWFADEERVRKVVGLPEKHNEMPNDREVTCGICFESCPRGSMSAAACGHPFCGTCWRGYISTAISDGPGCLMLRCPDPSCAAAVGQDMINSLADDEDKEKYGRYLCRSYIEDNRKTKWCPAPGCEYAVEFVMGSGSYDVNCNCSYGFCWNCTEEAHRPVDCATVSKWILKNSAESENMNWILANSKPCPKCKRPIEKNQGCMHITCTPPCKFEFCWLCLGPWSEHGERTGGFYACNRYESARQEGAYDESERRREMAKNSLERYTHYYERWAANQSSRQKALGDLQSLQNDKLEKLSDIQSQPESQLKFIIEAWLQIVECRRVLKWTYAYGFYLPEHEHAKRQFFEYLQGEAESGLERLHQCAEKELQIYLDAECPSKDFNDFRTKLAGLTSVTRNYFENLVRALETGLNDVGPSTSHGTCSKSATSKSLGGKSKSGKNRASSTSSKSGGSSRGGDDSNIWTCDQCTYANPRSARACQACDRQHR

SEQ ID NO: 6243 - DNA, 1521 bp, Sorghum bicolor
  misc_feature: Ceres ANNOT ID no. 6064777
  misc_feature: Encodes the peptide sequence at SEQ ID NO 6244
atgacgatcgacatgtccatgcccgggagctccgggctcctgaacgctgcggggaagagggacatgaagttcttcagcaacccctacgttcttgcgctcacgggcgctgcaggaatcggtggattcctctttggctacgacacaggtgtcatatctggggcccttctgtatatccgtgatgattttccagcggtcagggataattacttcttacaggaaacgattgttagcatggccttagtcggagctatgcttggagctgctgggggtggttggatcaatgatgcatatggtcgcaagaagtccactcttcttgctgatatgatgtttgctcttggctcacttgtcatgtgtgctgctgctggtccttacattctaattattggaaggctcctcgttggtttgggtgtgggtgttgcatcagtcacggcaccagtatacattgctgaagctgctccttcagaaatcaggggaggtttggtgtcaactaatgtactcatgattactggtggccaattcttctcctatcttatcaatctcggctttactgaggttcctggaacatggcgctggatgcttggtgttgctgctgtccctgccattgtacagtttgtgctgatgctttttctgccagaatctccccgttggctttactggaaggatgagaaggcaaaagctattgctgtccttgagaagatctatgactctgatcgtttggaggaagaggtagagctgcttgcttcatcctccatgcatgaattccagtccaacaatgctggaagctatttggatgtcttcaagtcaaaagaattgaggctagctttctttgctggggctggtcttcaggccttccagcaatttactgggatcaacaccgtcatgtattacagccccacgatagtccagatggctggtttctcttccaacaggttggccttgcttctttccctcatcgtcgctgccatgaatgccgctgggaccattgttggaatctacctaatcgaccgttgcggccgccgccgcctggcccttacaagcttgtctggggttgtgatctcccttgtcattcttgccttggccttcatactgcagtcatcatccggcctctgcatgagtgctgctaatggcacatgccaaggcgtgctaggctggttcgcggtggcaggccttgctctgtacatcgccttcttctctccaggcatggggcctgtcccatgggctgtgaactcggaaatctaccctgaggcataccgtggaatgtgcggtggcatgtcggccactgtcaactggatctctaacctcatcgtggcacagacgttcctgtcgatcgtggggctggtcgggactggtccgaccttcctgatcattgccgggatcgcggtgctcgccttcatcttcgtggccatgtacgtgccagagacgaagggcttgagctttgagcaggtggagcagatgtggaaggagagagcgtgggggaacagcggcaactgccagagacttttgggtgctgctgcgccgtag

SEQ ID NO: 6244 - protein, 506 aa, Sorghum bicolor
  misc_feature: Ceres ANNOT ID no. 6064777
  misc_feature (33)..(486): Pfam Id: Sugar_tr Pfam Desc: Sugar (and other) transporter
  misc_feature (37)..(437): Pfam Id: MFS_1 Pfam Desc: Major Facilitator Superfamily
  misc_feature (1)..(504): NCBI GI: 38347452 NCBI Desc: osjnba0076n16.21 [oryza sativa (japonica cultivar-group)]
  misc_feature (1)..(504): NCBI GI: 116310336 NCBI Desc: osigba0130b08.11 [oryza sativa (indica cultivar-group)]
  misc_feature (1)..(505): NCBI GI: 126635785 NCBI Desc: sugar transporter protein [ananas comosus]
  misc_feature (1)..(501): NCBI GI: 92896786 NCBI Desc: major facilitator superfamily [medicago truncatula]
  misc_feature (2)..(502): NCBI GI: 140070526 NCBI Desc: general substrate transporter [medicago truncatula]
  misc_feature: The sequence is a functional homolog of SEQ ID NO. 331 in the 11/188,298 US application
  misc_feature: The sequence is a functional homolog of SEQ ID NO. 449 in the 11/188,298 US application
  misc_feature: The sequence is a functional homolog of SEQ ID NO. 488 in the 11/188,298 US application
  misc_feature: The sequence is a functional homolog of SEQ ID NO. 296 in the 11/188,298 US application
MTIDMSMPGSSGLLNAAGKRDMKFFSNPYVLALTGAAGIGGFLFGYDTGVISGALLYIRDDFPAVRDNYFLQETIVSMALVGAMLGAAGGGWINDAYGRKKSTLLADMMFALGSLVMCAAAGPYILIIGRLLVGLGVGVASVTAPVYIAEAAPSEIRGGLVSTNVLMITGGQFFSYLINLGFTEVPGTWRWMLGVAAVPAIVQFVLMLFLPESPRWLYWKDEKAKAIAVLEKIYDSDRLEEEVELLASSSMHEFQSNNAGSYLDVFKSKELRLAFFAGAGLQAFQQFTGINTVMYYSPTIVQMAGFSSNRLALLLSLIVAAMNAAGTIVGIYLIDRCGRRRLALTSLSGVVISLVILALAFILQSSSGLCMSAANGTCQGVLGWFAVAGLALYIAFFSPGMGPVPWAVNSEIYPEAYRGMCGGMSATVNWISNLIVAQTFLSIVGLVGTGPTFLIIAGIAVLAFIFVAMYVPETKGLSFEQVEQMWKERAWGNSGNCQRLLGAAAP

SEQ ID NO: 6245 - DNA, 1218 bp, Sorghum bicolor
  misc_feature: Ceres ANNOT ID no. 6064792
  misc_feature: Encodes the peptide sequence at SEQ ID NO 6246
atgcaaaggaatggcgtgctggaatgcagcgtttgtcactccaaggtggcagttccgagccccaggagtgtgtcgagggcctatgacaagcaccgcagcaagatatcatccaagtaccgtgcacttaatgtccttctcgtgtctggggactgcatcttggttggcctccagcctatcctggtcttcatgtcgaaggttgatgggaagtttcagttcagtcctatcagcgttaactttttgacagaggttgcaaaagttatttttgccattgtaatgctagtaatcgagtctagaaaacaaaaggtgggggagaagccgcttctgtcactttctacctttgtacaggcagctcgtaataatgtactcttagctgttccggctctcctatatgccatcaacaactacctaaagtttatcatgcagttatacttcaacccctcaactgtgaagatgctaagcaacctgaaggtgctggtaattgctgttctcctaaaagttattatgagaagaaaattctctataattcagtgggaagcccttgcactattgcttattggtatcagcgtcaatcaactacgctctatacctgagggaaccaatgcttttggccttccagtcaccgctattgcatacgcatatacgctaatttttgtttctgtcccatcatttgcctctgtctacaatgagtacgctctaaaaagccagtttgatacaagcatataccttcagaatttgttcttatatggttatggtgcaattttcaacttccttggcatcttagggactgtcatatttcaaggcccagagagttttgatatctttcgagggcattcgagggcaacactgtttctcatttgtaacaatgctgctcaaggcattctctcctctttcttcttcaagtatgcagacactattttgaagaagtactcatctactgttgccacaattttcactggtctagcttcagctgcatttttggggcaacccttgaccgttaactttctcttaggcatctcaatagtatttatttcaatgcaccagtttttctctccactagcaaaagtcaaggatgaaaagccagctggaacagttgagctgggagattcacaaaatcataggtcctctgagtcttcttttgtaaatatgactgccggtgccactgatgatgcaaggcatcttaacgcaactgatgagagaaaaccactgctgccaatttga

SEQ ID NO: 6246 - protein, 405 aa, Sorghum bicolor
  misc_feature: Ceres ANNOT ID no. 6064792
  misc_feature (105)..(341): Pfam Id: Nuc_sug_transp Pfam Desc: Nucleotide-sugar transporter
  misc_feature (1)..(405): NCBI GI: 38347446 NCBI Desc: osjnba0076n16.10 [oryza sativa (japonica cultivar-group)]
  misc_feature (1)..(405): NCBI GI: 116310326 NCBI Desc: osigba0130b08.1 [oryza sativa (indica cultivar-group)]
  misc_feature (4)..(390): NCBI GI: 140070518 NCBI Desc: nucleotide-sugar transporter [medicago truncatula]
  misc_feature (4)..(405): NCBI GI: 56784333 NCBI Desc: plrr-4 polymorphic leucine-rich repeat protein-like [oryza sativa (japonica cultivar-group)]
  misc_feature (1)..(271): NCBI GI: 115459130 NCBI Desc: os04g0490600 [oryza sativa (japonica cultivar-group)]
MQRNGVLECSVCHSKVAVPSPRSVSRAYDKHRSKISSKYRALNVLLVSGDCILVGLQPILVFMSKVDGKFQFSPISVNFLTEVAKVIFAIVMLVIESRKQKVGEKPLLSLSTFVQAARNNVLLAVPALLYAINNYLKFIMQLYFNPSTVKMLSNLKVLVIAVLLKVIMRRKFSIIQWEALALLLIGISVNQLRSIPEGTNAFGLPVTAIAYAYTLIFVSVPSFASVYNEYALKSQFDTSIYLQNLFLYGYGAIFNFLGILGTVIFQGPESFDIFRGHSRATLFLICNNAAQGILSSFFFKYADTILKKYSSTVATIFTGLASAAFLGQPLTVNFLLGISIVFISMHQFFSPLAKVKDEKPAGTVELGDSQNHRSSESSFVNMTAGATDDARHLNATDERKPLLPI

SEQ ID NO: 6247 - DNA, 777 bp, Sorghum bicolor
  misc_feature: Ceres ANNOT ID no. 6064794
  misc_feature: Encodes the peptide sequence at SEQ ID NO 6248
atggccctcctccttcgccgtggcgcggccctcgccgcccgctccttccgcgccgcggcggcctccgcttccaccaccgtgcgccgcctcccagccgggggatcccttgcgggcgccggggaattcgctccatcgaggctcttcgtcttcgagaaccgaagaggcttcgcgaaggggaagaaatcgaaggatgatcgaggtgacactgttcaagctgttcctgacattgggccgactgtcaaatcagctgccactgcacaaatggatgctgcagtgatcgcactgtcacgagagctgagcaaactacggactggaagagctactcctggcatgcttgaccatatcatggtggagaatgcaggtgttaaagttgcactgaatcgcattgccgttgtttctgtcctggatgcacataccctatcagtgatgccttatgatcctacttccatgaagtctattgagcatgctattatctcatcaccattgggcattaatccaacacctgatgggaataggattattgcagctatccctccgttgacgaaggagaatatacaggcactgtgcaaggttgttactaaatcagcagaggattttaaacaaagtattagaagagcacgccaaaaggcacttgatacaataaagaaatctgcatcaagtatgcccaaggatgatgtaaagaggattgagaaggaggttgaagaattgaccaagaagttcataaagtcagcagatgatatgtgcaaggctaaggagaaggaaatcagcggaagctga

SEQ ID NO: 6248 - protein, 258 aa, Sorghum bicolor
  misc_feature: Ceres ANNOT ID no. 6064794
  misc_feature (94)..(256): Pfam Id: RRF Pfam Desc: Ribosome recycling factor
  misc_feature (1)..(258): NCBI GI: 38347444 NCBI Desc: osjnba0076n16.8 [oryza sativa (japonica cultivar-group)]
  misc_feature (80)..(255): NCBI GI: 15614987 NCBI Desc: ribosome recycling factor [bacillus halodurans c-125]
  misc_feature (80)..(255): NCBI GI: 14195173 NCBI Desc: ribosome recycling factor
  misc_feature (80)..(255): NCBI GI: 60390232 NCBI Desc: ribosome recycling factor (ribosome releasing factor) (rrf)
  misc_feature (80)..(255): NCBI GI: 34924948 NCBI Desc: ribosome recycling factor (ribosome releasing factor) (rrf)
MALLLRRGAALAARSFRAAAASASTTVRRLPAGGSLAGAGEFAPSRLFVFENRRGFAKGKKSKDDRGDTVQAVPDIGPTVKSAATAQMDAAVIALSRELSKLRTGRATPGMLDHIMVENAGVKVALNRIAVVSVLDAHTLSVMPYDPTSMKSIEHAIISSPLGINPTPDGNRIIAAIPPLTKENIQALCKVVTKSAEDFKQSIRRARQKALDTIKKSASSMPKDDVKRIEKEVEELTKKFIKSADDMCKAKEKEISGS

SEQ ID NO: 6249 - DNA, 2310 bp, Sorghum bicolor
  misc_feature: Ceres ANNOT ID no. 6064795
  misc_feature: Encodes the peptide sequence at SEQ ID NO 6250
atggcagtgctgctgcgcccggcggcgatcgccggaggtcggcaggtgtggccggtggcagaggacgatgagggggcgcgcgaggcggaggcggcgtcgcagcggctggtggaggcggtggcgcgcggcgacgcgagggaggccggcgagctgctcgcagcggggcgcgcggacgtgaactacgccggggtggtgtggctcagggcgcggcgcatcgcggaagcggaaccccaggagggcgccgccgccgaggcgcgggccgtgcacgaggagatccgcgccgacgtctcgccgctcttcctcgcctccggcaacggcgacgtcgcgctcgtccgcgccttgctcgcaaagggagcggacgtgaacggcaaggtgttccggggctacccgacgacggctgcggcacgggaggggtgcgcagaggtggccgagctgcttgtgcgtgcgggtgcgtcgcagccggcctgcgaggaggccgtcgtggaggctgcgctgcagggccaggccgcgctcgcggccatcttcatgcgctcggacctcgtccgcccccgcgttgccgtccacgcgctcgtgtccgccgcggcgcgcggcttcgtcgacgtcgtcgacacgctcatcaagtgtggagctgatccaaacgcgaccgctcgggtgctcctgcgctcgctgaagccatccctgcatgccaacgtcgactgcacggcgctctttgccgcaatcgtgagccgtcaagtcgctgtggtccgccatctacttcaggccggcgtgaagagggacacgaaggtgaggctgggagcatggtcctgggacgcgtccaccggcgaggagctgcgcgtcggcgccggactcgccgagccttacgacgcggtatggtgcgccgtggagtactacgagtccacgggctccatcctgcgcatgctcctccgtagcgggtacacgtcggccactgcacacctcggccgcacgctcctccaccacgccatcctctgtggcagtgccggtgccgtccagaccttgctggcgtccggtgcagactccgaagctcccgtgaagacgtccaggagcaacaggtccaggccggttcacctggccgtgcgcctgggccagccggagatcctgcggatgctggtcgacaggggctgcgacgtgaacgcgagggcggacgccggcgacaccgccgccatcctctgttcgcgccacaaacgcgaggactgcctcggagttctcgtgtccgccggcgcagacgtcgcgctgttaaactcggctggcgactccccgtcctccgtggcctcctctgggggatggaagaccggcttcgaaagggctgtcattggcgcaattcggtccgggaccatcccacgctcgagcgatcggaacgtgttctcgccgctgatgttcggcgcgctgtgcggcgacgcgaccgcgatggaagtgctgctcgctcagtcagacgtggacgtggacgagcaggatctggacgggtgctcgcccataatggctgctgccaagatgggcaacgtcgaggccttccgtgccctcgtattcgccggcgccaacgtgaagctgagcaacaagcgcggcgagacggccattgggctggcgcagcagagcaagaagagggacctcttcgagcaggtcatgctcgagttcgcgctggagaagggcatgcctggaggcttctacgcgcttcactgcgcctcccgtcgcggcgacaccgcggcggtgcggcacctcgccagcacgggcggcgacgtgaatatccccgacggcgacggctacaccccgctgatgctcgcggccagggaaggccacgcgggcgtgtgtgagcttctcatctcctacggcgctcgctgcgacctccgcacgccgcgcggcgagacggcgctctccctggcgcgggcagcgctggccacggcggggttcaacaaggccgaggacgtgatcatggacgagctgggccggcaggcggtcctccagggcgcgcacgtcaggaagcacaccaagggcgggcgcgggaggcctcatggcaagtccctgcgcatggtcgctgcggcgggcgtgctcaggtggggcgggtcgaaccggcgcaacgtgatctgccgggaggccgaggtcggtggcagctcggcgttccagaggcacaggcagaggaagggagacgcgtatgagcacgggctgttccgtgtggtgactgcgacagggagggaggtgcacttcgtgtgccagggcggcgaggaggccgcggagctgtgggtgaggggcatcagggccgtgacaagggcggcgtttggcaagagaggcaaggagtga

SEQ ID NO: 6250 - protein, 769 aa, Sorghum bicolor
  misc_feature: Ceres ANNOT ID no. 6064795
  misc_feature (319)..(351): Pfam Id: Ank Pfam Desc: Ankyrin repeat
  misc_feature (356)..(388): Pfam Id: Ank Pfam Desc: Ankyrin repeat
  misc_feature (493)..(525): Pfam Id: Ank Pfam Desc: Ankyrin repeat
  misc_feature (558)..(590): Pfam Id: Ank Pfam Desc: Ankyrin repeat
  misc_feature (591)..(623): Pfam Id: Ank Pfam Desc: Ankyrin repeat
  misc_feature (116)..(769): NCBI GI: 115459124 NCBI Desc: os04g0490300 [oryza sativa (japonica cultivar-group)]
  misc_feature (28)..(760): NCBI GI: 92870431 NCBI Desc: ankyrin [medicago truncatula]
  misc_feature (176)..(760): NCBI GI: 7573448 NCBI Desc: ankyrin-like protein [arabidopsis thaliana]
  misc_feature (26)..(769): NCBI GI: 47497839 NCBI Desc: ankyrin 3, epithelial isoform a-like [oryza sativa (japonica cultivar-group)]
  misc_feature (1)..(116): NCBI GI: 38347442 NCBI Desc: osjnba0076n16.6 [oryza sativa (japonica cultivar-group)]
MAVLLRPAAIAGGRQVWPVAEDDEGAREAEAASQRLVEAVARGDAREAGELLAAGRADVNYAGVVWLRARRIAEAEPQEGAAAEARAVHEEIRADVSPLFLASGNGDVALVRALLAKGADVNGKVFRGYPTTAAAREGCAEVAELLVRAGASQPACEEAVVEAALQGQAALAAIFMRSDLVRPRVAVHALVSAAARGFVDVVDTLIKCGADPNATARVLLRSLKPSLHANVDCTALFAAIVSRQVAVVRHLLQAGVKRDTKVRLGAWSWDASTGEELRVGAGLAEPYDAVWCAVEYYESTGSILRMLLRSGYTSATAHLGRTLLHHAILCGSAGAVQTLLASGADSEAPVKTSRSNRSRPVHLAVRLGQPEILRMLVDRGCDVNARADAGDTAAILCSRHKREDCLGVLVSAGADVALLNSAGDSPSSVASSGGWKTGFERAVIGAIRSGTIPRSSDRNVFSPLMFGALCGDATAMEVLLAQSDVDVDEQDLDGCSPIMAAAKMGNVEAFRALVFAGANVKLSNKRGETAIGLAQQSKKRDLFEQVMLEFALEKGMPGGFYALHCASRRGDTAAVRHLASTGGDVNIPDGDGYTPLMLAAREGHAGVCELLISYGARCDLRTPRGETALSLARAALATAGFNKAEDVIMDELGRQAVLQGAHVRKHTKGGRGRPHGKSLRMVAAAGVLRWGGSNRRNVICREAEVGGSSAFQRHRQRKGDAYEHGLFRVVTATGREVHFVCQGGEEAAELWVRGIRAVTRAAFGKRGKE

SEQ ID NO: 6251 - DNA, 468 bp, Sorghum bicolor
  misc_feature: Ceres ANNOT ID no. 6064812
  misc_feature: Encodes the peptide sequence at SEQ ID NO 6252
atgtcaagggatccgctagtagtaggacatgtagtaggtgacattttggacccatttattaaaacagcctcacttaaggttctgtacaacaacaaggaactgaccaatggatctgagctcaagccatcacaagtagcaaatgaaccaagggtcgaaatcggagggcgcgacatgaggaacctttacactctggtgatggtggatccagactccccaagtccaagtaacccaacaaaaagagaataccttcattgctatgaaaacccaaagccaactgctggaatacatcgctttgtctttgtactcttccgccagtctgtccagcaaaccgtttatgcaccaggatggagacaaaatttcaacacgagagacttttctgcgctctataatcttggacctcctgtggctgcagtgttcttcaattgccaaagggagaatgggtgcggaggcagacgatatattagataa

SEQ ID NO: 6252 - protein, 155 aa, Sorghum bicolor
  misc_feature: Ceres ANNOT ID no. 6064812
  misc_feature (17)..(143): Pfam Id: PBP Pfam Desc: Phosphatidylethanolamine-binding protein
  misc_feature (1)..(84): NCBI GI: 38344240 NCBI Desc: oj991113_30.17 [oryza sativa (japonica cultivar-group)]
  misc_feature (70)..(152): NCBI GI: 115503902 NCBI Desc: ft-like protein [vitis vinifera]
  misc_feature (3)..(84): NCBI GI: 48474219 NCBI Desc: flowering locus t [populus nigra]
  misc_feature (70)..(152): NCBI GI: 38347694 NCBI Desc: flowering locus t [populus nigra]
  misc_feature (70)..(152): NCBI GI: 38256990 NCBI Desc: flowering locus t [populus nigra]
  misc_feature: Useful for making plants with modulated flowering time
  misc_feature: Functional homolog of the protein sequence given in SEQ ID NO 13388
  misc_feature: Functional homolog of the protein sequence given in SEQ ID NO 13391
  misc_feature: Useful for making plants with modulated flowering time
  misc_feature: Functional homolog of the protein sequence given in SEQ ID NO 13388
  misc_feature: The sequence is a functional homolog of SEQ ID NO 2 in US patent 7196246
  misc_feature: The sequence is a functional homolog of SEQ ID NO 2 in US patent 7208653
MSRDPLVVGHVVGDILDPFIKTASLKVLYNNKELTNGSELKPSQVANEPRVEIGGRDMRNLYTLVMVDPDSPSPSNPTKREYLHCYENPKPTAGIHRFVFVLFRQSVQQTVYAPGWRQNFNTRDFSALYNLGPPVAAVFFNCQRENGCGGRRYIR

SEQ ID NO: 6253 - DNA, 621 bp, Sorghum bicolor
  misc_feature: Ceres ANNOT ID no. 6064828
  misc_feature: Encodes the peptide sequence at SEQ ID NO 6254
  misc_feature: Down-regulated in shoot tissues in response to salicylic acid treatment
atggcgtcctcggatgacgagacgagccggctctaccgcatccgtcgcacggtgcatgagatgctgcgcgaccgcggatacgcggtcagcgaggaagaaatcaatctcccaagggacaggttcatcgaccgcttcggcaaccccgtccgccgcgacgacctcgccagcagcgccatgaagttggacggctcctccgagcagatctacgtgttcttccccaatgaggccaagcccggggtgaagacgatcaggaactacgtcgagaagatgaagcaggagaacgtcttcgccggcatactcgtcgtgcagcaggcgctcagcgcgttcgcacgcagcgccgttcaggaggtctcccagaagtaccacctcgaagtcttccaggaagctgagcttcttgtcaacattaagaaccatgtgctagtgccagatcacgtgctcctgacagcacaagaaaagaagtctcttctagagcggtacaccgtgaaggaaacccagctcccccggattcagattacagacccgatagcaagatactatgggatgaagcgcgggcaggtcgtgaagatcacccgatccagtgaaactgctggaagatacatcacctaccgctacgttgtctga

SEQ ID NO: 6254 - protein, 206 aa, Sorghum bicolor
  misc_feature: Ceres ANNOT ID no. 6064828
  misc_feature (133)..(206): Pfam Id: RNA_pol_Rpb5_C Pfam Desc: RNA polymerase Rpb5, C-terminal domain
  misc_feature (4)..(91): Pfam Id: RNA_pol_Rpb5_N Pfam Desc: RNA polymerase Rpb5, N-terminal domain
  misc_feature (3)..(206): NCBI GI: 38344231 NCBI Desc: oj991113_30.8 [oryza sativa (japonica cultivar-group)]
  misc_feature (1)..(206): NCBI GI: 92889266 NCBI Desc: rna polymerase subunit, rpb5; rna polymerase rpb5, n-terminal [medicago truncatula]
  misc_feature (3)..(166): NCBI GI: 115459090 NCBI Desc: os04g0487300 [oryza sativa (japonica cultivar-group)]
  misc_feature (1)..(202): NCBI GI: 92880626 NCBI Desc: rna polymerase subunit, rpb5; rna polymerase rpb5, n-terminal [medicago truncatula]
  misc_feature (5)..(205): NCBI GI: 50417194 NCBI Desc: zgc:101098 protein [danio rerio]
  misc_feature: Useful for making plants with modulated drought sensitivity
  misc_feature: Functional homolog of the protein sequence given in SEQ ID NO 13421
  misc_feature: Useful for making plants with modulated drought sensitivity
  misc_feature: Useful for making plants with modulated water use efficiency
  misc_feature: Functional homolog of the protein sequence given in SEQ ID NO 13421
  misc_feature: Down-regulated in shoot tissues in response to salicylic acid treatment
MASSDDETSRLYRIRRTVHEMLRDRGYAVSEEEINLPRDRFIDRFGNPVRRDDLASSAMKLDGSSEQIYVFFPNEAKPGVKTIRNYVEKMKQENVFAGILVVQQALSAFARSAVQEVSQKYHLEVFQEAELLVNIKNHVLVPDHVLLTAQEKKSLLERYTVKETQLPRIQITDPIARYYGMKRGQVVKITRSSETAGRYITYRYVV

SEQ ID NO: 6255 - DNA, 624 bp, Sorghum bicolor
  misc_feature: Ceres ANNOT ID no. 6064838
  misc_feature: Encodes the peptide sequence at SEQ ID NO 6256
atggcgtcgcggacggcgtccaaggatatcatcacgctgcgaggctccgccgccatcgtcagcgagttcttcggatacgcggcgaatagcatcctctacaaccgcgcggtgtatcctgaggagagcttcaccaaggtgaagaagtatgggctcaccatgctgctcacgcaggacgagggggtgaaggacttcatcgccaacctcacctcccagctctcaaagtggctggaggccgggaagctgcagcggattgtgctggtgataatgagcaaggccaccagcgaggttctcgagcgatggaacttcaatatcgtcactgacgccgaggtcgtcgagaagggggctatcaaggagaagagcgacaaggagatcatgagggagattcaggccatcatgcgccagatcacctcctgcatcacctacctcccctgcctcgacgagccatgcgtgttcgacgtgctggcctacacggacaccgacgtcgacgctccgggcacctgggtcgagagcgacgccaagctcatcgacaacccgcagatggttaagctccactcgttcgacaccaagattcataaggtggacacgctggtgtcgtacaagaaggatgagtgggacgaggagtag

SEQ ID NO: 6256 - protein, 207 aa, Sorghum bicolor
  misc_feature: Ceres ANNOT ID no. 6064838
  misc_feature (12)..(201): Pfam Id: HORMA Pfam Desc: HORMA domain
  misc_feature (1)..(207): NCBI GI: 4836787 NCBI Desc: cell cycle checkpoint protein mad2 homolog [zea mays]
  misc_feature (1)..(207): NCBI GI: 115459076 NCBI Desc: os04g0486500 [oryza sativa (japonica cultivar-group)]
  misc_feature (1)..(207): NCBI GI: 90265254 NCBI Desc: h0302e05.2 [oryza sativa (indica cultivar-group)]
  misc_feature (1)..(207): NCBI GI: 38346060 NCBI Desc: oj000223_09.14 [oryza sativa (japonica cultivar-group)]
  misc_feature (1)..(207): NCBI GI: 60677612 NCBI Desc: mad2 [triticum aestivum]
MASRTASKDIITLRGSAAIVSEFFGYAANSILYNRAVYPEESFTKVKKYGLTMLLTQDEGVKDFIANLTSQLSKWLEAGKLQRIVLVIMSKATSEVLERWNFNIVTDAEVVEKGAIKEKSDKEIMREIQAIMRQITSCITYLPCLDEPCVFDVLAYTDTDVDAPGTWVESDAKLIDNPQMVKLHSFDTKIHKVDTLVSYKKDEWDEE

SEQ ID NO: 6257 - DNA, 1149 bp, Sorghum bicolor
  misc_feature: Ceres ANNOT ID no. 6064839
  misc_feature: Encodes the peptide sequence at SEQ ID NO 6258
atgctcctctccgggccgccggcggcgcccaccccgccgctgctgctcccggagagcagcggcgaggacggcggccacgattcctcctcccgcgcggcagcagtggcgggatcggcgccgaagaggcgcgcggagacctgggtccgtgaggagaccctctgcctcatcgcgctgcgccgggaaatggacgcccacttcaacacctccaagtccaacaagcacctctgggaggccatctccgcccggatgcgggaccaagggttcgaccgctccccgaccatgtgcaccgacaagtggcgcaacctgctcaaggagttcaagaaggcgcgcagccactctcggaacagcggcggcggctccggctccggcgctggagggaacggcaacgccaagatggcgtactacaaggagatcgacgacctgctcaagcgccgcgggaaggcgacgggaagcggcagtggcggctgcgttggcagtggtgctgccgggaagagccccacatccaattctaagatcgagtcctacctgcagttcaccacagataacggctttgatgatgctaacattccttttggtcctgtggaagcaaatggtagaccaatactgagtatcgatgatcgtttggaggatgacaggcatccgcttcccttgacggctgctgatgcagttgcaaccaatggtgtgaacccatggaattggagagacacctctactaatggtggagataaccatggcagcttcggtgggagagtcattttagtgaagtggggtgattacactaaaaggattggaattgatggtactcctgaagcaattaaggaagccatcaaatcagcatttggattaagaacaaggcgtgctttctggcttgaagatgaagatgaggttgttcgagccttggacagggacatgccagttggaacatacacacttaatcttgatgatgggataacaatcaaactctgtgatggaaaccgcatgcagacgccagaagacaagacattttacactgaagaggactttcgagatttcctcttacggcgtggttggacatttctcagggagtatggaggctatagaaacgtcgatagccttgatgatctccgaccaggtgtgatgtatcaggggctgcggtcacttggtgattga

SEQ ID NO: 6258 - protein, 382 aa, Sorghum bicolor
  misc_feature: Ceres ANNOT ID no. 6064839
  misc_feature (1)..(382): NCBI GI: 27368895 NCBI Desc: rml1 protein [oryza sativa (indica cultivar-group)]
  misc_feature (164)..(377): NCBI GI: 258168 NCBI Desc: box ii factor; b2f [nicotiana tabacum]
  misc_feature (164)..(377): NCBI GI: 170271 NCBI Desc: dna-binding protein [nicotiana tabacum]
  misc_feature (164)..(377): NCBI GI: 1093376 NCBI Desc: gt1a protein
  misc_feature (10)..(378): NCBI GI: 598073 NCBI Desc: gt-1
  misc_feature: The sequence is a functional homolog of SEQ ID NO 1011 in the 10/374,780US patent application
  misc_feature: The sequence is a functional homolog of SEQ ID NO 4 in the 10/286,264US patent application
  misc_feature: The sequence is a functional homolog of SEQ ID NO 414 in the 10/412,699US patent application
  misc_feature: The sequence is a functional homolog of SEQ ID NO 46 in the 10/286,264US patent application
  misc_feature: The sequence is a functional homolog of SEQ ID NO 963 in the 11/479,226US patent application
  misc_feature: The sequence is a functional homolog of SEQ ID NO 988 in the 10/374,780US patent application
  misc_feature: The sequence is a functional homolog of SEQ ID NO 994 in the 10/374,780US patent application
  misc_feature: Useful for making plants with modulated growth and phenotype characteristics
  misc_feature: The sequence is a functional homolog of SEQ ID NO 4 in the 20030093837 US patent application
  misc_feature: The sequence is a functional homolog of SEQ ID NO 46 in the 20030093837 US patent application
  misc_feature: The sequence is a functional homolog of SEQ ID NO 1011 in the 20060162006 US patent application
  misc_feature: The sequence is a functional homolog of SEQ ID NO 988 in the 20060162006 US patent application
  misc_feature: The sequence is a functional homolog of SEQ ID NO 994 in the 20060162006 US patent application
  misc_feature: The sequence is a functional homolog of SEQ ID NO 414 in the 10/412,699 US patent application
  misc_feature: The sequence is a functional homolog of SEQ ID NO 46 in the 10/286,264 US patent application
  misc_feature: The sequence is a functional homolog of SEQ ID NO 963 in the 11/479,226 US patent application
MLLSGPPAAPTPPLLLPESSGEDGGHDSSSRAAAVAGSAPKRRAETWVREETLCLIALRREMDAHFNTSKSNKHLWEAISARMRDQGFDRSPTMCTDKWRNLLKEFKKARSHSRNSGGGSGSGAGGNGNAKMAYYKEIDDLLKRRGKATGSGSGGCVGSGAAGKSPTSNSKIESYLQFTTDNGFDDANIPFGPVEANGRPILSIDDRLEDDRHPLPLTAADAVATNGVNPWNWRDTSTNGGDNHGSFGGRVILVKWGDYTKRIGIDGTPEAIKEAIKSAFGLRTRRAFWLEDEDEVVRALDRDMPVGTYTLNLDDGITIKLCDGNRMQTPEDKTFYTEEDFRDFLLRRGWTFLREYGGYRNVDSLDDLRPGVMYQGLRSLGD

SEQ ID NO: 6259 - DNA, 1374 bp, Sorghum bicolor
  misc_feature: Ceres ANNOT ID no. 6064840
  misc_feature: Encodes the peptide sequence at SEQ ID NO 6260
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
atggcgctgaattgctcgtcacgctcgctcctggtgactgatgattgtgccggcatgatgcttggttgtgggtgccggtcggaggaggcctcccctctttcatcctgcggggtgaattcgctgtggtgggatgagctggagctggagctggaggaggaggtggagtcggatcctgtggatctcttacccacggacccctttgggatgaacttggagactacgttcacagctgcgattgccagttgcattggagacctcacggtcatgtctggtgctgggcattttggaagcagtgacgatgatgatttctatgcagacctgagttattacttgaatcaggcttttgtgctcactccggagccatggagtggtgcctataccggtgtttttgaggattcttttgtgtctggaggcctctcaggtgctggaggcatggaacagttttcacggttgcctcctattgcatcctgctcagagcctataggggtcacagaggacccatctagctcttgtgacacagccttgccatgctgtgatatggttgatgttgctcctgtccaggagggaaatgatgcccatgaagcaatggtgtttgttctgagctatcttggcttacgagacattcttgctgttgagatggtgtgcaagtcactacgttcagctgtccggaacgaaccctttttatggaaatgcatccatattgactcgcacttgggcaagaaggtgtctgatgctgatcttctgtgcctgacacagaagtccccgggttctgtgcagtgcctgagtcttatgggctgtctaagcatcacagatcagggattgaaagctgttttagaaagtaatcaacagttaacaaagttgggcatttttggtgctttccggattactcatcaaggtcttattgacaatctgaggtcatttaatatggtagcagatattggtttaaagaaactcagagttacaaatcgtgtcactgcatcagaagcacaatatgaagagttgttgtccttgatgaaaatagacaaggagctggcattacacaaacaagagcctcggatctttcatgctgatcgtcttttaccagatcttcatggtggatatgttcccgattctttcgtaccagatcttcatgatgaatatgctcttgatattgagaagtgtcctctctgtcctaattacaagcttgtttatgattgtccatcaaaggaatgcaagaccagcggagctagtacttgcagagggtgtgttgtttgcatctcaagatgtctgcgatgtgggagatgtatagacagtgagttccaagagacatttcttctggagaacctttgccgtgactgtgtcaaatacgaagactcaccccccacagaaaaatag

SEQ ID NO: 6260 - protein, 457 aa, Sorghum bicolor
  misc_feature: Ceres ANNOT ID no. 6064840
  misc_feature (1)..(454): NCBI GI: 90265125 NCBI Desc: h0811e11.8 [oryza sativa (indica cultivar-group)]
  misc_feature (188)..(404): NCBI GI: 82470791 NCBI Desc: non-s-locus f-box-like protein 2411 [petunia inflata]
  misc_feature (187)..(446): NCBI GI: 144924425 NCBI Desc: 4fe-4s ferredoxin, iron-sulfur binding; cyclin-like f-box [medicago truncatula]
  misc_feature (158)..(446): NCBI GI: 38175774 NCBI Desc: f-box protein family-like protein [oryza sativa (japonica cultivar-group)]
  misc_feature (185)..(446): NCBI GI: 115476500 NCBI Desc: os08g0428100 [oryza sativa (japonica cultivar-group)]
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
MALNCSSRSLLVTDDCAGMMLGCGCRSEEASPLSSCGVNSLWWDELELELEEEVESDPVDLLPTDPFGMNLETTFTAAIASCIGDLTVMSGAGHFGSSDDDDFYADLSYYLNQAFVLTPEPWSGAYTGVFEDSFVSGGLSGAGGMEQFSRLPPIASCSEPIGVTEDPSSSCDTALPCCDMVDVAPVQEGNDAHEAMVFVLSYLGLRDILAVEMVCKSLRSAVRNEPFLWKCIHIDSHLGKKVSDADLLCLTQKSPGSVQCLSLMGCLSITDQGLKAVLESNQQLTKLGIFGAFRITHQGLIDNLRSFNMVADIGLKKLRVTNRVTASEAQYEELLSLMKIDKELALHKQEPRIFHADRLLPDLHGGYVPDSFVPDLHDEYALDIEKCPLCPNYKLVYDCPSKECKTSGASTCRGCVVCISRCLRCGRCIDSEFQETFLLENLCRDCVKYEDSPPTEK

SEQ ID NO: 6261 - DNA, 1524 bp, Sorghum bicolor
  misc_feature: Ceres ANNOT ID no. 6064842
  misc_feature: Encodes the peptide sequence at SEQ ID NO 6262
atgtcaggaggatcgacaccatcatcaaggcgaaacagctttaattctttgtctagagacctagaccttccttcagagcaaggttgtctctccattgttgtacttggggcttctggtgaccttgctaagaagaaaactttcccagccctctaccacctctttgatcagggatttatacaatctggtgaagtccatatatttggttatgctagatcaaatctttctgatgatgggttaagagaacgcattcgtgggtatctcaaaggagacccagaagatctttcagaatttttgcaattaataaaatatgtcagtggttcctatgacactggagaaggatttcagaaactgaacaagacaatatcacagtatgaggcgtcaaacaaatcaggaagctatcgcaggctcttttatttggcattgcctccatctgtctacccttcagtgtgcaaaatgatcagaacatattgcatgaatccatcttctcaccctggatggaccagagtcattgttgagaagccctttggaaaggacttggattccgctgaagaattaagtgcccaacttggggagctattcgaggaacaccaactatacagaatagaccattacctgggaaaagagttggtccaaaacttgcttgtccttcgttttgccaaccgcttgttcttgcctctttggaaccgcgacaatattgataatatacagatagtattcagggaggactttggaactgaagggcgtggaggatattttgaccaatatggaatcattcgtgatatcattcagaatcatttactgcaggttttctgtttggttgcgatggaaaagcctgtctcccttaagcctgagcacatcagagatgagaaagtcaaggttctgcaatctgtgaaccctattaagcctgaagaggtagtccttgggcaatacgatggctacaaggatgaccctacagtgccagatgactcaaataccccaacttttgcatctgttgttcttcgggtacacaatgaaagatgggaaggtgttcctttcattcttaaagctggtaaagcattgagctcaaggaaagcagaagttcgggtgcaattcaaggatgttcctggtgacatttttagaaataagaggcaaggaagaaatgagtttgttatacgcctccaaccatcagaagccatgtacatgaaactaactgttaagaagcctgggttagaaatggctactgaacaaagtgaacttgatttgtcatatggtatgcggtaccaaaatatcaaaattcctgaggcatatgaacgccttatcttggatacaataagaggagaccagcagcacttcgttcgcagagatgagctaaaggctgcttggcagattttcactcctttgctgcacgacattgacgacggcaagctgaaggccctcccatatgaacctggcagtcgaggccccaaggaagcagacgaattgagcgcgagagttggatatgtgcagacccacggttacatatggataccaccgacccttgcatag

SEQ ID NO: 6262 - protein, 507 aa, Sorghum bicolor
  misc_feature: Ceres ANNOT ID no. 6064842
  misc_feature (214)..(498): Pfam Id: G6PD_C Pfam Desc: Glucose-6-phosphate dehydrogenase, C-terminal domain
  misc_feature (33)..(212): Pfam Id: G6PD_N Pfam Desc: Glucose-6-phosphate dehydrogenase, NAD binding domain
  misc_feature (1)..(507): NCBI GI: 90265122 NCBI Desc: h0811e11.5 [oryza sativa (indica cultivar-group)]
  misc_feature (1)..(507): NCBI GI: 38346054 NCBI Desc: oj000223_09.8 [oryza sativa (japonica cultivar-group)]
  misc_feature (1)..(507): NCBI GI: 115459064 NCBI Desc: os04g0485300 [oryza sativa (japonica cultivar-group)]
  misc_feature (1)..(507): NCBI GI: 19071787 NCBI Desc: glucose-6-phosphate dehydrogenase [oryza sativa]
  misc_feature (1)..(507): NCBI GI: 8918502 NCBI Desc: glucose-6-phosphate dehydrogenase [triticum aestivum]
  misc_feature (10)..(506): SWISSPROT Homolog: EC 1.1.1.49 Glucose-6-phosphate 1-dehydrogenase, cytoplasmic isoform
MSGGSTPSSRRNSFNSLSRDLDLPSEQGCLSIVVLGASGDLAKKKTFPALYHLFDQGFIQSGEVHIFGYARSNLSDDGLRERIRGYLKGDPEDLSEFLQLIKYVSGSYDTGEGFQKLNKTISQYEASNKSGSYRRLFYLALPPSVYPSVCKMIRTYCMNPSSHPGWTRVIVEKPFGKDLDSAEELSAQLGELFEEHQLYRIDHYLGKELVQNLLVLRFANRLFLPLWNRDNIDNIQIVFREDFGTEGRGGYFDQYGIIRDIIQNHLLQVFCLVAMEKPVSLKPEHIRDEKVKVLQSVNPIKPEEVVLGQYDGYKDDPTVPDDSNTPTFASVVLRVHNERWEGVPFILKAGKALSSRKAEVRVQFKDVPGDIFRNKRQGRNEFVIRLQPSEAMYMKLTVKKPGLEMATEQSELDLSYGMRYQNIKIPEAYERLILDTIRGDQQHFVRRDELKAAWQIFTPLLHDIDDGKLKALPYEPGSRGPKEADELSARVGYVQTHGYIWIPPTLA

SEQ ID NO: 6263 - DNA, 837 bp, Sorghum bicolor
  misc_feature: Ceres ANNOT ID no. 6064844
  misc_feature: Encodes the peptide sequence at SEQ ID NO 6264
atggaagcagagtaccccaaccagcaggcaggcccctcctcctcctccaccaccctctggccgtgcgcgactcgacgcaggaagagggacgagggcgagggcgacgacgacctctcgtcggaggaggacatggatctcgacgccgacgcgcagcgcgccgcggacaagctgaaagcagtgtcagaggaacttggacatgagatccgagttttttcgagtgagaattttgctctacaacccagcaagctgcctagtgcagatcatgaggaagatgatgacttttacgagcttcagcctgctgattactacaagttgatttcaaacaggataggagagcactctaaaatgctaaagactcgcaagatgcgggaggcagaacttgctgctcagcgagcaaagagaacaaaggcagtaatgagggtgcgattccctgatggctacattcttgaggccgactttcttccatcagagaggattcatagtctagtggacctgctcatgaaagtacttgctagaccagatcttccgttctatctttatacagtacctccaaagaagcgaataatggacacatcacaggacttctgtaccgctggttttgttcctggagctaatgttcatttttcttatgatctgcccgaagatgatctaaaagcaggaccctttctccgtgaagaaattcgaagtttggacggattgtcacttctgctgaaacctgctagtcaacctgatgattctagaatgaactcttctactcttcaatctggtgcatctcaatctgatcctgtaccaacaacaaataagaagcctggcagaccaaagtggttgaaaaggtaa

SEQ ID NO: 6264 - protein, 278 aa, Sorghum bicolor
  misc_feature: Ceres ANNOT ID no. 6064844
  misc_feature (1)..(278): NCBI GI: 115459062 NCBI Desc: os04g0485200 [oryza sativa (japonica cultivar-group)]
  misc_feature (55)..(278): NCBI GI: 38346053 NCBI Desc: oj000223_09.7 [oryza sativa (japonica cultivar-group)]
  misc_feature (55)..(278): NCBI GI: 90265121 NCBI Desc: h0811e11.4 [oryza sativa (indica cultivar-group)]
  misc_feature (59)..(212): NCBI GI: 140067899 NCBI Desc: ubx [medicago truncatula]
  misc_feature (12)..(277): NCBI GI: 17511732 NCBI Desc: alveolar soft part sarcoma chromosome region, candidate 1 [homo sapiens]
MEAEYPNQQAGPSSSSTTLWPCATRRRKRDEGEGDDDLSSEEDMDLDADAQRAADKLKAVSEELGHEIRVFSSENFALQPSKLPSADHEEDDDFYELQPADYYKLISNRIGEHSKMLKTRKMREAELAAQRAKRTKAVMRVRFPDGYILEADFLPSERIHSLVDLLMKVLARPDLPFYLYTVPPKKRIMDTSQDFCTAGFVPGANVHFSYDLPEDDLKAGPFLREEIRSLDGLSLLLKPASQPDDSRMNSSTLQSGASQSDPVPTTNKKPGRPKWLKR

SEQ ID NO: 6265 - DNA, 1167 bp, Sorghum bicolor
  misc_feature: Ceres ANNOT ID no. 6064847
  misc_feature: Encodes the peptide sequence at SEQ ID NO 6266
atggacggcggcggagaggacgggaagcagcagccgcacctggtactggcgcacaagctgttccttctgtcgcgctccgacgtcgacgacctcgccaaggtcgacctacgcgctgacgtgctcgcggcagtcaaatccgatgacatggcggctctgtacgagtcgctggcggcggacggcgtactggagatggacgcggcgctgctggccgagatgcgcgccaggatcgacgaggagatccggaagctcgacgagaagattgccgatgctgaggagaatttgggtgagagtgaagtgcgtgaggcccatcttgccaaatccttatacttcataagggttggggagaaggagaaagcactggagcagcttagagttactgaaggaaaaactgtagctgttgggcaaaagatggaccttgttttctacacactacaaattggacttttctatatggactttgatctcatctcaaagtccattgacaaagcgaaaaacttatttgaggaaggtggtgactgggagaggaagaacagattgaaagtatacgaaggattgtactgcatggcaactagaaacttcaagaaagctgctagtttattcttggattcaatttcaactttcacaacgtatgagctcttcacatatgatacattcatcttctacacagtcctcacgagtgttatctctctggatcgtgtatctctaaaacaaaaggttgtagatgcacctgagatcttagctgtaattggcaaagtacctcacctctcggagtttctcaattccctctacaattgccagtacaagtcattttttattgcattctctggcttgactgaaccgatcaagttagaccggtacttgcagcctcattttcgctactacatgcgtgaagtgcgcactgttgtctactcgcaatttctggaatcgtacaagagtgtgacaatggaagccatggctgctgcatttggtgtcacagttgactttatagaccaggaattgtcacgcttcattgctgctgggaagctccactgcaagatagacaaagttgctggcgtcttggaaacaaaccgacctgatgccaggaatgccttctaccaggcaaccatcaagcaaggagacttccttctgaaccgtatccagaagctatcacgagttattgacctgtag

SEQ ID NO: 6266 - protein, 388 aa, Sorghum bicolor
  misc_feature: Ceres ANNOT ID no. 6064847
  misc_feature (253)..(357): Pfam Id: PCI Pfam Desc: PCI domain
  misc_feature (1)..(388): NCBI GI: 90265119 NCBI Desc: h0811e11.2 [oryza sativa (indica cultivar-group)]
  misc_feature (1)..(388): NCBI GI: 20978545 NCBI Desc: 26s proteasome non-atpase regulatory subunit 6 (26s proteasome regulatory particle non-atpase subunit 7) (osrpn7)
  misc_feature (6)..(388): NCBI GI: 117607065 NCBI Desc: 26s proteasome subunit rpn7 [capsicum annuum]
  misc_feature (157)..(388): NCBI GI: 2982297 NCBI Desc: kiaa0107-like protein [picea mariana]
  misc_feature (6)..(388): NCBI GI: 38454206 NCBI Desc: proteasome, 26s, non-atpase regulatory subunit 6 [rattus norvegicus]
MDGGGEDGKQQPHLVLAHKLFLLSRSDVDDLAKVDLRADVLAAVKSDDMAALYESLAADGVLEMDAALLAEMRARIDEEIRKLDEKIADAEENLGESEVREAHLAKSLYFIRVGEKEKALEQLRVTEGKTVAVGQKMDLVFYTLQIGLFYMDFDLISKSIDKAKNLFEEGGDWERKNRLKVYEGLYCMATRNFKKAASLFLDSISTFTTYELFTYDTFIFYTVLTSVISLDRVSLKQKVVDAPEILAVIGKVPHLSEFLNSLYNCQYKSFFIAFSGLTEPIKLDRYLQPHFRYYMREVRTVVYSQFLESYKSVTMEAMAAAFGVTVDFIDQELSRFIAAGKLHCKIDKVAGVLETNRPDARNAFYQATIKQGDFLLNRIQKLSRVIDL

SEQ ID NO: 6267 - DNA, 984 bp, Sorghum bicolor
  misc_feature: Ceres ANNOT ID no. 6064855
  misc_feature: Encodes the peptide sequence at SEQ ID NO 6268
atggccggagcagcggcgtggagcgcgcacgacgcgcagcccgccgcgtgggcgctggcagcgccgctcgcgacgctggggctcctgctgtgcgcgcgcgccgcggcgcgcctggcgctgtggctgtacgcggcgttcctgcggcccgcgaggccgctgcgccggcggtacggcacgtgggccgtcgtgacgggcgccaccgacggcatcggccgcgcgctgtcgttccgcctggccgcggcggacctcggcctcgtccttgtgggccgcagccccgacaagctggccgccgtgtcggccgaggtgaaggccaggcaccccggcgcccaggtgcgcaccttcgtgctcgacttcgccggcgacggcctcgccgcgaaggtggacgcgctcggggagttcctgggggaacttgacatcggcgtgctcgtgaacaacgccggcgcgtgctacccgtacgcgcgctacttccacgaggtggacgaggcgctcgtgcggaacctgatacggctcaacgtcgacgccgtcacgcgggtgacgcacgccgtgctccccggcatggtgcgacgcgggcgcggcgccgtggtgaacatcggctccggcgcctccgctattctgccgtccgacccgctctacacagtctacgccgccaccaaggcctatatcgaccaattttcaagatgcctatatgttgagtacaggagcaaaggcattgacgtgcaatgccaggtaccaatgttagtggccacaaagatggcgtccatcaagacttcatccttctttgtgccatcccccgatacatatgcccgtgcggctattcgctacatcgggtatgaaccgcgatgcacaccatattggacacatgcgctattgtggttcctcggctcctttgtgcctgagcctgtcgctgataagatgatcctcaacgtagcactagatgttcgcaccaaggggcgggccaaagacgctaagaggaagacacattag

SEQ ID NO: 6268 - protein, 327 aa, Sorghum bicolor
  misc_feature: Ceres ANNOT ID no. 6064855
  misc_feature (59)..(233): Pfam Id: adh_short Pfam Desc: short chain dehydrogenase
  misc_feature (9)..(326): NCBI GI: 116310470 NCBI Desc: h0805a05.3 [oryza sativa (indica cultivar-group)]
  misc_feature (1)..(325): NCBI GI: 115447099 NCBI Desc: os02g0597900 [oryza sativa (japonica cultivar-group)]
  misc_feature (1)..(325): NCBI GI: 2586127 NCBI Desc: b-keto acyl reductase [hordeum vulgare]
  misc_feature (1)..(325): NCBI GI: 33327267 NCBI Desc: beta-ketoacyl reductase gl8b [zea mays]
  misc_feature (1)..(325): NCBI GI: 15824366 NCBI Desc: beta-ketoacyl reductase [zea mays]
  misc_feature: The sequence is a functional homolog of SEQ ID NO. 389 in the 11/188,298 US application
MAGAAAWSAHDAQPAAWALAAPLATLGLLLCARAAARLALWLYAAFLRPARPLRRRYGTWAVVTGATDGIGRALSFRLAAADLGLVLVGRSPDKLAAVSAEVKARHPGAQVRTFVLDFAGDGLAAKVDALGEFLGELDIGVLVNNAGACYPYARYFHEVDEALVRNLIRLNVDAVTRVTHAVLPGMVRRGRGAVVNIGSGASAILPSDPLYTVYAATKAYIDQFSRCLYVEYRSKGIDVQCQVPMLVATKMASIKTSSFFVPSPDTYARAAIRYIGYEPRCTPYWTHALLWFLGSFVPEPVADKMILNVALDVRTKGRAKDAKRKTH

SEQ ID NO: 6269 - DNA, 477 bp, Sorghum bicolor
  misc_feature: Ceres ANNOT ID no. 6064861
  misc_feature: Encodes the peptide sequence at SEQ ID NO 6270
atgatcaagctgaggtaccccaagaagctgttcaggaggagctcctccaagggcagcactaccagcagcagcagcgacggcgatgccggcagcgtccgcggcggcggggagatcgagtgggaggttcggccgggcggcatgctggtgcagaagagggactgcagggcggacgtggaggtcatcaccgtcagggtcgccaccggcttctcctggcacgacgtctccgttgtggctacctgcacttttggtgagctgaaggtggtgctgtccatggtgacagggctggagcctcgggagcagaggctgctgttcaggggcaaggagagggaggacagcgaccacctccacatgatcggggtgagggacatggacaaggtgctgctcctcgaggaccctgccctcaaggacatgaagctccgggccggactcacagcccaggccgtgcagagcccgtatcagacttttatcaaggtgtag

SEQ ID NO: 6270 - protein, 158 aa, Sorghum bicolor
  misc_feature: Ceres ANNOT ID no. 6064861
  misc_feature (1)..(158): NCBI GI: 116309941 NCBI Desc: h0525d09.13 [oryza sativa (indica cultivar-group)]
  misc_feature (1)..(158): NCBI GI: 47847633 NCBI Desc: ubiquitin-like protein [oryza sativa (japonica cultivar-group)]
  misc_feature (13)..(158): NCBI GI: 56785103 NCBI Desc: ubiquitin-like [oryza sativa (japonica cultivar-group)]
  misc_feature (30)..(141): NCBI GI: 56785178 NCBI Desc: bag domain containing protein-like [oryza sativa (japonica cultivar-group)]
  misc_feature (30)..(158): NCBI GI: 56797970 NCBI Desc: bcl-2 binding anthanogene-1 [hordeum vulgare subsp. vulgare]
MIKLRYPKKLFRRSSSKGSTTSSSSDGDAGSVRGGGEIEWEVRPGGMLVQKRDCRADVEVITVRVATGFSWHDVSVVATCTFGELKVVLSMVTGLEPREQRLLFRGKEREDSDHLHMIGVRDMDKVLLLEDPALKDMKLRAGLTAQAVQSPYQTFIKV

SEQ ID NO: 6271 - DNA, 114 bp, Sorghum bicolor
  misc_feature: Ceres ANNOT ID no. 6064864
  misc_feature: Encodes the peptide sequence at SEQ ID NO 6272
atgaaaataagagcttccgttcgtaaaatttgtataaaatgtcgactgattcgcaggcgtgggcgaattagagtcatttgttccaatccgaagcataaacaaagacaggggtaa

SEQ ID NO: 6272 - protein, 37 aa, Sorghum bicolor
  misc_feature: Ceres ANNOT ID no. 6064864
  misc_feature (1)..(37): Pfam Id: Ribosomal_L36 Pfam Desc: Ribosomal protein L36
  misc_feature (1)..(37): NCBI GI: 90309023 NCBI Desc: rpl36 [thinopyrum intermedium]
  misc_feature (1)..(37): NCBI GI: 11466823 NCBI Desc: ribosomal protein l36 [oryza sativa (japonica cultivar-group)]
  misc_feature (1)..(37): NCBI GI: 51338635 NCBI Desc: chloroplast 50s ribosomal protein l36
  misc_feature (1)..(37): NCBI GI: 902255 NCBI Desc: ribosomal protein l36 [zea mays]
  misc_feature (1)..(37): NCBI GI: 14017605 NCBI Desc: ribosomal protein l36 [triticum aestivum]
MKIRASVRKICIKCRLIRRRGRIRVICSNPKHKQRQG

SEQ ID NO: 6273 - DNA, 1578 bp, Sorghum bicolor
  misc_feature: Ceres ANNOT ID no. 6064867
  misc_feature: Encodes the peptide sequence at SEQ ID NO 6274
atgacgaagtgcaggttccaaatggataccacggatagcaaagcatccgttgttacaaaggtccacaacattgtgaatgagagcacctcccactcttgtccatcactacagcaaatccccctcacttcaaatccgtcccttctcctccatgtgctctcttcctacgggctggaacccaaggatctggctgctttggaggttgcatgtcaattcttcagaaggcctgcaaagtttgagccagatgccacgttgtctctccctgaacttgcagcatatgatacttgctgccaaaaggccatctttaagtcaatggagcaaaaggaaaaagacagcttgaagcagcggtgcggcggctcttggaagcttgtccttacgtacctgttggtcggcgagaagaattaccaccgtgggaaatctcgggttgtagctggaccagggcacaccatcgctgtcacatcgaagggggatgtgtactcattcggcgcaaattcttcagggcagcttgggcttgggaatacagaagaacagtgcaaaccatgccttattaggtctctgcagggcatcagaatcacacaagccgcagtcggttcgaggcggacaatgcttgtaagcgacacaggaagcgtgtatgtgtttggacaggatattttcgcgggtttagaatttgctggtgattataccagtagccctaaggttgtggagtcattgaaaggcatatttgtagtccaagcatctgttggaggccacttctctgcagttctgtctagagagggtcaggtttacactttctgttgggggcatgatgcaaggcttggtcatcattcagatccaactgatctcgagcctcgccttctctctgtaccgcctaaggatgctcttgttatgcagattgccgcgggcaactgctatctccttatgttgggccacgagtcggtctactcagtagggtgcggtgaaggaggcaagcttgggcatggatgcacgataagcctgacgatcccaaggatgatccaacagttcaagacactgaaggtaaaaccggtgtcggtttcagcaggcgctttccattgtgcagttctggcaagcgacggacgtgtgttcacctggggatgggactccgacactggttgtctggggcacgatgataaacaagaatatgttgtcctccccacggcagtggcaggcttggggtcggtgaaggctacctatatctcaactggctattgctccaccttcgtcgtcacagacaatggcgatgtctactccttcgggtgcgatcattcgcgtaatctgggtgttaaggcggatgtcggcgaggatgtcaggattcccaagctagccgccaatctgaatgtttcgctgaatgaaaaggttgtgcagattagcgcgaccaacacctgggactggcctagccgaagccaaaatcggattacctctgaatgtcatacatgcgtcctcaccgaatccggcaggctctactctctcggtagaggtagcgaggggcagcttggtgtgaagcttgctgagggacagaaaattaggccggccccagatggtgtcgccattgatctcgactag

SEQ ID NO: 6274 - protein, 525 aa, Sorghum bicolor
  misc_feature: Ceres ANNOT ID no. 6064867
  misc_feature (8)..(524): NCBI GI: 47847831 NCBI Desc: rjs-like protein [oryza sativa (japonica cultivar-group)]
  misc_feature (140)..(475): NCBI GI: 93003290 NCBI Desc: tpa: zinc finger protein [ciona intestinalis]
  misc_feature (141)..(514): NCBI GI: 23308399 NCBI Desc: at5g63860/mgi19_6 [arabidopsis thaliana]
  misc_feature (141)..(514): NCBI GI: 5478530 NCBI Desc: uvb-resistance protein uvr8 [arabidopsis thaliana]
  misc_feature (140)..(467): NCBI GI: 119578073 NCBI Desc: hcg2006901, isoform cra_f [homo sapiens]
MTKCRFQMDTTDSKASVVTKVHNIVNESTSHSCPSLQQIPLTSNPSLLLHVLSSYGLEPKDLAALEVACQFFRRPAKFEPDATLSLPELAAYDTCCQKAIFKSMEQKEKDSLKQRCGGSWKLVLTYLLVGEKNYHRGKSRVVAGPGHTIAVTSKGDVYSFGANSSGQLGLGNTEEQCKPCLIRSLQGIRITQAAVGSRRTMLVSDTGSVYVFGQDIFAGLEFAGDYTSSPKVVESLKGIFVVQASVGGHFSAVLSREGQVYTFCWGHDARLGHHSDPTDLEPRLLSVPPKDALVMQIAAGNCYLLMLGHESVYSVGCGEGGKLGHGCTISLTIPRMIQQFKTLKVKPVSVSAGAFHCAVLASDGRVFTWGWDSDTGCLGHDDKQEYVVLPTAVAGLGSVKATYISTGYCSTFVVTDNGDVYSFGCDHSRNLGVKADVGEDVRIPKLAANLNVSLNEKVVQISATNTWDWPSRSQNRITSECHTCVLTESGRLYSLGRGSEGQLGVKLAEGQKIRPAPDGVAIDLD

SEQ ID NO: 6275 - DNA, 2937 bp, Sorghum bicolor
  misc_feature: Ceres ANNOT ID no. 6064869
  misc_feature: Encodes the peptide sequence at SEQ ID NO 6276
  misc_feature: Up-regulated in root tissues in response to salicylic acid treatment
atgatggacacgaggcgtcactctgtgtctgtggatgtcccactgtcaagaaccttggtgcagctcaagcgagtgagatcgctgcgggatccagcgacgaactcgatgagcaagtacgcatctccttctgatcacatgatctgggagactgcttctagcaatggggtgactctggaccttggcaggtcagcacatcatcacctggttgaagaagacgaagacgtgggagctgagcctacaatggggtcagagcggagttttcggggaccaaatgcaaggactgcatcatataggaaatcttcagctgtcaggattagaggcttgaacccaccaagaaacaagcaggttcatcgtgtccgccaagatggtcaccgcaagtcgttggattctaaccactcaaatcacagttctatccgtcaattggcaaacaatgtggtcaacaatgtggatgcagataaggaagaggaggaagtgaattcttatgaaagaccaaaatttgcaatgccagataaggctgatgaagaagtgaaaatgccagactactccaaattcaggagcaagtcttctgctgcaatgagccgtgttgggagcccctgtatgtcagccagtgaggcacgctccgttgggtcaagaagaagcactttagggcatggaactgaggatacacgactgaggtcgaatgatgtcgtgggatcgaattttagtggctgtggtataagctactgctggtcaggagcatcgaagtaccgagaactttattcagatagtgatggtccagatcaacctctcttgtctacagatgggaccgaggctgcattccaaggcaatgtaccatacactgagacaccgaggtgtttaagccagaaattccgccctcgttctttcagtgaattgatcggcctaaatgttgttgcccagtccctcttatattcctcttgcaaaggaaaagttgctccaatgtacttgtttcatggcccccggggtacaggcaagacatccacagcaaggatttttgccgcagcactaaattgtgtatctcttgaagagcaaaggccatgtgggttctgtaaagagtgtgtcattcttttctctgggaagagtagagatgtgaaagaacttgatgcagcgaaaatggatcgtttaggtcgagtaaaggcacttctcaagagtgcatctctcgttccatactcttcgcgcttcaaggttttcataatagatgaatgccatctcttgcaagaagatgcatggtcagcaatactgaagagtcttgatgagccataccggcatacagtatacattatgattacttctgacatagaaagcctgcctcgcacttccatcacacattgccagaagttccattttccgaagataaaggtggcagatattgtctacaggttggagagaatctgtatagaagaaggattggaatttgaccatgatgggttgtatttcattgctgcaaagtctaatggttctcttagagattcagaaataatgcttgatcaactcagtttgctagggaagaagatcacaatttctcttgtgcatgaacttgtaggatctgtgtctgatgacgagttgattgaattgcttgatctagcattgtcgtccgacacaaccaatactgtaagacgagctcgagaacttatggggtcagcaattgatcctctgcagctggtgtctcagttggccaaccttattatggacattctctcagggcgatgtcaatctgcagtcactgaagtcagcaaaagtttcttgggtagatatgcattatcggagattggaataaagaaattaaggcatgcactgaagatactatcagaaactgaaaaacaattaaggacatcaaggaatcaggctacttgggttacagttgcgcttttgcagtttagcaccaatgaacctaaccttgctgctgaaccgaatgatatgcatgcacattcagtaactggatatacagatgactgggtttccaaggtgcactcaagtgccaatttttgtcaggcatgtaacagcagcaagtccaactgctctgagagacactgtaggcggcttaagcttgagaacatatggaggagagccattggaaagtgtcgatcaaggtcagccaaaagtttcctcaggaaagaaggcttcttatcatcggttcatgttactgaagagctggccatagcagaagttggttttggacacccggatcacctatcaagagcagagaaaatgcaaagcctcatagaatgctctttacagcatgttcttgggtgcaatgtggagatcagattcaaacttgtaccctgtccagtcagaaaagatgctaggttgaagagacagtcgttcagttttctcaactgctctggccggaagcaagagctgtcagattcagttgtgactgatgaagatgaagttgtgaggcctggagcaagagagacaccgcttaaaggctacacctctagtcagcaggaatcaccatataccatgcaacgtgttgattcaaaaccaacagtccatggttgtgaggatgatgctcggagtaccttgacgtcaaacagatccatgacagatgatctgacaaggacgtgcaggtcagagactaactactcaaagggtgtaagtgagcacggccactttgatagcatccaggaaccggacctacagccgaattgcttctcgcgaacactcaagcttcaaaagaagctattgtcttctggcgcagcacacacaatctgtttgaggatccagccacataacaagatggacttcctgcctaagaaagaattcgatacatacttctgcgcatacgaaccttacgagcagtgttcaagatcaaattcaagagctacttacagttcaagagatgatgacttgtggagcaagaattcacgctttggttcgaatctactctgctggagggccccaaaacaatccatgtaa

SEQ ID NO: 6276 - protein, 978 aa, Sorghum bicolor
  misc_feature: Ceres ANNOT ID no. 6064869
  misc_feature (320)..(510): Pfam Id: AAA Pfam Desc: ATPase family associated with various cellular activities(AAA)
  misc_feature (361)..(632): Pfam Id: DNA_pol3_delta Pfam Desc: DNA polymerase III, delta subunit
  misc_feature (181)..(634): NCBI GI: 20197093 NCBI Desc: similar to prokaryotic dna polymerase iii gamma subunit [arabidopsis thaliana]
  misc_feature (265)..(634): NCBI GI: 30683811 NCBI Desc: dna polymerase-related [arabidopsis thaliana]
  misc_feature (265)..(634): NCBI GI: 7262689 NCBI Desc: contains similarity to dna pol iii gamma and tau from chlamydia trachomatis gbae001306.1 and contains an aaa (atpase) pf00004 domain. [arabidopsis thaliana]
  misc_feature (743)..(978): NCBI GI: 115488218 NCBI Desc: os12g0289600 [oryza sativa (japonica cultivar-group)]
  misc_feature (280)..(839): NCBI GI: 79530257 NCBI Desc: atp binding / nucleoside-triphosphatase/ nucleotide binding [arabidopsis thaliana]
  misc_feature: Up-regulated in root tissues in response to salicylic acid treatment
MMDTRRHSVSVDVPLSRTLVQLKRVRSLRDPATNSMSKYASPSDHMIWETASSNGVTLDLGRSAHHHLVEEDEDVGAEPTMGSERSFRGPNARTASYRKSSAVRIRGLNPPRNKQVHRVRQDGHRKSLDSNHSNHSSIRQLANNVVNNVDADKEEEEVNSYERPKFAMPDKADEEVKMPDYSKFRSKSSAAMSRVGSPCMSASEARSVGSRRSTLGHGTEDTRLRSNDVVGSNFSGCGISYCWSGASKYRELYSDSDGPDQPLLSTDGTEAAFQGNVPYTETPRCLSQKFRPRSFSELIGLNVVAQSLLYSSCKGKVAPMYLFHGPRGTGKTSTARIFAAALNCVSLEEQRPCGFCKECVILFSGKSRDVKELDAAKMDRLGRVKALLKSASLVPYSSRFKVFIIDECHLLQEDAWSAILKSLDEPYRHTVYIMITSDIESLPRTSITHCQKFHFPKIKVADIVYRLERICIEEGLEFDHDGLYFIAAKSNGSLRDSEIMLDQLSLLGKKITISLVHELVGSVSDDELIELLDLALSSDTTNTVRRARELMGSAIDPLQLVSQLANLIMDILSGRCQSAVTEVSKSFLGRYALSEIGIKKLRHALKILSETEKQLRTSRNQATWVTVALLQFSTNEPNLAAEPNDMHAHSVTGYTDDWVSKVHSSANFCQACNSSKSNCSERHCRRLKLENIWRRAIGKCRSRSAKSFLRKEGFLSSVHVTEELAIAEVGFGHPDHLSRAEKMQSLIECSLQHVLGCNVEIRFKLVPCPVRKDARLKRQSFSFLNCSGRKQELSDSVVTDEDEVVRPGARETPLKGYTSSQQESPYTMQRVDSKPTVHGCEDDARSTLTSNRSMTDDLTRTCRSETNYSKGVSEHGHFDSIQEPDLQPNCFSRTLKLQKKLLSSGAAHTICLRIQPHNKMDFLPKKEFDTYFCAYEPYEQCSRSNSRATYSSRDDDLWSKNSRFGSNLLCWRAPKQSM

SEQ ID NO: 6277 - DNA, 1017 bp, Sorghum bicolor
  misc_feature: Ceres ANNOT ID no. 6064881
  misc_feature: Encodes the peptide sequence at SEQ ID NO 6278
atggcggccctcgtgccatggatcctacggcggcgacctgtccgctctgccacgtctctggtctccattcgtgattcatggcatcgaatgtgcggctcctcttcctcatctcctgcagcgtcgttcgagtgtttgtggggatggtttgggccagaggaacacaggcggaggtggaggccgtggtttcagcagcccgtgaggtgcgggagcacggggatcacactcgatacggacggcaagtttgcgaggttcggggtcggcgacacgggcgtcgccaaacagaaggggaggcagcagtcgcctccaaagaagaagatgtccaggaaggccaaggtcaaccagcttaagtggtaccgcctcaaggccaagaagaagatgaagtcccccaaccccgaagttaggatcagatacaagcttgaaaaggctaagaggaaggaggaatggttgattgagaagctgaggaagtatgatgtcccgaggacaccggagccagttcatgaccctgagattcttactgaggaggagaagttttatctcaagcgaactggggagaagaagaagaattatgttcctgttgggaggagaggggtttttggtggtgtggttctcaacatgcacctccattggaagaatcatgagactgtgaaggtggtttgcaagccttgtcgacctggacaagtttacgagtatgctgaggaattaacaaggctcagcaaaggcacaatcattgatattaaacccaataatacaattatgttttatcgggggaagaactatgtgcaaccacaggtgatgtcacctccagatactctttcaaagcagaaggccttagagaaatatagatatctacaatcccttgagcataccagccagtttattgagaagctagagaaggagcttgaagattacaagaagcatgttgctttattcaagaaccgtgagggagttgcttctgagaaaatcagcaacgaacattccactgttgacgatcctgcaactaccttagattctaaatga

SEQ ID NO: 6278 - protein, 338 aa, Sorghum bicolor
  misc_feature: Ceres ANNOT ID no. 6064881
  misc_feature (171)..(255): Pfam Id: CRS1_YhbY Pfam Desc: CRS1 / YhbY domain
  misc_feature (1)..(338): NCBI GI: 89212802 NCBI Desc: cfm6 [zea mays]
  misc_feature (60)..(312): NCBI GI: 57900276 NCBI Desc: group ii intron splicing factor crs1-like [oryza sativa (japonica cultivar-group)]
  misc_feature (60)..(312): NCBI GI: 57900277 NCBI Desc: group ii intron splicing factor crs1-like [oryza sativa (japonica cultivar-group)]
  misc_feature (60)..(312): NCBI GI: 57900278 NCBI Desc: group ii intron splicing factor crs1-like [oryza sativa (japonica cultivar-group)]
  misc_feature (88)..(322): NCBI GI: 90265163 NCBI Desc: h0522a01.2 [oryza sativa (indica cultivar-group)]
MAALVPWILRRRPVRSATSLVSIRDSWHRMCGSSSSSPAASFECLWGWFGPEEHRRRWRPWFQQPVRCGSTGITLDTDGKFARFGVGDTGVAKQKGRQQSPPKKKMSRKAKVNQLKWYRLKAKKKMKSPNPEVRIRYKLEKAKRKEEWLIEKLRKYDVPRTPEPVHDPEILTEEEKFYLKRTGEKKKNYVPVGRRGVFGGVVLNMHLHWKNHETVKVVCKPCRPGQVYEYAEELTRLSKGTIIDIKPNNTIMFYRGKNYVQPQVMSPPDTLSKQKALEKYRYLQSLEHTSQFIEKLEKELEDYKKHVALFKNREGVASEKISNEHSTVDDPATTLDSK

SEQ ID NO: 6279 - DNA, 1431 bp, Sorghum bicolor
  misc_feature: Ceres ANNOT ID no. 6064885
  misc_feature: Encodes the peptide sequence at SEQ ID NO 6280
atgtcattgggctatgctgagaagctgtcctaccgggaggatgtgggtactgtgggaatgcctgagatctttgagccccctgagctagtccagaataagatagaagagcttgctgccatggtgcaaaagagtaagcatttagtggtgtttactggggcagggatatcaacttcatcaggcatacctgattttcgagggcccaagggtgtctggaccttgcagcgtgcaggaaaaggtgttcctaatgcatcacttcccttccatcgtgctgttccaagcttgactcatatggcactagtcgaactggaaagaggagggtttctaaagttcgtcataagccagaatgttgacagcctacatctccgttctggtttcccaagggagaagctggctgaattacatggcaattctttcaaggagatctgcccatgctgtaaaactgagtaccttcgtgattttgagattgagacaataggactgaaggatactccaaggcgttgttctgataagaattgtggagctagattaaaagatacagttcttgactgggatgatgctttaccccctgaggagatgaattcggccaaggagcattgtcgatcagctgatcttgtcctttgtctaggaactagcttgcagattactcctgcatgtaatatgcctctgatgtcaatcaagaatggggggagggtggctattgtaaatcttcaggcaactccaaaggataaaaaggcaagccttgtcatccatggacttgttgataaggtcattgctggagtcatgagcaagttgagtctgcgaattcctccatatatacgtactgactttgttcagctcactctcaggcactctgtgaaaaagaaatgtgttagatggactcttcgagtaacaagtattcatggcctccgagcaccgttgccatttcttcagtctgtcaaggtttcctttccagaaagacctgacatgaagtctgtagtgcttaaagagcaaccattctcattgcagagggaaacatcaatgaataaaccatttttcatgctgttgacattaaatttcagtgatggttgcagctgcttgagctcatcaatcggatggcctgttgattttcagaagcaaaaagacagtttcgtcagagatagagctctagtcctaaaggagttgcagtctgctgccgagcatgagacttgcggtgggcaacaagaagttctggaaagagagatcctgccaagagctgagacatctattcatggaattgtaacaaacgtcgtcaggtatgacattgaagctgaaaagttggctccacccaaggatgatttgatgaatcacagccgcagcaaccctgcaaaacggcacatggaaggcactgattgccactcgccactgccaaagaaactgaaatactttttgaaagacgagaggctgaactgctaa

SEQ ID NO: 6280 - protein, 476 aa, Sorghum bicolor
  misc_feature: Ceres ANNOT ID no. 6064885
  misc_feature (52)..(216): Pfam Id: SIR2 Pfam Desc: Sir2 family
  misc_feature (1)..(476): NCBI GI: 14550108 NCBI Desc: sir2-like histone deacetylase [zea mays]
  misc_feature (1)..(466): NCBI GI: 38347038 NCBI Desc: osjnbb0067g11.13 [oryza sativa (japonica cultivar-group)]
  misc_feature (1)..(466): NCBI GI: 5353746 NCBI Desc: sir2-like protein [oryza sativa subsp. indica]
  misc_feature (1)..(356): NCBI GI: 109716216 NCBI Desc: sir2-family protein hdac1 [triticum aestivum]
  misc_feature (1)..(433): NCBI GI: 9758610 NCBI Desc: transcription regulator sir2-like protein [arabidopsis thaliana]
  misc_feature (1)..(271): SWISSPROT Homolog: EC 2.4.2.31 Mono-ADP-ribosyltransferase sirtuin-6
MSLGYAEKLSYREDVGTVGMPEIFEPPELVQNKIEELAAMVQKSKHLVVFTGAGISTSSGIPDFRGPKGVWTLQRAGKGVPNASLPFHRAVPSLTHMALVELERGGFLKFVISQNVDSLHLRSGFPREKLAELHGNSFKEICPCCKTEYLRDFEIETIGLKDTPRRCSDKNCGARLKDTVLDWDDALPPEEMNSAKEHCRSADLVLCLGTSLQITPACNMPLMSIKNGGRVAIVNLQATPKDKKASLVIHGLVDKVIAGVMSKLSLRIPPYIRTDFVQLTLRHSVKKKCVRWTLRVTSIHGLRAPLPFLQSVKVSFPERPDMKSVVLKEQPFSLQRETSMNKPFFMLLTLNFSDGCSCLSSSIGWPVDFQKQKDSFVRDRALVLKELQSAAEHETCGGQQEVLEREILPRAETSIHGIVTNVVRYDIEAEKLAPPKDDLMNHSRSNPAKRHMEGTDCHSPLPKKLKYFLKDERLNC

SEQ ID NO: 6281 - DNA, 576 bp, Sorghum bicolor
  misc_feature: Ceres ANNOT ID no. 6064887
  misc_feature: Encodes the peptide sequence at SEQ ID NO 6282
atgtcgtcgtcgtgctccactgccatcgacggcggcgccgcgaacccgccggcggccctggacctggcaccggacacggacgccccggcgggcgatggcctggaactggcgcagttcgcggcgggttgcttctggagcgtggagctgacgtaccagcgcctccccggcgtggcgcgcacggaggtcgggtacacgcagggccaccaccaggcccccacgtacgagctcgtctgcggccacggcaccgggcacgccgaggcggtgcgcctgcactacgaccccaaggcctgcccctacaccacgctcctcgacgtcttctgggcaaagatcaaccccaccacgctcaacagacagggcaaggacgtcgggacgcagtaccggacgggcatctactactacacggcggagcaggagtcgctggcggaggagcagaagaagtgggaggacaagatcgtcaccgagatcctgccggcgaagcggttctaccccgccgaggagtaccaccagcgctacctggagaagggcggccagtccgccgagaagggctgcactgaacccatgcgctgctacggctga

SEQ ID NO: 6282 - protein, 191 aa, Sorghum bicolor
  misc_feature: Ceres ANNOT ID no. 6064887
  misc_feature (35)..(189): Pfam Id: PMSR Pfam Desc: Peptide methionine sulfoxide reductase
  misc_feature (4)..(191): NCBI GI: 38345256 NCBI Desc: osjnbb0011n17.17 [oryza sativa (japonica cultivar-group)]
  misc_feature (4)..(191): NCBI GI: 90265066 NCBI Desc: h0510a06.16 [oryza sativa (indica cultivar-group)]
  misc_feature (12)..(191): NCBI GI: 90265065 NCBI Desc: h0510a06.15 [oryza sativa (indica cultivar-group)]
  misc_feature (24)..(191): NCBI GI: 40019251 NCBI Desc: peptide methionine sulfoxide reductase [secale cereale]
  misc_feature (15)..(191): NCBI GI: 31455408 NCBI Desc: methionine sulfoxide reductase [fragaria x ananassa]
  misc_feature (15)..(191): SWISSPROT Homolog: EC 1.8.4.11 Peptide methionine sulfoxide reductase
  misc_feature: Useful for making plants with modulated flowering time
  misc_feature: Functional homolog of the protein sequence given in SEQ ID NO 13951
MSSSCSTAIDGGAANPPAALDLAPDTDAPAGDGLELAQFAAGCFWSVELTYQRLPGVARTEVGYTQGHHQAPTYELVCGHGTGHAEAVRLHYDPKACPYTTLLDVFWAKINPTTLNRQGKDVGTQYRTGIYYYTAEQESLAEEQKKWEDKIVTEILPAKRFYPAEEYHQRYLEKGGQSAEKGCTEPMRCYG

SEQ ID NO: 6283 - DNA, 1032 bp, Sorghum bicolor
  misc_feature: Ceres ANNOT ID no. 6064893
  misc_feature: Encodes the peptide sequence at SEQ ID NO 6284
atggccgccgacgaccttcacagcctcgccaccgtcgcggccgcggtgatcgcgtgcatgggctacgcccgcttcgccgcgcggcggctccgcccgggcctgccccgccttgccgcgttcctcccggtgctcgccaccttgcctttcctcccgctcgccttccgtgcgctccacccgcgcgccgtgtccgggttcttcctcgcctgggccgccgagttcaagctcctgctcctcgcatccggccagggcccgctccagccgaccctcccgctgcccaccttcgtcgccatcgccaccttacccgttacgctacggggtcccaagagcaagagctccgccgcgaggccgggcctggggctcgtggagtccgccgtcatggccgcgctgctcgcggccatcgtgtcgctgtaccggtacgaggagcggatgaacgggtacgtcctgctcacgctctactccgtgcacgtgtacctcgcgctggagctcgtcctggcggcggccgccgcggcgtcgcgcgcgctggcggggctggagctggagccccagttcgaccggccctacctctcggcctcgctgcgggacttctggggccggaggtggaacctctccgtgccggcgctgctccgccagtgcgtgttccgccccgtgcgggcgcgcctcggcgtccgcgcgggtgtgctagccgcgttcgtcgtctccggcctgatgcacgaggccatgttctcctacatcacgctgctgccgccgacgggggaggcggccgcgttcttcacgctgcacggggcgtgcgcggtggcggaggggtggtgggccgcgcacgaagggtggccgcgcccgccgcgcgccctggccacgccgctgacactggcgttcgtcggcgtcacggggttctggctcttctttcccccgatcacgaggcccggcgccgacaagcaggtgatcgccgagtgcgaggccatggtcgcgttcctgcgggacgccgcgggctgggcggttgactccgcctggtcagtcttgtctagccggtcgtaa

SEQ ID NO: 6284 - protein, 343 aa, Sorghum bicolor
  misc_feature: Ceres ANNOT ID no. 6064893
  misc_feature (1)..(340): NCBI GI: 90265062 NCBI Desc: h0510a06.12 [oryza sativa (indica cultivar-group)]
  misc_feature (1)..(340): NCBI GI: 115459030 NCBI Desc: os04g0481900 [oryza sativa (japonica cultivar-group)]
  misc_feature (1)..(343): NCBI GI: 90265061 NCBI Desc: h0510a06.11 [oryza sativa (indica cultivar-group)]
  misc_feature (1)..(343): NCBI GI: 38345253 NCBI Desc: osjnbb0011n17.14 [oryza sativa (japonica cultivar-group)]
  misc_feature (8)..(327): NCBI GI: 58532043 NCBI Desc: osjnba0009k15.16 [oryza sativa (japonica cultivar-group)]
MAADDLHSLATVAAAVIACMGYARFAARRLRPGLPRLAAFLPVLATLPFLPLAFRALHPRAVSGFFLAWAAEFKLLLLASGQGPLQPTLPLPTFVAIATLPVTLRGPKSKSSAARPGLGLVESAVMAALLAAIVSLYRYEERMNGYVLLTLYSVHVYLALELVLAAAAAASRALAGLELEPQFDRPYLSASLRDFWGRRWNLSVPALLRQCVFRPVRARLGVRAGVLAAFVVSGLMHEAMFSYITLLPPTGEAAAFFTLHGACAVAEGWWAAHEGWPRPPRALATPLTLAFVGVTGFWLFFPPITRPGADKQVIAECEAMVAFLRDAAGWAVDSAWSVLSSRS

SEQ ID NO: 6285 - DNA, 861 bp, Sorghum bicolor
  misc_feature: Ceres ANNOT ID no. 6064900
  misc_feature: Encodes the peptide sequence at SEQ ID NO 6286
atgtgcctcgccgccgcgtgcgcgtccgcctcctcccctgcacgccgcctctcgccctccgcctccaccgcgctcccgcgccgcttcctccacagcctcctcagcacccccacgaggccttcttccccgccgccaccgcctctgctgcggcgctgcttcaagttctaccagatggcgcaatattggagtcaaccatcactggacaggaacaaggctctggttgagtacctaaagcagtatggtgttgttagaactgaaaaagtggcggaagtaatggaaacgattgatagagcactatttgtaccagagggtaccccttacattgacagtcctatgcctattggtttcaacgcaacaatatctgctcctcacatgcatgcaacctgcttagagctattgaaggatcatttgcaaccaggaatgcatgctctggatgttggatcaggtagcggctacctgacagcttgttttgccatgatggttggaccagaaggccgtgctgtgggaattgaacacattcctgagcttgttgcttcttctattgaaaatgtgcaaagaagtgctgcagctccactactgagggatggatcactctcttttcatgttacagatggcaggcttggctttccagacgcagcaccctatgatgctatccatgttggtgcagcggcacccgagatccctcagcctctgcttgatcagctaaagcctggcggccggatggtcataccagttggtacctacttgcaggacctgcaggtggtcgacaagaacacggatggatcaatcagtgtccggaacgacgcctctgtgcgctacgtcccactgaccagccgctccgcgcagttgcaggacccctaa

SEQ ID NO: 6286 - protein, 286 aa, Sorghum bicolor
  misc_feature: Ceres ANNOT ID no. 6064900
  misc_feature (68)..(281): Pfam Id: PCMT Pfam Desc: Protein-L-isoaspartate(D-aspartate) O-methyltransferase(PCMT)
  misc_feature (144)..(243): Pfam Id: Methyltransf_11 Pfam Desc: Methyltransferase domain
  misc_feature (58)..(285): NCBI GI: 2499570 NCBI Desc: protein-l-isoaspartate o-methyltransferase (protein-beta-aspartate methyltransferase) (pimt) (protein l-isoaspartyl methyltransferase) (l-isoaspartyl protein carboxyl
  misc_feature (58)..(285): NCBI GI: 2499570 (continued) methyltransferase)
  misc_feature (58)..(285): NCBI GI: 90265055 NCBI Desc: h0510a06.5 [oryza sativa (indica cultivar-group)]
  misc_feature (58)..(285): NCBI GI: 38345249 NCBI Desc: osjnbb0011n17.10 [oryza sativa (japonica cultivar-group)]
  misc_feature (58)..(284): NCBI GI: 1322021 NCBI Desc: l-isoaspartyl methyltransferase
  misc_feature (58)..(284): NCBI GI: 4678355 NCBI Desc: protein-l-isoaspartate(d-aspartate) o-methyltransferase [arabidopsis thaliana]
  misc_feature (58)..(285): SWISSPROT Homolog: EC 2.1.1.77 Protein-L-isoaspartate O-methyltransferase
MCLAAACASASSPARRLSPSASTALPRRFLHSLLSTPTRPSSPPPPPLLRRCFKFYQMAQYWSQPSLDRNKALVEYLKQYGVVRTEKVAEVMETIDRALFVPEGTPYIDSPMPIGFNATISAPHMHATCLELLKDHLQPGMHALDVGSGSGYLTACFAMMVGPEGRAVGIEHIPELVASSIENVQRSAAAPLLRDGSLSFHVTDGRLGFPDAAPYDAIHVGAAAPEIPQPLLDQLKPGGRMVIPVGTYLQDLQVVDKNTDGSISVRNDASVRYVPLTSRSAQLQDP

SEQ ID NO: 6287 - DNA, 2295 bp, Sorghum bicolor
  misc_feature: Ceres ANNOT ID no. 6064902
  misc_feature: Encodes the peptide sequence at SEQ ID NO 6288
atgcgggtaggagcctgccatgacctcagcaccgtcacgcccacgccgcggcagcagagtatggcggcgcagctcgagcgcgggtccctactggttggcgggcgcgagctcctcgtccgcgccccgcctaacgtcaccctacggcctgccggtgaggccgccgccgccgccgactcgggcgccgcgttcctcggagccacggcggcggcggcgtccagccgccacgtgttctccgtcggaaacctggcaagtgggtggaggtggctgtcactgttcaggttcaagatctggtggatgatcccggccacgggcgccggcgcggcggctatgccggcggagacgcagatgctgcttctggagtacaggagcgaggccaggacggagcgtggctcactgtacgcgctgatgctgccggttcttgacggcggcttccgggccagcctccaggggagccccgaggacgagctccagttctgcttcgagagcggtgatcctgatgtccagacgatggaagcagttgatgcagtgtttatcaactcaggggacaaccccttcaagcttctgaaggaatccatcaagatggtgtccaagatcaaaggaactttcagtcatatagaggacaaggagattccttcaaatttggactggtttgggtggtgcacttgggatgcattttacaaagctgttaacccaagtgggattgaggagggccttcaaagtctgcgtgaaggtggtgtgccaccaaggtttctgattatagatgatggctggcaagaaacagttgacgaattcaaggaaggggacgaagccatccgtgagcaggccgtatttgcgcataggctgagtgatctgaaggagaaccataagttcaggggagaaacctgcaagaatcttgaggacctcattaagaagataaaagaaaaacatggagtcaagtacatctacatgtggcatgctctacttggatattggggaggcgtcttagcaacatctgatgcgatgaagaagtataatccaaagcttctttacccagtccaatcaccgggtaatgttgcgaatctgagggatattgccatggacagcttggagaaatttggagtgggcatcgttgatcctgacaagatatatgagttctacaatgatcagcacagctacctttctagtgtgggtgtggatggagtgaaggttgatgttcagaacgtgttggaaactcttggacgcggacttggtggacgtgttgcagtaactcaaaagtatcagcaggctcttgaggaatccattgcccagaacttcaaaacaaacaacctaatctgctgcatgagtcacaattcagacagcatctttagtgccttgaagagtgcagttgctagagcctcagaagatttcatgcctagggaaccaacactgcaaactctgcacatcgcttctgtggcattcaatagcctattgttgggagagatcttcatacctgactgggatatgttccatagcaagcatgaatcagcggaatttcacggagctgctagagccctgagtggtggtggggtttatgtcagcgataaacctggggtgcatgatttcaatgttctaaaaaagcttgttctaccagacggctcgattctaagagcaaggtatgctggtcgtcctacacgcgattgtctgttcactgacccagtcatggatggcaaaagtctgctgaagatatggaacttgaacaatttcactggtgtcattggagtgttcaattgtcagggagctggacagtgggtttggccagtgaaagaaactgcttatgttcctatcaacgtaaacatcattggtcagctctcaccgtccgatgtagagtctctcgaggagatagctggtgatgattgggatggagagactgcagtatatgctttcggttcatgttctctttcaaggcttcagaagcacaaaagtttggaggtttcattgtctactatggcatgtgagatttacaacatttcaccaataaagattttcagcgaagccgtttggtttgcgcctcttggactgatcgacatgttcaactccggtggtgcacttcacaatgtttcaagtgttgcagattcttcagctacgaccgttcatatcagatgccgaggaccagggtggtttggggcgtattcagccaccaggccagagctttgcagagttgatgaacacgaagtggagttcactcatgcagaggatggcctgctgaccttttatctccccctttcttcctcccaggacaacctgagacacattgaaattgtctacagagctttatga

SEQ ID NO: 6288 - protein, 764 aa, Sorghum bicolor
  misc_feature: Ceres ANNOT ID no. 6064902
  misc_feature (23)..(745): Pfam Id: Raffinose_syn Pfam Desc: Raffinose synthase or seed imbibition protein Sip1
  misc_feature (23)..(763): NCBI GI: 38345247 NCBI Desc: osjnbb0011n17.8 [oryza sativa (japonica cultivar-group)]
  misc_feature (23)..(763): NCBI GI: 90265053 NCBI Desc: h0510a06.3 [oryza sativa (indica cultivar-group)]
  misc_feature (99)..(763): NCBI GI: 115459016 NCBI Desc: os04g0481100 [oryza sativa (japonica cultivar-group)]
  misc_feature (28)..(692): NCBI GI: 91075914 NCBI Desc: alkaline alpha galactosidase [cucumis sativus]
  misc_feature (28)..(693): NCBI GI: 29838631 NCBI Desc: alkaline alpha galactosidase ii [cucumis melo]
MRVGACHDLSTVTPTPRQQSMAAQLERGSLLVGGRELLVRAPPNVTLRPAGEAAAAADSGAAFLGATAAAASSRHVFSVGNLASGWRWLSLFRFKIWWMIPATGAGAAAMPAETQMLLLEYRSEARTERGSLYALMLPVLDGGFRASLQGSPEDELQFCFESGDPDVQTMEAVDAVFINSGDNPFKLLKESIKMVSKIKGTFSHIEDKEIPSNLDWFGWCTWDAFYKAVNPSGIEEGLQSLREGGVPPRFLIIDDGWQETVDEFKEGDEAIREQAVFAHRLSDLKENHKFRGETCKNLEDLIKKIKEKHGVKYIYMWHALLGYWGGVLATSDAMKKYNPKLLYPVQSPGNVANLRDIAMDSLEKFGVGIVDPDKIYEFYNDQHSYLSSVGVDGVKVDVQNVLETLGRGLGGRVAVTQKYQQALEESIAQNFKTNNLICCMSHNSDSIFSALKSAVARASEDFMPREPTLQTLHIASVAFNSLLLGEIFIPDWDMFHSKHESAEFHGAARALSGGGVYVSDKPGVHDFNVLKKLVLPDGSILRARYAGRPTRDCLFTDPVMDGKSLLKIWNLNNFTGVIGVFNCQGAGQWVWPVKETAYVPINVNIIGQLSPSDVESLEEIAGDDWDGETAVYAFGSCSLSRLQKHKSLEVSLSTMACEIYNISPIKIFSEAVWFAPLGLIDMFNSGGALHNVSSVADSSATTVHIRCRGPGWFGAYSATRPELCRVDEHEVEFTHAEDGLLTFYLPLSSSQDNLRHIEIVYRAL

SEQ ID NO: 6289 - DNA, 1671 bp, Sorghum bicolor
  misc_feature: Ceres ANNOT ID no. 6064904
  misc_feature: Encodes the peptide sequence at SEQ ID NO 6290
atggcggcctccacctctccactgctcctcctcgcccttctcctcctacccgcgctcacggcggcggcctcgctcccggcgctgccgctctcgacggcgtcgcgttggattgtgggcgcggacgggcggcgcgtgaagctggcgtgcgcgacctgggcttcgcacctggagcccgcagccgcggagggcctggcgcggcgcggcgtgtcggacatcgcagcgcgcgtggcggcgatggggttcaactgcgtcaggctcacctggccgacctatctcgccaccaacgttacgctcgcttcgctgccgctgcggtggtcgctggagcgccttggcatgctggagtccgtcgccggcgtgcgggtcaacaaccccgccctcctcgacctgcccctcgtcgacgtgttccgggaagtggtgtcatcattagccagcaaaggtattatggtcatacttgacaaccaaatgaccactccaggatggtgctgcagcagaattgatggcaatggcttctttggagatgtgtacttcgaccctgatgaatggttgaaaggcctcagtgcaatggcaactatgtttaacaacacaaaaaatgttgttggcatgagcttgcggaatgaacttcgaggcccaaaacaaaatgttagtttgtggtacaggtacatgcagatgggtgctgaagctgtacatgctgcaaaccctaacgtcctggttattttatcgggcctggattttgacaacactctcagcttcttgttcaaagaaaaagtccacctatcattttccggaaagttagtttatgagcaacattggtatggcttctcagatggtggcaattgggaaactcagaaccaaaacgatgtttgtgcgatggttgttgatttcatatgggctaaaggattattcctacttcaacaaggctggccgttgtttttctctgagtttggatttgatatgtcaggcacacatattggtgacaatcgctatcttacctgcttcttaagtgtggcagctgaaatggatctggactggtcaatttgggctctgcaagggagttactatatcagagagggtattttagcttatgacgaatcatatggattgctatcatgggactggtgtacggctagaaatcctagcttcattaaaaggatcaattctctccaatcaccattccaaggtcctggtcttccaaacagtcaagagccatacaacataatctttcatccccaaagtgggctttgcgtcttggccaggtcttcaaagttacttgagttgggtccatgcgacgaatcaaacgcctggaactacacctcagcatacaacctagtagtgaaaaacacaggacaatgccttcaagtgaagtcggtgggcaagaatgcaaagcttggcaccgattgcagcaaaccaagttcgaagtggaacctgatatcgaattcaaagatgcatgtttcggctgagctcacaaaaaatggaaccagggtttgcttggacgccagccctgctggtgccatcataacaaatcagtgcaagtgcctaagtgtagatccgacctgtgaccctgagagtcagtggttcaaagtgatcgtaagcagtagagacatacctgggggcgactccatcttgcagttgccgtcacttggtccctggccttcgacatcccttagttcttga

SEQ ID NO: 6290 - protein, 556 aa, Sorghum bicolor
  misc_feature: Ceres ANNOT ID no. 6064904
  misc_feature (36)..(353): Pfam Id: Cellulase Pfam Desc: Cellulase (glycosyl hydrolase family 5)
  misc_feature (2)..(555): NCBI GI: 90265051 NCBI Desc: h0510a06.1 [oryza sativa (indica cultivar-group)]
  misc_feature (3)..(555): NCBI GI: 38345244 NCBI Desc: osjnbb0011n17.5 [oryza sativa (japonica cultivar-group)]
  misc_feature (3)..(555): NCBI GI: 116309844 NCBI Desc: osigba0158f13.11 [oryza sativa (indica cultivar-group)]
  misc_feature (1)..(405): NCBI GI: 115459012 NCBI Desc: os04g0481000 [oryza sativa (japonica cultivar-group)]
  misc_feature (22)..(554): NCBI GI: 38345246 NCBI Desc: osjnbb0011n17.7 [oryza sativa (japonica cultivar-group)]
MAASTSPLLLLALLLLPALTAAASLPALPLSTASRWIVGADGRRVKLACATWASHLEPAAAEGLARRGVSDIAARVAAMGFNCVRLTWPTYLATNVTLASLPLRWSLERLGMLESVAGVRVNNPALLDLPLVDVFREVVSSLASKGIMVILDNQMTTPGWCCSRIDGNGFFGDVYFDPDEWLKGLSAMATMFNNTKNVVGMSLRNELRGPKQNVSLWYRYMQMGAEAVHAANPNVLVILSGLDFDNTLSFLFKEKVHLSFSGKLVYEQHWYGFSDGGNWETQNQNDVCAMVVDFIWAKGLFLLQQGWPLFFSEFGFDMSGTHIGDNRYLTCFLSVAAEMDLDWSIWALQGSYYIREGILAYDESYGLLSWDWCTARNPSFIKRINSLQSPFQGPGLPNSQEPYNIIFHPQSGLCVLARSSKLLELGPCDESNAWNYTSAYNLVVKNTGQCLQVKSVGKNAKLGTDCSKPSSKWNLISNSKMHVSAELTKNGTRVCLDASPAGAIITNQCKCLSVDPTCDPESQWFKVIVSSRDIPGGDSILQLPSLGPWPSTSLSS

SEQ ID NO: 6291 - DNA, 1515 bp, Sorghum bicolor
  misc_feature: Ceres ANNOT ID no. 6064961
  misc_feature: Encodes the peptide sequence at SEQ ID NO 6292
atgatcgagcagttcgtcaacttcgtcatccggccgcctcgtgcagagtacaatccagatcagtatttatgggagccagagtttactctcgctggaaggaagtataaaaggctagatttggagcttacaaatgaaagaagtcagaccttaaaatgcagccactatgttcctgctgtcatcccagaaaacactgcccttccatgtgtagtctactgccatgggaatagtggatgcagagcagatgcaaatgaagctgctgtcatacttcttccttcaaatatcaccctttttacacttgactttgcgggatcagggctatcaagcggagattatgtcagtcttggttggcatgagaagcaggatctcaaatgtgccgtgtcctttctgcgtaacaataagcaagtttctcgtataggcctttggggacgctcgatgggtgctgttacaagtctgctatatggagcagaagacccctcaattgctggcatggttctggatagtgctttcgctaacttatacgacttgatgatggagctcgtagaagtttacaaaatacgggttcctaagttcacggttaagatggctgttcagtacatgcgacgtgtcattcagaaaagagctaaatttgacataatggatcttaatgttgtccagtttgcacccaagacgtttattcctgcattatttggacatgcttcaaatgatatgtttattcagccacatcacacagaacgtattcatcaggcatatgcgggggataaaaatctaatcaaatttgagggtgatcacaattccccaaggccccagttttattacgactctgtttcaatattcttctacaacgttcttcacccacctcagtttccttcaacttgcacaaataaatttgataagtattacaaccttggtgcttttaagggtggtgctggtaccaatgagagcttattgtatgagatcatcaatggtctacgggcagctggcactgatgcaggaagttcatcagctgctacagctaatttcacaaatgctacaaaatcagtagttgaattgctgacagagagggtaaatcagctatctgttaaaaatgataatgacttggattttcttttggatgaaaatcagaacctcactgagatggacggtaacacaggggagtgtcatttagaggataaagcaaacagacaaacagaggaatgctgttcatacaccagctcaaacagagagagctggggacgatgttcttccttgggtggagctagtgatggatcgtcatcaggcgagcagcctgaggtacctaatcataagaacaagagtatgtcactaagggctctagcaacgccattgagacgggtacgaaggaaacctctacctctcacgatcccgaaggagaagaagaatcgatcactgtggaagaggttaaaaaaagagaggcaagagatgggggaaaacatatcccagcgtctccggttgtgtctccaaggccaggctcgacacaagagaaccaaatcgtcttga

SEQ ID NO: 6292 - protein, 504 aa, Sorghum bicolor
  misc_feature: Ceres ANNOT ID no. 6064961
  misc_feature (2)..(305): NCBI GI: 79474471 NCBI Desc: catalytic [arabidopsis thaliana]
  misc_feature (2)..(312): NCBI GI: 79415968 NCBI Desc: catalytic [arabidopsis thaliana]
  misc_feature (3)..(294): NCBI GI: 28828687 NCBI Desc: similar to dictyostelium discoideum (slime mold). random slug cdna-11 (fragment)
  misc_feature (122)..(289): NCBI GI: 115453097 NCBI Desc: os03g0359000 [oryza sativa (japonica cultivar-group)]
  misc_feature (9)..(282): NCBI GI: 67624169 NCBI Desc: random slug cdna-11 (fragment) [cryptosporidium hominis]
MIEQFVNFVIRPPRAEYNPDQYLWEPEFTLAGRKYKRLDLELTNERSQTLKCSHYVPAVIPENTALPCVVYCHGNSGCRADANEAAVILLPSNITLFTLDFAGSGLSSGDYVSLGWHEKQDLKCAVSFLRNNKQVSRIGLWGRSMGAVTSLLYGAEDPSIAGMVLDSAFANLYDLMMELVEVYKIRVPKFTVKMAVQYMRRVIQKRAKFDIMDLNVVQFAPKTFIPALFGHASNDMFIQPHHTERIHQAYAGDKNLIKFEGDHNSPRPQFYYDSVSIFFYNVLHPPQFPSTCTNKFDKYYNLGAFKGGAGTNESLLYEIINGLRAAGTDAGSSSAATANFTNATKSVVELLTERVNQLSVKNDNDLDFLLDENQNLTEMDGNTGECHLEDKANRQTEECCSYTSSNRESWGRCSSLGGASDGSSSGEQPEVPNHKNKSMSLRALATPLRRVRRKPLPLTIPKEKKNRSLWKRLKKERQEMGENISQRLRLCLQGQARHKRTKSS

SEQ ID NO: 6293 - DNA, 675 bp, Sorghum bicolor
  misc_feature: Ceres ANNOT ID no. 6064963
  misc_feature: Encodes the peptide sequence at SEQ ID NO 6294
atgggtgctgtgcttggacggcatgacacccacaagcggagtttccatggttcgaagctggagtcaaagatggttgatgctatgcagaagagagcgttgcatggaacttcactgaaatcgttcgatagtattatcatgaagttccccaaaatagacgagagttttagaaaatgcaagactatcttcgaacaatttgatgaagattccaatggcgaaatagataaagaagaactgaaacattgttttcaaaagctggaaatctcattcacagaggaggagatatctgatctctttgaagcttgcgatataaatgaagatatgggcatgaagttcaatgagttcattgtctttctgtgccttgtctatcttctcaatgaaccagctgtctcagaagcaaagataaagatgggactaggaaatcttgaggcaacttttgagaccttggttgatgcatttgtcttcttggataagaataaggatgggtatgtgagcaaggatgagatgatccaagcaataaatgagaccacaacaggagagcgctcttctgggcgtatagccatgaaaagatttgaggaaatggactgggacaagaatggaatggtgacattcaaggaatttctctttgccttcactcgttgggtagggattgatgaaaatgaggatgacgatgaataa

SEQ ID NO: 6294 - protein, 224 aa, Sorghum bicolor
  misc_feature: Ceres ANNOT ID no. 6064963
  misc_feature (57)..(85): Pfam Id: efhand Pfam Desc: EF hand
  misc_feature (147)..(175): Pfam Id: efhand Pfam Desc: EF hand
  misc_feature (1)..(224): NCBI GI: 49388350 NCBI Desc: calcium-binding ef hand-like protein [oryza sativa (japonica cultivar-group)]
  misc_feature (1)..(224): NCBI GI: 62867639 NCBI Desc: at4g26470 [arabidopsis thaliana]
  misc_feature (8)..(224): NCBI GI: 48095044 NCBI Desc: similar to cg11638-pa [apis mellifera]
  misc_feature (10)..(115): NCBI GI: 3800847 NCBI Desc: vu91b calmodulin [synthetic construct]
  misc_feature (52)..(118): NCBI GI: 3800851 NCBI Desc: vu91d calmodulin [synthetic construct]
MGAVLGRHDTHKRSFHGSKLESKMVDAMQKRALHGTSLKSFDSIIMKFPKIDESFRKCKTIFEQFDEDSNGEIDKEELKHCFQKLEISFTEEEISDLFEACDINEDMGMKFNEFIVFLCLVYLLNEPAVSEAKIKMGLGNLEATFETLVDAFVFLDKNKDGYVSKDEMIQAINETTTGERSSGRIAMKRFEEMDWDKNGMVTFKEFLFAFTRWVGIDENEDDDE

SEQ ID NO: 6295 - DNA, 1344 bp, Sorghum bicolor
  misc_feature: Ceres ANNOT ID no. 6064968
  misc_feature: Encodes the peptide sequence at SEQ ID NO 6296
atggggcaaaaggactccaagccttcatatggatatggatactcttatgattacggcagtacttcgtcaggatataactcgagaaatactggaaatacgtcctccggttatagcgcgaggtatgcgccttcttcagagaacaatgtacagccagaaacaaccgcaaggttgcagaggaagtattccaggattggggatgactatcgttctttgagtcaggtgactgaagctttggcacaagcaggtcttgaatcttcaaatcttatcgtaggcattgattttacaaagagcaatgaatggacaggtaaaatttccttcaatcgtcgctgcctgcatgatattggaaacactccaaacccatatgagcaagctatatctattattggaaggacactttcagcatttgatgaagataatttgattccctgctttggatttggcgacgcatcaactcatgatcaggaggtattcagcttttacccagagaaccgcccatgcaacggatttgaagaggcgctagacagatacagagaaattgttccaactcttcgattagcaggtcctacatctttcgctccaataattgagacagcagttggaattgttgacagcactggtggtcaatatcatgttcttctgataattgcagatggacaggtcacccgaagcgtcgatacacaatctggacaattaagtccacaggagcgggctactattgatgcaatagtaagagcgagccagttccccttgtcaattgttcttgttggggttggtgatggaccatgggacatgatgcaccagtttgatgacaatatacctgctcggtcatttgacaatttccagtttgtgaatttcacggagattatgtcaaagagtgtagcagctgacagaaaggaggcagaatttgcattgtcagcactgatggaaatccctacacagtacaaagcaacacttgatctccaactcttaggccgccgccaaagaataactccaagaattgctctgccaccaccaataaggaatgcttattcacggtctactagctttagccaacagtctggtgtttattcacgatcaagtagctttgaccaacagacaagtggttttcaacaacgttcggagagcttgaaacagcagcagcctgcagccccaaagagacctgacactgacacttatgcatcagaaagagctttagaggacagaattctgtgccccatctgcatgtataaatcgaaggaccttgcatttggatgtggacatcagacttgctatgaatgcgggaagaatttggagcgctgccctctatgccagcagcacataaccacaaggatcaggctctactga

SEQ ID NO: 6296 - protein, 447 aa, Sorghum bicolor
  misc_feature: Ceres ANNOT ID no. 6064968
  misc_feature (110)..(258): Pfam Id: Copine Pfam Desc: Copine
  misc_feature (44)..(381): NCBI GI: 42408845 NCBI Desc: copine i-like [oryza sativa (japonica cultivar-group)]
  misc_feature (6)..(447): NCBI GI: 60459371 NCBI Desc: ring-finger protein [capsicum annuum]
  misc_feature (2)..(447): NCBI GI: 56785364 NCBI Desc: copine iii-like [oryza sativa (japonica cultivar-group)]
  misc_feature (11)..(447): NCBI GI: 109627815 NCBI Desc: copine-like protein [oryza sativa (japonica cultivar-group)]
  misc_feature (1)..(407): NCBI GI: 30697566 NCBI Desc: copine-related [arabidopsis thaliana]
MGQKDSKPSYGYGYSYDYGSTSSGYNSRNTGNTSSGYSARYAPSSENNVQPETTARLQRKYSRIGDDYRSLSQVTEALAQAGLESSNLIVGIDFTKSNEWTGKISFNRRCLHDIGNTPNPYEQAISIIGRTLSAFDEDNLIPCFGFGDASTHDQEVFSFYPENRPCNGFEEALDRYREIVPTLRLAGPTSFAPIIETAVGIVDSTGGQYHVLLIIADGQVTRSVDTQSGQLSPQERATIDAIVRASQFPLSIVLVGVGDGPWDMMHQFDDNIPARSFDNFQFVNFTEIMSKSVAADRKEAEFALSALMEIPTQYKATLDLQLLGRRQRITPRIALPPPIRNAYSRSTSFSQQSGVYSRSSSFDQQTSGFQQRSESLKQQQPAAPKRPDTDTYASERALEDRILCPICMYKSKDLAFGCGHQTCYECGKNLERCPLCQQHITTRIRLY

SEQ ID NO: 6297 - DNA, 2988 bp, Sorghum bicolor
  misc_feature: Ceres ANNOT ID no. 6064971
  misc_feature: Encodes the peptide sequence at SEQ ID NO 6298
  misc_feature: Down-regulated in shoot tissues in response to aminocyclopropane carboxylic treatment
  misc_feature: Up-regulated in shoot tissues in response to salicylic acid treatment
  misc_feature: Up-regulated in root tissues in response to salicylic acid treatment
atggacgacagcctctacgacgagttcggcaactacataggcccagagctcgccgactccgacgccgatgacgactccgacgctggcggcgcctcaccgtccccctccgcgtccggctcgccgtcaccggcggcgcgctcctcgtcgggctccccctcccgcccagccgcgctcatggacgtcgacgacgacgagggcgacccgtcccagcaggccgtggtgctcgccgaggacaaaaagtactaccccaccgccgaggaggtgtacggacctggcgtggaggcgctcgtcatggacgaggacgagcagccgctcgagatgcccatcatcgcgccgccccgcgtcgtgaagttcgaggtcgggacccgcgccgcggccacgtctacctacgcgtccaccgacttcctcctcggcctcgcgggcaaccccgcgctcgtccgcaacgtcaccctcgtcggccacctccagcacgggaagacggtgttcatggacatgctcgtagagcagacacacgaagtggacaccttcgactctgagggggagcgccatgtgcggttcactgacacaagggtggacgagcaggagaggcaggtctccatcaaggctgtgccaatgtcgcttgttctcgaggggggaaacggcaagtcatacctgtgcaacatcatggacacgcccgggcatgtcaacttctctgatgagatgactgcagcactgagacttgcggatggcgctgtgctcgttgttgatgctgccgagggagtaatggttaatactgagagggcaattcgtcatgcaattcaagaaaggcttcccatcgttgttgtgattaacaaggttgacagattgataacagaactaaagctgcccccaaatgatgcatatttcaagctgaggcatactctagaggcaattaatgatcttatctcatcatgttctactacagtaggtggcactcagctggtggatcctgctgctggaaatgtatgttttgcaagtggtgctgctggctggtcttttaccttacagtcttttgcccatctctacttaaagattcatgggattcaatttgaccatgagaaatttgcatctcgcctatggggagacctgtattttcaccctgattctagaacctttaaaaagaagccgccaaaggaaggagctaacagatcatttgttgagtttatccttgagcctctgtacaaaatttatagtctggtcgttggtgagcaaaaagggaatgtggaatcaaagcttgctgaattgggtgtcacgttgagcaatgcagcttataagcttaatgttagacctttgctgaggttagcttgccgctcaatttttggcactgctactggttttaccgatatgttagtgaaacatatcccctcagtgaaggatgctgctgcaaggaagatagaccacatatacactggaccacaagattcctctattgtggatgctatgaaaaaatgtgatcccaatggaccccttatggttaacgtaacaaaactatatccaaagtctgattgcagtgtctttgatgcctttggacgagtttacagtggcacaatacagactggacagactgtgagggtccttggagaaggctattctccagatgatgaagaggatatgactgtcaaagaggtgaccaaattgtgggtttatcaggcacgataccgtgttgcaattagtaaagcccctgctggctcttgggttcttattgaaggtgtagatgcatcaataatgaaaactgctactatatgtcctatgaatattgatgaagatgtatacatatttagacctctacgtttcaacaccttgcctgttgtaaaaatagctgctgagcctctcaacccaagtgagcttcctaaaatggtcgaaggtcttcgtaaaattagcaagagctatcctcttgctattaccaaggttgaggagtctggagagcacactatcctggggactggtgaactatatctggattccataatgaaggacctcagagagctttattcagaggttgaggtgaaggtagcagatcctgttgttacattttgtgaaacagttgttgatacttcttctatgaaatgttttgctgaaacacctaacaagaggaacaaaattactatgcttgccgaaccattagagaagggcttagcagaagatattgagaatggtcttgttagcctggattcaaggcagaaagaaattactgacttctttcgccaacgctaccagtgggatgtgcttgcagctaggtcgatatgggcttttggacctgacaagcagggtcctaacattcttctggatgacacactttcaattgaggttgacaagaacctgctcaatgcggtcaaagattcaattgttcaagggttccagtggggtgctagagaaggtcctttgtgtgatgaaccaattaggaacgtgaaattcaagatcttaaatgcaaacatagctccagaaccattgcatcgtggtggtggtcagataattcccacagcacgtcgtgttgtctactctgcattccttatggctaatcctcgccttatggaacctgtgtattatgttgagatccaaacaccaattgactgtgtgtctgcaatttatacggtgctatcccggcggcgtggtcacgtaacagctgatgtgcccaagccaggcactccaatatacattgttaaggcatttttacctgttatagagtcttttggatttgagacagatctcagataccatacccagggacaagccttttgtttgtcagtattcgatcactgggctattgttcctggtgaccccttagataagagtattgttcttcgccccctggagccagcacctatacagcaccttgcccgtgagttcatggtaaagaccaggcgaaggaagggcatgagtgaagatgtgagcatcaataaattcttcgacgaggccatgatgaatgagctggctcaacaggctgctgatatccacttgcaaatgatgtag

SEQ ID NO: 6298 - protein, 995 aa, Sorghum bicolor
  misc_feature: Ceres ANNOT ID no. 6064971
  misc_feature (144)..(462): Pfam Id: GTP_EFTU Pfam Desc: Elongation factor Tu GTP binding domain
  misc_feature (848)..(937): Pfam Id: EFG_C Pfam Desc: Elongation factor G C-terminus
  misc_feature (725)..(846): Pfam Id: EFG_IV Pfam Desc: Elongation factor G, domain IV
  misc_feature (514)..(588): Pfam Id: GTP_EFTU_D2 Pfam Desc: Elongation factor Tu domain 2
  misc_feature (147)..(280): Pfam Id: MMR_HSR1 Pfam Desc: GTPase of unknown function
  misc_feature (1)..(995): NCBI GI: 92872219 NCBI Desc: translation factor; elongation factor g, iii and v [medicago truncatula]
  misc_feature (1)..(995): NCBI GI: 15221423 NCBI Desc: elongation factor tu family protein [arabidopsis thaliana]
  misc_feature (71)..(995): NCBI GI: 15238745 NCBI Desc: elongation factor tu family protein [arabidopsis thaliana]
  misc_feature (1)..(986): NCBI GI: 48097815 NCBI Desc: similar to cg4849-pa [apis mellifera]
  misc_feature (60)..(994): NCBI GI: 27882632 NCBI Desc: mgc53479 protein [xenopus laevis]
  misc_feature: Down-regulated in shoot tissues in response to aminocyclopropane carboxylic treatment
  misc_feature: Up-regulated in shoot tissues in response to salicylic acid treatment
  misc_feature: Up-regulated in root tissues in response to salicylic acid treatment
MDDSLYDEFGNYIGPELADSDADDDSDAGGASPSPSASGSPSPAARSSSGSPSRPAALMDVDDDEGDPSQQAVVLAEDKKYYPTAEEVYGPGVEALVMDEDEQPLEMPIIAPPRVVKFEVGTRAAATSTYASTDFLLGLAGNPALVRNVTLVGHLQHGKTVFMDMLVEQTHEVDTFDSEGERHVRFTDTRVDEQERQVSIKAVPMSLVLEGGNGKSYLCNIMDTPGHVNFSDEMTAALRLADGAVLVVDAAEGVMVNTERAIRHAIQERLPIVVVINKVDRLITELKLPPNDAYFKLRHTLEAINDLISSCSTTVGGTQLVDPAAGNVCFASGAAGWSFTLQSFAHLYLKIHGIQFDHEKFASRLWGDLYFHPDSRTFKKKPPKEGANRSFVEFILEPLYKIYSLVVGEQKGNVESKLAELGVTLSNAAYKLNVRPLLRLACRSIFGTATGFTDMLVKHIPSVKDAAARKIDHIYTGPQDSSIVDAMKKCDPNGPLMVNVTKLYPKSDCSVFDAFGRVYSGTIQTGQTVRVLGEGYSPDDEEDMTVKEVTKLWVYQARYRVAISKAPAGSWVLIEGVDASIMKTATICPMNIDEDVYIFRPLRFNTLPVVKIAAEPLNPSELPKMVEGLRKISKSYPLAITKVEESGEHTILGTGELYLDSIMKDLRELYSEVEVKVADPVVTFCETVVDTSSMKCFAETPNKRNKITMLAEPLEKGLAEDIENGLVSLDSRQKEITDFFRQRYQWDVLAARSIWAFGPDKQGPNILLDDTLSIEVDKNLLNAVKDSIVQGFQWGAREGPLCDEPIRNVKFKILNANIAPEPLHRGGGQIIPTARRVVYSAFLMANPRLMEPVYYVEIQTPIDCVSAIYTVLSRRRGHVTADVPKPGTPIYIVKAFLPVIESFGFETDLRYHTQGQAFCLSVFDHWAIVPGDPLDKSIVLRPLEPAPIQHLAREFMVKTRRRKGMSEDVSINKFFDEAMMNELAQQAADIHLQMM

SEQ ID NO: 6299 - DNA, 3306 bp, Sorghum bicolor
  misc_feature: Ceres ANNOT ID no. 6064976
  misc_feature: Encodes the peptide sequence at SEQ ID NO 6300
atgacgaagcaggcgacgagcgcgtcgacggtgtcggaggcggcggagagcgcgcggcgggtgacgccgatgaagctgctggtgcgcgtggtggaggcgcggggcctccccgccgtgcacctcaacggctccagcgaccccttcgtgaagctcaagctggggaagcgccgcgccaagacggccgtcgtgaagcgcagcctggcccccgcgtgggacgaggagttcagcttcctcgtcggcgacgtcgccgaggagctggtggtgtcggtgctcaacgaggacaagtacttcagcaacgacctgctgggcctggtccgcctgccgctgtcgcaggtcatggagaccgacgacctctccctcggcacccagtggtaccagctccagcccaagagcaagaaatccaagaagaaatgccgcggagaagtttgtctgcacgtatcattgtccacaagaacccacgtatctgacgagtcacagagtgttcctcatcctgcttcagatgacttagcatccagttcagacagccccattgagcgcaaaacattatcgacaacatgtagctgcatcgacctatcagctgtttccagcatcgaaccccgagcatctcacagcagcttcgaacgattcccggacagcattctggatcttccagcccggagtagcgtggaagaattagcaacctctgaacctggaccagcagcagctgcagacactgatgtgacgccaaatccgtcatcggtggtagaggtcttgtcccgctatttcttcaggaaacctgagaatgctactccaaatgtgcacccgactacatcagacactgatcagacagttgatcatcagttgcaagagccaaacgtgagctcatcagaagatcgtgaaatccctgagaaaggcacggtggtgcctgagtcgagccttgatgagctgctcaaagtcatggagtcgaaagatcaaggcagtgagatgccagctaacttgcctggtggtgtgctggttgacgaatcttatgtcgccgcgccgaccgagttgaactctctcctgttctcgccgaattcagatttctggccagcagtggcagagcttcaaggaacaagtgggtttcagattgaaccatggaaacttgacagcaatgagagctgtgtgcaaagaacattgacttacacaaaagctgcaagcaagttggttaaagctgtgaaagccacagaagaacagaagtacctgaaagcggccgcaaattcttacgcggtgttttctgttgtcagcactcctgatgttccctgcggaaattgctttaaggtggagatactgtactgtatcacaccaggtccccatctgtcatctgaagagcaaacatctcatcttactgttagctggagggtaaactttgttcagagcacaatgataaaaggaatgattgagaacggtgcaaaacaaggcatggccgagggttatgcccaattctctgaagtactaaaccagaagcttaaagtagccgagcttgatgatgctaattcaaacaaagaaaagattttagcttcattacatgcccaaaaggaatcaggttggcggttgattgtccgctttctcgggaacttcacattcatattctctgttgccatagcactatatgttatagcacaccttcatttgtccaagcccgatgtgacgcatgggcttgagtattttggtcttgaccttccagattcaattggggaggttgtagtttgtgcagttttaattcttcaggggcagagcattgtcaaagtaacacggcgcttcttaagtgcatggaaacaaagaggcagtgaccatggggtcaaagctcacggtgatggttggttgttgactgttgcactcatcgaagccactggtattacagctactggttcatctgacctatttgatctctatgttgtttttacatgcaatgctaagaggaaaacaagctcaattaaatttcagacatcagatccaaaatggaacgagatattcgaatttgatgctatggatgatcctccatcaaggatggacgttgctctttatgattcgagtgggcaatgtgtcattggtcacacagaagtcaactttttgaaaaacaatttgtcagaattaactgacatatggcttcctctcaatgggaaatgtgatcaagcaagtaaccctaaattgcatttgagaatatttttgaacaactcgagggggactgaagttgtcatgaattacctagcaaagatgggaaaagaagttggtaagaagataaatttgcggtcaacccaaacaaatgtagcattccgaaagctgtttgccctccctccagaagagtttctcatcgacgatttcacctgccatctgaaacggaagatgccacttcagggccgcctctttttctctccaagaatagttggattttattccaacatatttggacacaaaaccaagtttttctttttgtgggaggacgtcgatgacatccaggttatccctgctacactgtccatcggtagcccgtctttgatgatcctccttcgaaaggatagaggtttagaagcaaaacatggtgccaagggaacagatcatcatggaagactcaaatttatttttcaatcttttgtttccttcaatgatgcttacaggataatcacagcaatttggaaaattcgagcactcagtccagaacagaagggggaggcgattgaaaaagacgaagtgaaagaactgctgcctgaagaatgcggatccttgttcactaatgcggatgttaaaatgtctgaaatattttcatcagttctttctgttgatgttgagtccttgatggagatgttttcaggaggtcccctggagcacaaaatgatgcaaaaggccggctgtgtagactacactgccacacaatgggaacttgtaggatgcaatatacagcagcggcaaacaagctacaagtttgacaaaaacttgtctcggtacggaggagaagcgaccaccactgaacagaagtatagcttggtcaaccaagatggctgggccattgaaaaggtgatgaccctccaaggtgttctacttgcagactacttcaatctccagatgaagtactttatcacgaatataccttcgaaaccaaatacctgcagtatcctggttttgttggggattgcctggttaaagagtaccaagcaaaagaagaaggtcacgaagactattatttccaatacctcaaatagattgaaggaactctttgctgaagtcgagaaggagcttacatcaagaagcggtagccttcttaatgcagcaactggtcccactactacttaa

SEQ ID NO: 6300 - protein, 1101 aa, Sorghum bicolor
  misc_feature: Ceres ANNOT ID no. 6064976
  misc_feature (26)..(106): Pfam Id: C2 Pfam Desc: C2 domain
  misc_feature (615)..(693): Pfam Id: C2 Pfam Desc: C2 domain
  misc_feature (762)..(828): Pfam Id: GRAM Pfam Desc: GRAM domain
  misc_feature (1)..(1090): NCBI GI: 51814441 NCBI Desc: no pollen; osnop [oryza sativa (japonica cultivar-group)]
  misc_feature (192)..(752): NCBI GI: 15218791 NCBI Desc: c2 domain-containing protein / gram domain-containing protein [arabidopsis thaliana]
  misc_feature (216)..(1084): NCBI GI: 38344486 NCBI Desc: osjnba0022h21.21 [oryza sativa (japonica cultivar-group)]
  misc_feature (216)..(1084): NCBI GI: 116310301 NCBI Desc: osigba0106g07.15 [oryza sativa (indica cultivar-group)]
  misc_feature (739)..(1090): NCBI GI: 51090353 NCBI Desc: c2 domain-containing protein-like [oryza sativa (japonica cultivar-group)]
MTKQATSASTVSEAAESARRVTPMKLLVRVVEARGLPAVHLNGSSDPFVKLKLGKRRAKTAVVKRSLAPAWDEEFSFLVGDVAEELVVSVLNEDKYFSNDLLGLVRLPLSQVMETDDLSLGTQWYQLQPKSKKSKKKCRGEVCLHVSLSTRTHVSDESQSVPHPASDDLASSSDSPIERKTLSTTCSCIDLSAVSSIEPRASHSSFERFPDSILDLPARSSVEELATSEPGPAAAADTDVTPNPSSVVEVLSRYFFRKPENATPNVHPTTSDTDQTVDHQLQEPNVSSSEDREIPEKGTVVPESSLDELLKVMESKDQGSEMPANLPGGVLVDESYVAAPTELNSLLFSPNSDFWPAVAELQGTSGFQIEPWKLDSNESCVQRTLTYTKAASKLVKAVKATEEQKYLKAAANSYAVFSVVSTPDVPCGNCFKVEILYCITPGPHLSSEEQTSHLTVSWRVNFVQSTMIKGMIENGAKQGMAEGYAQFSEVLNQKLKVAELDDANSNKEKILASLHAQKESGWRLIVRFLGNFTFIFSVAIALYVIAHLHLSKPDVTHGLEYFGLDLPDSIGEVVVCAVLILQGQSIVKVTRRFLSAWKQRGSDHGVKAHGDGWLLTVALIEATGITATGSSDLFDLYVVFTCNAKRKTSSIKFQTSDPKWNEIFEFDAMDDPPSRMDVALYDSSGQCVIGHTEVNFLKNNLSELTDIWLPLNGKCDQASNPKLHLRIFLNNSRGTEVVMNYLAKMGKEVGKKINLRSTQTNVAFRKLFALPPEEFLIDDFTCHLKRKMPLQGRLFFSPRIVGFYSNIFGHKTKFFFLWEDVDDIQVIPATLSIGSPSLMILLRKDRGLEAKHGAKGTDHHGRLKFIFQSFVSFNDAYRIITAIWKIRALSPEQKGEAIEKDEVKELLPEECGSLFTNADVKMSEIFSSVLSVDVESLMEMFSGGPLEHKMMQKAGCVDYTATQWELVGCNIQQRQTSYKFDKNLSRYGGEATTTEQKYSLVNQDGWAIEKVMTLQGVLLADYFNLQMKYFITNIPSKPNTCSILVLLGIAWLKSTKQKKKVTKTIISNTSNRLKELFAEVEKELTSRSGSLLNAATGPTTT

SEQ ID NO: 6301 - DNA, 1197 bp, Sorghum bicolor
  misc_feature: Ceres ANNOT ID no. 6064977
  misc_feature: Encodes the peptide sequence at SEQ ID NO 6302
atggcggagggcggggaggacgcgcgccgccgcgccgcggtcaccgactaccgcaagaagctcctcacctgccgggagctcgaggcgcgggtcaaaacagggagggagaacctaaaagatgcaaagaaaaacttggaaaaaactgaagaggatctaaaatcattgcaaagtgttggtcaaattatcggtgaggtgcttcgacctttggacaaggaacgatttattgtcaaagctagcagtggaccacgctatgttgttgcctgccgaagtaaagttgacaaagaaaagttgattgccggtacacgagttgttcttgacatgacaacacttaccatcatgcgcactctgcctcgtgaggttgatcctgtagtttacaacatgctacatgaagatcctggcaatgttagttactcagctgtaggtgggttatcagatcaaataagggaactcagagaatccattgagttaccgcttatgaacccagaattgtttctccgtgtcgggattaagccgccgaagggtgtgctgctctacggtccacctggaactgggaagacacttctagctagagccattgctagcaacattgatgctaatttcttgaaggttgtgtcaagtgctatcattgataaatatattggtgaaagtgcacgcttaattcgtgaaatgtttaactatgcacgtgagcatcagccatgcatcatttttatggatgaaattgatgccatcggtggccgaagatttagtgagggcacaagtgcagatcgtgagattcagaggacattgatggagcttctaaatcagctagatggattcgacgagcttgggaaggtgaaaatgatcatggcaaccaaccggcctgatgttttggatcccgcactccttcgtcctgggcggttggacaggaagattgagatcccattgccgaatgaacaggggaggatggaggtcctcaagatccatgcagttggcattgcgaagcatggcgagattgactatgaagctgtaatcaatctagctgaaggcttcaacggagccgatctgcgcaacgtctgcaccgaagccggcatggctgctatccgagcagagcgtgactatgtcattcacgaggacttcatgaaggctgtgcgcaagctgaatgacgccaagaagctcgagtccagtgcacactacagcgctgacttcggcaaggattga

SEQ ID NO: 6302 - protein, 398 aa, Sorghum bicolor
  misc_feature: Ceres ANNOT ID no. 6064977
  misc_feature (174)..(361): Pfam Id: AAA Pfam Desc: ATPase family associated with various cellular activities(AAA)
  misc_feature (22)..(398): NCBI GI: 17298147 NCBI Desc: 26s proteasome regulatory particle triple-a atpase subunit4b [oryza sativa (japonica cultivar-group)]
  misc_feature (6)..(398): NCBI GI: 24745880 NCBI Desc: 26s proteasome aaa-atpase subunit rpt4a [solanum tuberosum]
  misc_feature (1)..(398): NCBI GI: 9758590 NCBI Desc: 26s proteasome aaa-atpase subunit rpt4a [arabidopsis thaliana]
  misc_feature (1)..(398): NCBI GI: 92870338 NCBI Desc: aaa atpase; 26s proteasome subunit p45; nucleic acid-binding, ob-fold [medicago truncatula]
  misc_feature (7)..(391): NCBI GI: 116116458 NCBI Desc: ensangp00000017473 [anopheles gambiae str. pest]
  misc_feature: The sequence is a functional homolog of SEQ ID NO. 462 in the 11/188,298 US application
  misc_feature: The sequence is a functional homolog of SEQ ID NO. 471 in the 11/188,298 US application
MAEGGEDARRRAAVTDYRKKLLTCRELEARVKTGRENLKDAKKNLEKTEEDLKSLQSVGQIIGEVLRPLDKERFIVKASSGPRYVVACRSKVDKEKLIAGTRVVLDMTTLTIMRTLPREVDPVVYNMLHEDPGNVSYSAVGGLSDQIRELRESIELPLMNPELFLRVGIKPPKGVLLYGPPGTGKTLLARAIASNIDANFLKVVSSAIIDKYIGESARLIREMFNYAREHQPCIIFMDEIDAIGGRRFSEGTSADREIQRTLMELLNQLDGFDELGKVKMIMATNRPDVLDPALLRPGRLDRKIEIPLPNEQGRMEVLKIHAVGIAKHGEIDYEAVINLAEGFNGADLRNVCTEAGMAAIRAERDYVIHEDFMKAVRKLNDAKKLESSAHYSADFGKD

SEQ ID NO: 6303 - DNA, 1161 bp, Sorghum bicolor
  misc_feature: Ceres ANNOT ID no. 6064990
  misc_feature: Encodes the peptide sequence at SEQ ID NO 6304
atggatgcgagtgcggaggttactgatgctattggcgcaatgggcattgacaatgggaccaaggggaagttgccgcccagtgataatgtagagggccacgcagaagaacatgacgggctggctgatggagcgcattcgggcgagagcgaggtgatcaacccatctgaagaagtggaaatggaagccacctcgcaatcccaggacataaagccccgagttcctgagggggttcaaggccattcaccgaaggttgttactaaatctcagcgacagagccctcgaggcggggataagagtcaagctaggaaaagctctcccagtccttcttcttatcctaaggcgcccattgcacgggtttctgatccagatctagttgatagctcttccagcaatggcgatgctggtgccagtaagaaaaaggccgaaaagagcagtttccgtccagttgccaaggagagcccatcacttgaggactcaaaagagaagaagaaaactcagaaggcaccaaaccagcattctgtcaaaaaggatattgaagaagaatcaaatgaaggtgtgaaacctcaaagggttggcagcactccttcatatggatttagttttaagtgtgatgagagagctgaaaaaagaagagagttctacacaaagctcgaggagaagattcatgcacaggaactggagaaaagcaacttgcaggcaaaatcaaaggaaactgaagaagctgaactcaaaatgctgagaaagagtttaaatttcaaggcaacaccaatgcccagcttttacaaggaaccacctccccccaaggttgagttgaagaagatccctacaacaagagctagatcaccaaagcttggtcgctccaagaacacatcctcaggagggacagaaggaaattcaaatcctccagctcattcagctcgactgagtctcgatgaaagggtctcccaaaatggtgtcaagaaagcacctgctgcaaatgcagtgaagaagccccaacggaaatctctccctaaactgccttcagagcaagcaaccaaagttgacattgcagcatctgtttcatctgcagaagagctagaaaacaagtcatcgtcgacgtgtcttgttcgagaggcgatccgcgctcaagttacacctgatgaacctggactcagtgcgtag

SEQ ID NO: 6304 - protein, 386 aa, Sorghum bicolor
  misc_feature: Ceres ANNOT ID no. 6064990
  misc_feature (201)..(257): Pfam Id: TPX2 Pfam Desc: Targeting protein for Xklp2 (TPX2)
  misc_feature (70)..(381): NCBI GI: 42733498 NCBI Desc: bri1-kd interacting protein 118 [oryza sativa (japonica cultivar-group)]
  misc_feature (35)..(274): NCBI GI: 140057127 NCBI Desc: targeting for xklp2 [medicago truncatula]
  misc_feature (231)..(381): NCBI GI: 51091379 NCBI Desc: bri1-kd interacting protein 118-like [oryza sativa (japonica cultivar-group)]
  misc_feature (1)..(140): NCBI GI: 51091380 NCBI Desc: bri1-kd interacting protein 118-like [oryza sativa (japonica cultivar-group)]
  misc_feature (48)..(307): NCBI GI: 92874845 NCBI Desc: targeting for xklp2 [medicago truncatula]
MDASAEVTDAIGAMGIDNGTKGKLPPSDNVEGHAEEHDGLADGAHSGESEVINPSEEVEMEATSQSQDIKPRVPEGVQGHSPKVVTKSQRQSPRGGDKSQARKSSPSPSSYPKAPIARVSDPDLVDSSSSNGDAGASKKKAEKSSFRPVAKESPSLEDSKEKKKTQKAPNQHSVKKDIEEESNEGVKPQRVGSTPSYGFSFKCDERAEKRREFYTKLEEKIHAQELEKSNLQAKSKETEEAELKMLRKSLNFKATPMPSFYKEPPPPKVELKKIPTTRARSPKLGRSKNTSSGGTEGNSNPPAHSARLSLDERVSQNGVKKAPAANAVKKPQRKSLPKLPSEQATKVDIAASVSSAEELENKSSSTCLVREAIRAQVTPDEPGLSA

SEQ ID NO: 6305 - DNA, 1764 bp, Sorghum bicolor
  misc_feature: Ceres ANNOT ID no. 6065011
  misc_feature: Encodes the peptide sequence at SEQ ID NO 6306
atggctatgattgacgaacctctgtacccgattgctgtgctgattgatgaactgaaaaatgaagatattcagttgcgccttaactccatcagaaagctttctacaattgcccgggcattgggtgaagaaagaacaaggaaagagctgattccgttccttagtgaaaacaacgacgatgaagatgaggtgcttcttgcaatggcggaagagttgggcgtttttattccttatgttggaggtgtagagcatgcacacgttttgcttccaccactggaaacattgtgtactgtggaggaaacctgcgtcagagacaaggctgtggaatcgctttgtcggataggagcacagatgaaggaaaatgatattgtggactggtttgcccctgtcgtaaagaggttggcggcaggcgagtggttcacagctcgagtttcgtcatgtggcctttttcatatcgcctatcctagtgcatctgaacaactgaaggcagaactgaggacaatttatggccagttatgccaagacgacatgcctatggtacgaagagctgctgcatccaatcttggaaagtttgctgcaacagttgaacaaagtcatttgaagacagaaatcatgtcaatatttgatgatctaactcaagatgatcaagattcagtgcgactattggcagttgagggttgtgctgctcttgggaagttgttggagccccaagattgtgcagcacatattctcccagttattgtaaatttctctcaggataaatcttggcgtgtgcgttatatggtggcaaatcaactgtatgagctatgtgaagctgttggtactgagcccacaaggggtgatctggtgtcagcatatgttcgcctcctctgtgacaatgaggctgaagtgcggattgcagctgctggaaaagttacaaaattctgcaaaatattaaacccacaaattgcaattgaacatattcttccgtgtgtcaaggaattatcaacagattcatctcaacatgttcgttcagctttggcatcagttattatgggaatggctcctgtattgggaaaggatgccactattgaacaacttcttcccatttttcttgctttgctgaaggatgagttccctgatgttcgactcaacattataagcaaacttgatcaagttaaccaggttattggaattgacttgctgtcgcaatcacttctaccagccattgtagagctcgctgaagataggcactggagagttcggcttgccataattgagtacatacctttgttggccagccagttaggtgttggtttttttgatgacaaattgggggcactttgcatgcagtggttggaagataaggttttctcaatccgagatgctgctgccaacaatttaaagcgtttggcagaggaatttggccctgagtgggcgatgcaacatataattcctcaggttttggagaagataaacaacccacattatctgtataggatgaccactttgcaagctatttctttgctagctcctgtcatgggtcctgatatcacatgccaacagttgctccctgttgtcattgcttcttcaaaggacagggttccgaacatgaaattcaatgttgctaaagtcctgcaatcacttgtaccaatccttgatcaatctgttgtggagaaggcggtgaaaccatgcctagttgagctcagtgaggacccagatgtagatgtaagatactatgcacaccaggcccttcgggcgtgtgaccaaatggtgatatctagctga

SEQ ID NO: 6306 - protein, 587 aa, Sorghum bicolor
  misc_feature: Ceres ANNOT ID no. 6065011
  misc_feature (158)..(194): Pfam Id: HEAT Pfam Desc: HEAT repeat
  misc_feature (236)..(272): Pfam Id: HEAT Pfam Desc: HEAT repeat
  misc_feature (275)..(311): Pfam Id: HEAT Pfam Desc: HEAT repeat
  misc_feature (314)..(350): Pfam Id: HEAT Pfam Desc: HEAT repeat
  misc_feature (353)..(389): Pfam Id: HEAT Pfam Desc: HEAT repeat
  misc_feature (392)..(428): Pfam Id: HEAT Pfam Desc: HEAT repeat
  misc_feature (1)..(587): NCBI GI: 62997485 NCBI Desc: protein phosphatase 2a regulatory subunit a [zea mays]
  misc_feature (1)..(587): NCBI GI: 5679686 NCBI Desc: protein phosphatase 2a a subunit [oryza sativa]
  misc_feature (1)..(587): NCBI GI: 30725386 NCBI Desc: at3g25800 [arabidopsis thaliana]
  misc_feature (1)..(587): NCBI GI: 683502 NCBI Desc: protein phosphatase 2a 65 kda regulatory subunit [arabidopsis thaliana]
  misc_feature (1)..(587): NCBI GI: 11094367 NCBI Desc: ser/thr specific protein phosphatase 2a a regulatory subunit beta isoform [medicago sativa subsp. x varia]
MAMIDEPLYPIAVLIDELKNEDIQLRLNSIRKLSTIARALGEERTRKELIPFLSENNDDEDEVLLAMAEELGVFIPYVGGVEHAHVLLPPLETLCTVEETCVRDKAVESLCRIGAQMKENDIVDWFAPVVKRLAAGEWFTARVSSCGLFHIAYPSASEQLKAELRTIYGQLCQDDMPMVRRAAASNLGKFAATVEQSHLKTEIMSIFDDLTQDDQDSVRLLAVEGCAALGKLLEPQDCAAHILPVIVNFSQDKSWRVRYMVANQLYELCEAVGTEPTRGDLVSAYVRLLCDNEAEVRIAAAGKVTKFCKILNPQIAIEHILPCVKELSTDSSQHVRSALASVIMGMAPVLGKDATIEQLLPIFLALLKDEFPDVRLNIISKLDQVNQVIGIDLLSQSLLPAIVELAEDRHWRVRLAIIEYIPLLASQLGVGFFDDKLGALCMQWLEDKVFSIRDAAANNLKRLAEEFGPEWAMQHIIPQVLEKINNPHYLYRMTTLQAISLLAPVMGPDITCQQLLPVVIASSKDRVPNMKFNVAKVLQSLVPILDQSVVEKAVKPCLVELSEDPDVDVRYYAHQALRACDQMVISS

SEQ ID NO: 6307 - DNA, 927 bp, Sorghum bicolor
  misc_feature: Ceres ANNOT ID no. 6065017
  misc_feature: Encodes the peptide sequence at SEQ ID NO 6308
atgaagttcggcaagagcctgagcgggcagatcgtggagacgctcccggagtggcgcgacaagttcctctcctacaaggacctgaagaagcgcctcaagctcatcggcgccgggaacggggccgccgagcggcagccgaagcgggcccgccgcgacgacgccggggagcctgacgcgtccgcggcggcggcggcgatgacgccggaggaggcggactttatgcggctcctggaggccgagctcgacaagttcaactctttcttcgtcgagaaggaagaggagtacatcatccgccagaaggaactgcaggaccgggtggccagggcggccggccgggagtccaaggaggagctcatgcgggtgcgcaaggagatcgtcgacttccatggcgagatggtgctgctcgagaactacagcgccctcaactacaccggattggttaagattctcaagaaatacgataagagaactggagccctgatccggctgcccttcatccagaaagttcttcagcagcctttcttcaccactgatctcctgtacaagcttgtgaagcagtgtgaagccatgctggagcagctccttccggttagtgaggcatctgtatccagtgaagatgtaaaaggagacagtaatgatgaagagaagctggcaaagccgagttcttccttggtaaatggtggtggcattccagagttagatgagattgagtacatggagagtatgtacatgaagagcaccgttgcagcccttaggtcactgaaggagatccggagcaagagttcaactgtcagtatgttctcgttgccacctcttcagggcaacaatgcacaggacagttaccagatccgggcagagcaaaccaaactagatgaagagccagagaggtggagcaaagtaacagtgatagagcaggcggccaaatga

SEQ ID NO: 6308 - protein, 308 aa, Sorghum bicolor
  misc_feature: Ceres ANNOT ID no. 6065017
  misc_feature (1)..(170): Pfam Id: SPX Pfam Desc: SPX domain
  misc_feature (1)..(215): NCBI GI: 21592813 NCBI Desc: ids4-like protein [arabidopsis thaliana]
  misc_feature (1)..(215): NCBI GI: 23507805 NCBI Desc: at5g20150/f5o24_40 [arabidopsis thaliana]
  misc_feature (1)..(308): NCBI GI: 124054717 NCBI Desc: ids4-like protein [phaseolus vulgaris]
  misc_feature (1)..(272): NCBI GI: 92893061 NCBI Desc: spx, n-terminal [medicago truncatula]
  misc_feature (69)..(279): NCBI GI: 16506648 NCBI Desc: ids-4-like protein [castanea sativa]
MKFGKSLSGQIVETLPEWRDKFLSYKDLKKRLKLIGAGNGAAERQPKRARRDDAGEPDASAAAAAMTPEEADFMRLLEAELDKFNSFFVEKEEEYIIRQKELQDRVARAAGRESKEELMRVRKEIVDFHGEMVLLENYSALNYTGLVKILKKYDKRTGALIRLPFIQKVLQQPFFTTDLLYKLVKQCEAMLEQLLPVSEASVSSEDVKGDSNDEEKLAKPSSSLVNGGGIPELDEIEYMESMYMKSTVAALRSLKEIRSKSSTVSMFSLPPLQGNNAQDSYQIRAEQTKLDEEPERWSKVTVIEQAAK

SEQ ID NO: 6309 - DNA, 783 bp, Sorghum bicolor
  misc_feature: Ceres ANNOT ID no. 6065018
  misc_feature: Encodes the peptide sequence at SEQ ID NO 6310
  misc_feature: Down-regulated in root tissues in response to salicylic acid treatment
atgccaccgcgaaagcgcccggcggcgccgccggaggagccctctccttcttcgaagcctctacttgacgcccagccgtccgaaccctccaaacccgcccccgattccgagcagccgaccatctcggcgacgatcctcgcccaactgcccacccaggagcgcctggcgtacaagctcatcttcgaggcgggcaacaagggcatgtggatgctggacatccgcaagaagttgttgatgggccccaacatcgccaccaaggtcgtgcgcaccctcgtggggcgtgggctcctgaaggaggtcagcgatgtgcgccaccgcagcaggaagatcttcatggccaccgacttccagccctccgccgagatcactggcggcacctggtaccacgacggccgcctagacaccgacgccgtaagcaccgcgcgccgctgctgccaggcgcaggtcgagaggctcggcgccgcgaccgcgcagatgatccacaacggcattctgaaggacgaccccagggccgtgtacactatcgacaagatcagagatattatcaagaccatggttctggacaaggtcctcgaggaggtcaagagcaccgggacgggggagttcacggccgtcagggccggcacaatgtgctaccggctggtgactggggctccgcagggagggatgatggagggaattccttgtggggtttgccccaggattgatgagtgctcaccggagggggtcatttcgccgagcacctgcgtttactacaagaagtggctgcagatggacttctag

SEQ ID NO: 6310 - protein, 260 aa, Sorghum bicolor
  misc_feature: Ceres ANNOT ID no. 6065018
  misc_feature (1)..(257): Pfam Id: RNA_pol_Rpc34 Pfam Desc: RNA polymerase Rpc34 subunit
  misc_feature (196)..(260): NCBI GI: 115468826 NCBI Desc: os06g0603400 [oryza sativa (japonica cultivar-group)]
  misc_feature (52)..(145): NCBI GI: 119630646 NCBI Desc: polymerase (rna) iii (dna directed) polypeptide f, 39 kda, isoform cra_c [homo sapiens]
  misc_feature (36)..(256): NCBI GI: 24648960 NCBI Desc: cg5380-pa [drosophila melanogaster]
  misc_feature (40)..(145): NCBI GI: 41055399 NCBI Desc: similar to polymerase (rna) iii (dna directed) polypeptide f, 39 kda [danio rerio]
  misc_feature (52)..(145): NCBI GI: 119630645 NCBI Desc: polymerase (rna) iii (dna directed) polypeptide f, 39 kda, isoform cra_b [homo sapiens]
  misc_feature: Down-regulated in root tissues in response to salicylic acid treatment
MPPRKRPAAPPEEPSPSSKPLLDAQPSEPSKPAPDSEQPTISATILAQLPTQERLAYKLIFEAGNKGMWMLDIRKKLLMGPNIATKVVRTLVGRGLLKEVSDVRHRSRKIFMATDFQPSAEITGGTWYHDGRLDTDAVSTARRCCQAQVERLGAATAQMIHNGILKDDPRAVYTIDKIRDIIKTMVLDKVLEEVKSTGTGEFTAVRAGTMCYRLVTGAPQGGMMEGIPCGVCPRIDECSPEGVISPSTCVYYKKWLQMDF

SEQ ID NO: 6311 - DNA, 1041 bp, Sorghum bicolor
  misc_feature: Ceres ANNOT ID no. 6065033
  misc_feature: Encodes the peptide sequence at SEQ ID NO 6312
atggaggtggtgaacaggtacgtcgccacccggcaccacatcgagggcgccccgacggaggccgatttcgaggtggtggaggagacggcgaggtgggcgccggactccggcgaggtgctcgtcaggaacatgtacctgtccatcgacccgtaccagctcaaccgcatgaagcggagtagcgcgtcgcacggcgccgtcgacggcatcctgcccggccagaggatcgcggcgtacgcggccggcgaggtggtggcgtcggcgtgcgaggagtacgcggcgggcgacgtggtggccggcgtcctcgggtgggaggactacacgctgttcaagccgtccccggccgtgctcatgtccaaggtcgccgtcgccgccgacgccgacgcgggcttccccctgtcccaccacatcagcgtgctgggcaccagcggcatgaccgcgtacggcggcctcttcgaggtgggcaagccggtgaagggcgagaaggtgttcgtgtcggcggcgtcgggctccgtcggcagcctcgtcggccagttcgccaagatcgccggctgctacgtcgtcgggtgcgccgggacgcaagccaaggttgatctgctcagagacaagctgggattcgacgatgctttcaactacaaagaggagcctgacctgaaatcagcgctgaagaggtacttccccgacggcatcgacgtctacttcgagaacgtgggcggcgagatgctggaggcggcgctggccaacatgaacacctacggccgggtggcgctcagcggcgtcatcgccgagtacacgggcggcgggcggcgcgcggtgccggacctgctggacgtgatctacaagcgcatcaccatccggggcttcttcgcctgggacttcctgcccaggttcgccgagttcaacgccgtcatcggcgagtggatccgcgacgggaaggtccaggtggtcgaggacgtctccgacggcctcgagagcgtcccgtccgcgttcgccgccctgttccgcggccagaatgttggcaagaagctcgttaagctggcgtag

SEQ ID NO: 6312 - protein, 346 aa, Sorghum bicolor
  misc_feature: Ceres ANNOT ID no. 6065033
  misc_feature (158)..(305): Pfam Id: ADH_zinc_N Pfam Desc: Zinc-binding dehydrogenase
  misc_feature (5)..(346): NCBI GI: 21554121 NCBI Desc: quinone oxidoreductase-like protein [arabidopsis thaliana]
  misc_feature (2)..(346): NCBI GI: 6692816 NCBI Desc: allyl alcohol dehydrogenase [nicotiana tabacum]
  misc_feature (5)..(346): NCBI GI: 886430 NCBI Desc: zeta-crystallin homologue [arabidopsis thaliana]
  misc_feature (1)..(346): NCBI GI: 118138607 NCBI Desc: chain a, crystal structure of arabidopsis thaliana double bond reductase (at5g16970)-apo form
  misc_feature (1)..(346): NCBI GI: 21539447 NCBI Desc: quinone oxidoreductase-like protein [arabidopsis thaliana]
MEVVNRYVATRHHIEGAPTEADFEVVEETARWAPDSGEVLVRNMYLSIDPYQLNRMKRSSASHGAVDGILPGQRIAAYAAGEVVASACEEYAAGDVVAGVLGWEDYTLFKPSPAVLMSKVAVAADADAGFPLSHHISVLGTSGMTAYGGLFEVGKPVKGEKVFVSAASGSVGSLVGQFAKIAGCYVVGCAGTQAKVDLLRDKLGFDDAFNYKEEPDLKSALKRYFPDGIDVYFENVGGEMLEAALANMNTYGRVALSGVIAEYTGGGRRAVPDLLDVIYKRITIRGFFAWDFLPRFAEFNAVIGEWIRDGKVQVVEDVSDGLESVPSAFAALFRGQNVGKKLVKLA

SEQ ID NO: 6313 - DNA, 1047 bp, Sorghum bicolor
  misc_feature: Ceres ANNOT ID no. 6065034
  misc_feature: Encodes the peptide sequence at SEQ ID NO 6314
atgggacggcgaacgtcggtggtgctggctctgttggtgatcgcgctgtcgctgctgctactgctgccatctgccgccgccgccgccgtagcgaaagccatcgacgcgagcaaagtccagcggctggagctgcccgactctctggtcggcccggagagcgtggcgttcgacgggcgcggcgccgggccctacgtcagcgtcgcggacggccgcgtcctccggtggggcggcagcggcaacggctccggctccggctggacgacgtacacgtacagcccgagctacgccaagaacgggtgcgcggcgccgtcggagatcccgcccgtggccacggagagctcgtgcgggcggccgctgggcctgcggttccaccgccgctccggcacgctctacgtcgccgacgcgtacatggggctgatgaaggtgggtcccggcggcggggaggcgacggtgctcgcgacggaggccggcggggagccgctgcgcttcacgaacggggtggacgtggaccagcgcacgggggaggtctacttcaccgacagcagcagcacgtaccggcggtcgcagcaccagatggtgacggcgacgggggactcgacggggcgaatcatgaggtacgacccggggaccggacaggtggcggtgctcgcttccggcgtgacgtacccgaacggcgtcgccgtcagcgccgacgggacccacctcgtcgtcgcgctcacggggccctgcaagctgctcaggtactggctccggggcgccaaggccggaacgtccgagacgctcgctgacctgccggggtacccggacaacgtgaggcccgacgggaagggagggtactgggtggcgctccaccgggagaagaacgagttgccgttcggcggcgtgaactcgcacctggtcggtgtgaggattggcgccgacggcgagacgctgcaggagatgaagggacccaagaacgtcaggcccacggagctggtggaacgaaaaggcggcaaaatatatatggggtctgttgagttgtcgtatgttggcattgttagcccttag

SEQ ID NO: 6314 - protein, 348 aa, Sorghum bicolor
  misc_feature: Ceres ANNOT ID no. 6065034
  misc_feature (165)..(253): Pfam Id: Str_synth Pfam Desc: Strictosidine synthase
  misc_feature (44)..(339): Pfam Id: SGL Pfam Desc: SMP-30/Gluconolaconase/LRE-like region
  misc_feature (16)..(346): NCBI GI: 115478879 NCBI Desc: os09g0374900 [oryza sativa (japonica cultivar-group)]
  misc_feature (50)..(287): NCBI GI: 30694556 NCBI Desc: strictosidine synthase family protein [arabidopsis thaliana]
  misc_feature (50)..(236): NCBI GI: 6664319 NCBI Desc: t27g7.16 [arabidopsis thaliana]
  misc_feature (50)..(284): NCBI GI: 140040327 NCBI Desc: strictosidine synthase [medicago truncatula]
  misc_feature (50)..(284): NCBI GI: 115455371 NCBI Desc: os03g0750700 [oryza sativa (japonica cultivar-group)]
MGRRTSVVLALLVIALSLLLLLPSAAAAAVAKAIDASKVQRLELPDSLVGPESVAFDGRGAGPYVSVADGRVLRWGGSGNGSGSGWTTYTYSPSYAKNGCAAPSEIPPVATESSCGRPLGLRFHRRSGTLYVADAYMGLMKVGPGGGEATVLATEAGGEPLRFTNGVDVDQRTGEVYFTDSSSTYRRSQHQMVTATGDSTGRIMRYDPGTGQVAVLASGVTYPNGVAVSADGTHLVVALTGPCKLLRYWLRGAKAGTSETLADLPGYPDNVRPDGKGGYWVALHREKNELPFGGVNSHLVGVRIGADGETLQEMKGPKNVRPTELVERKGGKIYMGSVELSYVGIVSP

SEQ ID NO: 6315 - DNA, 1323 bp, Sorghum bicolor
  misc_feature: Ceres ANNOT ID no. 6065035
  misc_feature: Encodes the peptide sequence at SEQ ID NO 6316
atgctagaggcgaagccgccgtcgccgggctccggcgcggccggggcggcggcggcgcacatccacagtcaccggcggtgggcggcgccgctgctggcctcggtcctgctctcgtcgctcctcatctccgcgtcgctcttcttctcctcctcccgcgcgctgctcctctccttctcgccgctcccttccgcggcctccgccgagcctctcttcgtcgaggccaagctccgccagcagatgcgcgccgaggagcgccccgcgaggggcgccgtgcccaggatcgcctacctcatctccggctccgcgggggacggagccgcgctgcgccggacgctcagggcgctctaccacccggccaacacgtacgtcgtgcacctcgacctcgaggcccccgccgccgagcgcgccgagctcgccgcggccgtccgcgcggacaccgtctacgcaaggttccgcaacgtcaaggtcgtcacacgggccaacctcgtcacctaccgtggcccgaccatggtggccaacacgctgcacgcggctgccatcctgctgcgcgagggcggtgattgggactggttcatcaacctctccgcctccgactatccgctcgtcacccaggacgatctgttgcatgtgctctccgagttgcccaggcagcttaacttcattgagcataccagtgacatcggatggaaggagtaccagagggcgaagccagtgatcatcgaccctgggctatacagcctgcagaagtctgacgttttctggataacagagaaaaggagtgtaccaactgcgttcaagctattcactggctcagcatggatgatgcttacccatcagtttattgaatactgcatatggggatgggacaatctcccaaggacagtcttgatgtattacgccaattttctttcttcaccagaaggttacttccacacagtcatctgcaatgtccccgagttccggaacaccacagtcaaccatgatctacatttcatttcttgggacaacccaccaaagcaacaccctcattatctcacacttgctgactatgatggtatggttaacagtaacgcaccctttgcaaggaagtttggaagagaagatcctgtgctggacaagattgaccaggaactattgggccgccaacctgatggatttgtgcctggtggatggacagatgtactgaatacaactgagaaagggaaacccttcactgttgagcgtgtgcaagatctccgcccagggcctggtgtggacagattaaagaaacttgtcacaggcttgctcacacaagaaggttttgatgacaagcattgcttgtga

SEQ ID NO: 6316 - protein, 440 aa, Sorghum bicolor
  misc_feature: Ceres ANNOT ID no. 6065035
  misc_feature (94)..(319): Pfam Id: Branch Pfam Desc: Core-2/I-Branching enzyme
  misc_feature (9)..(439): NCBI GI: 77556820 NCBI Desc: glycosylation enzyme-like protein [oryza sativa (japonica cultivar-group)]
  misc_feature (25)..(439): NCBI GI: 46358506 NCBI Desc: glycosylation enzyme-like protein [triticum monococcum]
  misc_feature (31)..(439): NCBI GI: 102139993 NCBI Desc: glycosyl transferase family 14 protein [musa acuminata]
  misc_feature (19)..(439): NCBI GI: 42567183 NCBI Desc: glycosyltransferase family 14 protein / core-2/i-branching enzyme family protein [arabidopsis thaliana]
  misc_feature (20)..(439): NCBI GI: 20856992 NCBI Desc: at3g15350/k7l4_15 [arabidopsis thaliana]
  misc_feature: Useful for making plants with altered carbohydrate content
  misc_feature: Functional homolog of the protein sequence given in SEQ ID NO 13727
MLEAKPPSPGSGAAGAAAAHIHSHRRWAAPLLASVLLSSLLISASLFFSSSRALLLSFSPLPSAASAEPLFVEAKLRQQMRAEERPARGAVPRIAYLISGSAGDGAALRRTLRALYHPANTYVVHLDLEAPAAERAELAAAVRADTVYARFRNVKVVTRANLVTYRGPTMVANTLHAAAILLREGGDWDWFINLSASDYPLVTQDDLLHVLSELPRQLNFIEHTSDIGWKEYQRAKPVIIDPGLYSLQKSDVFWITEKRSVPTAFKLFTGSAWMMLTHQFIEYCIWGWDNLPRTVLMYYANFLSSPEGYFHTVICNVPEFRNTTVNHDLHFISWDNPPKQHPHYLTLADYDGMVNSNAPFARKFGREDPVLDKIDQELLGRQPDGFVPGGWTDVLNTTEKGKPFTVERVQDLRPGPGVDRLKKLVTGLLTQEGFDDKHCL

SEQ ID NO: 6317 - DNA, 522 bp, Sorghum bicolor
  misc_feature: Ceres ANNOT ID no. 6065050
  misc_feature: Encodes the peptide sequence at SEQ ID NO 6318
atgcagcaggatcagacgacgagctcgctgccctccagcagcgagcgctcctccagctcagcgccgcagacggatcaggagaccagggaagcgatggagagcgacgaggagatcaggagggtgccggaggtcgggctggagctggccggcccgtcgacgtccggcagggagacgactgcggctgcgggcacggcggcgggcgctgccgggacgtcgtccgcgtcgcaggcggccaccagcgccgcccgccgccgcggccgtagccccgccgacaaggagcaccggcgcctcaaaaggttgcttcggaaccgggtgtcggcgcagcaagcacgggagaggaagaaggcgtacctgagcgagctggaggtgagggtcaaggacctggagaagaggaactcagagctggaggagaggctgtccacgctgcagaacgagaaccaaatgcttagacagatactgaagaacaccactgtaaacagaagaggcccaggtggcagcagtgctggtggagatagccaatag

SEQ ID NO: 6318 - protein, 173 aa, Sorghum bicolor
  misc_feature: Ceres ANNOT ID no. 6065050
  misc_feature (91)..(154): Pfam Id: bZIP_1 Pfam Desc: bZIP transcription factor
  misc_feature (91)..(145): Pfam Id: bZIP_2 Pfam Desc: Basic region leucine zipper
  misc_feature (1)..(167): NCBI GI: 2251085 NCBI Desc: hy5 [arabidopsis thaliana]
  misc_feature (32)..(163): NCBI GI: 115444913 NCBI Desc: os02g0203000 [oryza sativa (japonica cultivar-group)]
  misc_feature (1)..(157): NCBI GI: 6018699 NCBI Desc: thy5 protein [lycopersicon esculentum]
  misc_feature (2)..(162): NCBI GI: 2934884 NCBI Desc: tgacg-motif binding factor [glycine max]
  misc_feature (2)..(173): NCBI GI: 2104677 NCBI Desc: transcription factor [vicia faba]
  misc_feature: The sequence is a functional homolog of SEQ ID NO 1362 in the 10/374,780US patent application
  misc_feature: The sequence is a functional homolog of SEQ ID NO 1363 in the 10/374,780US patent application
  misc_feature: The sequence is a functional homolog of SEQ ID NO 1364 in the 10/374,780US patent application
  misc_feature: The sequence is a functional homolog of SEQ ID NO 1482 in the 10/412,699US patent application
  misc_feature: The sequence is a functional homolog of SEQ ID NO 1483 in the 10/412,699US patent application
  misc_feature: The sequence is a functional homolog of SEQ ID NO 20 in the 10/225,066US patent application
  misc_feature: The sequence is a functional homolog of SEQ ID NO 206 in the 10/225,066US patent application
  misc_feature: The sequence is a functional homolog of SEQ ID NO 2356 in the 10/374,780US patent application
  misc_feature: The sequence is a functional homolog of SEQ ID NO 2844 in the 10/374,780US patent application
  misc_feature: The sequence is a functional homolog of SEQ ID NO 827 in the 11/479,226US patent application
  misc_feature: The sequence is a functional homolog of SEQ ID NO 933 in the 10/374,780US patent application
  misc_feature: Useful for making plants with altered alkaloid content
  misc_feature: Useful for making plants with altered terpenoid content
  misc_feature: Useful for making plants with modulated growth and phenotype characteristics
  misc_feature: Useful for making plants with modulated nitrogen use efficiency
  misc_feature: Functional homolog of the protein sequence given in SEQ ID NO 12882
  misc_feature: Functional homolog of the protein sequence given in SEQ ID NO 13120
  misc_feature: The sequence is a functional homolog of SEQ ID NO 1482 in the 20040045049 US patent application
  misc_feature: The sequence is a functional homolog of SEQ ID NO 1483 in the 20040045049 US patent application
  misc_feature: The sequence is a functional homolog of SEQ ID NO 20 in the 20050160493 US patent application
  misc_feature: The sequence is a functional homolog of SEQ ID NO 206 in the 20050160493 US patent application
  misc_feature: The sequence is a functional homolog of SEQ ID NO 933 in the 20060162006 US patent application
  misc_feature: The sequence is a functional homolog of SEQ ID NO. 337 in the 11/188,298 US application
  misc_feature: The sequence is a functional homolog of SEQ ID NO. 512 in the 11/188,298 US application
MQQDQTTSSLPSSSERSSSSAPQTDQETREAMESDEEIRRVPEVGLELAGPSTSGRETTAAAGTAAGAAGTSSASQAATSAARRRGRSPADKEHRRLKRLLRNRVSAQQARERKKAYLSELEVRVKDLEKRNSELEERLSTLQNENQMLRQILKNTTVNRRGPGGSSAGGDSQ

SEQ ID NO: 6319 - DNA, 1002 bp, Sorghum bicolor
  misc_feature: Ceres ANNOT ID no. 6065053
  misc_feature: Encodes the peptide sequence at SEQ ID NO 6320
atggcgacggtgctgccgctcgccgccgcctcggcctcggcctcgacctcggccgcgccgaggacttgcatctccggcggcctagtccccgcgccgttcctcggagctcgcgtgcgtctccgcatccacagcccgccgcggggcgttgcctgcgccctccgacggagaccctccaagtacaagactaaaatccagagtgaagagaatgtggtggctgcagaagatgtcatggatgatgatgatgacgaggatggtgcactggaagcacttttcaagcagctggaagaagatcttgagaatgatgatttatctgtggatgacgatgatgatggtatatcagaagaagatatggcaaggtttgaaaaggagttggcagaagcaattaaaggtgtcagtggtgttgatgaatcagcaggggattctttgatgagctctggggactatggtattgatgagcaaatagacagaagcgaacggccagagctgaaaacctggcaactccggagattggctcgtgcactgaaaattggtcggcgtaaaactagtataaagaatcttgcaggggagctaggtttagataggggtttggtcattgaaatgctccgcaatccaccaccgaagcttctactcatgtctgattctttgcctgatgaagccccttctaaatctgaagtgaaggaaatagaaccccctagttcgaccactgatgacgaggttgataccactgaaatcaaaccagagttggagcttccagtgcatgtcatgagtgcagaatggtctgcaagaaaaagattgaaaaaggtgcaacttgagaccttagaaagagtctacctgcgaagcaaacggcccacgaatgcaatgatcagcagcatcgttcaagtgacaaaccttccacgaaagaccattgttaagtggtttgaggatagaagggaacaagatggggtccctgaccatcgtgttgcattcaagagatccctatctgagattggttctatttcataa

SEQ ID NO: 6320 - protein, 333 aa, Sorghum bicolor
  misc_feature: Ceres ANNOT ID no. 6065053
  misc_feature (58)..(328): NCBI GI: 92886802 NCBI Desc: calcium-binding ef-hand; homeodomain-related [medicago truncatula]
  misc_feature: Useful for making plants with altered alkaloid content
  misc_feature: GREAT-hit functional homolog of the protein sequence given in SEQ ID NO 13335
  misc_feature: Useful for making plants with altered alkaloid content
  misc_feature: Functional homolog of the protein sequence given in SEQ ID NO 13335
MATVLPLAAASASASTSAAPRTCISGGLVPAPFLGARVRLRIHSPPRGVACALRRRPSKYKTKIQSEENVVAAEDVMDDDDDEDGALEALFKQLEEDLENDDLSVDDDDDGISEEDMARFEKELAEAIKGVSGVDESAGDSLMSSGDYGIDEQIDRSERPELKTWQLRRLARALKIGRRKTSIKNLAGELGLDRGLVIEMLRNPPPKLLLMSDSLPDEAPSKSEVKEIEPPSSTTDDEVDTTEIKPELELPVHVMSAEWSARKRLKKVQLETLERVYLRSKRPTNAMISSIVQVTNLPRKTIVKWFEDRREQDGVPDHRVAFKRSLSEIGSIS

SEQ ID NO: 6321 - DNA, 1260 bp, Sorghum bicolor
  misc_feature: Ceres ANNOT ID no. 6065088
  misc_feature: Encodes the peptide sequence at SEQ ID NO 6322
atggcgacggtgtcgatggacatcccgaagccctcggcgctgacggcggctggacacgaggctgccacggcgaagacgaggggcggcggcgaggggctggggaagtactacaatcagcacatccaggacctactcctcgcagtccagcagaggatcagtgacctaagccgcctagaggcccagaggaacgatctcaactcccaagttaaaatgtgcagggaagagttgcatctgcttcaggaaccaggttcacatgttggtgaggttgtgaaggtgatgagcaagtcaaaggttctagtgaaggtgcatccagaaggcaaatatattgttgatgttgataaaagtatagatattgcaaagctcacaccttccacacgagttgctcttcgaagcgggagctatatgcttcatgttattctgcccagcaaagtcgatccattagttaaccttatgaaggttgagaaagttcctaattctacatatgatatgattggtggtcttgatcagcaaattaaagagatcaaagaggtaatcgagcttccaataaagcatcctgagttgtttgagagtcttgggattgcccaaccaaagggtgtcattctctatggccctccaggtactggaaaaacattacttgctcgtgcagttgctcatcacacagactgtaccttcattagggtgtctggttctgagctggttcagaagtacattggagagggttcccggatggttcgtgaactttttgtgatggctagggaacatgcaccatccattatatttatggatgaaatagactccattggatcggctaggatggagtcaagtggcagtggtgatagtgaggttcagcgcaccatgcttgagcttctaaaccaacttgatggttttgaagcaacgaacaagattaaggttctcatggcaacaaacaggatagacattttggatcaagccctcctgaggcctggacgtattgacaggaaaattgaatttccaaatccaagtgaaacttcccgctttgatattttgaagattcattcaagaagaatgaacttgatgcgcggcattgatctgaagaagatagctacgaagatgaatggagcctctggggcagagctgaaggctatttgcacagaagcaggaatgtttgcccttcgggaaagaagggtgcacgtcacccaggaggatttcgagatggcagtggcaaaggtgatgaagaaggatacagagaagaacatgtctctgcggaagctctggaagtga

SEQ ID NO: 6322 - protein, 419 aa, Sorghum bicolor
  misc_feature: Ceres ANNOT ID no. 6065088
  misc_feature (198)..(385): Pfam Id: AAA Pfam Desc: ATPase family associated with various cellular activities(AAA)
  misc_feature (195)..(326): Pfam Id: AAA_2 Pfam Desc: ATPase family associated with various cellular activities(AAA)
  misc_feature (1)..(419): NCBI GI: 11991116 NCBI Desc: 26s proteasome atpase subunit rpt6 [oryza sativa]
  misc_feature (1)..(419): NCBI GI: 11993907 NCBI Desc: 26s proteasome rpt6a subunit [dactylis glomerata]
  misc_feature (30)..(419): NCBI GI: 6652888 NCBI Desc: 26s proteasome aaa-atpase subunit rpt6a [arabidopsis thaliana]
  misc_feature (30)..(419): NCBI GI: 6752880 NCBI Desc: 26s proteasome regulatory subunit 8 [pinus taeda]
  misc_feature (10)..(419): NCBI GI: 17385640 NCBI Desc: tat-binding protein homolog [matricaria chamomilla]
  misc_feature: The sequence is a functional homolog of SEQ ID NO. 462 in the 11/188,298 US application
  misc_feature: The sequence is a functional homolog of SEQ ID NO. 471 in the 11/188,298 US application
MATVSMDIPKPSALTAAGHEAATAKTRGGGEGLGKYYNQHIQDLLLAVQQRISDLSRLEAQRNDLNSQVKMCREELHLLQEPGSHVGEVVKVMSKSKVLVKVHPEGKYIVDVDKSIDIAKLTPSTRVALRSGSYMLHVILPSKVDPLVNLMKVEKVPNSTYDMIGGLDQQIKEIKEVIELPIKHPELFESLGIAQPKGVILYGPPGTGKTLLARAVAHHTDCTFIRVSGSELVQKYIGEGSRMVRELFVMAREHAPSIIFMDEIDSIGSARMESSGSGDSEVQRTMLELLNQLDGFEATNKIKVLMATNRIDILDQALLRPGRIDRKIEFPNPSETSRFDILKIHSRRMNLMRGIDLKKIATKMNGASGAELKAICTEAGMFALRERRVHVTQEDFEMAVAKVMKKDTEKNMSLRKLWK

SEQ ID NO: 6323 - DNA, 1023 bp, Sorghum bicolor
  misc_feature: Ceres ANNOT ID no. 6065094
  misc_feature: Encodes the peptide sequence at SEQ ID NO 6324
atggagaagaagaaggtggcgatcccgctggtgtgccacggccactcgcggccggtggttgacctcttctacagccccgtcacacccgatggctacttcctcatcagcgccagcaaggacacaaatccaatgcttcgtaatggtgagactggtgactggattgggacttttcaaggtcataaaggtgctgtttggagctgttgccttgacaggaatgctctgagggctgcttctgcttctgctgacttctcggctaaagtatgggatgcccttactggtgatgagctgcattcatttgaacacaagcatatagttcgggcatgtgccttctctgaggacacccaccttttactcactggaggcatggaaaagactttgcgtgtgtatgatatgaatcgtcctgatgcagctccaagagagcttgacaaatcgcctggttctgtccgaactgctgcttggcttcatagtgaccaaactatattaagttcctgcactgacatgggtggagtaagactatgggatgtgagaactggaaaaattgtccaaactcttgaaaccaaggcatctgtcactagtgcagaagtaagccaggatggcaggttcatcactacagctgatggctcaagtgtaaaattctgggatgcaaatcacttcggccttgttaaaagctatgatatgccgtgcaatgtggagtcggcttcacttgaacctaagtctgggagtaaatttgtagctggaggagaagatttgtgggttcatgtattcgatttcttcactggtgaagaaatagcttgtaacaaagggcatcatggtccagtccactgtgtccggtttgcacctggtggtgaatcatatgcatcaggttcggaagatggcaccattcggatctggcagcttagcccggctaattctgatgacaacgaggcggccaatgcaaatggcaagacaactgctggggtgaacgaggttacaaccaagatagaaggcttccacattcccaaggaggggcagaccgaggggtag

SEQ ID NO: 6324 - protein, 340 aa, Sorghum bicolor
  misc_feature: Ceres ANNOT ID no. 6065094
  misc_feature (51)..(89): Pfam Id: WD40 Pfam Desc: WD domain, G-beta repeat
  misc_feature (93)..(130): Pfam Id: WD40 Pfam Desc: WD domain, G-beta repeat
  misc_feature (260)..(298): Pfam Id: WD40 Pfam Desc: WD domain, G-beta repeat
  misc_feature (1)..(340): NCBI GI: 115468796 NCBI Desc: os06g0598900 [oryza sativa (japonica cultivar-group)]
  misc_feature (9)..(298): NCBI GI: 41053501 NCBI Desc: serine/threonine kinase receptor associated protein [danio rerio]
  misc_feature (9)..(298): NCBI GI: 12667270 NCBI Desc: serine-threonine kinase receptor-associated protein [carassius auratus gibelio]
  misc_feature (9)..(298): NCBI GI: 51895969 NCBI Desc: mgc86380 protein [xenopus laevis]
  misc_feature (9)..(298): NCBI GI: 48122105 NCBI Desc: similar to ensangp00000003345 [apis mellifera]
  misc_feature: The sequence is a functional homolog of SEQ ID NO. 502 in the 11/188,298 US application
  misc_feature: The sequence is a functional homolog of SEQ ID NO. 485 in the 11/188,298 US application
MEKKKVAIPLVCHGHSRPVVDLFYSPVTPDGYFLISASKDTNPMLRNGETGDWIGTFQGHKGAVWSCCLDRNALRAASASADFSAKVWDALTGDELHSFEHKHIVRACAFSEDTHLLLTGGMEKTLRVYDMNRPDAAPRELDKSPGSVRTAAWLHSDQTILSSCTDMGGVRLWDVRTGKIVQTLETKASVTSAEVSQDGRFITTADGSSVKFWDANHFGLVKSYDMPCNVESASLEPKSGSKFVAGGEDLWVHVFDFFTGEEIACNKGHHGPVHCVRFAPGGESYASGSEDGTIRIWQLSPANSDDNEAANANGKTTAGVNEVTTKIEGFHIPKEGQTEG

SEQ ID NO: 6325 - DNA, 1551 bp, Sorghum bicolor
  misc_feature: Ceres ANNOT ID no. 6065095
  misc_feature: Encodes the peptide sequence at SEQ ID NO 6326
atggagacgtcggcgccgcccaatgccgccgctccgccggcgcagcagccacggaggcggctgccggacttccagcagtcagtgcggctcaagtatgtgaagctggggtaccactacctcatctcccacgggatgtacctgctgctgtcgccgctgatggcgctcgtcgccgtgcagctctccaccgtctccccgcgcgacctcgccgacctgtgggagcagctccgcttcaacctcctctccgtcgtcgcctgctccacgctgctcgtcttcctctccaccgtctacttcctcacccgcccgcgccccgtgtacctgctcgacttcgcctgctacaagccggagccggagcgcaagtgcacgcgccagaccttcatgcactgctccaacctcaccggatccttcacggacgacaacctcgaattccagcgcaagatcctcgagcgctccggcctcggcgaggacacctaccttccccccgccgtgctccgggtgccccccaacccgtgcatggacgaggcgcgcaaggaggcgcgcgccgtcatgttcggcgccatcgaccagctgctcgagaagaccggggtcaggcccaaggacattggcgtcctagtggtcaactgcagcctgttcaacccgacgccgtcgctgtcagccatggtggtgaaccattacaagctgagggggaatattgtgagctacaacctcggcgggatgggctgcagcgctgggctgctgtccattgacctcgccaaggatctgctgcaggtgcaccccaactcttacgcgctggtgatcagcatggagaacatcacactgaattggtacttcgggaacaaccggtccatgctcgtgtcgaattgcctgttccggatgggtggtgcggccatcctgctctccaacaggcggtctgacaggcggaggtccaagtatgagctggtgcacacggtgcgcacgcacaagggcgccgacgacaagtgcttcggctgcgtgacccaggaggaagatgagattggcaagattggtgtgtcgctgtccaaggacctcatggcggtggccggagacgcgcttaagaccaacatcaccacgctggggccgttggtgctcccgttatcagagcagcttctcttcatgggcacactgattgccaagaaggtgctcaagatgaagatcaagccgtacatccctgacttcaaactggcattcgagcacttctgcatccatgctggtggccgtgctgtgctggatgagctggagaagaacctggagctaactgactggcacatggagccatcgaggatgaccctgtataggtttggcaacacatcaagcagctcactctggtacgagctggcatacactgaggccaagggcaggatcaggaagcgcgacaggatctggcagatcgcgttcggttctggattcaagtgcaacagcgccgtctggaaggcgctccggactgtgaacccggccaaggagaagagcccctggatggatgagattgacaacttcccggtggatgttccaaagatttcaaaggttggcggtgcttga

SEQ ID NO: 6326 - protein, 516 aa, Sorghum bicolor
  misc_feature: Ceres ANNOT ID no. 6065095
  misc_feature (96)..(385): Pfam Id: FAE1_CUT1_RppA Pfam Desc: FAE1/Type III polyketide synthase-like protein
  misc_feature (399)..(483): Pfam Id: ACP_syn_III_C Pfam Desc: 3-Oxoacyl-[acyl-carrier-protein (ACP)] synthase III C terminal
  misc_feature (342)..(485): Pfam Id: Chal_sti_synt_C Pfam Desc: Chalcone and stilbene synthases, C-terminal domain
  misc_feature (2)..(513): NCBI GI: 29417540 NCBI Desc: beta-ketoacyl-coa-synthase [marchantia polymorpha]
  misc_feature (18)..(507): NCBI GI: 11066477 NCBI Desc: fatty acid elongase 1-like protein [limnanthes douglasii]
  misc_feature (19)..(513): NCBI GI: 53850553 NCBI Desc: at1g04220 [arabidopsis thaliana]
  misc_feature (21)..(513): NCBI GI: 1045614 NCBI Desc: beta-ketoacyl-coa synthase
  misc_feature (18)..(509): NCBI GI: 32172500 NCBI Desc: fae3 [marchantia polymorpha]
  misc_feature (12)..(513): SWISSPROT Homolog: EC 2.3.1.119 3-ketoacyl-CoA synthase 11 (EC 2.3.1.-)
  misc_feature: The sequence is a functional homolog of SEQ ID NO 2 in US patent 7038112
METSAPPNAAAPPAQQPRRRLPDFQQSVRLKYVKLGYHYLISHGMYLLLSPLMALVAVQLSTVSPRDLADLWEQLRFNLLSVVACSTLLVFLSTVYFLTRPRPVYLLDFACYKPEPERKCTRQTFMHCSNLTGSFTDDNLEFQRKILERSGLGEDTYLPPAVLRVPPNPCMDEARKEARAVMFGAIDQLLEKTGVRPKDIGVLVVNCSLFNPTPSLSAMVVNHYKLRGNIVSYNLGGMGCSAGLLSIDLAKDLLQVHPNSYALVISMENITLNWYFGNNRSMLVSNCLFRMGGAAILLSNRRSDRRRSKYELVHTVRTHKGADDKCFGCVTQEEDEIGKIGVSLSKDLMAVAGDALKTNITTLGPLVLPLSEQLLFMGTLIAKKVLKMKIKPYIPDFKLAFEHFCIHAGGRAVLDELEKNLELTDWHMEPSRMTLYRFGNTSSSSLWYELAYTEAKGRIRKRDRIWQIAFGSGFKCNSAVWKALRTVNPAKEKSPWMDEIDNFPVDVPKISKVGGA

SEQ ID NO: 6327 - DNA, 1200 bp, Sorghum bicolor
  misc_feature: Ceres ANNOT ID no. 6065096
  misc_feature: Encodes the peptide sequence at SEQ ID NO 6328
atggccaacaccacatccttccgctcccgcctgctcgtcctcccaccgccaccggcgccccgcaccgccgtgtcctttcgtctccgcccatgcgctaccacggtctcctcgtcctcccagaggaggaggaggccccgcctcgcggcacgggcggcgcagcccggcggcgctgtggccccggcgtcggccgcgtcgaaggaggatgagcaggaggagattggcagcggcgggggtctgtctgcggctgacgcagagaggctgtgtgagttcctgcgggccgacctgccgcacctgttcgacgacgtcggcatcgaccggtctgcatacgacgaccgcgtgcggttccgggaccctatcacccgccacgacaccatcgacggctacctcttcaacatccgcctcctcaagctgctcttccgccccgacttctacctccacgccgtcaagcagacagggccgtacgagctcaccacgaggtggaccatggtgatgaagtttatgctcttgccctggaagccggagctggtcttcactggcctgtcgatcatgggcgtcaacccgcagaatctcaagttcaacagccatgtggatctttgggattcgatacaaaataacgagtacttctcttctgaaggattattggatgttttcaagcagctacggatttacaagacccctgacatagaaacaccaaattaccttattctaaagaggactgcacattacgaggttaggagttatgcaccattcttagtggttgaagcaaaaggtgataaactgacgggatcatctggcttcaataatgtaaccggatatatatttggcaataatgcttcgtctgaaaagattccgatgactacacctgtcttcactcaagcttctgacgacacactttcagatgtatccatccagatagttctgccaatgaacaaagacttggacagtttaccagctccaaatacagcagttactttgcggaaggtagaaggaggcattgctgcagtgaaaaaattcagtggacgaccaaaagaagaaattgtactgcagaaggagaaggatctacggtcccagttacttaatgatggattgaagcctcatccaggctgtttgcttgcacgctacaatgatcccaggacaaagagcttcttaatgaggaacgaggtgctcatacggctaattgacttcacactggagttgtaa

SEQ ID NO: 6328 - protein, 399 aa, Sorghum bicolor
  misc_feature: Ceres ANNOT ID no. 6065096
  misc_feature (227)..(393): Pfam Id: SOUL Pfam Desc: SOUL heme-binding protein
  misc_feature (222)..(295): NCBI GI: 50253033 NCBI Desc: soul heme-binding protein-like [oryza sativa (japonica cultivar-group)]
  misc_feature (228)..(390): NCBI GI: 121997212 NCBI Desc: soul heme-binding protein [halorhodospira halophila sl1]
  misc_feature (214)..(392): NCBI GI: 118735622 NCBI Desc: soul heme-binding protein [dinoroseobacter shibae dfl 12]
  misc_feature (228)..(390): NCBI GI: 116749836 NCBI Desc: soul heme-binding protein [syntrophobacter fumaroxidans mpob]
  misc_feature (229)..(392): NCBI GI: 146276214 NCBI Desc: soul heme-binding protein [rhodobacter sphaeroides atcc 17025]
MANTTSFRSRLLVLPPPPAPRTAVSFRLRPCATTVSSSSQRRRRPRLAARAAQPGGAVAPASAASKEDEQEEIGSGGGLSAADAERLCEFLRADLPHLFDDVGIDRSAYDDRVRFRDPITRHDTIDGYLFNIRLLKLLFRPDFYLHAVKQTGPYELTTRWTMVMKFMLLPWKPELVFTGLSIMGVNPQNLKFNSHVDLWDSIQNNEYFSSEGLLDVFKQLRIYKTPDIETPNYLILKRTAHYEVRSYAPFLVVEAKGDKLTGSSGFNNVTGYIFGNNASSEKIPMTTPVFTQASDDTLSDVSIQIVLPMNKDLDSLPAPNTAVTLRKVEGGIAAVKKFSGRPKEEIVLQKEKDLRSQLLNDGLKPHPGCLLARYNDPRTKSFLMRNEVLIRLIDFTLEL

SEQ ID NO: 6329 - DNA, 2928 bp, Sorghum bicolor
  misc_feature: Ceres ANNOT ID no. 6065101
  misc_feature: Encodes the peptide sequence at SEQ ID NO 6330
atggcgccgccgccgccgccgccaccgccgcaggcgcaggcgcggcaccaccaccaccaccaccaggggccagccaacaagggcggcggccacgcggagcggacgaagcagccgctgcagagcagcgtgacgcagcccaaggcggagccaccggcggtggtggcggcggccgtgctgccggagggaggcaagcggtgcggaggaggaggaggagggaggcgccgcggcgggcgcggccgggccaaggcgccgccgggtgagtctcgtgctgcgctggcggtagcggtagcgccagcgccggcgcaggcgcctccgccgcgcacggtcattgggccgcccgtgccgagcaaggggctgtcgttctgccgccggccggggttcgggacggtgggtgcgcgctgcgtcgtcaaggctaaccacttcctcgccgagctcccggacaaggacctcacccagtatgatgtgaagatcacgccggaggtgagctcgcggaccgtgaaccgggccataatggcggagctggtccgcctctaccgcgcgtccgacctcggaatgcgactcccggcctacgacggccgcaagaatctctacaccgcgggcaccctcccgttcgactctcgcgagttcgtcgtgcgcctcaccgatgaggacgacggcaccggcgtgccgcctcgggagagggagtacagggtcgccatcaagttcgccgcgcgcgccgacctccaccacctcaggcagttcatcgccgggcggcaggcggacgcgccccaggaggccctacaggtactcgacatcgtgctccgcgagctcgccaaccagaggtacgtgtccatagggcggtccttctactcgccggacatcaggaggccgcagcggctaggcgacggcctgcagtcgtggtgtgggttctaccagagcatccggccgacacagatgggattgtcgcttaacatcgacatgtcgtccacggcgttcattgaacccctgccggtgatcgagttcgtggcccagatattaggaaaggatgtcatatcaaggccattatccgatgctaaccgaatcaagatcaagaaggcattgcgaggagtaaaagttgaggtcactcaccgggggaatgtaaggcgcaagtatcgcatttctgggttgacaacgcaaccaactcatgaactgattttcccaattgatgagcaaatgaatatgaaatctgtcgtggagtacttcaaggaaatgtatggtttcaccattcagcatcctcatcttccctgccttcaggttgggaaccaaaagaaggcgaactatctaccgatggaggcatgcaagatcgttgaaggccagagatacacgaagaggctgaatgaaaaacagatcacatcattgctgaaggttacatgccaaaggcctagagaacaggagatggatattctacagacagttcatcaaaatggatatgagcaagatccatatgcaaaggaatttgggatcaacattagtgagaagctaacctctgttgaagctcgagtccttcctgcaccttggttgaagtaccatgacactggaaaagagaaagagtgcttaccacaggttggtcaatggaacatggtaaacaagaaagtgataaatggatgcaaggtgagccattgggcgtgtataaacttctcaaggagtgttccagaaaacacagctaggggattttgccaggaattggcgcaaatgtgtcagatttcgggcatggaatttaacagtgagccagtgatgccattatattcagctagaccagaccaagtagtgaaggcacttaaaaatgtgtataatattgcattgaacaaactcaagggtaaagaacttgaacttcttttggctatcctccctgacaacaatggtccgttatatggtgacatcaaacgtatttgtgaaactgatttgggattgataacacaatgttgcttgaccaaacatgtttttaagatcagcaagcagtacttggcaaatgtctcactgaaaattaatgttaagatgggaggaagaaatactgtgctcctggatgcaataagttggaggattcctttggtcagtgacataccaactattatatttggtgcggatgtaacacatcctgaaactggggaggactcaagtccatcaattgctgccgttgttgcttctcaagattggccagaagttacaaagtatgctggattggtttgtgctcaggcacaccggcaagagctcattcaggacctttacaaaacatggcatgatcctcagagaggcactgtaacaggcggcatgatcagggagctcttaatatccttcaggaaggccactgggcagaagccattgagaataatattctacagggacggtgttagtgaaggccagttctaccaagttctcctttacgagttagatgccatccgtaaggcatgtgcgtccctagaaccaaattaccagcctcctgtaacatttgtggtagttcaaaaacgtcatcatacaagactttttgcaaataatcacaaagacagaagtagcatggacaagagtggaaatattttgccaggaaccgttgttgattctaagatatgccacccaacggagtttgatttctacctctgcagtcatgctggaattcagggaacaagtaggcctgctcactaccatgtcctctgggatgagaacaatttcacagcagacgaaatgcagacattgacaaacaacctttgctacacttatgcccggtgcacacgctcggtttctgttgtccctcctgcatactacgcacacctggcagcattccgggctcggttctacatggaaccagagatgtcagagaaccagacgtcaaagagctccaatagcacgaacggagtctcggtgaagcccctgcctgctgtgaaggagaaggtgaaaagggtgatgttctactgctga

SEQ ID NO: 6330 - protein, 975 aa, Sorghum bicolor
  misc_feature: Ceres ANNOT ID no. 6065101
  misc_feature (617)..(938): Pfam Id: Piwi Pfam Desc: Piwi domain
  misc_feature (329)..(466): Pfam Id: PAZ Pfam Desc: PAZ domain
  misc_feature (1)..(975): NCBI GI: 50725578 NCBI Desc: zll/pnh homologous protein [oryza sativa (japonica cultivar-group)]
  misc_feature (1)..(975): NCBI GI: 21280321 NCBI Desc: zll/pnh homologous protein [oryza sativa (japonica cultivar-group)]
  misc_feature (41)..(975): NCBI GI: 10177951 NCBI Desc: pinhead [arabidopsis thaliana]
  misc_feature (41)..(975): NCBI GI: 2959781 NCBI Desc: zwille protein [arabidopsis thaliana]
  misc_feature (2)..(954): NCBI GI: 84688906 NCBI Desc: ago1-1 [nicotiana benthamiana]
  misc_feature: The sequence is a functional homolog of SEQ ID NO 152 in the 10/225,066US patent application
  misc_feature: The sequence is a functional homolog of SEQ ID NO 238 in the 10/374,780US patent application
  misc_feature: Useful for making plants with modulated growth and phenotype characteristics
  misc_feature: The sequence is a functional homolog of SEQ ID NO 152 in the 20050160493 US patent application
  misc_feature: The sequence is a functional homolog of SEQ ID NO 152 in the 10/225,066 US patent application
  misc_feature: The sequence is a functional homolog of SEQ ID NO 238 in the 10/374,780 US patent application
  misc_feature: The sequence is a functional homolog of SEQ ID NO 2086 in the 10/374,780 US patent application
MAPPPPPPPPQAQARHHHHHHQGPANKGGGHAERTKQPLQSSVTQPKAEPPAVVAAAVLPEGGKRCGGGGGGRRRGGRGRAKAPPGESRAALAVAVAPAPAQAPPPRTVIGPPVPSKGLSFCRRPGFGTVGARCVVKANHFLAELPDKDLTQYDVKITPEVSSRTVNRAIMAELVRLYRASDLGMRLPAYDGRKNLYTAGTLPFDSREFVVRLTDEDDGTGVPPREREYRVAIKFAARADLHHLRQFIAGRQADAPQEALQVLDIVLRELANQRYVSIGRSFYSPDIRRPQRLGDGLQSWCGFYQSIRPTQMGLSLNIDMSSTAFIEPLPVIEFVAQILGKDVISRPLSDANRIKIKKALRGVKVEVTHRGNVRRKYRISGLTTQPTHELIFPIDEQMNMKSVVEYFKEMYGFTIQHPHLPCLQVGNQKKANYLPMEACKIVEGQRYTKRLNEKQITSLLKVTCQRPREQEMDILQTVHQNGYEQDPYAKEFGINISEKLTSVEARVLPAPWLKYHDTGKEKECLPQVGQWNMVNKKVINGCKVSHWACINFSRSVPENTARGFCQELAQMCQISGMEFNSEPVMPLYSARPDQVVKALKNVYNIALNKLKGKELELLLAILPDNNGPLYGDIKRICETDLGLITQCCLTKHVFKISKQYLANVSLKINVKMGGRNTVLLDAISWRIPLVSDIPTIIFGADVTHPETGEDSSPSIAAVVASQDWPEVTKYAGLVCAQAHRQELIQDLYKTWHDPQRGTVTGGMIRELLISFRKATGQKPLRIIFYRDGVSEGQFYQVLLYELDAIRKACASLEPNYQPPVTFVVVQKRHHTRLFANNHKDRSSMDKSGNILPGTVVDSKICHPTEFDFYLCSHAGIQGTSRPAHYHVLWDENNFTADEMQTLTNNLCYTYARCTRSVSVVPPAYYAHLAAFRARFYMEPEMSENQTSKSSNSTNGVSVKPLPAVKEKVKRVMFYC

SEQ ID NO: 6331 - DNA, 582 bp, Sorghum bicolor
  misc_feature: Ceres ANNOT ID no. 6065106
  misc_feature: Encodes the peptide sequence at SEQ ID NO 6332
atgccgacgagctcgaccaactccgccgcggcggcttcccctgccgtgtcaggcctcgactacgacgacaccgcgctcaccctcgccctcccgggctcctcctcctccgccgccgacccctccgccgccgccgaccgcaagcgcgcccacgccgaccacgacaagccgccctccccaaaggcgcgggccgtggggtggccgccggtgcgcgcgtaccggcgcaacgcgctgcgcgacgagcaggccgccaagctcgtgaaggtggccgtggacggcgcgccgtacctgcgcaaggtggacctcgcggcgcacgacgggtacgcggcgctgctccgcgcgctccacggcatgttcgcctcctgcctcggagccgacggggccgggagcctcgtcgacgccgccaccggcgccgagtacgtgcccacctacgaggacaaggacggcgactggatgctcgtcggagacgtccccttcaagatgtttgtggactcgtgcaagaggatccgcctcatgaagagctccgaggccggcagcctatttcacataacttgcactcgatttagccctaccatgtcgttttaa

SEQ ID NO: 6332 - protein, 193 aa, Sorghum bicolor
  misc_feature: Ceres ANNOT ID no. 6065106
  misc_feature (19)..(180): Pfam Id: AUX_IAA Pfam Desc: AUX/IAA family
  misc_feature (5)..(179): NCBI GI: 75254412 NCBI Desc: auxin-responsive protein iaa23 (indoleacetic acid-induced protein 23)
  misc_feature (6)..(179): NCBI GI: 75252053 NCBI Desc: auxin-responsive protein iaa1 (indoleacetic acid-induced protein 1)
  misc_feature (83)..(176): NCBI GI: 32400272 NCBI Desc: iaa1 protein [triticum aestivum]
  misc_feature (1)..(179): NCBI GI: 75254479 NCBI Desc: auxin-responsive protein iaa15 (indoleacetic acid-induced protein 15)
  misc_feature (82)..(176): NCBI GI: 88911337 NCBI Desc: auxin-responsive protein iaa30 (indoleacetic acid-induced protein 30)
  misc_feature: The sequence is a functional homolog of SEQ ID NO 1149 in the 10/412,699US patent application
  misc_feature: The sequence is a functional homolog of SEQ ID NO 652 in the 11/479,226US patent application
  misc_feature: The sequence is a functional homolog of SEQ ID NO 736 in the 10/374,780US patent application
  misc_feature: The sequence is a functional homolog of SEQ ID NO 737 in the 10/374,780US patent application
  misc_feature: The sequence is a functional homolog of SEQ ID NO 738 in the 10/374,780US patent application
  misc_feature: The sequence is a functional homolog of SEQ ID NO 739 in the 10/374,780US patent application
  misc_feature: The sequence is a functional homolog of SEQ ID NO 742 in the 10/374,780US patent application
  misc_feature: Useful for making plants with modulated growth and phenotype characteristics
  misc_feature: The sequence is a functional homolog of SEQ ID NO 1149 in the 20040045049 US patent application
  misc_feature: The sequence is a functional homolog of SEQ ID NO 736 in the 20060162006 US patent application
  misc_feature: The sequence is a functional homolog of SEQ ID NO 737 in the 20060162006 US patent application
  misc_feature: The sequence is a functional homolog of SEQ ID NO 738 in the 20060162006 US patent application
  misc_feature: The sequence is a functional homolog of SEQ ID NO 739 in the 20060162006 US patent application
  misc_feature: The sequence is a functional homolog of SEQ ID NO 652 in the 20070022495 US patent application
  misc_feature: The sequence is a functional homolog of SEQ ID NO 736 in the 10/374,780 US patent application
  misc_feature: The sequence is a functional homolog of SEQ ID NO 738 in the 10/374,780 US patent application
  misc_feature: The sequence is a functional homolog of SEQ ID NO 739 in the 10/374,780 US patent application
  misc_feature: The sequence is a functional homolog of SEQ ID NO 648 in the 11/479,226 US patent application
  misc_feature: The sequence is a functional homolog of SEQ ID NO 636 in the 11/479,226 US patent application
  misc_feature: The sequence is a functional homolog of SEQ ID NO 652 in the 11/479,226 US patent application
  misc_feature: The sequence is a functional homolog of SEQ ID NO 656 in the 11/479,226 US patent application
  misc_feature: The sequence is a functional homolog of SEQ ID NO 737 in the 10/374,780 US patent application
  misc_feature: The sequence is a functional homolog of SEQ ID NO 598 in the 10/666,642 US patent application
  misc_feature: The sequence is a functional homolog of SEQ ID NO 904 in the 11/435,388 US patent application
MPTSSTNSAAAASPAVSGLDYDDTALTLALPGSSSSAADPSAAADRKRAHADHDKPPSPKARAVGWPPVRAYRRNALRDEQAAKLVKVAVDGAPYLRKVDLAAHDGYAALLRALHGMFASCLGADGAGSLVDAATGAEYVPTYEDKDGDWMLVGDVPFKMFVDSCKRIRLMKSSEAGSLFHITCTRFSPTMSF

SEQ ID NO: 6333 - DNA, 1263 bp, Sorghum bicolor
  misc_feature: Ceres ANNOT ID no. 6065108
  misc_feature: Encodes the peptide sequence at SEQ ID NO 6334
atggccgcctccatcgcggcctcgtccttcgttccagggtcgccggcgccggcgccggccgctcctaagagcggccttggggagcgcccagagagcctggacgtccgcggcgtggcggcgaagccgggagcctcgtcgaatgccgtgagggcgggcaagacgcgcgcccatgctgccgtccccaaggtgaacggtgggggcaagtctgcggtggcggatggggagcacgacaccgtaccttcctcggtgcccaagactttctacaaccagcttcccgactggagcatgctccttgcggccatcacgaccatcttcttggccgccgagaagcagtggacgatgcttgactggaagcccaggcggcctgacatgctcactgacacctttgggtttggccggatcatacatgatgggctcatgttcaggcagaacttctccattaggtcctatgagataggggcggataggacggcatctatagagacgctgatgaaccatttgcaggaaacagcacttaatcatgtgaagaccgctgggctgctaggtgatggattcggctccacaccagagatgagtaaaagaaacttgttctgggtggttagccaaatgcaggccatcgtcgagcgttatccatgctggggtgatactgttgaagtagatacatgggttagtgctaatggtaaaaatggaatgcgaagggattggcatatacgtgattctataacaggccacacgatactgaaggcaacaagtaaatgggttatgatgaacaaacttactaggaagcttgcaagaattccagatgaagtgcggactgaaatagagccatacttttttgagcgttctgctattgttgatgaagacaaccgcaagcttccaaaactgccagatggtcaaagcacttctgcagctaaatatgtgaggacagggctgactcctcggtgggctgatcttgatataaatcagcatgtcaataatgttaaatacattgcgtggattcttgagagtgcaccgatatctattcttgagaatcatgaactggcgagtattgtgctggattacaaaagggagtgtggccgggatagtgtgctgcagtcacacacctctgtgcagacggattgcaacagtgagtctggagaaacaaccttgcactgtgagcatgtgctgagccttgaatcaggcccgaccatggtaaaggcccggaccatgtggaggcctaagcgaaccaaggcccaagaaacagtggttccatcttcattttga

SEQ ID NO: 6334 - protein, 420 aa, Sorghum bicolor
  misc_feature: Ceres ANNOT ID no. 6065108
  misc_feature (138)..(406): Pfam Id: Acyl-ACP_TE Pfam Desc: Acyl-ACP thioesterase
  misc_feature (1)..(342): NCBI GI: 115468772 NCBI Desc: os06g0596300 [oryza sativa (japonica cultivar-group)]
  misc_feature (1)..(408): NCBI GI: 30962820 NCBI Desc: palmitoyl-acyl carrier protein thioesterase [elaeis guineensis]
  misc_feature (1)..(408): NCBI GI: 90018255 NCBI Desc: palmitoyl-acp thioesterase [elaeis guineensis]
  misc_feature (1)..(412): NCBI GI: 119638461 NCBI Desc: acyl-atp thioesterase [brachypodium sylvaticum]
  misc_feature (1)..(408): NCBI GI: 12004043 NCBI Desc: acyl-acp thioesterase [iris tectorum]
MAASIAASSFVPGSPAPAPAAPKSGLGERPESLDVRGVAAKPGASSNAVRAGKTRAHAAVPKVNGGGKSAVADGEHDTVPSSVPKTFYNQLPDWSMLLAAITTIFLAAEKQWTMLDWKPRRPDMLTDTFGFGRIIHDGLMFRQNFSIRSYEIGADRTASIETLMNHLQETALNHVKTAGLLGDGFGSTPEMSKRNLFWVVSQMQAIVERYPCWGDTVEVDTWVSANGKNGMRRDWHIRDSITGHTILKATSKWVMMNKLTRKLARIPDEVRTEIEPYFFERSAIVDEDNRKLPKLPDGQSTSAAKYVRTGLTPRWADLDINQHVNNVKYIAWILESAPISILENHELASIVLDYKRECGRDSVLQSHTSVQTDCNSESGETTLHCEHVLSLESGPTMVKARTMWRPKRTKAQETVVPSSF

SEQ ID NO: 6335 - DNA, 1158 bp, Sorghum bicolor
  misc_feature: Ceres ANNOT ID no. 6065138
  misc_feature: Encodes the peptide sequence at SEQ ID NO 6336
atgggcgagttgatccctgggttgccggaggaggtggcgagggagtgcctcgtccgagtgggcttcgaccagctgccggtggtccgccgcatctcgcgccagtggaagtccgaggtggagtcgcctgactaccaccgccagcgccgggcggaggggctggcgcgcccggtgctcgcgctggtccaggcgcagccgacagctccaccggctgacgacgctggtccggtggcggacaagcactcgacggcagcagcagcaggctcgggaggaggcccagcgaactcgtaccggatggtgttgctggacccggtggaaggacggtgggcgccgctgccgcccctgccagggccaagcgagagcctgcccctcttctgccaggtggccgccgtggacggcgggcaggggaggaggaagcggctggtggtggtcggcggctggcacccggagacgtgggcgccgacagacgcggtgttcgtgtacgacttcctgacgggcgcgtggcggcgcggcgcgcccatgccgggcccacgccggtccttcttcgcgtgcgcggccgtcggcggcgccgtgtacgtggccggcggccacgacgacgagaagaacgcgctccggtcggcgctggcctacgacccggaggccgacgcgtgggcgcagctcccggacatggcggaggagcgcgacgagccccgcgggctctgcgtcgccggaaggttcttcctcgtcgtcggcgggtacccgacgcaggcgcagggccggttcgttggctccgcggagtgcttcgacccggcgacgtccgcctgggcgcccgtcgacgacctagtcgaggacggcgtgtgcccgaggacctgctgcgccgcgccgccagggtctggctctgagcgcatgtacatgctaagtcgcgatgggcacctcgtggcgcgcgacggcggcgcggcgtggcgaccggtggcgcaggtgcccgaggacgcgcgcaccgcggcgaccgtctccgtcatcccggacgaccgcgtcgtggtcattgggtccgggtgccacggcggggatcagaccgtgtacgtgctccgcgaggaggccgggaaaggcgcgtcctggacgcgcgccgccgcaccgccggagttttccgggcacgtgcaggcctcctgcttccttgaaatctga

SEQ ID NO: 6336 - protein, 385 aa, Sorghum bicolor
  misc_feature: Ceres ANNOT ID no. 6065138
  misc_feature (122)..(174): Pfam Id: Kelch_1 Pfam Desc: Kelch motif
  misc_feature (177)..(223): Pfam Id: Kelch_1 Pfam Desc: Kelch motif
  misc_feature (3)..(50): Pfam Id: F-box Pfam Desc: F-box domain
  misc_feature (3)..(385): NCBI GI: 50725654 NCBI Desc: kelch repeat-containing f-box-like [oryza sativa (japonica cultivar-group)]
  misc_feature (3)..(385): NCBI GI: 49387909 NCBI Desc: kelch repeat-containing f-box-like [oryza sativa (japonica cultivar-group)]
  misc_feature (3)..(375): NCBI GI: 46390144 NCBI Desc: kelch repeat-containing f-box family protein-like [oryza sativa (japonica cultivar-group)]
  misc_feature (90)..(283): NCBI GI: 92868693 NCBI Desc: cyclin-like f-box; serine/threonine protein phosphatase, bsu1 [medicago truncatula]
  misc_feature (92)..(247): NCBI GI: 42572771 NCBI Desc: kelch repeat-containing f-box family protein [arabidopsis thaliana]
  misc_feature: The sequence is a functional homolog of SEQ ID NO. 315 in the 11/188,298 US application
  misc_feature: The sequence is a functional homolog of SEQ ID NO. 440 in the 11/188,298 US application
MGELIPGLPEEVARECLVRVGFDQLPVVRRISRQWKSEVESPDYHRQRRAEGLARPVLALVQAQPTAPPADDAGPVADKHSTAAAAGSGGGPANSYRMVLLDPVEGRWAPLPPLPGPSESLPLFCQVAAVDGGQGRRKRLVVVGGWHPETWAPTDAVFVYDFLTGAWRRGAPMPGPRRSFFACAAVGGAVYVAGGHDDEKNALRSALAYDPEADAWAQLPDMAEERDEPRGLCVAGRFFLVVGGYPTQAQGRFVGSAECFDPATSAWAPVDDLVEDGVCPRTCCAAPPGSGSERMYMLSRDGHLVARDGGAAWRPVAQVPEDARTAATVSVIPDDRVVVIGSGCHGGDQTVYVLREEAGKGASWTRAAAPPEFSGHVQASCFLEI

SEQ ID NO: 6337 - DNA, 1254 bp, Sorghum bicolor
  misc_feature: Ceres ANNOT ID no. 6065139
  misc_feature: Encodes the peptide sequence at SEQ ID NO 6338
  misc_feature: Up-regulated in shoot tissues in response to salicylic acid treatment
atgcgagctctgctccggatccactcgcccgcggtcatctccaccgcatccttcctccacacctactcaaccgccgcctccaagatcctagccccgagccccaccttcgtcccgctccggctcatccgccgcttcgcggccatggccgccaccgccgcggacgagttcgtgaagggccgcgtcttccccaacggcgtcgccgtcatcacgctcgatcgccccaaggccctcaacgccatgaacgtcgaaatggatgttagatacaaggcacttcttgatgaatgggaagcaaatccaagtgtcaagtgtattcttgtggaaagcagctcttctcgtgccttctcagcagggatggatattaagggggttgctgcggaaatacaaaaggacaaaaacacaccacttgtgcaaaaggtcttcacagcagagtactccttgatttgtaagatacatgagtatgcaaaaccttatatatgcttgatggatggagtgacaatgggatttggaattgggctatcagggcatggccgctaccgcattattactgagaggacactcctagccatgcctgagaatgctattggcctgttcccagatgttggttttgcttacattggtgcaaaagccccaggagggggcgcagttggagcttaccttgggattactggaaaaaggatatcatcacctgctgatgctatgtttataggccttggtactcattatgtaccttctgcaaatttgggttcactcaaggaatccctcctgagtgctaacttcacccatgatcctcatagagatgttgagtcagttctgacaggatacaagaaagaaccagagtctgaatcacaactagaaaagcttttgccatatatcatttcttctttcagtcctgataaatcagtagctgaatctgtggaagagctaaagaaatgtagtcgaagtggtgatgctgcagtggcagaatgggccaatgaagctttagcaggaattgagaaaggtgctccattttctctttgtttaacacagaagcatttctctcaagtggcatcagcgtacaggactagtgaacactatttatctaagctcgctggtgttatgaaattggaataccgcattgccttgaggtcgtcggttagaaatgattttgttgaaggcaatccgaagtggaatccagccactctggaagaagtaaacatgggcgaggttgaatctgtttttgagccattaggtgctgaggctgagttgagtgtgtga

SEQ ID NO: 6338 - protein, 417 aa, Sorghum bicolor
  misc_feature: Ceres ANNOT ID no. 6065139
  misc_feature (67)..(243): Pfam Id: ECH Pfam Desc: Enoyl-CoA hydratase/isomerase family
  misc_feature (43)..(414): NCBI GI: 79473201 NCBI Desc: catalytic [arabidopsis thaliana]
  misc_feature (48)..(414): NCBI GI: 21536517 NCBI Desc: 3-hydroxyisobutyryl-coenzyme a hydrolase-like protein [arabidopsis thaliana]
  misc_feature (13)..(417): NCBI GI: 11994698 NCBI Desc: 3-hydroxyisobutyryl-coenzyme a hydrolase-like protein [arabidopsis thaliana]
  misc_feature (53)..(417): NCBI GI: 140057190 NCBI Desc: enoyl-coa hydratase/isomerase [medicago truncatula]
  misc_feature (13)..(417): NCBI GI: 145332679 NCBI Desc: enoyl-coa hydratase/isomerase family protein [arabidopsis thaliana]
  misc_feature: Up-regulated in shoot tissues in response to salicylic acid treatment
MRALLRIHSPAVISTASFLHTYSTAASKILAPSPTFVPLRLIRRFAAMAATAADEFVKGRVFPNGVAVITLDRPKALNAMNVEMDVRYKALLDEWEANPSVKCILVESSSSRAFSAGMDIKGVAAEIQKDKNTPLVQKVFTAEYSLICKIHEYAKPYICLMDGVTMGFGIGLSGHGRYRIITERTLLAMPENAIGLFPDVGFAYIGAKAPGGGAVGAYLGITGKRISSPADAMFIGLGTHYVPSANLGSLKESLLSANFTHDPHRDVESVLTGYKKEPESESQLEKLLPYIISSFSPDKSVAESVEELKKCSRSGDAAVAEWANEALAGIEKGAPFSLCLTQKHFSQVASAYRTSEHYLSKLAGVMKLEYRIALRSSVRNDFVEGNPKWNPATLEEVNMGEVESVFEPLGAEAELSV

SEQ ID NO: 6339 - DNA, 1497 bp, Sorghum bicolor
  misc_feature: Ceres ANNOT ID no. 6065167
  misc_feature: Encodes the peptide sequence at SEQ ID NO 6340
  misc_feature: Up-regulated in root tissues in response to salicylic acid treatment
atggggagcgagagcaatcgcggcggtgcggcggaccggatggtggcggaggaggaggagaagaagaagcgcggggggcggctgttcgagatgccggagatcaggttcaccaagctcttcatcaatggctgcttcgtcgacgccgcctcaggccggacgtttgagacgagggacccgcgcacgggggacgtgatagccaccgtcgccgaggctgacaaagacgacgtggactcggcagtgagggcagccagggacgccttcgaccacggcgaatggccacgcatgtctggatccgaacgggggcggatcatggcgaggttcgctgacctggtggagcagcacgcggacgagctggcggcgctggagagcctggacgccgggaagcacccggccatcaccaaggccgtcgacatcggcaacgcggcgggcagcctgcggtacttcgccggcgcggcggacaagatccacgggctacacaccctccgcgagcccctgggcgtcgccgggatcatcatcccctggaacttcccctccaccatgttcgccatcaaggtcgccccggccctggccgccggctgcgccatggtcgtcaagcccgccgagcagacgccgctcagcgcgctcttcttcgcccagctcgccaagcgggctggagtccccgatggcgtcgtcaatgtcgtgccaggcttcggtccgacggcgggagctgcactcgcgtctcacatggacgttgacatggtgactttcactggatccacagaggttgggcgcctcataatgaaggcctccgcggagagcaacctgaagccggtttacctggagctcggcggcaagtcgccgctcatcatcttcgacgacgcggacgtcgacatggccgtcgagctcgccgtcagcgctaacttcttcaacaaggaaggcatgtacagcagattcgaggagaagttggcagagaggatgaagagctgggtggtgggagaccctttcagtgacgctcgtgccaaccagggccctcaggtggacaaggcgcagtatgagagggtgctcagctacatcgaccatggcaagagagaaggggccactcttctgaccggaggaggaagaccagccgcctgtggtcacaaaggctactacattgagcccacggttttcaccaacgtcacggaggacatggtcatagccaaggaggagatcttcggccctgtcatgtgcctgatcaagttcaagacggtggaggaggcgatctggagggcgaacgacagtcggtacgggctgggcgccggggtggtgacgcgagacgtggacgtggcgaaccgggtggtgaggtcggtgcgcgccggggtggtgtgggtcaactgctacttcgccatgggcagcgactgccccttcggcggacgcaagatgagcgggttcggcaaggacgaaggcatgcacgcgctcgacaagtacctggccatcaagtccgtcgtcaccccgctgcgtgcctcgccatggatgtga

SEQ ID NO: 6340 - protein, 498 aa, Sorghum bicolor
  misc_feature: Ceres ANNOT ID no. 6065167
  misc_feature (45)..(488): Pfam Id: Aldedh Pfam Desc: Aldehyde dehydrogenase family
  misc_feature (31)..(497): NCBI GI: 19850247 NCBI Desc: cytosolic aldehyde dehydrogenase rf2d [zea mays]
  misc_feature (29)..(498): NCBI GI: 19850241 NCBI Desc: cytosolic aldehyde dehydrogenase rf2c [zea mays]
  misc_feature (29)..(498): NCBI GI: 19850243 NCBI Desc: cytosolic aldehyde dehydrogenase rf2c [zea mays]
  misc_feature (29)..(498): NCBI GI: 144228161 NCBI Desc: cytosolic aldehyde dehydrogenase [leymus chinensis]
  misc_feature (21)..(498): NCBI GI: 45238345 NCBI Desc: aldehyde dehydrogenase [crocus sativus]
  misc_feature (19)..(498): SWISSPROT Homolog: EC 1.2.1.3 Aldehyde dehydrogenase 2C4, cytosolic
  misc_feature (33)..(488): SWISSPROT Homolog: EC 1.2.1.36 Retinal dehydrogenase 1
  misc_feature: Useful for making plants with altered carbohydrate content
  misc_feature: Functional homolog of the protein sequence given in SEQ ID NO 13953
  misc_feature: Up-regulated in root tissues in response to salicylic acid treatment
  misc_feature: The sequence is a functional homolog of SEQ ID NO. 428 in the 11/188,298 US application
  misc_feature: The sequence is a functional homolog of SEQ ID NO. 304 in the 11/188,298 US application
  misc_feature: The sequence is a functional homolog of SEQ ID NO. 537 in the 11/188,298 US application
  misc_feature: The sequence is a functional homolog of SEQ ID NO. 437 in the 11/188,298 US application
  misc_feature: The sequence is a functional homolog of SEQ ID NO. 475 in the 11/188,298 US application
  misc_feature: The sequence is a functional homolog of SEQ ID NO. 477 in the 11/188,298 US application
  misc_feature: The sequence is a functional homolog of SEQ ID NO. 442 in the 11/188,298 US application
  misc_feature: The sequence is a functional homolog of SEQ ID NO. 435 in the 11/188,298 US application
MGSESNRGGAADRMVAEEEEKKKRGGRLFEMPEIRFTKLFINGCFVDAASGRTFETRDPRTGDVIATVAEADKDDVDSAVRAARDAFDHGEWPRMSGSERGRIMARFADLVEQHADELAALESLDAGKHPAITKAVDIGNAAGSLRYFAGAADKIHGLHTLREPLGVAGIIIPWNFPSTMFAIKVAPALAAGCAMVVKPAEQTPLSALFFAQLAKRAGVPDGVVNVVPGFGPTAGAALASHMDVDMVTFTGSTEVGRLIMKASAESNLKPVYLELGGKSPLIIFDDADVDMAVELAVSANFFNKEGMYSRFEEKLAERMKSWVVGDPFSDARANQGPQVDKAQYERVLSYIDHGKREGATLLTGGGRPAACGHKGYYIEPTVFTNVTEDMVIAKEEIFGPVMCLIKFKTVEEAIWRANDSRYGLGAGVVTRDVDVANRVVRSVRAGVVWVNCYFAMGSDCPFGGRKMSGFGKDEGMHALDKYLAIKSVVTPLRASPWM

SEQ ID NO: 6341 - DNA, 516 bp, Sorghum bicolor
  misc_feature: Ceres ANNOT ID no. 6065168
  misc_feature: Encodes the peptide sequence at SEQ ID NO 6342
atgcagtcgctgcaggacaaggcgtcggagtggagcggcgtggcggccgccgatgccttcgccatcgacgacgtcaacctattcgagtccctcggcggcaccccgcagcccttcgtcgacctctccaccaatttctacaccagggtttttgaggacgaagaggagtggttccgggagatattcgcggggtcgaagaaggaggatgccatccagaaccagtatgagttcctgatccagcgcatgggcggcccgcctctcttctcccagaggagaggacaccctgcccttataggacgacatcgaccattcttggttacccaccgagctgcagagcggtggctacaccacatgcaacaagctttggatacaactgaaagcatagatgtggactcaaaaaccaaaatgatgaatttttttaggcacactgcttactttcttgttgctggcaatgagatgacaaggcaacagggccatggagtagcctgcaaacatgcaacaagtaaaccagctgagtga

SEQ ID NO: 6342 - protein, 171 aa, Sorghum bicolor
  misc_feature: Ceres ANNOT ID no. 6065168
  misc_feature (26)..(146): Pfam Id: Bac_globin Pfam Desc: Bacterial-like globin
  misc_feature (1)..(171): NCBI GI: 14165165 NCBI Desc: 2-on-2 hemoglobin [hordeum vulgare]
  misc_feature (1)..(171): NCBI GI: 27085257 NCBI Desc: hemoglobin hb2 [triticum aestivum]
  misc_feature (1)..(168): NCBI GI: 124028605 NCBI Desc: truncated hemoglobin [populus tremula x populus tremuloides]
  misc_feature (1)..(170): NCBI GI: 31559437 NCBI Desc: 2-on-2 hemoglobin [datisca glomerata]
  misc_feature (1)..(171): NCBI GI: 62318701 NCBI Desc: 2-on-2 hemoglobin (glb3) [arabidopsis thaliana]
MQSLQDKASEWSGVAAADAFAIDDVNLFESLGGTPQPFVDLSTNFYTRVFEDEEEWFREIFAGSKKEDAIQNQYEFLIQRMGGPPLFSQRRGHPALIGRHRPFLVTHRAAERWLHHMQQALDTTESIDVDSKTKMMNFFRHTAYFLVAGNEMTRQQGHGVACKHATSKPAE

SEQ ID NO: 6343 - DNA, 2865 bp, Sorghum bicolor
  misc_feature: Ceres ANNOT ID no. 6065191
  misc_feature: Encodes the peptide sequence at SEQ ID NO 6344
atggagccgccctctgccgcggcgcgggcggcggctgcgccaaggccgccgagcttcgcgtcgcagaccaatgctctcctgcgcaaaaacctcatcttccagaaacgtaataggaagggaaccattcggttaatcatagttcccatatatctctgtctcataatcagcgttcttcaaagagtcatcaacaattttctagataagccgaaatacaggtgtggttgcaagtgcattgttgtcaacggcacaggcccttgccaaaatgtgtgtggaattcagtactctacactggatcaggcacctagttgccccattccaaatcctccaaaatggcctgctctcgtgcaagtacccctaccagagtatcgcgctgtgcaggattcctccggcttgtttacaggcttccctgacgagtcatgtagaaagacacaatcatgcactgccagtataccctttgctggagcaaacaggactctatctaatagtatcatgcagaacctgttcacaagctcaccacttttaaatatttctgattacacaagcatatcaagtcatttgcttggtacagatgtaccaggatcttctacaggatttgttgaacctgcttttatctcggctcgacctatatatgttcttcaaccacaatgcaagtccagtgattcagttacaatcccaattactgtcggttctgttaatgcccagaaagagataaaatgtgttcaaggtttgcccttgtggcggaacagttcagcaacaattaatgaggaaacatttcaaggctaccggaaagggaaaactgctgaagggataaatgaaattgtgatgggctatgatttccaagattcaaatgagaagcattttaatgttcttgctttgtataactcgacttatgagaatgcctctttcattccaatgccatttgcacttttgcgcattccacgctcattgaatgcggtatcaaatgcctatctccaacttattcgaggttcaggcgtaaatatgttgctcgacttcacaaaagaaatgcctaagcaagccacccgtctgacatttgatttttctgctgtcgccggtccactatttttcgaatgggttgttgtcttgctttttccggttatgctgacctaccttgtatatgagaagcaacacaagctacgaacaatgatgaaaatgcatggacttggggatggcccttactggattatatactatatgtacttccttattttctccacgttgtatatgattgtatttgtcattttcggatccgtcataggtgtgaactttttcaagataaatgactacagtatacagtttgtgttctttttcagcttcattaatctgcagattgtattggccttcctagcctcatcattcttttctaaagttaacactgctcaggcaattgcgtacctgtacatatttgggtcagggttgatggcaggatatcttattcgcaattttattgaaggggggaaattcccaagacactggattacagttctggagataatacctgcattttctttatatcgaggactatatgagcttggccagtatgctgttaggtcttcagaaacaggaagccctggcatgcgatggagtgatttaaatgaccacacgaatggaatgagagatgtgttaatcattattattttagaatggttggttttgcttcctgttgcatattatttcgaccatgcttcttcagttggacacagatctagtctcctttctataatcaaacatctcctaaaggaccctacttcgagaaggataactgttaataaaatagctgataaggatgttcacatagagatggagaagctagatattatcaaagaaagagagactgttgatcaagtgctacagcaacacactagtggctacgctgtcatttgtgatgacctaaaaaaagtatatcgtggaaaagatggtaaccccgataagtttgcggttcaaggtgtatcacttgctttgccttatggagagtgccttggtattcttggccctaatggagctggaaaaagctcttttattagcatgatgattgggtttgtaaagccaacatcaggaaacgcatttgtacggggtttcagcatacaaaatgacatggaaaagatatacagcagcatgggagtttgcccacagaatgatatgctttgggagacgctaactggcagggaacatctccagttttatggccgactgaagggccttagtggttcatctttggatctcgctgttgatgagtctttaaggagtgtaaatttgcttcatgggggtgctcctgataagcaagtgaagaagtacagtggtggcatgaggaggcgccttagtgtcgccatctcgttgatcggagatgctaaagtcgtctacatggatgagccaagcactggattagacccagcttctaggaagagtctctggagtgctgtgaagcaagcaaagcaggatagagcaatcattctcaccacgcattccatggaagaagctgaaactctttgtgatagactgtgtatcatggtcgatggaagcctccagtgtataggcacgcccaaagagctcatagctagatacggagggtactatgtgctgacgatgacaacactgcccgagttcgaacaagaggtcgaaaacctggtgcgcaagctctcaccaagctccaggaaggtgtaccacctgtctgggacgcagaagtacgagctgccgaagcaggaagcgaggatctcagatgtgttcatggccgtggagagcttcaagaagagggtggaggtccaggcctggggcctcgcggacaccaccatggaggatgtgttcgtcaaggtcgccaaaggggcccggtccagcgaagaactctcctag

SEQ ID NO: 6344 - protein, 954 aa, Sorghum bicolor
  misc_feature: Ceres ANNOT ID no. 6065191
  misc_feature (663)..(845): Pfam Id: ABC_tran Pfam Desc: ABC transporter
  misc_feature (5)..(948): NCBI GI: 115476294 NCBI Desc: os08g0398300 [oryza sativa (japonica cultivar-group)]
  misc_feature (12)..(949): NCBI GI: 22331657 NCBI Desc: abc transporter family protein [arabidopsis thaliana]
  misc_feature (12)..(954): NCBI GI: 144923966 NCBI Desc: aaa atpase [medicago truncatula]
  misc_feature (46)..(949): NCBI GI: 4741195 NCBI Desc: abc transporter-like protein [arabidopsis thaliana]
  misc_feature (16)..(949): NCBI GI: 22331649 NCBI Desc: abc transporter family protein [arabidopsis thaliana]
MEPPSAAARAAAAPRPPSFASQTNALLRKNLIFQKRNRKGTIRLIIVPIYLCLIISVLQRVINNFLDKPKYRCGCKCIVVNGTGPCQNVCGIQYSTLDQAPSCPIPNPPKWPALVQVPLPEYRAVQDSSGLFTGFPDESCRKTQSCTASIPFAGANRTLSNSIMQNLFTSSPLLNISDYTSISSHLLGTDVPGSSTGFVEPAFISARPIYVLQPQCKSSDSVTIPITVGSVNAQKEIKCVQGLPLWRNSSATINEETFQGYRKGKTAEGINEIVMGYDFQDSNEKHFNVLALYNSTYENASFIPMPFALLRIPRSLNAVSNAYLQLIRGSGVNMLLDFTKEMPKQATRLTFDFSAVAGPLFFEWVVVLLFPVMLTYLVYEKQHKLRTMMKMHGLGDGPYWIIYYMYFLIFSTLYMIVFVIFGSVIGVNFFKINDYSIQFVFFFSFINLQIVLAFLASSFFSKVNTAQAIAYLYIFGSGLMAGYLIRNFIEGGKFPRHWITVLEIIPAFSLYRGLYELGQYAVRSSETGSPGMRWSDLNDHTNGMRDVLIIIILEWLVLLPVAYYFDHASSVGHRSSLLSIIKHLLKDPTSRRITVNKIADKDVHIEMEKLDIIKERETVDQVLQQHTSGYAVICDDLKKVYRGKDGNPDKFAVQGVSLALPYGECLGILGPNGAGKSSFISMMIGFVKPTSGNAFVRGFSIQNDMEKIYSSMGVCPQNDMLWETLTGREHLQFYGRLKGLSGSSLDLAVDESLRSVNLLHGGAPDKQVKKYSGGMRRRLSVAISLIGDAKVVYMDEPSTGLDPASRKSLWSAVKQAKQDRAIILTTHSMEEAETLCDRLCIMVDGSLQCIGTPKELIARYGGYYVLTMTTLPEFEQEVENLVRKLSPSSRKVYHLSGTQKYELPKQEARISDVFMAVESFKKRVEVQAWGLADTTMEDVFVKVAKGARSSEELS

SEQ ID NO: 6345 - DNA, 1365 bp, Sorghum bicolor
  misc_feature: Ceres ANNOT ID no. 6065200
  misc_feature: Encodes the peptide sequence at SEQ ID NO 6346
atggaggaggaggggttccgatggagcagagcgggctctttcgtcctgttctacttggtcttgttcctgtccgcggccgtgtcgtcggaggccaacatcggcgacttcgacgactactggcggcagcgcaagctcatggccgacgccgcggcagaggccacgtacaagcatgacccgctcgaggtcaccaaccaactcaaccgcgcagtgcacagatccgtcgagaaggaggacatgagcacgcggcggcgggcgatgatggggcacaagaagggtaagctcaacaacgggccgtgcgaggcgacgaacccgatcgaccgttgctggcggtgccggcaggactgggcgacggaccggaagcggctggctcggtgcgcccagggcttcggtcgcaacaccaccggcggtctggccggcaagttctacgtggtgacggacggcaccgacgacgacgtggtgaaccctcgccccggcacgctccggtgggccgtcatccagatcgagccgctgtggatcaccttcgccaggacgatgatcatcacgctcaaggaggagctcatcatccagggcgacaagaccatcgacggccggggcgcgcaggtgcggatcgccaacggcgcgcagctgacggtgcagttcgccaacaacgtcatcatccacaacgtgcacatcaacgacatcatgtcctccaacaagaacggcggcaacatccgggactcgccggaccacttcggctggcgcaccgtctccgacggcgacggcatcaccctcttcggctccaccaacgtgtggctcgaccacctctccctctccaactgccaggacggcctcatcgacgtcatcgtcaagtccacgggcgtcaccatctccaactgccacatgaccaaccacaacgacgtcatgctcttcagctccagcgacaagcaccccgaggaccagatcatgcagatcaccgtcgccttcaaccacttcggcagaggcctcgtgcagaggatgccgaggtgccgctgggggttcttccacgtcgtcaacaacgactacacgcactggctcatgtacgccatcggcggcagcaaggcgccgaccatcatcagccaggggaaccgctacatcgcgccgcccaacctggcggcgaagctggtcacaaagcaccatgacgcgccggagtcggagtggaagaactgggtgtggcactcggagaacgacctcttcatggagggagccaacttcaccgtcagcggcggccagaagatcaacaggaatttccacaagaaggacctcatcaagcccaagaacgggtcctacgtcaccaggctcacgcgatacgccggcgcgctcgcctgcaggcccggcaagccctgctag

SEQ ID NO: 6346 - protein, 454 aa, Sorghum bicolor
  misc_feature: Ceres ANNOT ID no. 6065200
  misc_feature (183)..(370): Pfam Id: Pec_lyase_C Pfam Desc: Pectate lyase
  misc_feature (32)..(85): Pfam Id: Pec_lyase_N Pfam Desc: Pectate lyase, N terminus
  misc_feature (10)..(454): NCBI GI: 19451 NCBI Desc: pectate lyase [lilium longiflorum]
  misc_feature (13)..(454): NCBI GI: 1171161 NCBI Desc: pectate lyase homolog
  misc_feature (13)..(454): NCBI GI: 92871796 NCBI Desc: pectate lyase, n-terminal; pectolytic enzyme, pectin lyase fold [medicago truncatula]
  misc_feature (13)..(454): NCBI GI: 34223509 NCBI Desc: oil palm polygalacturonase allergen pest411 [elaeis guineensis]
  misc_feature (17)..(452): NCBI GI: 34223507 NCBI Desc: oil palm polygalacturonase allergen pest361 [elaeis guineensis]
  misc_feature (10)..(454): SWISSPROT Homolog: EC 4.2.2.2 Pectate lyase precursor
  misc_feature: Useful for making plants with altered cell wall content and/or composition
  misc_feature: Functional homolog of the protein sequence encoded by LOCUS at2g02720
  misc_feature: Functional homolog of the protein sequence encoded by LOCUS at5g15110
  misc_feature: Useful for making plants with altered cell wall content and/or composition
  misc_feature: Functional homolog of the protein sequence given in SEQ ID NO 13952
  misc_feature: Useful for making plants with modulated phosphate use efficiency
  misc_feature: Functional homolog of the protein sequence given in SEQ ID NO 13129
  misc_feature: Useful for making plants with altered carbohydrate content
  misc_feature: Functional homolog of the protein sequence given in SEQ ID NO 13668
MEEEGFRWSRAGSFVLFYLVLFLSAAVSSEANIGDFDDYWRQRKLMADAAAEATYKHDPLEVTNQLNRAVHRSVEKEDMSTRRRAMMGHKKGKLNNGPCEATNPIDRCWRCRQDWATDRKRLARCAQGFGRNTTGGLAGKFYVVTDGTDDDVVNPRPGTLRWAVIQIEPLWITFARTMIITLKEELIIQGDKTIDGRGAQVRIANGAQLTVQFANNVIIHNVHINDIMSSNKNGGNIRDSPDHFGWRTVSDGDGITLFGSTNVWLDHLSLSNCQDGLIDVIVKSTGVTISNCHMTNHNDVMLFSSSDKHPEDQIMQITVAFNHFGRGLVQRMPRCRWGFFHVVNNDYTHWLMYAIGGSKAPTIISQGNRYIAPPNLAAKLVTKHHDAPESEWKNWVWHSENDLFMEGANFTVSGGQKINRNFHKKDLIKPKNGSYVTRLTRYAGALACRPGKPC

SEQ ID NO: 6347 - DNA, 921 bp, Sorghum bicolor
  misc_feature: Ceres ANNOT ID no. 6065247
  misc_feature: Encodes the peptide sequence at SEQ ID NO 6348
atgccgtcgcacgcggatctggaccgtcagatctcgcagctgcgggattgcaagttcctgccggaggcggaggtcaaggcgctatgcgagcaggccaaggcgatcctcatggaggagtggaacgtgcagcccgtgcgctgccccgtcactgtctgcggcgacatccacggccagttctacgacctcatcgagctcttccgcatcggcggcaacgcgcccgacaccaactacctctttatgggcgactacgtcgaccgtggctactactcagtggagacggtgtcgttgttagtggctttaaaagtacgttatagagacagaatcacaatattgagaggaaatcatgagagcagacaaataactcaagtgtatggcttctatgatgaatgcttgcggaaatatggaaatgcaaatgtgtggaagtactttacagacttgtttgattatttgcctctcacagctcttatagaaaaccagatcttctgcctacatggtggtctgtctccatcactggatacattggataatatccgtgctcttgatcgcatacaagaggttccccatgaaggacctatgtgtgatcttttgtggtctgacccggatgaccgatgtgggtggggaatttcaccaaggggtgctggatacacatttggccaagatattgcacaacaattcaaccatacaaatgggctaagtcttatttcaagggctcatcaacttgtaatggaagggttcaattggtgccaggataagaacgttgtgactgtgttcagcgcgcctaactactgctaccgatgtgggaacatggctgccatccttgaaattggtgagaacatggatcagaacttcctccaattcgacccagctccgcggcaaatcgagccagacatgacgcgcaagaccccagactactttttgtaa

SEQ ID NO: 6348 - protein, 306 aa, Sorghum bicolor
  misc_feature: Ceres ANNOT ID no. 6065247
  misc_feature (47)..(242): Pfam Id: Metallophos Pfam Desc: Calcineurin-like phosphoesterase
  misc_feature (1)..(306): NCBI GI: 116242775 NCBI Desc: serine/threonine-protein phosphatase pp2a-1 catalytic subunit
  misc_feature (1)..(306): NCBI GI: 3859548 NCBI Desc: protein phosphatase 2a catalytic subunit [oryza sativa (indica cultivar-group)]
  misc_feature (1)..(306): NCBI GI: 5231210 NCBI Desc: serine/threonine protein phosphatase pp2a-3 catalytic subunit [oryza sativa (indica cultivar-group)]
  misc_feature (1)..(306): NCBI GI: 11134222 NCBI Desc: serine/threonine protein phosphatase pp2a-3 catalytic subunit
  misc_feature (1)..(306): NCBI GI: 1218054 NCBI Desc: protein phosphatase 2a [oryza sativa]
  misc_feature (1)..(306): SWISSPROT Homolog: EC 3.1.3.16 Serine/threonine-protein phosphatase PP2A-1 catalytic subunit
  misc_feature: The sequence is a functional homolog of SEQ ID NO 13 in US patent 7271316
MPSHADLDRQISQLRDCKFLPEAEVKALCEQAKAILMEEWNVQPVRCPVTVCGDIHGQFYDLIELFRIGGNAPDTNYLFMGDYVDRGYYSVETVSLLVALKVRYRDRITILRGNHESRQITQVYGFYDECLRKYGNANVWKYFTDLFDYLPLTALIENQIFCLHGGLSPSLDTLDNIRALDRIQEVPHEGPMCDLLWSDPDDRCGWGISPRGAGYTFGQDIAQQFNHTNGLSLISRAHQLVMEGFNWCQDKNVVTVFSAPNYCYRCGNMAAILEIGENMDQNFLQFDPAPRQIEPDMTRKTPDYFL

SEQ ID NO: 6349 - DNA, 1074 bp, Sorghum bicolor
  misc_feature: Ceres ANNOT ID no. 6065256
  misc_feature: Encodes the peptide sequence at SEQ ID NO 6350
atggtggcagcgtccgtggccgagcgggcctacgaggtggcgacgcggtccgcgctggtggcgctggagcgcaacctcatcccggacgccgtgacccggcggcttacgcggctcctgctcgcgcagcgcctccgccggggctacctcccctccgcgccgctccagctgcagcagctcctccagttcgtccgctcccttgaagagatgcccattgccattgaaacagacaaagctaaagcccaacattatgagttgccaactgcatttttcaagttagtgcttggaaggaatctcaaatacagttcctgctacttccctgatgattcaagcaccctagaagatgctgaggttgcaatgatggatctgtattgtgagaggtcaaaactacaagatggccaaagcatcctagatgttggatgtggatggggatccctttcactgtacattgcaaagaaatataggagctgcagtgtaacagggatatgcaactctactacacaaaaggcttttatagaagagcaatgtagggaaaatgagttgtcaaatgttgagataattgtagcagacatcagcaagtttgagatggagcgctcttttgacaggatcatatctatagagatgtttgagcacatgaaaaactacaagtcgcttcttaagaagatatccaggtggatgaaagaggacggcctactatttgttcacttcttctgccacaaaacatttccatatcattttgaggataaaaatgatgatgattggatcacgaggtatttcttcagtggaggaacaatgccatctgcaaacctacttctctactttcaggaagatgtatctgttctcaatcattggcttgtcagtggcacgcattatgcgagaactagcgaggagtggttaaaacgtatgaacaagagtatcacttcaataaggtcgatcttcgagaaaacttatgggaaggaatcaactaccaaatggatagcttattggcggacgttcttcatctcggtagctgaactttttggatacaacaatggagatgaatggatggttgcacattacttgttccaaaagaagtag

SEQ ID NO: 6350 - protein, 357 aa, Sorghum bicolor
  misc_feature: Ceres ANNOT ID no. 6065256
  misc_feature (75)..(356): Pfam Id: CMAS Pfam Desc: Cyclopropane-fatty-acyl-phospholipid synthase
  misc_feature (136)..(233): Pfam Id: Methyltransf_11 Pfam Desc: Methyltransferase domain
  misc_feature (136)..(231): Pfam Id: Methyltransf_12 Pfam Desc: Methyltransferase domain
  misc_feature (4)..(209): NCBI GI: 115468648 NCBI Desc: os06g0574100 [oryza sativa (japonica cultivar-group)]
  misc_feature (6)..(357): NCBI GI: 21593795 NCBI Desc: coclaurine n-methyltransferase [arabidopsis thaliana]
  misc_feature (7)..(357): NCBI GI: 16754879 NCBI Desc: coclaurine n-methyltransferase [coptis japonica]
  misc_feature (6)..(357): NCBI GI: 51980204 NCBI Desc: (s)-coclaurine n-methyltransferase; cnmt [thalictrum flavum subsp. glaucum]
  misc_feature (14)..(357): NCBI GI: 33413898 NCBI Desc: s-adenosyl-l-methionine:coclaurine n-methyltransferase [papaver somniferum]
MVAASVAERAYEVATRSALVALERNLIPDAVTRRLTRLLLAQRLRRGYLPSAPLQLQQLLQFVRSLEEMPIAIETDKAKAQHYELPTAFFKLVLGRNLKYSSCYFPDDSSTLEDAEVAMMDLYCERSKLQDGQSILDVGCGWGSLSLYIAKKYRSCSVTGICNSTTQKAFIEEQCRENELSNVEIIVADISKFEMERSFDRIISIEMFEHMKNYKSLLKKISRWMKEDGLLFVHFFCHKTFPYHFEDKNDDDWITRYFFSGGTMPSANLLLYFQEDVSVLNHWLVSGTHYARTSEEWLKRMNKSITSIRSIFEKTYGKESTTKWIAYWRTFFISVAELFGYNNGDEWMVAHYLFQKK

SEQ ID NO: 6351 - DNA, 2175 bp, Sorghum bicolor
  misc_feature: Ceres ANNOT ID no. 6065268
  misc_feature: Encodes the peptide sequence at SEQ ID NO 6352
atgtccggcggcgtgctcttcctggccctgctggcggcggcggcggcgttggccatcatcgtcgccccgtccccagccaatgcggcggtgtcgtacgaccacagggcggtggtgatcaacgggcagcgccggatcctcatctccggctccatccactacccacgcagcacgccggagatgtggccggaccttctccagaaggccaaggacggcggcctcgacgtggtccagacctacgtcttctggaacgggcacgaaccccagcagggccagtactacttcggcgaccgctacgacctcgtccgcttcgtcaagctcgccaagcaggccggcctcttcgtgcacctccgcatcgggccctacgtctgcgccgagtggaacttcggcggcttccccgtgtggctcaagtacgtccccggcgtcagcttccgcaccgacaacgcgccgttcaaggcggcgatgcaggcgttcgtggagaagatcgtgtcgatgatgaaggcggaggggctcttcgagtggcagggcgggcccatcatcctcgcgcaggtggagaacgagtacgggcccatggagtccgtcatgggcggcggcgccaagccctacgccaactgggcggccaagatggccgtcgccaccggcgccggcgtgccctgggtcatgtgcaagcaggacgacgcaccggaccccgtgatcaacacctgcaatggcttctactgcgattacttcagccccaactccaacagcaagcctacaatgtggaccgaggcctggaccggctggttcacggcgttcggtggcgcggtgccacaccggccggtggaggacatggccttcgccgtggcgcgcttcatccagaagggcggctccttcgtcaactactacatgtaccatggaggcaccaacttcgaccgcacctccggcgggccgttcatcgccaccagctacgattacgatgcgccgatcgacgaatacggtctgctgaggcagccgaaatggggtcacctgagggacctgcacaaggccatcaagcaagccgagccggcgctggtctccggcgaccccaccatccagaccatcgggaactacgagaaggcgtacgtgtacaagtcgagcagcggcgcgtgcgcggcgttcctgtccaactaccacaccaacgcggcggcgcgggtggtgttcaacgggcggcgctacgacctcccggcgtggtccatcagcgtgctgccggactgcaggacggccgtgttcaacacggcgacggtgagctcgccgtcggcgccggcgaggatgacccccgcgggcggcttctcgtggcagtcgtacagcgaggccaccaactcgctggacgaccgcgccttcaccaaggacggcctggtggagcagctcagcatgacgtgggacaagtccgactacctgtggtacaccacctacgtgaacatcaactcgaacgagcagttcttgaagtccggacagtggccgcagctgaccatctactccgccggccacgccctgcaggtgttcgtcaacgggcagtcctacggcgccgcgtatggcggctacgacagcccgaagctgacatacagcgggtacgtgaagatgtggcagggcagcaacaagatctccatcctcagcgcagcagtcggcctccctaaccagggcacccactacgaggcgtggaacgtcggcgtgctcggtccggtgacgctgtccggcctcaacgagggcaagagggacctcagcaaccagaaatggacctaccagatcggcctgcacggcgagtcgctgggcgtgcactccgtcgccgggagctcgtccgtcgagtggggcagcgccgccgggaagcaacccttgacatggcacaaggcctacttcaacgcgccgtccggcaacgcgccggtggccctggacatgagcagcatggggaagggccaggcgtgggtgaacggccaccacatcggccggtactggtcgtacaaggccaccggcggcagctgcggcggctgcagctacgcggggacgtacagcgagaccaagtgccagaccggctgcggcgacgtctcgcagaggtactaccatgtcccgcgctcctggctcaaccccagcggcaacctgctggtggtgctcgaggagttcggcggcgacctgtccggcgtcaagctcgtcaccaggacgacatga

SEQ ID NO: 6352 - protein, 724 aa, Sorghum bicolor
  misc_feature: Ceres ANNOT ID no. 6065268
  misc_feature (36)..(342): Pfam Id: Glyco_hydro_35 Pfam Desc: Glycosyl hydrolases family 35
  misc_feature (6)..(723): NCBI GI: 452712 NCBI Desc: beta-galactosidase [asparagus officinalis]
  misc_feature (8)..(723): NCBI GI: 33521214 NCBI Desc: beta-galactosidase [sandersonia aurantiaca]
  misc_feature (16)..(724): NCBI GI: 114217395 NCBI Desc: beta-d-galactosidase [persea americana]
  misc_feature (11)..(722): NCBI GI: 14970839 NCBI Desc: beta-galactosidase [fragaria x ananassa]
  misc_feature (5)..(722): NCBI GI: 124360385 NCBI Desc: d-galactoside/l-rhamnose binding suel lectin; galactose-binding like [medicago truncatula]
  misc_feature (6)..(723): SWISSPROT Homolog: EC 3.2.1.23 Beta-galactosidase precursor
  misc_feature: Useful for making plants with altered cell wall content and/or composition
  misc_feature: Functional homolog of the protein sequence encoded by LOCUS at3g13750
  misc_feature: Functional homolog of the protein sequence encoded by LOCUS at3g52840
  misc_feature: Functional homolog of the protein sequence encoded by LOCUS at4g26140
  misc_feature: Functional homolog of the protein sequence encoded by LOCUS at5g56870
  misc_feature: Useful for making plants with altered cell wall content and/or composition
  misc_feature: Functional homolog of the protein sequence given in SEQ ID NO 13590
  misc_feature: Useful for making plants with altered carbohydrate content
  misc_feature: Functional homolog of the protein sequence given in SEQ ID NO 13588
  misc_feature: The sequence is a functional homolog of SEQ ID NO 2 in US patent 7084321
MSGGVLFLALLAAAAALAIIVAPSPANAAVSYDHRAVVINGQRRILISGSIHYPRSTPEMWPDLLQKAKDGGLDVVQTYVFWNGHEPQQGQYYFGDRYDLVRFVKLAKQAGLFVHLRIGPYVCAEWNFGGFPVWLKYVPGVSFRTDNAPFKAAMQAFVEKIVSMMKAEGLFEWQGGPIILAQVENEYGPMESVMGGGAKPYANWAAKMAVATGAGVPWVMCKQDDAPDPVINTCNGFYCDYFSPNSNSKPTMWTEAWTGWFTAFGGAVPHRPVEDMAFAVARFIQKGGSFVNYYMYHGGTNFDRTSGGPFIATSYDYDAPIDEYGLLRQPKWGHLRDLHKAIKQAEPALVSGDPTIQTIGNYEKAYVYKSSSGACAAFLSNYHTNAAARVVFNGRRYDLPAWSISVLPDCRTAVFNTATVSSPSAPARMTPAGGFSWQSYSEATNSLDDRAFTKDGLVEQLSMTWDKSDYLWYTTYVNINSNEQFLKSGQWPQLTIYSAGHALQVFVNGQSYGAAYGGYDSPKLTYSGYVKMWQGSNKISILSAAVGLPNQGTHYEAWNVGVLGPVTLSGLNEGKRDLSNQKWTYQIGLHGESLGVHSVAGSSSVEWGSAAGKQPLTWHKAYFNAPSGNAPVALDMSSMGKGQAWVNGHHIGRYWSYKATGGSCGGCSYAGTYSETKCQTGCGDVSQRYYHVPRSWLNPSGNLLVVLEEFGGDLSGVKLVTRTT

SEQ ID NO: 6353 - DNA, 1161 bp, Sorghum bicolor
  misc_feature: Ceres ANNOT ID no. 6065280
  misc_feature: Encodes the peptide sequence at SEQ ID NO 6354
atgtctgccatctacatgagccagctctccactgctctccctctcatggagggagatcaccaccaccaccaccaccaccaccaccaaggccacttccaagccttcacgctgccaaaggatcccccaatccttttcccctttgtgatcagcaatagtagcgccagcgaaagcagtctgagctatggatcggcagatcatcacttgttgaggcagcatcgtcaaactatgctcgagccccaacatatgattggtggatcgtcatcagctgcgagtagtgtctttgcgacgccgttcccgactgtggagagcatccgtgacgacatgatcgagcctgcctcgtacgatccatacgatatggggaagctgcaccaggtggtcggtggcgggtcgtcgatggatgcttgcagctggacgccgccggcggccaagatgaggatcacgaggaaggccactgccgccgatcccagtggtgccgggaagaagccgaggagaagggcgcatcaggcagcagggtacgacgccgacatcaacatgagcggccaaccaaatttgggtgttattagggtgtgctccgactgcaacaccaccaagacgcccttgtggaggagtggtccttgcggccccaagtcgctctgcaacgcgtgcggtatcaggcagcggaaggcacggcgggcgatgatggccgccgcgtctacctccgggccagcagcagtgcccgccaccgacagcgataaggcctcgccgagcaacgccgccggggccgcagcagcacaccccaaggtgaagaaggagaagagatcagtggacgtggaccggtcgctgccgttcaagaaacggtgcaaggtggtccaggtccagcaggatcacgctgcggccgtcgcagctcctgccgcggccactgacaggccggctgtcgtcgtgcagcaggcggccaccgccgccgaggttggtgacgacgacgcctgtccgagcagggacctgcttgtcgacgacattggtgggctcatcagctggagcaggagtccgccggcggctcccgcatctgcagatgctgcctcctgcagtttccgggcgtcgccggcgttgccggtgcagcaggacgagatcacggacgctgccatgctgctcatgacgctgtcctgcgggcttgtccgaagctga

SEQ ID NO: 6354 - protein, 386 aa, Sorghum bicolor
  misc_feature: Ceres ANNOT ID no. 6065280
  misc_feature (190)..(225): Pfam Id: GATA Pfam Desc: GATA zinc finger
  misc_feature (1)..(256): NCBI GI: 54291240 NCBI Desc: zinc finger protein-like [oryza sativa (japonica cultivar-group)]
  misc_feature (1)..(347): NCBI GI: 46806488 NCBI Desc: zinc finger protein-like [oryza sativa (japonica cultivar-group)]
  misc_feature (127)..(242): NCBI GI: 20521225 NCBI Desc: gata-type zinc finger transcription factor-like [oryza sativa (japonica cultivar-group)]
  misc_feature (188)..(268): NCBI GI: 57899525 NCBI Desc: zinc finger protein-like [oryza sativa (japonica cultivar-group)]
  misc_feature (162)..(267): NCBI GI: 15240409 NCBI Desc: zinc finger (gata type) family protein [arabidopsis thaliana]
  misc_feature: The sequence is a functional homolog of SEQ ID NO 1032 in the 10/666,642US patent application
  misc_feature: The sequence is a functional homolog of SEQ ID NO 1655 in the 10/374,780US patent application
  misc_feature: The sequence is a functional homolog of SEQ ID NO 1656 in the 10/374,780US patent application
  misc_feature: The sequence is a functional homolog of SEQ ID NO 1657 in the 10/374,780US patent application
  misc_feature: The sequence is a functional homolog of SEQ ID NO 276 in the 10/666,642US patent application
  misc_feature: The sequence is a functional homolog of SEQ ID NO 607 in the 10/374,780US patent application
  misc_feature: The sequence is a functional homolog of SEQ ID NO 608 in the 10/374,780US patent application
  misc_feature: The sequence is a functional homolog of SEQ ID NO 609 in the 10/374,780US patent application
  misc_feature: Useful for making plants with modulated growth and phenotype characteristics
  misc_feature: The sequence is a functional homolog of SEQ ID NO 1655 in the 20060162006 US patent application
  misc_feature: The sequence is a functional homolog of SEQ ID NO 1656 in the 20060162006 US patent application
  misc_feature: The sequence is a functional homolog of SEQ ID NO 1657 in the 20060162006 US patent application
  misc_feature: The sequence is a functional homolog of SEQ ID NO 607 in the 20060162006 US patent application
  misc_feature: The sequence is a functional homolog of SEQ ID NO 608 in the 20060162006 US patent application
  misc_feature: The sequence is a functional homolog of SEQ ID NO 609 in the 20060162006 US patent application
  misc_feature: The sequence is a functional homolog of SEQ ID NO 1032 in the 20070033671 US patent application
  misc_feature: The sequence is a functional homolog of SEQ ID NO 276 in the 20070033671 US patent application
  misc_feature: The sequence is a functional homolog of SEQ ID NO 1032 in the 10/666,642 US patent application
MSAIYMSQLSTALPLMEGDHHHHHHHHHQGHFQAFTLPKDPPILFPFVISNSSASESSLSYGSADHHLLRQHRQTMLEPQHMIGGSSSAASSVFATPFPTVESIRDDMIEPASYDPYDMGKLHQVVGGGSSMDACSWTPPAAKMRITRKATAADPSGAGKKPRRRAHQAAGYDADINMSGQPNLGVIRVCSDCNTTKTPLWRSGPCGPKSLCNACGIRQRKARRAMMAAASTSGPAAVPATDSDKASPSNAAGAAAAHPKVKKEKRSVDVDRSLPFKKRCKVVQVQQDHAAAVAAPAAATDRPAVVVQQAATAAEVGDDDACPSRDLLVDDIGGLISWSRSPPAAPASADAASCSFRASPALPVQQDEITDAAMLLMTLSCGLVRS

SEQ ID NO: 6355 - DNA, 1245 bp, Sorghum bicolor
  misc_feature: Ceres ANNOT ID no. 6065390
  misc_feature: Encodes the peptide sequence at SEQ ID NO 6356
  misc_feature: Up-regulated in root tissues in response to methyl jasmonate treatment
  misc_feature: Up-regulated in shoot tissues in response to methyl jasmonate treatment
atggcggggtacggggaggagaaccagaacgccatgaacgggtacgaggaggaagaggaggaagaagaggttgaagaggtcgaggaggtgtacgaagaggaggaggaggagggggacggggatggggagggggagggggaagcggacgagggggctgcggccgccgaggcagcggcgatggcggccgagacgagaagcgtcgttggagaccggggcctagcggaggccgctgggaatgttgacgctggtggcgaggatgggagagatgcagattctgggggtggtgattcgtcggggaagattttcgtagggggtgtagcctgggagacaaccgaagaaacattcacaaagcattttcagaagtatggagctataactgattctgtgatcatgaaggacaagcatactaggatgcctcgtggatttggatttgttacattttccgatccatctgtgcttgacagggttctagaggatgcccatgtcatagatggaagaacagttgaagtcaaaaggactgtcccaaaagaggaaatgtcgtcgaaagatggacctaagacaaaaaagatctttgtgggtggtatcccatcatctcttaccgaagataaattaaaggagcacttctcatcatatgggaaggtggttgagcatcagattatgcttgaccatagcactggacgctcgcgtggctttggatttgtcacatttgaaagtgaggatgctgttgaaagggttatgtcagaggggagaatgcatgatcttggagggaaacaggttgaaattaagaaagctgaaccaaagaaacctggcgggggtgattcaagctcaaacggaagacacagtcgtggtggtggtcaccgtgattcataccgtggtagtggtggtggcagtggtgtttctgggaacagcagtggtggtggctatggatacggtggtggctaccgatcaactgctgcagcatactatggcagcacagcatatggtgcatacggcagagggtatggatatggcggtactgctgctggctatggctcaggttatggctctgcatatggtggctccatgtatggaggtccttatggtgcctacggggcatatggtggtgcctatggaggtggtgcatatggtgctccaggaggttatggtgcgggaggatatgacagctatggtggggctggaggcatgggtggtggtggcagcgccggtggtcggggctccagcagataccacccttatggaaaatga

SEQ ID NO: 6356 - protein, 414 aa, Sorghum bicolor
  misc_feature: Ceres ANNOT ID no. 6065390
  misc_feature (101)..(170): Pfam Id: RRM_1 Pfam Desc: RNA recognition motif. (a.k.a. RRM, RBD, or RNP domain)
  misc_feature (190)..(261): Pfam Id: RRM_1 Pfam Desc: RNA recognition motif. (a.k.a. RRM, RBD, or RNP domain)
  misc_feature (124)..(414): NCBI GI: 115468588 NCBI Desc: os06g0566100 [oryza sativa (japonica cultivar-group)]
  misc_feature (95)..(405): NCBI GI: 42409159 NCBI Desc: rna recognition motif (rrm)-containing protein-like [oryza sativa (japonica cultivar-group)]
  misc_feature (70)..(414): NCBI GI: 15220810 NCBI Desc: rna recognition motif (rrm)-containing protein [arabidopsis thaliana]
  misc_feature (100)..(414): NCBI GI: 8778468 NCBI Desc: f1l3.34 [arabidopsis thaliana]
  misc_feature (100)..(405): NCBI GI: 28374304 NCBI Desc: hnrpa1-prov protein [xenopus laevis]
  misc_feature: Up-regulated in root tissues in response to methyl jasmonate treatment
  misc_feature: Up-regulated in shoot tissues in response to methyl jasmonate treatment
  misc_feature: The sequence is a functional homolog of SEQ ID NO. 339 in the 11/188,298 US application
  misc_feature: The sequence is a functional homolog of SEQ ID NO. 458 in the 11/188,298 US application
MAGYGEENQNAMNGYEEEEEEEEVEEVEEVYEEEEEEGDGDGEGEGEADEGAAAAEAAAMAAETRSVVGDRGLAEAAGNVDAGGEDGRDADSGGGDSSGKIFVGGVAWETTEETFTKHFQKYGAITDSVIMKDKHTRMPRGFGFVTFSDPSVLDRVLEDAHVIDGRTVEVKRTVPKEEMSSKDGPKTKKIFVGGIPSSLTEDKLKEHFSSYGKVVEHQIMLDHSTGRSRGFGFVTFESEDAVERVMSEGRMHDLGGKQVEIKKAEPKKPGGGDSSSNGRHSRGGGHRDSYRGSGGGSGVSGNSSGGGYGYGGGYRSTAAAYYGSTAYGAYGRGYGYGGTAAGYGSGYGSAYGGSMYGGPYGAYGAYGGAYGGGAYGAPGGYGAGGYDSYGGAGGMGGGGSAGGRGSSRYHPYGK

SEQ ID NO: 6357 - DNA, 3654 bp, Sorghum bicolor
  misc_feature: Ceres ANNOT ID no. 6065391
  misc_feature: Encodes the peptide sequence at SEQ ID NO 6358
atgggccgttccggccgccggcggcgggaccgcatgcggtggagcaatctctacaccttctcctgcttccgcgcccagcagcacgggcacgccgccggcgacgcgggcccttcctccgacggggctggcgccgtcggcgggccgggcttctcgcgcgtcgtctactgcaacaacgccgccctgcagaagccgctcaagtacgtcaccaactacatcaccaccaccaagtacaacatcatcaccttcttccccaaggccatcttcgagcagttccggcgcgtcgccaacctctacttcctcctcaccgccatcctctcgctcaccccggtgtgccccttctcggccgtcagcatgattgctcccctggcctttgtcgtcggcctcagcatgatgaaggaggggctggaggactggcgccgcttcatccaggacatgaaggtgaacaaccgcaaggtcagcgtgcacaagggtgatggcgagttcgactacaggcactgggaggacctatgcgtcggcgatgtcgtcagggttgagaaggacgagttcttccctgctgatttaatgctactgtcctcaagctatgaggatggcatttgctatgttgagacaatgaacctcgatggcgagaccaaccttaaggtgaagaggtcacttgaggttacgctgccgctggaagaagacgagtcatttaaggatttccaggcagtgatacgctgcgaggatcccaacccgagcttgtacacgttcactggtaactttgagtatgagaggcaggtgtacgcccttgatccgtttcagatacttctgagggactcaaaactaaggaatacagcctttatctatggagtggttatctttactggccatgacagtaaggtcatgcagaactcaactgagtcgccatccaagaggagcaggattgagaagaagatggatttaatcatatacatcctgtttactgtgcttgtgttgatatcgatcattagttcagtgggattcgctgtgaggatcaagttcgatttgcccaactggtggtacttgcagccacagaaaagcaataaattagatgatccatcacgcccagctctttctgggatattccatctcatcacggccctcattctttacgggtatctgattccaatctcgctgtatgtctcgattgaacttgtgaaggtattgcaagcacatttcattaaccaggacatccatatgtttgatgaggagactggcaatactgctcaggcacgtacatcaaacttgaatgaggaacttggccaggttcatacaatcttgtcggataaaactggtactctgacctgcaatcagatggatttcctgaagtgttcaattgctggagtatcatatggcgtgggttcaagtgaagttgaacttgctgctgcaaagcagatggcctcaggtgctgatgatcatgatatccctttacaagatatatgggaggagaacaatgaggatgaaatcgagttggtagaaggagtcacctttagtgttgggaacaaccgaaagccctccataaaaggcttcagttttgtggatgaccgcctcatggaagggaactggaacaaggagccaaattcttccacaattctactcttcttcaggatacttgctctgtgtcacacagcaataccggagataaatgaagcaactggctctattgcctatgaagcagaatcacctgatgagggggcttttcttgtggcagccagggaatttggattcgaatttttcaagcgaacacaatcaagtgtctttgtcagggagaaacacacttcttcgaaaggcacaattgagagggagttcaagattctcaatctgttggagttcaatagcaaaagaaaacgaatgactgtaattctgcaggatgaagatggtcaaattcttcttttttgcaaaggtgcagacagcatcatatttgatagactagcaaaaaatggaaggatgtatgaagttgatacaactaggcatctgaatgattatggtgaggcaggcttgcgaacattggcactatcgtacagggtgcttgatgaatcagaatattcttcttggaatgctgagtttcttaaagcaaagacctctattgggcctgatagagagttgcaacttgaacgtgtctctgagttgattgaaagagagctgatccttgttggtgcaactgctgtagaggacaaattacaaaaaggggttcctcagtgcatagatcgtttggcgcaagcaggtctcaaaatctgggttctgacaggtgataaaatggaaactgcaattaacattggtttactgaggcaaggcatgaaacaaatatgtttgtccatacccactggtgatcaggtagcccaggatgcaaagaaggttgcaaaggagagtctcctgtcgcaaatcgccaatgggtcacaaatggtcaaactcgagaaggatccagatgcagcatttgctctagttattgatggaaaagctctggcatttgctttggaggatgacatgaagcatatgttcttgaacctggcaatcgagtgtgcttctgtcatatgttgccgtgtgtccccaaagcagaaagcactggtgactcggctcgtcaaagaaggtataggacaaaccactttagcagtaggtgatggtgcaaatgatgtgggcatgattcaagaagctgatattggagttggtataagtggggtagaaggcatgcaggcagtgatggctagtgatttctccatttctcaatttcggtttcttgagcgacttcttgtcgtccatgggcattggtgctacaagagaatcgcccaaatgatttgctacttcttttacaagaatattgcctttgggcttacaatattttactttgaagcattcgctgggttttctgggcaatctgtatacgatgattggtttatgctgcttttcaatgttgttcttacctcgcttcctgttatatcgctcggagtatttgagcaagatgtttcatccgaaatctgcttacagttcccagcattataccagcaagggccaaagaatcttttctttgattggtaccggatccttggatggatggggaatggcctctactcctctctggccatattcttcctcaatctctgcatattctatgatcaggcaatccgtgctggggggcagactgcagacatggctgcagtgggaactgccatgttcacctgcatcatctgggctgtcaacatgcagattgcccttacaatgagccatttcacatggattcaacatctctttgtatggggcagcataacaacttggtatatcttcatcctcgcctacgggatgacattgagatcccgcgacaactaccagatcctgttggaagtccttgggccagctcccatatactgggcagcgacgcttctggtgactgctgcttgcaacatcccctacctgatacacatatcctaccagaggtcgtgcaaaccacttgatcaccatgtgattcaagagatcaagtacctaaagaaagatgtcgaagaccagacaatgtggaagagggagcggtcgaaggccaggcagaagacaaagattggtttcactgcaagggttgatgcaaagatcaagcagatcaaggggaaattgcataagaaaggcccatctttaacaatccatacagtatcttag

SEQ ID NO: 6358 - protein, 1217 aa, Sorghum bicolor
  misc_feature: Ceres ANNOT ID no. 6065391
  misc_feature (6)..(1210): NCBI GI: 92872739 NCBI Desc: atpase, e1-e2 type [medicago truncatula]
  misc_feature (7)..(1212): NCBI GI: 12229656 NCBI Desc: potential phospholipid-transporting atpase 4 (aminophospholipid flippase 4)
  misc_feature (7)..(1212): NCBI GI: 15220134 NCBI Desc: haloacid dehalogenase-like hydrolase family protein [arabidopsis thaliana]
  misc_feature (1)..(1201): NCBI GI: 5734708 NCBI Desc: similar to gbaf067820 atpase ii from homo sapiens and is a member of pf00122 e1-e2 atpases family. [arabidopsis thaliana]
  misc_feature (7)..(1205): NCBI GI: 11994751 NCBI Desc: p-type transporting atpase [arabidopsis thaliana]
MGRSGRRRRDRMRWSNLYTFSCFRAQQHGHAAGDAGPSSDGAGAVGGPGFSRVVYCNNAALQKPLKYVTNYITTTKYNIITFFPKAIFEQFRRVANLYFLLTAILSLTPVCPFSAVSMIAPLAFVVGLSMMKEGLEDWRRFIQDMKVNNRKVSVHKGDGEFDYRHWEDLCVGDVVRVEKDEFFPADLMLLSSSYEDGICYVETMNLDGETNLKVKRSLEVTLPLEEDESFKDFQAVIRCEDPNPSLYTFTGNFEYERQVYALDPFQILLRDSKLRNTAFIYGVVIFTGHDSKVMQNSTESPSKRSRIEKKMDLIIYILFTVLVLISIISSVGFAVRIKFDLPNWWYLQPQKSNKLDDPSRPALSGIFHLITALILYGYLIPISLYVSIELVKVLQAHFINQDIHMFDEETGNTAQARTSNLNEELGQVHTILSDKTGTLTCNQMDFLKCSIAGVSYGVGSSEVELAAAKQMASGADDHDIPLQDIWEENNEDEIELVEGVTFSVGNNRKPSIKGFSFVDDRLMEGNWNKEPNSSTILLFFRILALCHTAIPEINEATGSIAYEAESPDEGAFLVAAREFGFEFFKRTQSSVFVREKHTSSKGTIEREFKILNLLEFNSKRKRMTVILQDEDGQILLFCKGADSIIFDRLAKNGRMYEVDTTRHLNDYGEAGLRTLALSYRVLDESEYSSWNAEFLKAKTSIGPDRELQLERVSELIERELILVGATAVEDKLQKGVPQCIDRLAQAGLKIWVLTGDKMETAINIGLLRQGMKQICLSIPTGDQVAQDAKKVAKESLLSQIANGSQMVKLEKDPDAAFALVIDGKALAFALEDDMKHMFLNLAIECASVICCRVSPKQKALVTRLVKEGIGQTTLAVGDGANDVGMIQEADIGVGISGVEGMQAVMASDFSISQFRFLERLLVVHGHWCYKRIAQMICYFFYKNIAFGLTIFYFEAFAGFSGQSVYDDWFMLLFNVVLTSLPVISLGVFEQDVSSEICLQFPALYQQGPKNLFFDWYRILGWMGNGLYSSLAIFFLNLCIFYDQAIRAGGQTADMAAVGTAMFTCIIWAVNMQIALTMSHFTWIQHLFVWGSITTWYIFILAYGMTLRSRDNYQILLEVLGPAPIYWAATLLVTAACNIPYLIHISYQRSCKPLDHHVIQEIKYLKKDVEDQTMWKRERSKARQKTKIGFTARVDAKIKQIKGKLHKKGPSLTIHTVS

SEQ ID NO: 6359 - DNA, 1047 bp, Sorghum bicolor
  misc_feature: Ceres ANNOT ID no. 6065424
  misc_feature: Encodes the peptide sequence at SEQ ID NO 6360
atgggcgactctggcggctccgttgtgtcggtggacgtcgagcgcatctccttcggcggcaaggaacatcatatacaaaccaaccatggatctgtatctgttgccatacacggtgaccatgataagcctgctcttattacttacccagatattgctttgaaccatatgtcttgcttccaaggactactcttctgtcctgaagcagcttcattgctgcttcataatttttgcatttaccatatcagccccccaggacatgagttgggagctgctccgattttgtcgagcacacctgtggcatctgttgatgacttagcagatcaaatcgcagatgtacttgatttctttggactggattcagttatgtgcttaggtgtcactgcgggcgcatacattcttactctctttgcaacaaagtatagagagcgagtactaggacttattctcgtttcacctctatgtaaagctccctcatggtctgagtggttttataataaggtaatgtcaaatttactatattattatggcatgtgcaatgtcgtgaaggatattttgttgcagcgctactttggaaagggagtacgtggaggctcaactgaacccgaatcagatattgtgcaggcttgtagaagctttctagatcaacggcagtgcatgaatgtgtggagatttatccaaactatcaatgagagaaaagacttgacagagaacctgaagcaactacaatgcagaacactaatttttgttggtgagaattcccagttccatgctgaagctgttcacatgactgcaaagcttgataggcgatatagcgctcttgtggaggtacaagcttgtggttcggttgtgacagaggagcaacctcatgcaatgctgataccgatggagtacttcctcatgggatatggactgtacaggccaagccagataaactgtagccctcgcagccctctgaatccgttttgcatatcaccggagctcctctctcctgagagcatgggggttaaactaaagccaatcaagacacgagccaacctcaaagcatag

SEQ ID NO: 6360 - protein, 348 aa, Sorghum bicolor
  misc_feature: Ceres ANNOT ID no. 6065424
  misc_feature (22)..(306): Pfam Id: Ndr Pfam Desc: Ndr family
  misc_feature (76)..(297): Pfam Id: Abhydrolase_1 Pfam Desc: alpha/beta hydrolase fold
  misc_feature (1)..(343): NCBI GI: 21593137 NCBI Desc: pollen specific protein sf21 [arabidopsis thaliana]
  misc_feature (1)..(346): NCBI GI: 13605684 NCBI Desc: at5g11790/t22p22_180 [arabidopsis thaliana]
  misc_feature (1)..(343): NCBI GI: 82494244 NCBI Desc: sf21c1 [helianthus annuus]
  misc_feature (22)..(347): NCBI GI: 145329178 NCBI Desc: ndr family protein [arabidopsis thaliana]
  misc_feature (1)..(343): NCBI GI: 145308278 NCBI Desc: sf21c6 [helianthus annuus]
MGDSGGSVVSVDVERISFGGKEHHIQTNHGSVSVAIHGDHDKPALITYPDIALNHMSCFQGLLFCPEAASLLLHNFCIYHISPPGHELGAAPILSSTPVASVDDLADQIADVLDFFGLDSVMCLGVTAGAYILTLFATKYRERVLGLILVSPLCKAPSWSEWFYNKVMSNLLYYYGMCNVVKDILLQRYFGKGVRGGSTEPESDIVQACRSFLDQRQCMNVWRFIQTINERKDLTENLKQLQCRTLIFVGENSQFHAEAVHMTAKLDRRYSALVEVQACGSVVTEEQPHAMLIPMEYFLMGYGLYRPSQINCSPRSPLNPFCISPELLSPESMGVKLKPIKTRANLKA

SEQ ID NO: 6361 - DNA, 1578 bp, Sorghum bicolor
  misc_feature: Ceres ANNOT ID no. 6065430
  misc_feature: Encodes the peptide sequence at SEQ ID NO 6362
atggcgctcgccttcgacgagttcgggcgccccttcatcatactcagggagcaggagaagaagacgcgcctgcgcgggctcgacgcgcagaaggccaacatcgccgccggcaaggccgtggcgcggatcctccgcacctcgctcggacccaagggcatggacaagatgctccagtcccccgacggagacgtcaccatcacaaatgatggggccacgattctggagcagatggatgttgacaaccagattgcaaagctgatggtggagctgtcccgcagtcaagactatgagatcggggatggtaccactggggtggtggtcatggcaggggcacttctagagcaggctgagaaacttctggagcgttatgagatggcttcaagggtagcttttgatcaccttgagcgcatctcccaaaagtttgaattcaatgcagacaatatagagccactggttcagacctgcatgacgactctgtcgtcaaagattgttcaccgttgcaagcgggcactcgcagagattgctgtcaaagcagtccttgcggttgctgatttgggcaggaaggatgttaacttggatttaatcaaagtagaaggcaaggtcggtgggaagctggaggacacagaactaatatatggaattgtcgttgacaaagatatgagccaccctcaaatgccaaagagaattgaggatgctaagatagccatcctgacctgcccatttgagcccccgaaacctaagacaaagcataaggttgacattgatactgtagagaaattccagactctgcgtgagcaagagcagaagtactttgatgaaatggttcagaaatgcaaggatgttggtgcaaccctggttatttgtcaatggggttttgatgatgaagccaatcatctattgatgcatagaaatctgccagctgtcagatgggttggtggtgttgaattggaattgattgccatcgctacaggaggacggattgttccaagatttcaagagctgagtccagaaaagcttgggaaggctggattagtcagagagaagtcatttggaacaaccaaggaccggatgctttacattgagcagtgtgccaactccagagctgtaactattttcattcgtggtggaaataaaatgatgattgaggagaccaagcgcagtcttcatgatgctctttgtgtggcaaggaatctaatccgcaataactcaattgtgtatggtggtggctcggcagagatatcttgctcaattgctgttgaaactgcagcagatcggcaccctggagttgagcagtatgctatcaggtcatttgctgatgcattggacgctgttccactggccttagctgagaacagtggtttgcctcctattgataccttaactgtggtgaaagctcaacaagtgaaggatagcaacccccattgtggcatagattgcaatgacgttggcaccaatgacatgaaagagcagaacgtctttgagaccctgattggcaagcagcaacagatcttacttgccacgcaggtggtgaagatgatcctcaagattgacgacgtgatctcgccatctgagtactga

SEQ ID NO: 6362 - protein, 525 aa, Sorghum bicolor
  misc_feature: Ceres ANNOT ID no. 6065430
  misc_feature (40)..(524): Pfam Id: Cpn60_TCP1 Pfam Desc: TCP-1/cpn60 chaperonin family
  misc_feature (1)..(525): NCBI GI: 1587206 NCBI Desc: t complex protein
  misc_feature (1)..(525): NCBI GI: 435175 NCBI Desc: t complex polypeptide 1 [avena sativa]
  misc_feature (1)..(525): NCBI GI: 435173 NCBI Desc: t complex polypeptide 1 [avena sativa]
  misc_feature (1)..(525): NCBI GI: 140054120 NCBI Desc: groel-like chaperone, atpase [medicago truncatula]
  misc_feature (3)..(524): NCBI GI: 27924333 NCBI Desc: cct5-prov protein [xenopus laevis]
MALAFDEFGRPFIILREQEKKTRLRGLDAQKANIAAGKAVARILRTSLGPKGMDKMLQSPDGDVTITNDGATILEQMDVDNQIAKLMVELSRSQDYEIGDGTTGVVVMAGALLEQAEKLLERYEMASRVAFDHLERISQKFEFNADNIEPLVQTCMTTLSSKIVHRCKRALAEIAVKAVLAVADLGRKDVNLDLIKVEGKVGGKLEDTELIYGIVVDKDMSHPQMPKRIEDAKIAILTCPFEPPKPKTKHKVDIDTVEKFQTLREQEQKYFDEMVQKCKDVGATLVICQWGFDDEANHLLMHRNLPAVRWVGGVELELIAIATGGRIVPRFQELSPEKLGKAGLVREKSFGTTKDRMLYIEQCANSRAVTIFIRGGNKMMIEETKRSLHDALCVARNLIRNNSIVYGGGSAEISCSIAVETAADRHPGVEQYAIRSFADALDAVPLALAENSGLPPIDTLTVVKAQQVKDSNPHCGIDCNDVGTNDMKEQNVFETLIGKQQQILLATQVVKMILKIDDVISPSEY

SEQ ID NO: 6363 - DNA, 4470 bp, Sorghum bicolor
  misc_feature: Ceres ANNOT ID no. 6065437
  misc_feature: Encodes the peptide sequence at SEQ ID NO 6364
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
atggccgacaacggcgatccggccatggcccttcttggctggtcgtcatcttggatctgcgggggagaggacgacgacggcgggcggctcaccgtcgcgtccccgtgcgtgcagaggaccctcatagactgcgtcaatgtggtcctgctcgtcgcctacgtctccacgctggcggtggcggctgcctgcgtcaggcggaggcagcgcgctgcaactgcaacagcggcaagccggaggagcggtgctcctgggtctgggtgggttctgctcgtcgtctcctcgtgctgcgtggcggctgccgtggcgtacggtgtcaccggtctccaggacgcctccgacgtcagggcggcggttccttacttcgtcagggccctggtctggatcgcgctggcggcgtcgctgcacgtccggccgacgaggccggcgagggccgtggccgtgctctggtgggtgctcttctcgctgctggtcaccgcgtacaatgtggagatccttgccgggggccacggcctcgacctcgccgagacgatctcgtggccggtgagcctcctcctcctgctctgcgccctcggctccctgctgcggcggggccacggggacgcctccaacgacagcggcggcttgtcagagcctctgatcggcggcaaagacgacagagccgccgtgccaacctcggagctgtaccgtgctggcctgttcggccagctcgccttctcgtggctgaaccctctgctccgtgtcggccgctccaaggcgctggacctcggcgacatcccgctcatcgccgacgaggacaccgcgcaccacacgtcgcagaagttcgccgaggactggagccgccacgtgggtgacaaggccaggagccgccggagagtagtaggcagcaacagcctcgccctcgtcctgctcaagtgcttcctcggcgagatcctgctcaccggcttctacgccttgctgagaacgctgtccatagcggttgctccattgctgctcttcgcgttcgtgtggtacagcaaccaggaggagcgagacctccgggtcggcctggtccttgtcggctgcctgctgatcaccaagctcatcgagtcgctctcgcagcggcattggttctttacctcgaggaggaccgggatgcgtatccggtcagcgctgatggcggtcatcttccagaagcagctcaggctgtccagtcaagggaggaagaaccactccactggcgagatcgtcaactacattgcggtcgatgcgtaccggctgggcgacgccatcagctggctgcacatggggtggagctcgccacttcagctggtcttctcagtcgccacgctcttctgggcactcaagcttggggctcttccaggtctggtcccccttgtcatctttggcttcctcaacgtgccattcgcgaaaatgctgcaggggtaccaggccaagttcatggttgcccaggacgagaggctccggtccacgtcggagatacttaacagcatgaagatcatcaagctgcagtcatgggaagacaagtttcgccaaatgatcgagtcactcagggacggggagttcaaatggctcaaggagactcagatgaagaaggcctacggtgcagtcatgtactggatgtccccgacggtcgtctctgctgtgatgtacacagcgacggccatcatggggagtgctcccctgaatgctagcacactcttcaccgtcttggccaccctgagggtaatggctgagccagtgaggtttcttccagagatcctaacaatgatgatccagtacaaggtgtcattagatcgaatagagaagtttcttctcgaagacgagatcagagaggaggatgtgaaaagagtgccttcagataactctgatgtcagagttcaagtccaagatggaaatttcagctggaaggcaaccggagctgatttgtcactgaggaatgttaaccttcgcataaatagaggagagaaggtggccgtatgcggcccagttggctcagggaaatcttcgctcctgtatgcattacttggggagataccaagaatatcaggatcggttgcggtgtttggttcagtggcatatgtttcacagagctcgtggatacagagtgggactgttcgtgaacatatactctttgggaagcctttccacaaggaactgtatgataaggcaatcaaatcttgtgctctggacaaggatatcgaaaattttgatcatggagacctcacagagattggtcagagaggactgaacatgagtggtggtcagaagcaaaggattcagctggctcgagccgtctacaatgacgcagatgtttatctactggatgacccattcagtgcagttgatgcgcacaccgctgctgttcttttttatgaatgtgtaatgacagcacttgcagagaagaccgttgttcttgtgacccaccaggttgaatttctgaccgaaaccaatagaattctggtaatggaaggtggtcaagttagtcaacaagggaaatattcagaacttctaggatctgggacagcatttgagaagctggtttctgctcatgaggcttcgatcacagcattggatactagtgccagccaacagaaccaagatcaagggcaacaagcgtttgatgaatacatagtgccaagtgcactgcaggttataaggcaggccagcgacattgaagtcaccgcaaagggaccttcagcagcaatacagcttacagaggaggaagagaagggcattggcgacctgggatggaagccatacaaagactacataaatgtacccaaggcggctttccaattctctggcatgtgtacttctcaggtgctcttcacgtgcttccagatcgcatccacatattggttggcggtggctgttcagatggatagtgtcagtgctgcacttcttgttggggcatattctggactctctatcttcagctgctgcttcgcctactttagaagcctttttgcggctaatctgggtctcaaggcctccaaagcattctttggcgggctaatggattccgtattcaaggctcccatgtcattttttgactcaacaccagtaggaagaattttaacaagggcatcttcagatttaagcattctagacttcgacataccttactccatggcttttgtggcgacgggcgctattgaggttgttaccacagtcctggtcatgggtactgtaacttggcaagtcttggttgtagctatccctgttgcgatcaccatgatatatgttcagaggtactacgtttcctcagctagggagctagtaagaatcaatggaacgacaaaggcacctgtaatgaactatgcatcagaatcaattcttggtgtggtgacgatcagggcatttgcagcaactgagaggtttatccacagcaacatgcagctcatcgacactgatgcgacactgttcttccatactgttgcagcacaagagtgggtgctcataagagtagaggcactgcagtccttgacaataattacagcagcattgttccttgttctggttcctccaggagcaatttcaccaggactttgtctctcctatgctttgacgttgactgcagcacaagttttcttgacaaggttctattcctacttggaaaactacatcatctctgttgaacgaatcaaacagtatatgcacctcccagtggagccaccagccattataccagaaaatagacctccaacttcatggccacaggagggaaggatagacctgcaagatttaaagataagataccgtccaaacgcaccgctcgtcctcaaaggaatcacttgcaccttttctgctgggaacaagattggggttgtagggaggacaggaagtgggaaatcaacacttatcagctcattgttccgtctcgttgatccggcgggtgggaagatacttattgacaagttggatatttgctccattggccttaaggatctaaggactaaactaagtattatccctcaagaacctacacttttcaggggaaccgtgcgcaccaatttagatcccctcggcctgcattctgatcaagagatatgggaggccttggagaagtgtcaactaaagacagcaatcagcagcacctctgctcttcttgatacagttgtgagtgatgatggcgataactggagtgctggacagcgtcagctcttctgtcttggcagagttctcctccgcaggaacaaaattctagttctagatgaggcgacagcatccatcgactctgcaacggatgcaatcctgcagaaagtaatcaggcaacagttctcaagttgcacggttataaccatagctcacagggtaccaactgtgacagacagcgacagggtcatggtcctgtcctacgggaagctcctagaatatgaaacgccagccaagctgttggaagacaaacaatcagcatttgctaaacttgtggctgagtattgggcaaataccaagcgaaattcaacatga

SEQ ID NO: 6364 - protein, 1489 aa, Sorghum bicolor
  misc_feature: Ceres ANNOT ID no. 6065437
  misc_feature (654)..(825): Pfam Id: ABC_tran Pfam Desc: ABC transporter
  misc_feature (1271)..(1454): Pfam Id: ABC_tran Pfam Desc: ABC transporter
  misc_feature (310)..(580): Pfam Id: ABC_membrane Pfam Desc: ABC transporter transmembrane region
  misc_feature (921)..(1197): Pfam Id: ABC_membrane Pfam Desc: ABC transporter transmembrane region
  misc_feature (11)..(1489): NCBI GI: 37694080 NCBI Desc: multidrug resistance associated protein 1 [zea mays]
  misc_feature (34)..(1488): NCBI GI: 140038713 NCBI Desc: abc transporter, transmembrane region, type 1 [medicago truncatula]
  misc_feature (181)..(1489): NCBI GI: 9280227 NCBI Desc: multidrug resistance-associated protein (mrp)-like; abc-transporter-like protein [arabidopsis thaliana]
  misc_feature (181)..(1489): NCBI GI: 30686160 NCBI Desc: abc transporter family protein [arabidopsis thaliana]
  misc_feature (181)..(1489): NCBI GI: 22553016 NCBI Desc: multidrug-resistance related protein [arabidopsis thaliana]
  misc_feature (181)..(1489): SWISSPROT Homolog: EC 3.6.3.44 Multidrug resistance-associated protein 6 precursor
  misc_feature: Up-regulated in root tissues in response to methyl jasmonate treatment
  misc_feature: Up-regulated in shoot tissues in response to salicylic acid treatment
  misc_feature: Up-regulated in root tissues in response to salicylic acid treatment
MADNGDPAMALLGWSSSWICGGEDDDGGRLTVASPCVQRTLIDCVNVVLLVAYVSTLAVAAACVRRRQRAATATAASRRSGAPGSGWVLLVVSSCCVAAAVAYGVTGLQDASDVRAAVPYFVRALVWIALAASLHVRPTRPARAVAVLWWVLFSLLVTAYNVEILAGGHGLDLAETISWPVSLLLLLCALGSLLRRGHGDASNDSGGLSEPLIGGKDDRAAVPTSELYRAGLFGQLAFSWLNPLLRVGRSKALDLGDIPLIADEDTAHHTSQKFAEDWSRHVGDKARSRRRVVGSNSLALVLLKCFLGEILLTGFYALLRTLSIAVAPLLLFAFVWYSNQEERDLRVGLVLVGCLLITKLIESLSQRHWFFTSRRTGMRIRSALMAVIFQKQLRLSSQGRKNHSTGEIVNYIAVDAYRLGDAISWLHMGWSSPLQLVFSVATLFWALKLGALPGLVPLVIFGFLNVPFAKMLQGYQAKFMVAQDERLRSTSEILNSMKIIKLQSWEDKFRQMIESLRDGEFKWLKETQMKKAYGAVMYWMSPTVVSAVMYTATAIMGSAPLNASTLFTVLATLRVMAEPVRFLPEILTMMIQYKVSLDRIEKFLLEDEIREEDVKRVPSDNSDVRVQVQDGNFSWKATGADLSLRNVNLRINRGEKVAVCGPVGSGKSSLLYALLGEIPRISGSVAVFGSVAYVSQSSWIQSGTVREHILFGKPFHKELYDKAIKSCALDKDIENFDHGDLTEIGQRGLNMSGGQKQRIQLARAVYNDADVYLLDDPFSAVDAHTAAVLFYECVMTALAEKTVVLVTHQVEFLTETNRILVMEGGQVSQQGKYSELLGSGTAFEKLVSAHEASITALDTSASQQNQDQGQQAFDEYIVPSALQVIRQASDIEVTAKGPSAAIQLTEEEEKGIGDLGWKPYKDYINVPKAAFQFSGMCTSQVLFTCFQIASTYWLAVAVQMDSVSAALLVGAYSGLSIFSCCFAYFRSLFAANLGLKASKAFFGGLMDSVFKAPMSFFDSTPVGRILTRASSDLSILDFDIPYSMAFVATGAIEVVTTVLVMGTVTWQVLVVAIPVAITMIYVQRYYVSSARELVRINGTTKAPVMNYASESILGVVTIRAFAATERFIHSNMQLIDTDATLFFHTVAAQEWVLIRVEALQSLTIITAALFLVLVPPGAISPGLCLSYALTLTAAQVFLTRFYSYLENYIISVERIKQYMHLPVEPPAIIPENRPPTSWPQEGRIDLQDLKIRYRPNAPLVLKGITCTFSAGNKIGVVGRTGSGKSTLISSLFRLVDPAGGKILIDKLDICSIGLKDLRTKLSIIPQEPTLFRGTVRTNLDPLGLHSDQEIWEALEKCQLKTAISSTSALLDTVVSDDGDNWSAGQRQLFCLGRVLLRRNKILVLDEATASIDSATDAILQKVIRQQFSSCTVITIAHRVPTVTDSDRVMVLSYGKLLEYETPAKLLEDKQSAFAKLVAEYWANTKRNST

SEQ ID NO: 6365 - DNA, 807 bp, Sorghum bicolor
  misc_feature: Ceres ANNOT ID no. 6065477
  misc_feature: Encodes the peptide sequence at SEQ ID NO 6366
atgccccggctcctcgtcgtcctcctcctcctcgccctctcgctcgtcgcgtgcgtgagcgccgtgcccgctgtcatccgcatggtcccggccgaccccaccgcggcctcctctggcgcggtagacgacgcggacgcgctcttctgcgacagctggaggctgtctgtggagacggccaacgcggggccctggctcgccgtgcccgcgcgctgcggggatttcgtgcgggactacatggaggggcctcgctacgcctctgactccgccatcgccgccgccgacgccctagccttcgcctctgatgccctggccgccgccgccgagtggggcggctcggcgagcgcgaggccggcgtgggtgttcgacgtcgacgagacgctgctctccaacgcgccctactacgcggtcaacggatggggattacaggaattcaatgagacctcatttgatgaatgggtagatgctgcaaaggcaccagcattaccatcaagcttgaatttgtacaatcaacttcagggacttggtttccatgttatccttttgactggccggagtgaattccaacgtaatgccacagagtcgaatcttttgttttctggctacaactcatgggaaaaactcatattgaggcaatcttctgatattggcaagactgctgtacagtacaagtcagagagaagagcagcaatggaagcagaaggtttcaagatacttgggaactcaggggatcagtggagtgatttgataggatcaccaatggcaacgagatccttcaagctaccaaacccaatgtacttcatcagctga

SEQ ID NO: 6366 - protein, 268 aa, Sorghum bicolor
  misc_feature: Ceres ANNOT ID no. 6065477
  misc_feature (35)..(268): Pfam Id: Acid_phosphat_B Pfam Desc: HAD superfamily, subfamily IIIB (Acid phosphatase)
  misc_feature (48)..(267): NCBI GI: 92877929 NCBI Desc: plant acid phosphatase [medicago truncatula]
  misc_feature (43)..(267): NCBI GI: 119638446 NCBI Desc: acid phosphatase [brachypodium sylvaticum]
  misc_feature (45)..(267): NCBI GI: 28375516 NCBI Desc: acid phosphatase [lycopersicon esculentum]
  misc_feature (45)..(267): NCBI GI: 445113 NCBI Desc: acid phosphatase 1
  misc_feature (46)..(268): NCBI GI: 21536678 NCBI Desc: acid phosphatase-like protein [arabidopsis thaliana]
  misc_feature (45)..(267): SWISSPROT Homolog: EC 3.1.3.2 Acid phosphatase 1 precursor
MPRLLVVLLLLALSLVACVSAVPAVIRMVPADPTAASSGAVDDADALFCDSWRLSVETANAGPWLAVPARCGDFVRDYMEGPRYASDSAIAAADALAFASDALAAAAEWGGSASARPAWVFDVDETLLSNAPYYAVNGWGLQEFNETSFDEWVDAAKAPALPSSLNLYNQLQGLGFHVILLTGRSEFQRNATESNLLFSGYNSWEKLILRQSSDIGKTAVQYKSERRAAMEAEGFKILGNSGDQWSDLIGSPMATRSFKLPNPMYFIS

SEQ ID NO: 6367 - DNA, 1425 bp, Sorghum bicolor
  misc_feature: Ceres ANNOT ID no. 6065550
  misc_feature: Encodes the peptide sequence at SEQ ID NO 6368
atggtgggaaggatgcgcggcggagccatggatttcgaggaccgcctagcgaccctcccccgcgtccgcggcgaccgcgacgacgacggcaacgagacgaggacagggactgtatggacggcaacggcgcacatcatcacggcggtgatcggctccggcgtgctgtcgctggcgtgggcgatggcgcagctgggatgggtgaccggggctgtcaccctggtgctcttcgcggcgatcaccttgtacacctgcggcctcctcgccgactgctaccgcgtgggcgaccccgtaacgggcaagcgcaactacacctacaccgaggccgtcaagagcaacctgggcggctggtacggttgcttctgcggcttctgccagtacgcgaacatgttcggcacctgcatcggctacaccatcacagcctccatcagtgctgcggccatcaacaagtccaactgcttccactggcacggccacgacgccgactgcagccagaacacgagcgcctacatcatcggcttcggcgtggtgcaggtcctcttcagccagctccacaacttccacaagctctggtggctctccatcgtcgccgccctcatgtccttctcctactccaccatcgccgtcggcctctccctggcgcagatcgtcacgggcccgacagggaagacgaccatgacgggcacccaggtcggggtggacgtcgactcggcgcagaaagtgtggatgacgttccaggccctgggcaacgtcgccttcgcctactcgtacgccatcgtgctcatcgagatccaggacacgctgcgctccccgcccgccgagaacgagaccatgcgccgggccaccgtgatgggcatctccaccaccaccgggttctacatgctgtgcggctgcctcggctacgccgccttcggcaacgccgcgccggggaacatcctcaccgggttcggattctacgagcccttctggctcgtcgacttcgccaacgcctgcatcgtcgtgcacctcgtcggcagcttccagctcttctgccaggccatctacgccgccgtcgaggaagccgtggcggcgcggtacccggggtccaccacgcgcgagcacggcgccgcgggcctcaacctcagcgtcttccgcctcgtgtggcgcacggcgttcgtggccgtcatcacgctgctggccatcctgatgcccttcttcaacagcatcctgggcatcctcggcagcatcgccttctggccgctcaccgtcttcttccccgtcgagatgtacatccggcagcgacaggtgccgaggttcagcaccaagtggacagcgctgcagagcctcagcttcgtctgcttcctcgtcaccgtcgcctcctgcgcggcctccgtgcaaggcgtgctcgactcgctcaagacctatgtgccattcaagacgaggtcgtga

SEQ ID NO: 6368 - protein, 474 aa, Sorghum bicolor
  misc_feature: Ceres ANNOT ID no. 6065550
  misc_feature (34)..(462): Pfam Id: Aa_trans Pfam Desc: Transmembrane amino acid transporter protein
  misc_feature (27)..(472): NCBI GI: 18181930 NCBI Desc: amino acid permease i [arabidopsis thaliana]
  misc_feature (27)..(472): NCBI GI: 2654019 NCBI Desc: neutral amino acid transport system ii [arabidopsis thaliana]
  misc_feature (27)..(472): NCBI GI: 3293031 NCBI Desc: amino acid carrier [ricinus communis]
  misc_feature (27)..(472): NCBI GI: 31455391 NCBI Desc: amino acid permease 1 [brassica napus]
  misc_feature (27)..(472): NCBI GI: 27447657 NCBI Desc: amino acid transporter [lycopersicon esculentum]
  misc_feature: The sequence is a functional homolog of SEQ ID NO. 313 in the 11/188,298 US application
  misc_feature: The sequence is a functional homolog of SEQ ID NO. 438 in the 11/188,298 US application
MVGRMRGGAMDFEDRLATLPRVRGDRDDDGNETRTGTVWTATAHIITAVIGSGVLSLAWAMAQLGWVTGAVTLVLFAAITLYTCGLLADCYRVGDPVTGKRNYTYTEAVKSNLGGWYGCFCGFCQYANMFGTCIGYTITASISAAAINKSNCFHWHGHDADCSQNTSAYIIGFGVVQVLFSQLHNFHKLWWLSIVAALMSFSYSTIAVGLSLAQIVTGPTGKTTMTGTQVGVDVDSAQKVWMTFQALGNVAFAYSYAIVLIEIQDTLRSPPAENETMRRATVMGISTTTGFYMLCGCLGYAAFGNAAPGNILTGFGFYEPFWLVDFANACIVVHLVGSFQLFCQAIYAAVEEAVAARYPGSTTREHGAAGLNLSVFRLVWRTAFVAVITLLAILMPFFNSILGILGSIAFWPLTVFFPVEMYIRQRQVPRFSTKWTALQSLSFVCFLVTVASCAASVQGVLDSLKTYVPFKTRS

SEQ ID NO: 6369 - DNA, 1425 bp, Sorghum bicolor; identical to SEQ ID NO: 6367
  misc_feature: Ceres ANNOT ID no. 6065554
  misc_feature: Encodes the peptide sequence at SEQ ID NO 6370

SEQ ID NO: 6370 - protein, 474 aa, Sorghum bicolor; identical to SEQ ID NO: 6368
  misc_feature: Ceres ANNOT ID no. 6065554
  misc_feature (34)..(462): Pfam Id: Aa_trans Pfam Desc: Transmembrane amino acid transporter protein
  misc_feature (27)..(472): NCBI GI: 18181930 NCBI Desc: amino acid permease i [arabidopsis thaliana]
  misc_feature (27)..(472): NCBI GI: 2654019 NCBI Desc: neutral amino acid transport system ii [arabidopsis thaliana]
  misc_feature (27)..(472): NCBI GI: 3293031 NCBI Desc: amino acid carrier [ricinus communis]
  misc_feature (27)..(472): NCBI GI: 31455391 NCBI Desc: amino acid permease 1 [brassica napus]
  misc_feature (27)..(472): NCBI GI: 27447657 NCBI Desc: amino acid transporter [lycopersicon esculentum]
  misc_feature: The sequence is a functional homolog of SEQ ID NO. 313 in the 11/188,298 US application
  misc_feature: The sequence is a functional homolog of SEQ ID NO. 438 in the 11/188,298 US application

SEQ ID NO: 6371 - DNA, 1476 bp, Sorghum bicolor
  misc_feature: Ceres ANNOT ID no. 6065560
  misc_feature: Encodes the peptide sequence at SEQ ID NO 6372
atggcgcaggacctggagatggcggcgcgcaacggctccggctccggcgccggcgccgacggagcgcactactaccctcagcagccgcgggacggcggcgccggcggccaggagctcgacgacgacggcaggaagaagcgcaccggaacggtatggacggcgagcgcgcacatcatcacagccgtcatcggctccggtgtgctctccctcgcctggtcaactgcacagctgggctgggtcgtggggccgctcaccctgatgatctttgccctcatcacgtactacacctctagccttctcagtgactgctaccgcagcggcgatcagctcactggcaagaggaactacacctacatggacgctgtcgccgcatacctgggtcgatggcaagtcttgtcctgtggtgttttccagtatgttaacttggttggaactgccgttgggtatacaattacagcgtccatcagtgcagcggccgtgcacaaggctaactgcttccacaaaaagggacacgacgccgattgcagcacctatgacaccatgtacatggttgtatttgggatcgttcagatcttcttctctcagctccctaacttcagtgacctttcgtggctgtccatcgtcgccgccatcatgtcattctcttactcgaccatcgctgtcggcctctcattggcgcggaccatttcaggccgtactggtaaatcaactttgactggcactgagatcggagtcgacgttgattcagcccagaaggtctggctggcgcttcaagctctcggcaacattgcattcgcttattcctactccatgattctcattgaaatccaagacacggtgaagtctcctcccgccgagaacaagacgatgaagaaggcgaccctgatgggcgtgacgaccaccacggcgttctacatgcttgctggctgccttgggtactcggcgttcgggaacgcggcgccagggaacatcctgaccgggttcggcttctacgaaccttactggctgatcgactttgccaacgtctgcatcgtggtgcacctggtgggcgcgtaccaggtcttctcgcagcccatctttgcggccttggagacggccgccgccaagcgctggccgaacgccaagttcgtcacgcgcgagcaccccctcgtggccggcaggttcaacgtcaacatgctcaggctgacgtggaggacggcgttcgtggtggtgagcacggtgctcgccatcgtgatgcccttcttcaacgacatcctgggcttcctcggcgccatcgggttctggccgctcaccgtgtactacccagtggagatgtacatccggcagcggcggatacagaagtacaccaccaggtgggtggcgctgcagctgctcagcttcctgtgcttcctggtgtcgctcgcctcggcggtcgcgtccattgagggagtcaccgaatcgctcaaacactatgttcccttcaagaccaagtcatga

SEQ ID NO: 6372 - protein, 491 aa, Sorghum bicolor
  misc_feature: Ceres ANNOT ID no. 6065560
  misc_feature (47)..(479): Pfam Id: Aa_trans Pfam Desc: Transmembrane amino acid transporter protein
  misc_feature (40)..(489): NCBI GI: 27447657 NCBI Desc: amino acid transporter [lycopersicon esculentum]
  misc_feature (33)..(488): NCBI GI: 8809686 NCBI Desc: amino acid permease 6 [arabidopsis thaliana]
  misc_feature (33)..(488): NCBI GI: 31455393 NCBI Desc: amino acid permease 6 [brassica napus]
  misc_feature (37)..(489): NCBI GI: 31455391 NCBI Desc: amino acid permease 1 [brassica napus]
  misc_feature (37)..(489): NCBI GI: 18181930 NCBI Desc: amino acid permease i [arabidopsis thaliana]
  misc_feature: The sequence is a functional homolog of SEQ ID NO. 313 in the 11/188,298 US application
  misc_feature: The sequence is a functional homolog of SEQ ID NO. 438 in the 11/188,298 US application
MAQDLEMAARNGSGSGAGADGAHYYPQQPRDGGAGGQELDDDGRKKRTGTVWTASAHIITAVIGSGVLSLAWSTAQLGWVVGPLTLMIFALITYYTSSLLSDCYRSGDQLTGKRNYTYMDAVAAYLGRWQVLSCGVFQYVNLVGTAVGYTITASISAAAVHKANCFHKKGHDADCSTYDTMYMVVFGIVQIFFSQLPNFSDLSWLSIVAAIMSFSYSTIAVGLSLARTISGRTGKSTLTGTEIGVDVDSAQKVWLALQALGNIAFAYSYSMILIEIQDTVKSPPAENKTMKKATLMGVTTTTAFYMLAGCLGYSAFGNAAPGNILTGFGFYEPYWLIDFANVCIVVHLVGAYQVFSQPIFAALETAAAKRWPNAKFVTREHPLVAGRFNVNMLRLTWRTAFVVVSTVLAIVMPFFNDILGFLGAIGFWPLTVYYPVEMYIRQRRIQKYTTRWVALQLLSFLCFLVSLASAVASIEGVTESLKHYVPFKTKS

SEQ ID NO: 6373 - DNA, 729 bp, Sorghum bicolor
  misc_feature: Ceres ANNOT ID no. 6065605
  misc_feature: Encodes the peptide sequence at SEQ ID NO 6374
atggccatggcggcgccgttcattgcgatggcgagcaataacatcggcagcgccagcgccaacaacgccacaggcggcggcaacggtgacatcaagcggcgccggacctcgtccgacgccctgcagcgcaccgtctccgacgtctcctacgagctccaccaccaccaccaccaccaccagcacggcgccggcggcgtcaacaagcaggagaagacgaaggcggcggatcaggccgagcagcagctgctgctgcaccccgtgcctgaggtgcaggacgccaagtgcgagtgctgcggcatgtcggaggagtgcacgcccgagtacatccgcggcgtgcgcggcaggttcgcgggccgctgggtctgcggcctgtgcgccgaggccgtgacggaggaggccgagaagatgaacggcggcggcggcgggacgctggaggaggcgctcagggcgcacatgggcgtgtgcaagcgcttcaacggcttcggccggacgcacccggtgctgttccaggccgaggccatgcgggagatcctcaggcgccgggccaagctcggccccaggtccaggtccagcatcaaccctagggaggtcagggaagtcgccgtcggcgccaaggccggcagcggcggcggcggcactactgggatcgctcgcagctccagctgcatgcccttcatcaccgacgacttcaacgaacgggcaacgtcgtcgtccatcaacaaaaactga

SEQ ID NO: 6374 - protein, 242 aa, Sorghum bicolor
  misc_feature: Ceres ANNOT ID no. 6065605
  misc_feature (79)..(238): NCBI GI: 7715593 NCBI Desc: f20b17.20 [arabidopsis thaliana]
  misc_feature (89)..(152): NCBI GI: 144923428 NCBI Desc: 4fe-4s ferredoxin, iron-sulfur binding [medicago truncatula]
  misc_feature (89)..(227): NCBI GI: 4587551 NCBI Desc: f15i1.18 [arabidopsis thaliana]
  misc_feature: The plant is abnormally small.
  misc_feature: Useful for making plants with modulated biomass
  misc_feature: GREAT-hit functional homolog of the protein sequence given in SEQ ID NO 13055
MAMAAPFIAMASNNIGSASANNATGGGNGDIKRRRTSSDALQRTVSDVSYELHHHHHHHQHGAGGVNKQEKTKAADQAEQQLLLHPVPEVQDAKCECCGMSEECTPEYIRGVRGRFAGRWVCGLCAEAVTEEAEKMNGGGGGTLEEALRAHMGVCKRFNGFGRTHPVLFQAEAMREILRRRAKLGPRSRSSINPREVREVAVGAKAGSGGGGTTGIARSSSCMPFITDDFNERATSSSINKN

SEQ ID NO: 6375 - DNA, 522 bp, Sorghum bicolor
  misc_feature: Ceres ANNOT ID no. 6065651
  misc_feature: Encodes the peptide sequence at SEQ ID NO 6376
atggctaatgactctctgacgaggggacacataatcggggatgtcttagacccgtttactagctcagtgcctctaactgtcatgtatgatggcagaccggtgtttgatgggatggagtttcgggcgtcggcggtgtcggtgaaacctagagttgagattggaggtgatgattttcgagtggcctataccctagttatggtggatcctgatgcgcctaatcccagcaaccctaccctacgggaatacttgcattggatggtgaccgacatcccagcatcaactgatgatagctttggccgagagctcataccatatgagaacccaagccccaccatgggcatccaccgtattgtcttggtgctctaccagcaactggggcggggcacggtgtttgcaccgcaagtgcgtcaaaacttcaacttgcgcaattttgcacgccgtttcaacctcggcaagcctgtggctgcgatgtacttcaactgccagcggcaaacaggcacaggtgggagaaggttcacttga

SEQ ID NO: 6376 - protein, 173 aa, Sorghum bicolor
  misc_feature: Ceres ANNOT ID no. 6065651
  misc_feature (17)..(162): Pfam Id: PBP Pfam Desc: Phosphatidylethanolamine-binding protein
  misc_feature (1)..(173): NCBI GI: 89514803 NCBI Desc: ft-like protein 4 [hordeum vulgare subsp. vulgare]
  misc_feature (4)..(171): NCBI GI: 88770800 NCBI Desc: flowering locus t-like protein ft1 [populus tremula]
  misc_feature (4)..(171): NCBI GI: 48474219 NCBI Desc: flowering locus t [populus nigra]
  misc_feature (4)..(171): NCBI GI: 38304185 NCBI Desc: flowering locus t [populus nigra]
  misc_feature (4)..(171): NCBI GI: 28200390 NCBI Desc: sp3d [lycopersicon esculentum]
  misc_feature: Useful for making plants with modulated flowering time
  misc_feature: Functional homolog of the protein sequence given in SEQ ID NO 13388
  misc_feature: Functional homolog of the protein sequence given in SEQ ID NO 13391
  misc_feature: Useful for making plants with modulated flowering time
  misc_feature: Functional homolog of the protein sequence given in SEQ ID NO 13388
  misc_feature: The sequence is a functional homolog of SEQ ID NO 2 in US patent 7196246
MANDSLTRGHIIGDVLDPFTSSVPLTVMYDGRPVFDGMEFRASAVSVKPRVEIGGDDFRVAYTLVMVDPDAPNPSNPTLREYLHWMVTDIPASTDDSFGRELIPYENPSPTMGIHRIVLVLYQQLGRGTVFAPQVRQNFNLRNFARRFNLGKPVAAMYFNCQRQTGTGGRRFT

SEQ ID NO: 6377 - DNA, 1071 bp, Sorghum bicolor
  misc_feature: Ceres ANNOT ID no. 6065690
  misc_feature: Encodes the peptide sequence at SEQ ID NO 6378
atgacgagcggcgccgggggagccgccgccgggatcgggggcaccagggtgcccacgtggagggagcgcgagaacaaccgccgcagggagcgccggcgccgcgcgatcgccgccaagatcttcgccggactcagggcctacggcaactacaacctccccaagcactgcgacaacaacgaggtgctcaaggcgctctgcaacgaggccggctggaccgtcgagcccgacggcaccacctaccgcaagggatgtaaacctctggcaacagaacggcctgatccaattggaaggtcggcatcaccaagcccttgctcttcatatcaacccagtccacgagcttcatacaatccaagccctgcatcctcttcgtttccaagctctggatcctcctctcacattactcttggtgggaacaacttcatgggtggtgtcgagggcaactctcttatcccatggctaaagaacctttcctcgagttcctcatttgcctcctcctccaagttcccacagcttcaccatctctacttcaacggtggttccatcagtgcaccggtaacacctccatccagctctccaactcgcacacctcgcatcaagactgactgggagaatccaagtgttcagccaccatgggctggggcaaattatgcttctcttcccaactcccaaccgccgagccctgggcatcaccaggttgctccagacccagcatggctagctgggtttcagatatcatctgctggtccttcatctccaacatacagccttgtggcaccgaatccttttggcattttcaaggagaccatcgccagcacctcaagaatgtgtacccctggacagagtggaacatgttctcctgtaatgggtggtgtgccaatccatcacgatgtccagatggttgatggtgccccagatgatttcgcctttgggagcagcagcaacggcaacaacgaatcacctggtcttgtgaaggcatgggagggggaacggatacacgaggagtgcgcctcggacgagcatgagctggagctcacccttgggagctcgaagactcgtgcagatccctcctga

SEQ ID NO: 6378 - protein, 356 aa, Sorghum bicolor
  misc_feature: Ceres ANNOT ID no. 6065690
  misc_feature (4)..(353): NCBI GI: 115435144 NCBI Desc: os01g0203000 [oryza sativa (japonica cultivar-group)]
  misc_feature (14)..(350): NCBI GI: 61211694 NCBI Desc: bes1/bzr1 homolog protein 4
  misc_feature (2)..(349): NCBI GI: 6651069 NCBI Desc: 107 protein [arabidopsis thaliana]
  misc_feature (2)..(231): NCBI GI: 20147315 NCBI Desc: at1g75080/f9e10_7 [arabidopsis thaliana]
  misc_feature (1)..(301): NCBI GI: 61211658 NCBI Desc: bes1/bzr1 homolog protein 2
MTSGAGGAAAGIGGTRVPTWRERENNRRRERRRRAIAAKIFAGLRAYGNYNLPKHCDNNEVLKALCNEAGWTVEPDGTTYRKGCKPLATERPDPIGRSASPSPCSSYQPSPRASYNPSPASSSFPSSGSSSHITLGGNNFMGGVEGNSLIPWLKNLSSSSSFASSSKFPQLHHLYFNGGSISAPVTPPSSSPTRTPRIKTDWENPSVQPPWAGANYASLPNSQPPSPGHHQVAPDPAWLAGFQISSAGPSSPTYSLVAPNPFGIFKETIASTSRMCTPGQSGTCSPVMGGVPIHHDVQMVDGAPDDFAFGSSSNGNNESPGLVKAWEGERIHEECASDEHELELTLGSSKTRADPS

SEQ ID NO: 6379 - DNA, 978 bp, Sorghum bicolor
  misc_feature: Ceres ANNOT ID no. 6065750
  misc_feature: Encodes the peptide sequence at SEQ ID NO 6380
atggccacattcacctgcaggtccatggccttcctctccctcgccgccgccgtcctcgttgccctactcaccgccggcgccgcggacgcgcagaagctctcccccaacttctactccaagacgtgcccgaacgtggccaccatcgtgcggcagcagatggcgtccgccgtcgcggcggagaagcgtatgggcgcctccattctccgcatgttcttccacgactgcttcgtcaatggctgcgacggctccatcctcctcgacgacacgtccaccttcaccggcgagaagggcgccggccccaacgccaactccgtccgcgggttcgaggtcatcgacgccatcaagacgaaggtggaggcctcctgcaaggccaccgtctcctgcgccgacatcctcgccctcgccgcccgtgacggggtcaacctgctgggagggccgacatggagcgtgccgctgggccggaaggactcgcggacggcgagccagagcctggcgaactcgaacctgccaggcccggggtcaagcctggccacgctcatcaggatgttcggcaaccagggcctgtcggcgcgcgacatgacggcgctgtcgggggcgcacaccatcggcaggtcgcagtgccagttcttccgcagccggatctacaccgagagcaacatcaacgccagcttcgccgcgctgcggcagaagacgtgcccgcgctccggcggcgacgccacgctcgcgccgttcgacgtgcagacgcccgacggcttcgacaacgcctactaccagaacctggtggcgcagaagggcctgctgcactcggaccaggagctcttcaatggcgggtcgcaggacgcgctggtcaggcagtacagcaccaacgccaaccagttctccgcggacttcgtctccgccatgatcaagatgggcaacctcatgccgtcgtcagggacgcccacggaagtcaggctcaactgcaggaagacgaactaa

SEQ ID NO: 6380 - protein, 325 aa, Sorghum bicolor
  misc_feature: Ceres ANNOT ID no. 6065750
  misc_feature (49)..(289): Pfam Id: peroxidase Pfam Desc: Peroxidase
  misc_feature (18)..(325): NCBI GI: 5453379 NCBI Desc: bacterial-induced peroxidase precursor [gossypium hirsutum]
  misc_feature (19)..(325): NCBI GI: 61697137 NCBI Desc: peroxidase [populus alba x populus tremula var. glandulosa]
  misc_feature (11)..(325): NCBI GI: 62909955 NCBI Desc: peroxidase [pisum sativum]
  misc_feature (23)..(325): NCBI GI: 2944417 NCBI Desc: peroxidase flxper4 [linum usitatissimum]
  misc_feature (14)..(325): NCBI GI: 55700871 NCBI Desc: tpa: class iii peroxidase 2 precursor [oryza sativa (japonica cultivar-group)]
  misc_feature (8)..(325): SWISSPROT Homolog: EC 1.11.1.7 Peroxidase 52 precursor
  misc_feature: Useful for making plants with altered cell wall content and/or composition
  misc_feature: Functional homolog of the protein sequence encoded by LOCUS at5g05340
  misc_feature: Useful for making plants with altered cell wall content and/or composition
  misc_feature: Functional homolog of the protein sequence given in SEQ ID NO 13605
  misc_feature: Useful for making plants with altered carbohydrate content
  misc_feature: Functional homolog of the protein sequence given in SEQ ID NO 13606
MATFTCRSMAFLSLAAAVLVALLTAGAADAQKLSPNFYSKTCPNVATIVRQQMASAVAAEKRMGASILRMFFHDCFVNGCDGSILLDDTSTFTGEKGAGPNANSVRGFEVIDAIKTKVEASCKATVSCADILALAARDGVNLLGGPTWSVPLGRKDSRTASQSLANSNLPGPGSSLATLIRMFGNQGLSARDMTALSGAHTIGRSQCQFFRSRIYTESNINASFAALRQKTCPRSGGDATLAPFDVQTPDGFDNAYYQNLVAQKGLLHSDQELFNGGSQDALVRQYSTNANQFSADFVSAMIKMGNLMPSSGTPTEVRLNCRKTN

SEQ ID NO: 6381 - DNA, 990 bp, Sorghum bicolor
  misc_feature: Ceres ANNOT ID no. 6065755
  misc_feature: Encodes the peptide sequence at SEQ ID NO 6382
atggtggtgagagcatcatcagtgataaggtgcttgctgacggtggccgcggtgctgtctctcctgatggccggtgccgctgctgccggcggcggtctgtcgacgagcttctacagcaagaagtgcccgaacgtgcagagcatcgtgcgggccgggatggcgtcggccgtggcggcggagaagcgcatgggcgcctccatcctccgcatgttcttccacgactgcttcgtcaatggctgtgacgcgtccatcttgctggacgacacggcgaccttcaccggcgagaagaacgccgggcccaacgccaactccgtgcgcgggtacgaggtcatcgacgccatcaagacccaggtcgaggcgtcctgcaacgccaccgtctcctgcgccgacatcctcgccctcgctgcccgggacgctgtcaacctcctcggcgggccgacgtggacggtgtacctcggccggcgggacgcgcggacggcgagccagagcgacgcgaacggcaacctcccggggccagggtcgagcctcgccaccctcgtcaccatgttcggcaacaagggcctgtcggcgcgcgacatgacggcgctgtcgggcgcgcacaccgtcgggcaggcccggtgcaccaccttccgcagccgcatctacggcgacaccaacatcaacgccaccttcgcgtcgctccggcagcagacgtgcccgcaggccagcgacggcggcgccggcgacgccgcgctggcgcccatcgacgtccggacccccgaggcgttcgacaacgcctactaccagaacctgatggccaggcaagggctgttccactcggaccaggagctcttcaacggcggctcgcaggacgcgctggtgaagaagtacagcggcaacgccgccatgttcgccgccgacttcgccaaggcgatggtgaggatgggcgccatcagcccgctcacggggacgcagggcgaggtcaggctcgactgcaggaaggtcaactag

SEQ ID NO: 6382 - protein, 329 aa, Sorghum bicolor
  misc_feature: Ceres ANNOT ID no. 6065755
  misc_feature (49)..(293): Pfam Id: peroxidase Pfam Desc: Peroxidase
  misc_feature (14)..(329): NCBI GI: 5453379 NCBI Desc: bacterial-induced peroxidase precursor [gossypium hirsutum]
  misc_feature (19)..(329): NCBI GI: 2944417 NCBI Desc: peroxidase flxper4 [linum usitatissimum]
  misc_feature (18)..(329): NCBI GI: 61697137 NCBI Desc: peroxidase [populus alba x populus tremula var. glandulosa]
  misc_feature (13)..(329): NCBI GI: 55700871 NCBI Desc: tpa: class iii peroxidase 2 precursor [oryza sativa (japonica cultivar-group)]
  misc_feature (6)..(329): NCBI GI: 62909955 NCBI Desc: peroxidase [pisum sativum]
  misc_feature (5)..(329): SWISSPROT Homolog: EC 1.11.1.7 Peroxidase 52 precursor
  misc_feature: Useful for making plants with altered cell wall content and/or composition
  misc_feature: Functional homolog of the protein sequence encoded by LOCUS at5g05340
  misc_feature: Useful for making plants with altered cell wall content and/or composition
  misc_feature: Functional homolog of the protein sequence given in SEQ ID NO 13605
  misc_feature: Useful for making plants with altered carbohydrate content
  misc_feature: Functional homolog of the protein sequence given in SEQ ID NO 13606
  misc_feature: Useful for making plants with modulated oxidative stress sensitivity
  misc_feature: Functional homolog of the protein sequence given in SEQ ID NO 13607
MVVRASSVIRCLLTVAAVLSLLMAGAAAAGGGLSTSFYSKKCPNVQSIVRAGMASAVAAEKRMGASILRMFFHDCFVNGCDASILLDDTATFTGEKNAGPNANSVRGYEVIDAIKTQVEASCNATVSCADILALAARDAVNLLGGPTWTVYLGRRDARTASQSDANGNLPGPGSSLATLVTMFGNKGLSARDMTALSGAHTVGQARCTTFRSRIYGDTNINATFASLRQQTCPQASDGGAGDAALAPIDVRTPEAFDNAYYQNLMARQGLFHSDQELFNGGSQDALVKKYSGNAAMFAADFAKAMVRMGAISPLTGTQGEVRLDCRKVN

SEQ ID NO: 6383 - DNA, 1545 bp, Sorghum bicolor
  misc_feature: Ceres ANNOT ID no. 6065845
  misc_feature: Encodes the peptide sequence at SEQ ID NO 6384
atgggagaggtgaaacagaaggtggcaacggaggaggatatgcttgaagaagatgatgagaaaagatctttggacaactctgtaccacctttgattctggacctcaacgagggtttcggtgagggaagcgaggaaggggaagccggcgatgatggtgacggcaacgaggaagatggtgacgacggcggtagcacaagtgaagttgaaggaggcaggagttcaagcaacaacagcagcagcaccaaccacacttccatgagcaacaagtattgcgacatggatagcaacagtaagggtgagggcagcggcgagagggcgctgaccgtgaggcagtacaacagatccaagcttccccgtctccggtggactccagacctgcatatggcatttgtccacgccgtggagaggctgggcggccaagagagagcaacgccaaagctggtgcttcagatgatgaacgtgagggggctcagcattgctcatgtaaaaagtcacttgcagatgtacagaagcaagaagctggaccacgagtctggtggacacgagagagcagccatctcctccgttttctcgcccatggacttccacatgatgaggagaggggaccatcgcttccatgacatgttgctccatcgagctgcaggctcggtgatctcctccggccggctgctccacaacgccgtctcgccggaggccagcaggctctacgcgctcctccaacgccggcagcagccttccatgcaaacgttcgacttcaagaactacagtagcaacctcagggatcaagagtggagtttcagccagcatgcagcggcagcggcggcggtggcagccagggctggggccatcaataaccacggcccaacgaaagggctcatccacgatatgatcttgagaaagaatggcaggccgacatcccatttgttcgacgtgcgggatgccatcgcttccaaccggacgtcgtcggacgccgcgggtgctgctgccaaccacggcggcggaagggtcgtcaggagcacggattgggacggcaccagctctgggccgcccttgtctaggacaatgtcggcagctgcctccacgggtgttgcgttgggcggtagtcaccatcagtctaggggaagagtcgctaacttgacatcgtcgtctgatcccgtggtgacaagtgaagccctaggctcccggctccagctgcagacgctcctagagcctagaacgacgaagaggatgaagacgccaatggaagggaatggcggcacgccggacttgcagctaagcttgagccccaacgacgacatgggaggagatgccgacaagcaggtcaagaagaggaagttcctaggcatcgagttaagtgaacaggaggtggacgacagtggtaagacgacgctgcctctctcgctctcgctgtcactccgtggtggcgagtggagcagcgaagatgccgggagcttagaggtagcggcacgtagcagcggcaagaagaaggccgctctggggcggagtactttggatctgaccatgtcgatcaaggcattggagtga

SEQ ID NO: 6384 - protein, 514 aa, Sorghum bicolor
  misc_feature: Ceres ANNOT ID no. 6065845
  misc_feature (119)..(170): Pfam Id: Myb_DNA-binding Pfam Desc: Myb-like DNA-binding domain
  misc_feature (2)..(264): NCBI GI: 92871144 NCBI Desc: homeodomain-related [medicago truncatula]
  misc_feature (54)..(179): NCBI GI: 115483751 NCBI Desc: os11g0106100 [oryza sativa (japonica cultivar-group)]
  misc_feature (44)..(174): NCBI GI: 140057815 NCBI Desc: homeodomain-related [medicago truncatula]
  misc_feature (109)..(174): NCBI GI: 7527727 NCBI Desc: t5e21.10 [arabidopsis thaliana]
  misc_feature (109)..(174): NCBI GI: 79344640 NCBI Desc: dna binding / transcription factor [arabidopsis thaliana]
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 1857 in the 10/374,780US patent application
  misc_feature: The sequence is a functional homolog of SEQ ID NO 2636 in the 10/374,780US patent application
  misc_feature: The sequence is a functional homolog of SEQ ID NO 320 in the 10/225,066US patent application
  misc_feature: Useful for making plants with modulated growth and phenotype characteristics
  misc_feature: The sequence is a functional homolog of SEQ ID NO 320 in the 20050160493 US patent application
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: Useful for making plants with modulated biomass
  misc_feature: Functional homolog of the protein sequence given in SEQ ID NO 13530
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
MGEVKQKVATEEDMLEEDDEKRSLDNSVPPLILDLNEGFGEGSEEGEAGDDGDGNEEDGDDGGSTSEVEGGRSSSNNSSSTNHTSMSNKYCDMDSNSKGEGSGERALTVRQYNRSKLPRLRWTPDLHMAFVHAVERLGGQERATPKLVLQMMNVRGLSIAHVKSHLQMYRSKKLDHESGGHERAAISSVFSPMDFHMMRRGDHRFHDMLLHRAAGSVISSGRLLHNAVSPEASRLYALLQRRQQPSMQTFDFKNYSSNLRDQEWSFSQHAAAAAAVAARAGAINNHGPTKGLIHDMILRKNGRPTSHLFDVRDAIASNRTSSDAAGAAANHGGGRVVRSTDWDGTSSGPPLSRTMSAAASTGVALGGSHHQSRGRVANLTSSSDPVVTSEALGSRLQLQTLLEPRTTKRMKTPMEGNGGTPDLQLSLSPNDDMGGDADKQVKKRKFLGIELSEQEVDDSGKTTLPLSLSLSLRGGEWSSEDAGSLEVAARSSGKKKAALGRSTLDLTMSIKALE

SEQ ID NO: 6385 - DNA, 1149 bp, Sorghum bicolor
  misc_feature: Ceres ANNOT ID no. 6065871
  misc_feature: Encodes the peptide sequence at SEQ ID NO 6386
atggcctcctcgctccgccatttcgccggcctcggctgtttccccgccgtggcctctacctctggctccacctgctgcctgcgccgctacaccccaaacttctgcgccttcgtggcgctccgtccgatcagcccgcccgccgccaccgccacggcgactgccaaggccctcacctctccgtctccggtggagcagcacctacaggccgtcgtcccgtgccacggcatcagcgacccgccggcggcgtcatcggcagcagcggtcccggcggcgccgctgcgggtggggatcgtcgggttcggcaacttcgggcagttcatcgcgggcgggctgcagcggcagggccacgtcgtgctggcggcttccagatccgactactccgtctactgcgccagccatggcattcgcttcttcaggagcgtcgacgcgctgtgcgaggagcagccggacgtgctgctcatctgcagctccatcctgtccacggagggcgtcgtccgagccatccccttccgcaagctccgccacgacaccatcgtcgccgacgtgctctccgtcaaggagttccctcgcaacctcctcctcgaggttctcccaccgggatttgggatcatctgtacgcaccccatgtttgggccggagagtggtaaacacggctggggcaagcttcccttcgtctttgacaaggtccgtgtcgcggaagacggggatcaggcagcaaagtgcgaccagttcttgagcatatttgaacaggagggatgtaggatggtggagatgtcatgcgcggagcatgatcgctacgctgcgggaagtcaattcatcacgcacacaattgggagggttttatcacaactgaacctcaagtcaacgccaatcaacaccaagggttatgaaaccttgctgcaacttaccaagaacaccgtaagcgacagtttcgatctgtactatgggctcttcatgtacaatgtcaatgccacagagcagctcgacaaactggaaatggcatttgagaaggtgagacagatgctgtctggcaggctccacgacttcatacgaaagcagattgtggagagggcagcccatgtgccagcagatccttcaggaaaattggcaaatggtttgtccagttctcctgcagctcgcctcttatag

SEQ ID NO: 6386 - protein, 382 aa, Sorghum bicolor
  misc_feature: Ceres ANNOT ID no. 6065871
  misc_feature (31)..(382): NCBI GI: 92884247 NCBI Desc: prephenate dehydrogenase; nadp oxidoreductase, coenzyme f420-dependent [medicago truncatula]
  misc_feature (37)..(371): NCBI GI: 16903100 NCBI Desc: arogenate dehydrogenase isoform 2 [arabidopsis thaliana]
  misc_feature (37)..(371): NCBI GI: 23308331 NCBI Desc: at1g15710/f7h2_5 [arabidopsis thaliana]
  misc_feature (93)..(347): NCBI GI: 16903098 NCBI Desc: arogenate dehydrogenase [arabidopsis thaliana]
  misc_feature (93)..(348): NCBI GI: 92877972 NCBI Desc: prephenate dehydrogenase [medicago truncatula]
  misc_feature (37)..(371): SWISSPROT Homolog: EC 1.3.1.78 Arogenate dehydrogenase 2, chloroplast precursor
MASSLRHFAGLGCFPAVASTSGSTCCLRRYTPNFCAFVALRPISPPAATATATAKALTSPSPVEQHLQAVVPCHGISDPPAASSAAAVPAAPLRVGIVGFGNFGQFIAGGLQRQGHVVLAASRSDYSVYCASHGIRFFRSVDALCEEQPDVLLICSSILSTEGVVRAIPFRKLRHDTIVADVLSVKEFPRNLLLEVLPPGFGIICTHPMFGPESGKHGWGKLPFVFDKVRVAEDGDQAAKCDQFLSIFEQEGCRMVEMSCAEHDRYAAGSQFITHTIGRVLSQLNLKSTPINTKGYETLLQLTKNTVSDSFDLYYGLFMYNVNATEQLDKLEMAFEKVRQMLSGRLHDFIRKQIVERAAHVPADPSGKLANGLSSSPAARLL

SEQ ID NO: 6387 - DNA, 966 bp, Sorghum bicolor
  misc_feature: Ceres ANNOT ID no. 6065916
  misc_feature: Encodes the peptide sequence at SEQ ID NO 6388
atgccggcgttcaaggccccggcgccgggcttcgccgtgcgcttcagccccttccacgagaaccgcctcctcgccgccacgtcccagcacttcggcctcgtgggcaacggccacctcatcgtcctcgacctcgccgccgccgggcccgggcccggggccgccccggtgccggtcttctccttcccgacctccgacgcgctcttcgactgcgcgtggtccgagtcccacgactccctctgcgccgccgcgtctggggacggctccgtgcgcctcttcgacgccgcgctcccgccggcgcagaacccggtacgcctcctccgcgagcacgcgcgggaggtgcacggcctcgactggaaccccgtccgccgggacgccttcatctccgcctcatgggacgacacgctcaagctctggtcccccgaccgcccggcctccgtccgcaccttccggggccacgagtactgcgtctacgccgccgcctggtccgcgcgccacccggacgtcttcgcctccgcctccggggaccggaccgcgcgcgtctgggacgtccgggaccccgcgcccacgctcatcctgcccgcgcacgaccacgaggtgctctcgctcgactgggacaagtacgacccctccatcctcgccaccgcctccgtcgacaagtccatccgcgtctgggacgtgcgcgcgccgcgggcgcccatcgcgcagctcgctggacacggctacgccgtcaagcgggtccgcttctcgccgcaccgccagggcatgctcatgtcctgctcctacgacatgaccgtctgcatgtgggactaccgcgccgaggatgctctgctcgccaggtacaaccaccacaccgagttcgtcgccggcattgacatgagtgtcctcgtcgacggcctgctcgccagcaccggatgggacgagatggtctacgtctggccgtttgggaccgatccaagagccatgtag

SEQ ID NO: 6388 - protein, 321 aa, Sorghum bicolor
  misc_feature: Ceres ANNOT ID no. 6065916
  misc_feature (100)..(139): Pfam Id: WD40 Pfam Desc: WD domain, G-beta repeat
  misc_feature (143)..(182): Pfam Id: WD40 Pfam Desc: WD domain, G-beta repeat
  misc_feature (186)..(225): Pfam Id: WD40 Pfam Desc: WD domain, G-beta repeat
  misc_feature (230)..(269): Pfam Id: WD40 Pfam Desc: WD domain, G-beta repeat
  misc_feature (1)..(320): NCBI GI: 82879859 NCBI Desc: peroxisomal import receptor pts2 [brassica napus]
  misc_feature (1)..(320): NCBI GI: 90186627 NCBI Desc: pectinesterase-like protein [brassica rapa]
  misc_feature (1)..(320): NCBI GI: 4689316 NCBI Desc: peroxisomal targeting signal type 2 receptor [arabidopsis thaliana]
  misc_feature (1)..(320): NCBI GI: 15218882 NCBI Desc: peroxisomal targeting signal type 2 receptor (pex7) [arabidopsis thaliana]
  misc_feature (1)..(320): NCBI GI: 28195239 NCBI Desc: peroxisomal targeting signal type 2 receptor [lycopersicon esculentum]
  misc_feature: The sequence is a functional homolog of SEQ ID NO. 485 in the 11/188,298 US application
  misc_feature: The sequence is a functional homolog of SEQ ID NO. 502 in the 11/188,298 US application
MPAFKAPAPGFAVRFSPFHENRLLAATSQHFGLVGNGHLIVLDLAAAGPGPGAAPVPVFSFPTSDALFDCAWSESHDSLCAAASGDGSVRLFDAALPPAQNPVRLLREHAREVHGLDWNPVRRDAFISASWDDTLKLWSPDRPASVRTFRGHEYCVYAAAWSARHPDVFASASGDRTARVWDVRDPAPTLILPAHDHEVLSLDWDKYDPSILATASVDKSIRVWDVRAPRAPIAQLAGHGYAVKRVRFSPHRQGMLMSCSYDMTVCMWDYRAEDALLARYNHHTEFVAGIDMSVLVDGLLASTGWDEMVYVWPFGTDPRAM

SEQ ID NO: 6389 - DNA, 3594 bp, Sorghum bicolor
  misc_feature: Ceres ANNOT ID no. 6065924
  misc_feature: Encodes the peptide sequence at SEQ ID NO 6390
atggtggcgatggagggtaagggggacgcgtcagtgacgccggtgaggactagtgaccggctgcggcagcgtccgaagtactatggtcgtggctatatgtactacaagccacccatgaggaagaaggttaagtctaagaagcgaactactgcatcacagattgttaagaaactgcttcgcaagccagctgcacgtccgccacctgctgattctattgcagcaaatttgcgccgttcaacgcgaaagcgaaggatttctgtaaatctggagggctatgatacagatagttccagtacgggagatcatgatcttatgagacctagatatcgatcttcaaagagtaaagggggaaacaatgctgcacatgatgaagtgtcagctaggccaaagcgccagaagttgtctaactccatgcctcgccgcgaaggtttacggcctagaagatctttgcgaggacaaagactgcatccataccatgaatctgaggatgaccaggaaagctctgaagaacaaggtgcagaagatcaaagagaaaatggcaatgagattgaagaggatgttggtgatgaggaggttgatggaggtgatgaagctgaaggagatggagatgatgaagatggcgaggaagagcaagaaggaaggaggagatatgatttaagggaacgttcagaggttcgtaggccatcccctcgtaaggaaggaaagcacagaccccaatctcctcgtagagtactagttcacggaattggtccaaagaacagcaagtatctaaaaaaaggtgggtcgcgcatgcataagcgccctcgtttctctttgccagatgattcagatgactcccttcttgtggatgagccagacgagggtccatccatgccatggatgcgcagtgggaggggaggtatgccatggttgatgggtgggttggacatgcatagtccagcagcatggggcctgagtgttggagcatctggttggggtcatcagggcgacacttctacttcactcatgcctggggtgcaaactgctggaccaagttctaagggaggagctgacattcagcctctgcaggttgatgagaatgtgagctttaaagatataggtggactatcggagtatattgatgctctgaaggaaatggttttcttcccattgctgtatccagatttttttgcaaactatcacatcactcctcctagaggtgttctgctttgtggcccaccgggcacaggaaaaacattgattgcccgtgccttagcttgtgctgcctctaaagctggccagaaggtcagtttttacatgcgcaaaggagctgatgttcttagtaaatgggtgggagaggctgaaaggcagctaaagttactttttgaggaagctcaaaagaatcagccgtcaattatattttttgatgaaatagatggcctggcgcctgtgaggtctagcaagcaagagcagattcacaattcaattgtttcgacattgcttgctttgatggatggccttgattcacgtgggcaagttgttttgattggagcaactaacagaattgatgccattgatggggcattgcgtagacctggccggtttgaccgtgagttttattttcctttacctggctatgaggctcgatcagaaatactggatattcatacaaggaaatggaaggatcctccaccgaaggaactaaagatggaacttgctgctagctgtgtgggctattgtggagctgatttgaaggcattgtgtacagaagcagctattagagcatttagagagaagtatcctcaagtctacactagtgacgacaagtttgtcattgatgttgattcggtcactgttgagaagtaccactttttggaagctatgtctacaataactcctgctgcgcacaggggatctattgtgcattcaaggccactttcaacggttatcgctccatgtctgaagaggcatcttgagaaaataatggaacaaatttctgatattttccctttcctttcatccatagattttagcaagttctccgctctttcctatggatcttccatcccccttgtttatagacctcgccttttgatatgtggtggtgaaagtgttggactggatcatgtgggaccagctgttttacatgagcttgagaagttctctgttcactctttgggattgccatctcttctctctgatccaagtgcaaagacacctgaagaagctcttgtgcatatttttggggaagccaagagaacaaccccatccattctatacttgcctcagttccatctttggtgggaaacggcgcatgaacaactcagggctgtgttattgactctgttgaatgagttgccctccaaccttccagttttattgcttggaacatcatcagtggctttcactgacctcgaagaagagtgtgcttctatattctcttctcgcaacgtgtatcaagtggatcatccaagttatgacgataaattgagatacttcagtatattgtttgagtcattgctctctttccaatcggaggaatcaagaaacaagtcaaagaaacagaagtctgctattgatcttcccaaagccccgaaagaagtggagggccctaaggcttctgagctaaaggctaaggcagaagctgagcagcatgctgttcgtcgaatgaggatgtgtctccgagatatctgcaaccgcattttgtacaacaaaaggttcaatgtatttcacttcccggtatcagaagaggaggtgcctgactatcgatcaataatccacaagcccatggatatggctactgttttgcagcgggtggactctggacagtaccttaccagggcagcatttatgaaggatattgatcttattgtctcaaatgcaaagacttacaatggggatgactacaatggatctaggatcgtcagtagagcatgtgaactcagagatgtggtccaaggtatgttgtcacagatggacccatgtttggtgtccttttgtgataaaattgctttacagggggggccacagcaggttgtggatgatgaagatagctctattcttcaagcagcgcctgttgctcagctggtttctggtactagaataagtgcaaggcttcgcaatgtactgcccgaagtaaacctgtcacaaagttatgaagtgctaaagcggcaaaagaaaagtgctgaaaatgaacagagcatgaccaaagatgtggcagctagagatgaaaagtctccggaagatgtagatttgtcaaagccaactgacccagaagaagctgcaaaagaaccagagttaaatggcacaacgaaagaagccaacgaatcaccagccgaagaaccagaagtacctactcctgaacccatggagtctgacaacgttcaagtcgccactaccgtggctactggtgacgacttgctaggacagctagaagccctaaagcaacgcttcatggaactcactgcaggctacggcgtgccacagctcgagaggctgtattcccggataatgaaaggagcaatagagttgacaagtaaagaaagcaacgaggatcatagacggttagtagttaggtatttgttgacattcgttgagaacagcaacaatttttaa

SEQ ID NO: 6390 - protein, 1197 aa, Sorghum bicolor
  misc_feature: Ceres ANNOT ID no. 6065924
  misc_feature (400)..(590): Pfam Id: AAA Pfam Desc: ATPase family associated with various cellular activities(AAA)
  misc_feature (886)..(973): Pfam Id: Bromodomain Pfam Desc: Bromodomain
  misc_feature (400)..(536): Pfam Id: AAA_5 Pfam Desc: ATPase family associated with various cellular activities(AAA)
  misc_feature (1)..(1197): NCBI GI: 24021796 NCBI Desc: bromodomain protein 103 [zea mays]
  misc_feature (1)..(1197): NCBI GI: 50725359 NCBI Desc: bromodomain protein 103-like [oryza sativa (japonica cultivar-group)]
  misc_feature (7)..(1197): NCBI GI: 18390588 NCBI Desc: cell division cycle protein 48-related / cdc48-related [arabidopsis thaliana]
  misc_feature (7)..(1197): NCBI GI: 27363450 NCBI Desc: at1g05910/t20m3_16 [arabidopsis thaliana]
  misc_feature (72)..(1197): NCBI GI: 6850321 NCBI Desc: contains similarity to yta7 atpase gene from saccharomyces cerevisiae gbx81072, and contains bromodomain pf00439, aaa pf00004, and sigma-54 pf00158 transcription factor
  misc_feature (72)..(1197): NCBI GI: 6850321 (continued) domains. [arabidopsis thaliana]
  misc_feature: The sequence is a functional homolog of SEQ ID NO. 462 in the 11/188,298 US application
  misc_feature: The sequence is a functional homolog of SEQ ID NO. 471 in the 11/188,298 US application
MVAMEGKGDASVTPVRTSDRLRQRPKYYGRGYMYYKPPMRKKVKSKKRTTASQIVKKLLRKPAARPPPADSIAANLRRSTRKRRISVNLEGYDTDSSSTGDHDLMRPRYRSSKSKGGNNAAHDEVSARPKRQKLSNSMPRREGLRPRRSLRGQRLHPYHESEDDQESSEEQGAEDQRENGNEIEEDVGDEEVDGGDEAEGDGDDEDGEEEQEGRRRYDLRERSEVRRPSPRKEGKHRPQSPRRVLVHGIGPKNSKYLKKGGSRMHKRPRFSLPDDSDDSLLVDEPDEGPSMPWMRSGRGGMPWLMGGLDMHSPAAWGLSVGASGWGHQGDTSTSLMPGVQTAGPSSKGGADIQPLQVDENVSFKDIGGLSEYIDALKEMVFFPLLYPDFFANYHITPPRGVLLCGPPGTGKTLIARALACAASKAGQKVSFYMRKGADVLSKWVGEAERQLKLLFEEAQKNQPSIIFFDEIDGLAPVRSSKQEQIHNSIVSTLLALMDGLDSRGQVVLIGATNRIDAIDGALRRPGRFDREFYFPLPGYEARSEILDIHTRKWKDPPPKELKMELAASCVGYCGADLKALCTEAAIRAFREKYPQVYTSDDKFVIDVDSVTVEKYHFLEAMSTITPAAHRGSIVHSRPLSTVIAPCLKRHLEKIMEQISDIFPFLSSIDFSKFSALSYGSSIPLVYRPRLLICGGESVGLDHVGPAVLHELEKFSVHSLGLPSLLSDPSAKTPEEALVHIFGEAKRTTPSILYLPQFHLWWETAHEQLRAVLLTLLNELPSNLPVLLLGTSSVAFTDLEEECASIFSSRNVYQVDHPSYDDKLRYFSILFESLLSFQSEESRNKSKKQKSAIDLPKAPKEVEGPKASELKAKAEAEQHAVRRMRMCLRDICNRILYNKRFNVFHFPVSEEEVPDYRSIIHKPMDMATVLQRVDSGQYLTRAAFMKDIDLIVSNAKTYNGDDYNGSRIVSRACELRDVVQGMLSQMDPCLVSFCDKIALQGGPQQVVDDEDSSILQAAPVAQLVSGTRISARLRNVLPEVNLSQSYEVLKRQKKSAENEQSMTKDVAARDEKSPEDVDLSKPTDPEEAAKEPELNGTTKEANESPAEEPEVPTPEPMESDNVQVATTVATGDDLLGQLEALKQRFMELTAGYGVPQLERLYSRIMKGAIELTSKESNEDHRRLVVRYLLTFVENSNNF

SEQ ID NO: 6391 - DNA, 519 bp, Sorghum bicolor
  misc_feature: Ceres ANNOT ID no. 6065948
  misc_feature: Encodes the peptide sequence at SEQ ID NO 6392
atggcagatagtgagcatcgaacagtgtttgtcacggtggggaccacatgttttgatgctcttgtcatggcggtagattctccagaagtgaagatggctttattgcaaaaaggttatagtaatcttcttattcaaatgggccgaggaacatatgttccatcaaaggtctcaggagatgctacccttcaagttgatcatttcacattttcaccaagcatagctgataatatgagaacagcttccctagttattagccatgcaggttcaggaagcatatttgagacgttacggcttggcaaacccctaatcgttgttgtaaatgaagatttgatggacaaccaccagagtgaattagcagaagaattggctgaaaggaagcatctcttctgtgcacgcccacaaactttgggagagaccatccgggcaatggacctagagacactagttccttatgagccaggggacgccaaaccagttgtcaccctgataaacagatttcttggctttccagttgactga

SEQ ID NO: 6392 - protein, 172 aa, Sorghum bicolor
  misc_feature: Ceres ANNOT ID no. 6065948
  misc_feature (8)..(166): Pfam Id: Glyco_tran_28_C Pfam Desc: Glycosyltransferase family 28 C-terminal domain
  misc_feature (54)..(172): NCBI GI: 115446081 NCBI Desc: os02g0467700 [oryza sativa (japonica cultivar-group)]
  misc_feature (7)..(168): NCBI GI: 50539980 NCBI Desc: zgc:92907 [danio rerio]
  misc_feature (7)..(168): NCBI GI: 47123223 NCBI Desc: mgc84616 protein [xenopus laevis]
  misc_feature (7)..(168): NCBI GI: 74752876 NCBI Desc: probable glycosyltransferase glt28d1 (glycosyltransferase 28 domain-containing protein 1)
  misc_feature (7)..(168): NCBI GI: 62857333 NCBI Desc: glt28d1 [xenopus tropicalis]
  misc_feature: Useful for making plants with altered oil content
  misc_feature: Useful for making plants with modulated biomass
  misc_feature: Useful for making plants with modulated heat sensitivity
  misc_feature: GREAT-hit functional homolog of the protein sequence given in SEQ ID NO 13434
  misc_feature: GREAT-hit functional homolog of the protein sequence given in SEQ ID NO 13458
  misc_feature: Useful for making plants with altered oil content
  misc_feature: Functional homolog of the protein sequence given in SEQ ID NO 13458
MADSEHRTVFVTVGTTCFDALVMAVDSPEVKMALLQKGYSNLLIQMGRGTYVPSKVSGDATLQVDHFTFSPSIADNMRTASLVISHAGSGSIFETLRLGKPLIVVVNEDLMDNHQSELAEELAERKHLFCARPQTLGETIRAMDLETLVPYEPGDAKPVVTLINRFLGFPVD

SEQ ID NO: 6393 - DNA, 585 bp, Sorghum bicolor
  misc_feature: Ceres ANNOT ID no. 6065953
  misc_feature: Encodes the peptide sequence at SEQ ID NO 6394
atggcgacctccttccaggggacgaccaccaagtgcaccgcctgcgacaagacggtgtacctcgtcgacaagctcaccgccgacaaccgcatctaccacaaggcctgcttccgctgccaccactgcaagggcaccctcaagcttgccaactacaactccttcgagggagtgctctactgcaggcctcacttcgaccagctgttcaagaggaccgggagtttggacaagagcttcgaaggaactccaaaggttgtcaagccagaaagaaacgttgggaatgagaatgctgttaaagtctcaagcgcctttgctggcaccagagagaaatgtgttggatgcagcaagacagtctatccaattgagagggttactgtcaacaacactatgtatcacaagagctgcttcaagtgctgccatggaggatgcaccatcagcccttctaactacattgcgcacgaggggaagctctactgcaagcaccaccacattcagctgatcaaagagaagggaaacttcagccagcttgagaatgatcacgagaagacgtcacaggctgggtcactggaggatgaagaagagtattaa

SEQ ID NO: 6394 - protein, 194 aa, Sorghum bicolor
  misc_feature: Ceres ANNOT ID no. 6065953
  misc_feature (12)..(68): Pfam Id: LIM Pfam Desc: LIM domain
  misc_feature (110)..(166): Pfam Id: LIM Pfam Desc: LIM domain
  misc_feature (1)..(175): NCBI GI: 7715037 NCBI Desc: lim transcription factor homolog [zea mays]
  misc_feature (4)..(192): NCBI GI: 144923051 NCBI Desc: lim, zinc-binding; bacterial enterotoxin [medicago truncatula]
  misc_feature (4)..(181): NCBI GI: 117950161 NCBI Desc: lim domain protein glim1a [populus tremula x populus alba]
  misc_feature (4)..(181): NCBI GI: 117950163 NCBI Desc: lim domain protein glim1b [populus tremula x populus alba]
  misc_feature (4)..(180): NCBI GI: 6467903 NCBI Desc: pollen specific lim domain protein 1a [nicotiana tabacum]
  misc_feature: Useful for making plants with altered carbohydrate content
  misc_feature: Functional homolog of the protein sequence given in SEQ ID NO 13763
  misc_feature: Useful for making plants with modulated heat sensitivity
  misc_feature: Functional homolog of the protein sequence given in SEQ ID NO 13762
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application
MATSFQGTTTKCTACDKTVYLVDKLTADNRIYHKACFRCHHCKGTLKLANYNSFEGVLYCRPHFDQLFKRTGSLDKSFEGTPKVVKPERNVGNENAVKVSSAFAGTREKCVGCSKTVYPIERVTVNNTMYHKSCFKCCHGGCTISPSNYIAHEGKLYCKHHHIQLIKEKGNFSQLENDHEKTSQAGSLEDEEEY

SEQ ID NO: 6395 - DNA, 585 bp, Sorghum bicolor; identical to SEQ ID NO: 6393
  misc_feature: Ceres ANNOT ID no. 6065954
  misc_feature: Encodes the peptide sequence at SEQ ID NO 6396

SEQ ID NO: 6396 - protein, 194 aa, Sorghum bicolor; identical to SEQ ID NO: 6394
  misc_feature: Ceres ANNOT ID no. 6065954
  misc_feature (12)..(68): Pfam Id: LIM Pfam Desc: LIM domain
  misc_feature (110)..(166): Pfam Id: LIM Pfam Desc: LIM domain
  misc_feature (1)..(175): NCBI GI: 7715037 NCBI Desc: lim transcription factor homolog [zea mays]
  misc_feature (4)..(192): NCBI GI: 144923051 NCBI Desc: lim, zinc-binding; bacterial enterotoxin [medicago truncatula]
  misc_feature (4)..(181): NCBI GI: 117950161 NCBI Desc: lim domain protein glim1a [populus tremula x populus alba]
  misc_feature (4)..(181): NCBI GI: 117950163 NCBI Desc: lim domain protein glim1b [populus tremula x populus alba]
  misc_feature (4)..(180): NCBI GI: 6467903 NCBI Desc: pollen specific lim domain protein 1a [nicotiana tabacum]
  misc_feature: Useful for making plants with altered carbohydrate content
  misc_feature: Functional homolog of the protein sequence given in SEQ ID NO 13763
  misc_feature: Useful for making plants with modulated heat sensitivity
  misc_feature: Functional homolog of the protein sequence given in SEQ ID NO 13762
  misc_feature: The sequence is a functional homolog of SEQ ID NO 428 in the 10/412,699 US patent application
  misc_feature: The sequence is a functional homolog of SEQ ID NO 616 in the 11/435,388 US patent application
  misc_feature: The sequence is a functional homolog of SEQ ID NO 992 in the 11/479,226 US patent application

SEQ ID NO: 6397 - DNA, 798 bp, Sorghum bicolor
  misc_feature: Ceres ANNOT ID no. 6066091
  misc_feature: Encodes the peptide sequence at SEQ ID NO 6398
atggccactgccggagccttccacgccggcggccgcctcctcctcccgctccgacgcagcccccgcgggcccagcccctcaccatggtcccacgtccgcacccacctcatctcctccaagccgccgccctccgctcctctcccgccgcccgtgccgccggcgcgcccgtccccagtggggtccgccttcgggtctcttagcaggaagaccggcgcgttgggggccggcgctggcgctggcgcgggtgtcgtcgggtggtaccttggcgtcctggacgcgcggcccgtgctgaccaagagcgtcaccgccgctgccatcttcaccgtcgcggacctctcctcccagatgctcagtcttggtcctgaggattcatttgattatctcaggaccatgcgtatggctagttatgggtttctgatctcaggacctaccctccatctctggttcaattttatctcaaaattcttccccaaaaaggatgtagtgaacacattgaagaagatgtttctagggcaagcagtctatggaccaattattaactcagttttcttctcgtataatgcaggattacaaggtgagactgttcctgagattattgcaagattgaagagggatctagttcccaccatcaaaagtgggcttttgtattggccaacttgtgatttcattactttcaagtttgttccagttcatttacagccactagtgagcaattcattctcatttctttggaccatctacataacatatatggcaagcttaaagaaagcagatgtggaggtggccacgagtacctaa

SEQ ID NO: 6398 - protein, 265 aa, Sorghum bicolor
  misc_feature: Ceres ANNOT ID no. 6066091
  misc_feature (190)..(257): Pfam Id: Mpv17_PMP22 Pfam Desc: Mpv17 / PMP22 family
  misc_feature (65)..(258): NCBI GI: 21553640 NCBI Desc: contains similarity to 22 kda peroxisomal membrane protein [arabidopsis thaliana]
  misc_feature (65)..(258): NCBI GI: 18422298 NCBI Desc: peroxisomal membrane 22 kda family protein [arabidopsis thaliana]
  misc_feature (58)..(252): NCBI GI: 15241166 NCBI Desc: peroxisomal membrane 22 kda family protein [arabidopsis thaliana]
  misc_feature (58)..(252): NCBI GI: 24111335 NCBI Desc: at5g19750/t29j13_170 [arabidopsis thaliana]
  misc_feature (84)..(253): NCBI GI: 97197141 NCBI Desc: protein sym1
MATAGAFHAGGRLLLPLRRSPRGPSPSPWSHVRTHLISSKPPPSAPLPPPVPPARPSPVGSAFGSLSRKTGALGAGAGAGAGVVGWYLGVLDARPVLTKSVTAAAIFTVADLSSQMLSLGPEDSFDYLRTMRMASYGFLISGPTLHLWFNFISKFFPKKDVVNTLKKMFLGQAVYGPIINSVFFSYNAGLQGETVPEIIARLKRDLVPTIKSGLLYWPTCDFITFKFVPVHLQPLVSNSFSFLWTIYITYMASLKKADVEVATST

SEQ ID NO: 6399 - DNA, 375 bp, Sorghum bicolor
  misc_feature: Ceres ANNOT ID no. 6066157
  misc_feature: Encodes the peptide sequence at SEQ ID NO 6400
atggagaagagccgggtgctggtggtgggcggcaccgggttcatcggccggcggatcgtgcgggcgagcctggcggaggggcacccgacgctggtcctgatgcggccggagatcggcctggacatcgacaagctccagatgctgctctctttcaaggcgcagggcgcgcggctggtggaggcgtcgctggaggaccacgcggcgctcgtcgccgccgtggcgcaggccgacgtggtgatctcggccatgtccggcgtgcacttccgcagccacaacctctccctgcagcataggctcgtcgaggctatcaaggaggccggcaacatcaagattttccatcacatcgaatctttaaacgtatgcatgaagtattaa

SEQ ID NO: 6400 - protein, 124 aa, Sorghum bicolor
  misc_feature: Ceres ANNOT ID no. 6066157
  misc_feature (6)..(125): Pfam Id: NmrA Pfam Desc: NmrA-like family
  misc_feature (1)..(112): NCBI GI: 115488076 NCBI Desc: os12g0263200 [oryza sativa (japonica cultivar-group)]
  misc_feature (1)..(112): NCBI GI: 76559886 NCBI Desc: tpa: isoflavone reductase-like protein 1 [vitis vinifera]
  misc_feature (1)..(112): NCBI GI: 116077988 NCBI Desc: pinoresinol-lariciresinol reductase homolog [lotus japonicus]
  misc_feature (1)..(112): NCBI GI: 1230614 NCBI Desc: isoflavone reductase-like protein
  misc_feature (3)..(112): NCBI GI: 116077990 NCBI Desc: pinoresinol-lariciresinol reductase homolog [lotus japonicus]
MEKSRVLVVGGTGFIGRRIVRASLAEGHPTLVLMRPEIGLDIDKLQMLLSFKAQGARLVEASLEDHAALVAAVAQADVVISAMSGVHFRSHNLSLQHRLVEAIKEAGNIKIFHHIESLNVCMKY

SEQ ID NO: 6401 - DNA, 945 bp, Sorghum bicolor
  misc_feature: Ceres ANNOT ID no. 6066161
  misc_feature: Encodes the peptide sequence at SEQ ID NO 6402
atggagaagagccgggtgctggtggtgggcggcaccgggtacatcggccggcggatcgtgcgggcgagcctggcggagggtcacccgacgctggtcctcatgcggccggagatcggcctggacatcgacaagctccagatgctgctctccttcaaggcgcagggcgcgcggctggtggaggcgtcgctggaggaccacgcggcgctcgtcgccgccgtggcgcaggccgacgtggtgatctcggcctcggccatgtccggggtgcacctccacagccacaacctctccttgcagcatcagctcgtcgaggctatcaaggaggctgggaacgtcaagcgttttataccatcagaattcggcatggatccatccaagatggggcatgctcttgaaccaggaaggattacatttgatgaaaagatggagctaagacgggcaattgaagaggccaacattccccacacctatgtttctgccaattgctttgctggttacttttgcccaaacctatgtcaaatgggcacccttttgccacccaaagagaaagttctcatttatggagacggcaatgttaaagttatattttgtgatgaagacgatgttgcaacatatacagtgaagtctgttgatgatcctcgcgcattgaacaagacaatatacttaagaccaccagaaaacattttgactcaaaatgatgttatctcaaaatgggaaaacctttctggaaatgttcttgagaaaatccacattcctatagatgaattcttggcttcaatgaaagatactaacttcgccaatcaagtcgttgtgggacacttttaccatattttctatgaaggttgcttgacaaattttgaaattggcgatgacggagcagaggctactctattgtacccggaggttcagtatactcgcatgggtgagtacatgaaaaaatatctgtaa

SEQ ID NO: 6402 - protein, 314 aa, Sorghum bicolor
  misc_feature: Ceres ANNOT ID no. 6066161
  misc_feature (6)..(305): Pfam Id: NmrA Pfam Desc: NmrA-like family
  misc_feature (6)..(214): Pfam Id: Epimerase Pfam Desc: NAD dependent epimerase/dehydratase family
  misc_feature (1)..(314): NCBI GI: 115488076 NCBI Desc: os12g0263200 [oryza sativa (japonica cultivar-group)]
  misc_feature (1)..(314): NCBI GI: 76559886 NCBI Desc: tpa: isoflavone reductase-like protein 1 [vitis vinifera]
  misc_feature (1)..(314): NCBI GI: 1230614 NCBI Desc: isoflavone reductase-like protein
  misc_feature (3)..(314): NCBI GI: 116077990 NCBI Desc: pinoresinol-lariciresinol reductase homolog [lotus japonicus]
  misc_feature (1)..(314): NCBI GI: 116077988 NCBI Desc: pinoresinol-lariciresinol reductase homolog [lotus japonicus]
MEKSRVLVVGGTGYIGRRIVRASLAEGHPTLVLMRPEIGLDIDKLQMLLSFKAQGARLVEASLEDHAALVAAVAQADVVISASAMSGVHLHSHNLSLQHQLVEAIKEAGNVKRFIPSEFGMDPSKMGHALEPGRITFDEKMELRRAIEEANIPHTYVSANCFAGYFCPNLCQMGTLLPPKEKVLIYGDGNVKVIFCDEDDVATYTVKSVDDPRALNKTIYLRPPENILTQNDVISKWENLSGNVLEKIHIPIDEFLASMKDTNFANQVVVGHFYHIFYEGCLTNFEIGDDGAEATLLYPEVQYTRMGEYMKKYL

SEQ ID NO: 6403 - DNA, 1200 bp, Sorghum bicolor
  misc_feature: Ceres ANNOT ID no. 6066200
  misc_feature: Encodes the peptide sequence at SEQ ID NO 6404
atgcccgtcgccgtggaggacaggggcggcgccgtggcgctgatgctggcgtccctcttcctcctgggcacatggccggctctcctgacgctgctggagcgcagaggccggctgcctcagcacacctacctcgactactccatcaccaacctcgtcgccggcgtcctgatggccgtcgcgcttgggcaggctggagatagcaggccagacttcttcactcagctcacccagatgcaggacaattggccttcagtcctaatcgcaatggccggtggcctcgccctcagtcttgggaacctggtctcgcagtacgcatgggcgtttgccggcctgtcagtgacaaacgtcatctgctcaagcatgacagtcgtttcaggcacgaccataaattattttctcgatggtcgtatcaatcgagccgagatactcttcccgggtgtcgtgtgcttcctcgtggcggtgttccttggtgcagccgtccattcttccaatgccaatgatgatgaacagaagctaagcatgtcagacagaagagtgcagacatcgagctcagcaatgacttttcagacaaaggttgaggagagacggtcaatcaaggtccttggccatagcaagttgctaggcctcggtctcgttttctttgccggggcctgcttttcactcttctcaccagcgatcaacctggccaccaacgaccagtggcatgccctgaggaagggtgtcccgcacctggtgatctacaccgccttcttctacttctcgttgtcatgtttcgtgctcggcgcctgcctcaacgtctggcttctgtatcaccccatggcgggagtgccagcatcgaccgccggagcatacgccagggactggaacggcaggcattgggcccttctagcagggctgctctgtggttgtggcaacggttttcagttcatgggcggccaggctgctgggtatgctgctgctgatgcagtccaggcgctgccgcttgtaagcacattttggggtgtcatcctcttcggggaataccggaggtcctcgagaaagacgtacttgttactctcgtccatgctgttgatgttcatcatcgctgttgcagttttcatggcttcagcagggcataggaagggatttgataccaatgctagattcattgtaaccagattgaacagaagttcagtttatcaagacagtatgcacagctag

SEQ ID NO: 6404 - protein, 399 aa, Sorghum bicolor
  misc_feature: Ceres ANNOT ID no. 6066200
  misc_feature (15)..(324): Pfam Id: FAE_3-kCoA_syn1 Pfam Desc: Fatty acid elongase 3-ketoacyl-CoA synthase 1
  misc_feature (167)..(373): NCBI GI: 77555848 NCBI Desc: allantoin permease [oryza sativa (japonica cultivar-group)]
  misc_feature (188)..(374): NCBI GI: 68566151 NCBI Desc: ureide permease 2 (atups2)
  misc_feature (168)..(378): NCBI GI: 42558472 NCBI Desc: allantoin permease [phaseolus vulgaris]
  misc_feature (164)..(374): NCBI GI: 77555851 NCBI Desc: allantoin permease [oryza sativa (japonica cultivar-group)]
  misc_feature (5)..(197): NCBI GI: 68846998 NCBI Desc: probable ureide permease a3 (vua3)
MPVAVEDRGGAVALMLASLFLLGTWPALLTLLERRGRLPQHTYLDYSITNLVAGVLMAVALGQAGDSRPDFFTQLTQMQDNWPSVLIAMAGGLALSLGNLVSQYAWAFAGLSVTNVICSSMTVVSGTTINYFLDGRINRAEILFPGVVCFLVAVFLGAAVHSSNANDDEQKLSMSDRRVQTSSSAMTFQTKVEERRSIKVLGHSKLLGLGLVFFAGACFSLFSPAINLATNDQWHALRKGVPHLVIYTAFFYFSLSCFVLGACLNVWLLYHPMAGVPASTAGAYARDWNGRHWALLAGLLCGCGNGFQFMGGQAAGYAAADAVQALPLVSTFWGVILFGEYRRSSRKTYLLLSSMLLMFIIAVAVFMASAGHRKGFDTNARFIVTRLNRSSVYQDSMHS

SEQ ID NO: 6405 - DNA, 1275 bp, Sorghum bicolor
  misc_feature: Ceres ANNOT ID no. 6066238
  misc_feature: Encodes the peptide sequence at SEQ ID NO 6406
  misc_feature: Down-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
atgtacctggtgaaggacattagcggcgccatcgggctgatggcggtggcgttggtgctcctgggcacctggccggttgtcctggcggtgctagagcggcggggccggctgccgcagcacacgttccttgacttctccgtcaccaacttcctggccgccgtgctcgtcgcgctcaccttcggccagatcggccccgacacgccggagacgcccaacttcctcacccagctcgctcaggttcagaacaactggccttcggtgttgttcgcgatggcgggcggcgtcaccctcagcctggggacacttgccacgcagtacggctgggcgttcgtcggcctttccgtcactgaagtcatggcctcaagcctcaaggtcgttatagggacgacgctcaactatttcctcgacggccggatcaacaaggcagagatcctcttccccggtgtcggctgcttcctgattgcggccatccttgggtcacttgtccacgcttccaatgccgccgacaaccaggaaaagctggcaaactccttggcgaagtacagcaaaaatacaaggaagaacactgcagacgatgaggatctcaccaaacacctccttaacaaagagataccaaaggatccagaagctgcaaagccggatgcagcagatcaggctactgaggccccggagaaagtagaggcaggaacggcagagttcctggttaacctggaggagaagagatcgattaaagtgctgggttcgcacacgctgctgggcctcgggatcgtggtgttcgcgggcgtcttctacgcgctgttcgcgccggcgctgaacctgtcgaccaacgaccagtggcacgcgctccccgccggcgtgccgcacctggtggtgtacacggcctacttctacttctccctcgcctgcctcgccgtcagcgcggcgctcaacgtgtggctcctgtaccggcccatcatggccggcgtgccggcgagctccaccgtgtccgcgtacctccgggacggcggcgagggcagggcgcccgcgatgctggcggggatggtgtgcgggctcgggaacgccttcacgttcatggcggggcaggcggccgggtacgccgccgccgactccgtgcaggcgctgccgctcgtcagcaccttctggggcgtcgtgctgttcggcgagtaccgccggtcgtcaagacgcacgtacacgctgctggccagcatgctgctcatgttcaccgtcgccatggtcctcctcatggcttcctccaaccacaggaagccgctctga

SEQ ID NO: 6406 - protein, 424 aa, Sorghum bicolor
  misc_feature: Ceres ANNOT ID no. 6066238
  misc_feature (14)..(372): Pfam Id: FAE_3-kCoA_syn1 Pfam Desc: Fatty acid elongase 3-ketoacyl-CoA synthase 1
  misc_feature (1)..(424): NCBI GI: 77555851 NCBI Desc: allantoin permease [oryza sativa (japonica cultivar-group)]
  misc_feature (1)..(378): NCBI GI: 77555852 NCBI Desc: allantoin permease [oryza sativa (japonica cultivar-group)]
  misc_feature (1)..(421): NCBI GI: 77555848 NCBI Desc: allantoin permease [oryza sativa (japonica cultivar-group)]
  misc_feature (1)..(210): NCBI GI: 68566151 NCBI Desc: ureide permease 2 (atups2)
  misc_feature (224)..(422): NCBI GI: 21592615 NCBI Desc: fatty acid elongase 3-ketoacyl-coa synthase 1 [arabidopsis thaliana]
  misc_feature: Down-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
MYLVKDISGAIGLMAVALVLLGTWPVVLAVLERRGRLPQHTFLDFSVTNFLAAVLVALTFGQIGPDTPETPNFLTQLAQVQNNWPSVLFAMAGGVTLSLGTLATQYGWAFVGLSVTEVMASSLKVVIGTTLNYFLDGRINKAEILFPGVGCFLIAAILGSLVHASNAADNQEKLANSLAKYSKNTRKNTADDEDLTKHLLNKEIPKDPEAAKPDAADQATEAPEKVEAGTAEFLVNLEEKRSIKVLGSHTLLGLGIVVFAGVFYALFAPALNLSTNDQWHALPAGVPHLVVYTAYFYFSLACLAVSAALNVWLLYRPIMAGVPASSTVSAYLRDGGEGRAPAMLAGMVCGLGNAFTFMAGQAAGYAAADSVQALPLVSTFWGVVLFGEYRRSSRRTYTLLASMLLMFTVAMVLLMASSNHRKPL

SEQ ID NO: 6407 - DNA, 1344 bp, Sorghum bicolor
  misc_feature: Ceres ANNOT ID no. 6066346
  misc_feature: Encodes the peptide sequence at SEQ ID NO 6408
atggaacatgttctcgcatgtgcgtcttctctgctcagttgccacaaggtgctccaagaagaagaaggagggcctctactactactgtcgtccatcagagccaggctcagcatgtacgtgatcgaggacaagggcggcgccatcgcgctgatgctggcgtcgctgctgttcctgggcacctggccggcggtgctcacgctgctggagcgccggggccggctgccgcagcacacgtacctggactactccctcaccaacctcctcgccgccgtgctcatcgcgctcaccttcggacagctcggggacagcaagcgcggcatgcccaacttcttcacgcagctgagccaggacaactggccgtcggtgctcttcgccatggccggaggcgtcgtgctcagcgtcgggaacctctccacgcagtatgcctgggcgtatgtgggcctctccgtcactgaggtcatcagctccagcatggtcgtggtcattggcacgacactgaactacttcctggacaaccgcatcaacagggcagagattctgttccctggtgtggcatgcttccttgtcgctgtcatccttggctctgctgtccatgcctccaatgcagctgacaatgagaagaaactcagtggctccacaaatgccaacaaacttgggacaagtggaactgtggaaccaagcaaacaagtcctagacaaagatgctcccaaggatttggagaatggagcctctggagccaagcaagttgacagagctgaggcaggcactgcagaatacctcattgaactcgaagaacggcgatcaatcaaggtcttcggttcaaacaccttcatcggtctggggatcgtcttcttcgcgggggtgtgcttctcgctcttctcgccggcgttcaaccttgccaccaacgaccaatggcacaccctcaaggacggcgtgccgcacctggtggtgtacacggccttcttctacttctccatctcgtgcttcgtcatcggcgtcggcctcaacatcctcttcctctaccgccccatggccggcgtgccccggtcctccttcggcgcctacctcagggactggaacggccggcagtgggcgctcctcgccggcctgctctgcggcttcggcaacggtttccagttcatgggcggccaagccgcaggctacgccgccgccgacgctgtccaggcgctgccgctcgtcagcaccttctggggcgtcctgctcttcggggagtaccgcaagtcgtcccggaagacatacgtcctgctgggtttcatgctcttcatgttcgtcgccgccgtcgccgtgctcatggcttcgtcaggtcacaggagcaccgagtga

SEQ ID NO: 6408 - protein, 447 aa, Sorghum bicolor
  misc_feature: Ceres ANNOT ID no. 6066346
  misc_feature (51)..(395): Pfam Id: FAE_3-kCoA_syn1 Pfam Desc: Fatty acid elongase 3-ketoacyl-CoA synthase 1
  misc_feature (38)..(447): NCBI GI: 77555848 NCBI Desc: allantoin permease [oryza sativa (japonica cultivar-group)]
  misc_feature (38)..(444): NCBI GI: 68566151 NCBI Desc: ureide permease 2 (atups2)
  misc_feature (38)..(446): NCBI GI: 42558472 NCBI Desc: allantoin permease [phaseolus vulgaris]
  misc_feature (38)..(444): NCBI GI: 77555851 NCBI Desc: allantoin permease [oryza sativa (japonica cultivar-group)]
  misc_feature (38)..(444): NCBI GI: 68566150 NCBI Desc: ureide permease 4 (atups4)
MEHVLACASSLLSCHKVLQEEEGGPLLLLSSIRARLSMYVIEDKGGAIALMLASLLFLGTWPAVLTLLERRGRLPQHTYLDYSLTNLLAAVLIALTFGQLGDSKRGMPNFFTQLSQDNWPSVLFAMAGGVVLSVGNLSTQYAWAYVGLSVTEVISSSMVVVIGTTLNYFLDNRINRAEILFPGVACFLVAVILGSAVHASNAADNEKKLSGSTNANKLGTSGTVEPSKQVLDKDAPKDLENGASGAKQVDRAEAGTAEYLIELEERRSIKVFGSNTFIGLGIVFFAGVCFSLFSPAFNLATNDQWHTLKDGVPHLVVYTAFFYFSISCFVIGVGLNILFLYRPMAGVPRSSFGAYLRDWNGRQWALLAGLLCGFGNGFQFMGGQAAGYAAADAVQALPLVSTFWGVLLFGEYRKSSRKTYVLLGFMLFMFVAAVAVLMASSGHRSTE

SEQ ID NO: 6409 - DNA, 2184 bp, Sorghum bicolor
  misc_feature: Ceres ANNOT ID no. 6066371
  misc_feature: Encodes the peptide sequence at SEQ ID NO 6410
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
atgggctcggtagccggcgacaccgccgcccgactcgcgtacccgccggcccgccgcgacgattccgtcgtcgacgactaccacggcgttcggatcgcggatccctatcgctggctggaggacccggactcggaggagacgaaggagttcgtggcgcggcaggcggagctggcggagacggtgctcgccgggtgccccgacagggagaacctgcgccgcgaggtcacgcggctcttcgaccacccgcgccacgccgcgccgttccgccgcgggaacaagtacttccacttccacaacaccggcctccaggcccagagcgtgctctacatgcaggatgatttggacgggaaggaagaggttcttttggatccaaatactctaagcaaggatggaacaattgctctttcaacatattctattagcaaggatggaaactacattgcttatgggctaagtgaaagtggtagtgattgggtctctattcatgtgaagagcatcactaacaagcagcctatgcctgataaattgtcctgggtaaagttctcatctatcagctggactcatgacgggaaaggttttttctatggtcggtatccagcacctagaggaggggaagtggatgctggaactgagacaaacatcaatcttaatcatcagatatattaccatgttttgggatctgatcagtcagaggatgtattgtgctggaaagatcctgaacacccaaagtatacctttggtgcttcagtcactgaagatggaaagtacatcatattgggcatctatgaaggttgtgaccctgtcaacaaattatactattgtgaaatttcttctcttcctcgaggaatagagggcttcagagagacacaggaattacttccatttgtcaagcttattgacaattttgatgctcaatatgaagttgtggccaatgatggtgatgaatttacatttttgaccaataaaagtgcccctaagaataagctggtaagggtaaatatcaaaaacccagagctgtggacagatgttcttccagagcatgaaaaagatgtgctcgagtcagccgacgccgttaacaataaccaactgttggtgtgttatatgtcagatgttaagcatattctgcagataagagaccttagaactggaaactttattcatcagttgcctctggagattggtgctgtttcagagatctcgtgcagacgggaagacaaggaagtatttattggcttcacaagctttctttctccaggcattattttcaggtgtaacttagcacctaccatccctgaaatgaagatgtttcgagaaatttcagttcctggatttgatcgcacaagttttgaagttaagcaggtttttgtccctagcaaggatggaaccataattcccatgttcataatgtcaaagaaagatatcaatcttaatggatcgcatccaactttgctatatggttatggaggattcaacataagcataacaccttcattcagtgttagtcgtgttgtgctatgcaagaacatgggtttcgttgtctgtgtagcaaacattcgaggtggtggagagtacggggaggagtggcacaaagctggagcacttgcaatgaaacaaaattgttttgatgactttgctgcctgcggggaattcctcatttctagtggttacaccagttccaatcgtttatgtattgaaggcggaagcaatggtggtcttctggttgctgcttctgttaatcagaggcctgatctcttcgggtgtgctctcgctcatgttggcgtcatggacatgctccgttttcacaagtttacaattggtcatgcctggactacagactatggttgttcagataaggaagaagagttccagtggctcattaaatattctccccttcataatgtacggagaccttgggagcaaagctctggtaaccactgccagtatccagcaaccatgttgttgacagctgatcatgatgatcgcgttgtgccgttgcattcactgaagttattacatgtcctgtgtaccagcactgaggacatcctgcagacaaatccaataattggtcgcattgaccggaagtcagggcatggagctggcaggccaactcaaaaactgattgatgaagctgcagacagatatagctttatggcaaagatgttaggggcatcgtggactgaatag

SEQ ID NO: 6410 - protein, 727 aa, Sorghum bicolor
  misc_feature: Ceres ANNOT ID no. 6066371
  misc_feature (14)..(437): Pfam Id: Peptidase_S9_N Pfam Desc: Prolyl oligopeptidase, N-terminal beta-propeller domain
  misc_feature (496)..(724): Pfam Id: Peptidase_S9 Pfam Desc: Prolyl oligopeptidase family
  misc_feature (3)..(727): NCBI GI: 79382269 NCBI Desc: prolyl oligopeptidase/ serine-type endopeptidase/ serine-type peptidase [arabidopsis thaliana]
  misc_feature (1)..(727): NCBI GI: 9558588 NCBI Desc: contains similarity to a rpop protein from rattus norvegicus gi3043760 and is a member of the prolyl oligopeptidase family pf00326. ests gbaa651190, gbh36145 come from this gene.
  misc_feature (1)..(727): NCBI GI: 9558588 (continued) [arabidopsis thaliana]
  misc_feature (1)..(727): NCBI GI: 38345850 NCBI Desc: osjnba0084k11.14 [oryza sativa (japonica cultivar-group)]
  misc_feature (3)..(580): NCBI GI: 6573707 NCBI Desc: t23e18.7 [arabidopsis thaliana]
  misc_feature (11)..(727): NCBI GI: 47507507 NCBI Desc: prep protein [xenopus laevis]
  misc_feature (14)..(727): SWISSPROT Homolog: EC 3.4.21.26 Prolyl endopeptidase
  misc_feature: Down-regulated in shoot tissues in response to aminocyclopropane carboxylic treatment
  misc_feature: Down-regulated in shoot tissues in response to methyl jasmonate treatment
  misc_feature: Down-regulated in shoot tissues in response to salicylic acid treatment
MGSVAGDTAARLAYPPARRDDSVVDDYHGVRIADPYRWLEDPDSEETKEFVARQAELAETVLAGCPDRENLRREVTRLFDHPRHAAPFRRGNKYFHFHNTGLQAQSVLYMQDDLDGKEEVLLDPNTLSKDGTIALSTYSISKDGNYIAYGLSESGSDWVSIHVKSITNKQPMPDKLSWVKFSSISWTHDGKGFFYGRYPAPRGGEVDAGTETNINLNHQIYYHVLGSDQSEDVLCWKDPEHPKYTFGASVTEDGKYIILGIYEGCDPVNKLYYCEISSLPRGIEGFRETQELLPFVKLIDNFDAQYEVVANDGDEFTFLTNKSAPKNKLVRVNIKNPELWTDVLPEHEKDVLESADAVNNNQLLVCYMSDVKHILQIRDLRTGNFIHQLPLEIGAVSEISCRREDKEVFIGFTSFLSPGIIFRCNLAPTIPEMKMFREISVPGFDRTSFEVKQVFVPSKDGTIIPMFIMSKKDINLNGSHPTLLYGYGGFNISITPSFSVSRVVLCKNMGFVVCVANIRGGGEYGEEWHKAGALAMKQNCFDDFAACGEFLISSGYTSSNRLCIEGGSNGGLLVAASVNQRPDLFGCALAHVGVMDMLRFHKFTIGHAWTTDYGCSDKEEEFQWLIKYSPLHNVRRPWEQSSGNHCQYPATMLLTADHDDRVVPLHSLKLLHVLCTSTEDILQTNPIIGRIDRKSGHGAGRPTQKLIDEAADRYSFMAKMLGASWTE

SEQ ID NO: 6411 - DNA, 705 bp, Sorghum bicolor
  misc_feature: Ceres ANNOT ID no. 6066448
  misc_feature: Encodes the peptide sequence at SEQ ID NO 6412
atggctgccgtgggcatcacctcccctccggcgccagcgccacacgccctcgcgcccgccgcatctccttccgcttcctcatactccacgctgggcctccgccgtctccgcctctcgccccgtctcgccgccggcggggcgtcgttccgcgcgcggcggtgcgccgccgctgccgacgctggggccgcggcctcggagggcgcctctgcagtggcggaccccgacgcgggcacagacgttgccggaggcgccgcgacctccacgcggccgccctactcgatcatctccgcggacaacgtgcagaaggcgatgcgcggcctcgcaattacagatgctgatcactatgggagacttggagtcaccaggctagcttctaccgatgaggtaaaagctgcttacgagaagaagtgtgaagaactaaatagcaaagaactagaagaagaggagcttcacaaggaatatgacctcataaaggaatcatttaccatactatcaaccgaggaagagcgaagattatatgattggagcttgtcaagaagtggacagcctgagcgatatgtgtggccatttcaagttgatcctttggagatggcaccagatcctccacaggaaccagaagatgagttaccaaccaagctcgttggctacttcttgctggcgtggttcatactctccgttgctttgtcagtgaccctcaacaaataa

SEQ ID NO: 6412 - protein, 234 aa, Sorghum bicolor
  misc_feature: Ceres ANNOT ID no. 6066448
  misc_feature (113)..(174): Pfam Id: DnaJ Pfam Desc: DnaJ domain
  misc_feature (1)..(158): NCBI GI: 115488650 NCBI Desc: os12g0498500 [oryza sativa (japonica cultivar-group)]
  misc_feature (62)..(234): NCBI GI: 29294046 NCBI Desc: dnaj domain family [arabidopsis thaliana]
  misc_feature (62)..(234): NCBI GI: 79328339 NCBI Desc: heat shock protein binding / unfolded protein binding [arabidopsis thaliana]
  misc_feature (113)..(184): NCBI GI: 83757135 NCBI Desc: dnaj domain protein [salinibacter ruber]
  misc_feature (81)..(183): NCBI GI: 68129708 NCBI Desc: dnaj protein-like protein [leishmania major]
MAAVGITSPPAPAPHALAPAASPSASSYSTLGLRRLRLSPRLAAGGASFRARRCAAAADAGAAASEGASAVADPDAGTDVAGGAATSTRPPYSIISADNVQKAMRGLAITDADHYGRLGVTRLASTDEVKAAYEKKCEELNSKELEEEELHKEYDLIKESFTILSTEEERRLYDWSLSRSGQPERYVWPFQVDPLEMAPDPPQEPEDELPTKLVGYFLLAWFILSVALSVTLNK

SEQ ID NO: 6413 - DNA, 1101 bp, Sorghum bicolor
  misc_feature: Ceres ANNOT ID no. 6066490
  misc_feature: Encodes the peptide sequence at SEQ ID NO 6414
atggagcccgacgccgcccaaaaccctagccccgtcccgccgcccatctccgcctactaccagacgcgcgcggagcaccacgccgtcgtctccagcgactggctcgcgcacgcggccgccgccgccgccgccttcccgggcgccgatgccgccgacgcggccgcccagccgcccacgccgtcgtcccccggggccgccggcggcgtcatcgaggagttcaacttctggcgccgcaagcccgaggccgcggaggcggtggccgccatcatggcgctcgccgccgtcatccgctccagcagggccaccaccatgatggagctcgagatcgagctcaagaaggcgtctgataagctcaagtcctgggatgctacatccatttctctttctgctgcttgtgatttgttcatgcggtttgtaacaaggacctcacatctggagcatgagaaatttgatgcagcaaagtcacgcctaattgagcgaggagaaaaatttggagagatatctttaaaggctcgcaagacaattgcaatgcttagccaggatttcatttatgatgggtgtactatacttgtccatgggtattccagggtagtattggaagttctaaagcttgctgcatccaatcgcaagctcttccgggtactgtgcacagagggcaggccagacagaactggtttaagaatgtcaaatgaacttgcagcattaggcatccctgttaaggttctaattgattcagctgttgcttattctatggatgaagttgacatggtatttgttggtgccgatggggttgttgagagtggaggcataatcaatatgatgggcacttatcagatagctcttgtggctcatagtatgaacaaacctgtttatgtggcagctgaaagttacaagtttgctcggctatatcccttggatcaaaaggacatgacaccagctcaccgaccaatagattttggagtcccagtacccactggtgtggaagtggagacgtctgcaagagactacacacctccccaatatctcacacttctcctgacagatcttggtgttctgacgccttctgttgttagtgatgagctcatccaattgtatctatga

SEQ ID NO: 6414 - protein, 366 aa, Sorghum bicolor
  misc_feature: Ceres ANNOT ID no. 6066490
  misc_feature (77)..(354): Pfam Id: IF-2B Pfam Desc: Initiation factor 2 subunit family
  misc_feature (92)..(366): NCBI GI: 115488640 NCBI Desc: os12g0497400 [oryza sativa (japonica cultivar-group)]
  misc_feature (3)..(366): NCBI GI: 79365631 NCBI Desc: gtp binding / translation initiation factor [arabidopsis thaliana]
  misc_feature (5)..(366): NCBI GI: 6056397 NCBI Desc: similar to initiation factor 2 subunit [arabidopsis thaliana]
  misc_feature (1)..(366): NCBI GI: 140072136 NCBI Desc: initiation factor 2b related [medicago truncatula]
  misc_feature (69)..(365): NCBI GI: 60464888 NCBI Desc: translation initiation factor eif-2b alpha subunit [dictyostelium discoideum]
MEPDAAQNPSPVPPPISAYYQTRAEHHAVVSSDWLAHAAAAAAAFPGADAADAAAQPPTPSSPGAAGGVIEEFNFWRRKPEAAEAVAAIMALAAVIRSSRATTMMELEIELKKASDKLKSWDATSISLSAACDLFMRFVTRTSHLEHEKFDAAKSRLIERGEKFGEISLKARKTIAMLSQDFIYDGCTILVHGYSRVVLEVLKLAASNRKLFRVLCTEGRPDRTGLRMSNELAALGIPVKVLIDSAVAYSMDEVDMVFVGADGVVESGGIINMMGTYQIALVAHSMNKPVYVAAESYKFARLYPLDQKDMTPAHRPIDFGVPVPTGVEVETSARDYTPPQYLTLLLTDLGVLTPSVVSDELIQLYL

SEQ ID NO: 6415 - DNA, 561 bp, Sorghum bicolor
  misc_feature: Ceres ANNOT ID no. 6066600
  misc_feature: Encodes the peptide sequence at SEQ ID NO 6416
atgcagcagccgatgcccatgcagccgcaggcgccggcgatgaccccggccgccggaatcaccacggagcagatccaaaagtatctggatgagaataagcagcttattttggctattttggaaaatcagaacctaggaaaattggcagaatgtgctcagtatcaatcacaacttcagaagaacctcttgtatctcgctgcaatcgcagatgcccaaccacagactgctgtaagccgccctcagatggcgccgcctggtgcattgcctggagtagggcagtacatgtcacaggtgcctatgttcccaccaaggacacctctcacaccccaacagatgcaggagcagcaacttcagcagcagcaggctcagttgctaaatttcagtggccagatggttgctagacctggcatggtcaacggcatgcctcagtccattcaagctcaacaagctcagccatcaccagcattgaacaaacaggatgctggtggagtcgcctcagagccctcgggcactgagagccacaggagcactggtggtgataatgatggtggaagcgactag

SEQ ID NO: 6416 - protein, 186 aa, Sorghum bicolor
  misc_feature: Ceres ANNOT ID no. 6066600
  misc_feature (17)..(84): Pfam Id: SSXT Pfam Desc: SSXT protein (N-terminal region)
  misc_feature (2)..(183): NCBI GI: 21539892 NCBI Desc: grf1-interacting factor 2 [arabidopsis thaliana]
  misc_feature (1)..(97): NCBI GI: 21539894 NCBI Desc: grf1-interacting factor 3 [arabidopsis thaliana]
  misc_feature (1)..(97): NCBI GI: 7267424 NCBI Desc: at4g00850 [arabidopsis thaliana]
  misc_feature (11)..(181): NCBI GI: 28278585 NCBI Desc: ss18-prov protein [xenopus laevis]
  misc_feature (11)..(181): NCBI GI: 64654314 NCBI Desc: ss18 protein [homo sapiens]
MQQPMPMQPQAPAMTPAAGITTEQIQKYLDENKQLILAILENQNLGKLAECAQYQSQLQKNLLYLAAIADAQPQTAVSRPQMAPPGALPGVGQYMSQVPMFPPRTPLTPQQMQEQQLQQQQAQLLNFSGQMVARPGMVNGMPQSIQAQQAQPSPALNKQDAGGVASEPSGTESHRSTGGDNDGGSD

SEQ ID NO: 6417 - DNA, 2961 bp, Sorghum bicolor
  misc_feature: Ceres ANNOT ID no. 6066623
  misc_feature: Encodes the peptide sequence at SEQ ID NO 6418
  misc_feature: Down-regulated in shoot tissues in response to salicylic acid treatment
atgaggatcatgatcaagggaggcgtgtggaagaacacggaggatgagatcctcaaggcggccgtgatgaagtacggcaagaaccagtgggctcgcatctcgtcgctgctcgtccgcaagtccgccaagcagtgcaaggcccgctggtacgagtggctcgacccgtcaatcaagaagactgagtggacaagggaagaggatgagaagctacttcatcttgctaaactcatgcctactcagtggaggacaattgcacctattgtaggtcgaacaccatctcagtgtcttgaacgttatgaaaaattgcttgatgctgcatgtgcaaaggatgaaaattatgaggctaatgatgaccctaggaagctgcggcctggtgaaattgacccaaaccctgagtcaaagcctgcacgtcctgatcctgttgatatggatgaagatgaaaaagaaatgctttctgaggctagggctcgcttagctaacactaggggtaaaaaggcaaaacggaaggcaagagagaaacaacttgaagaggcaagacggcttgcctcactacaaaaaaggagagagttgaaggcggctggtattgatacacgccacagaaaaagaaagagaaaggggattgactacaatgccgagatcccatttgaaaagagaccacctccaggtttttatgacactgttggtgaagacaggccacttgaacatgtgcagtttccaacaaccattgaggagcttgaagggaagagaagagcagatatagaggcacagttaagaaaacaagatattgccaggaacaagatcctgcagcgacaggatgcccctgctgctataatgcaagctaataaactaaatgacccagaagctgtcacaaagaggtcaaagctaatgctgccgcctccccaaatttctgaccatgagttagaggagatagcaaagatgggcagtgctggtgatcctgctttagctgatgagcttggtgaaggaagtactgccacaagaactttgcttgccagctattctcagactccaagacttggtatgacaccattgcgaactccgcaacgaactccagctgggaagggtgatgcaattatgatggaggcagaaaatcttgcacgtcttagagaatcacaaacacctctgttaggaggtgacaacccagagcttcatccatcagatttctctggtgttacaccacgtaaggagatacagacaccaaatccaatggcaacacctttggcaagccctggacctggtgttactccaaggattggtatgactccatctagagaggggcacagctttggtttaacaccaagaggaactccttttcgtgatgaactgcgcataaatgaagaagtggaaatgcaggacagcactaaacttgagcttcgtaggcaagctgaactgaaaaaaagcctgcgatctggttttgcttctattccacagccaaggaacgagtaccagatagtcatgccacctattacagaggatgaggcagaagaagctgaagagaaaattgaagaggacatgtcagacagactggcacgagaaagggctgaggaacaagctaggcaggaggcattgctcagaaagagatccaaagtgttgcagaggagtctgcctaggccgcctgctgcttcagtagaaattatccggcaatctcttattagaagcggagaaagcagaagcagaagcacctttgtgcctcctacatcacttgaacaagctgatgaactaataaatgaggagctccttaggcttcttgagcatgataatgcaaaatatcctcttgatgaaaaaactcaaaaagagaaaaagaaagggaagcgtcagcaaaatgggggagctcttgtccctgaaattgatgattttgatgaagatgaactaaaagaggctagttctatggttgaagaggagattcaatatcttcgagtggccatgggtcatgaaaatgaatcttttgaggactttgtgaaagcacatgatgcatgccaagaggaccttatgttttttcctactaacaatagctatggtttagctagtgttgctggaaatgctgataagatttctgctttgcaaaatgagtttgaaactgtgaagaagcgaatggatgatgaagctaagaaggcttctcggcttgagcagaagattaagcttctgacacaaggatatcaggtacgggctggaaaactgtggtcacaggtccaagatacattcaagcaaatggacactgctgcaacagaactcgagtgcttccaagagctgcagaaacaggaacatcttgctgcttcgtatcgaatcctaaatttgactgaagaagtgaataaacagaaagcactagaaaggaccctccagagccgctatggtgagctggtttctggttttcagaggatacaagaacagcttgaggagcacaagaagcaactcaaggtacaggaggcaatagaagccgaaaatcgtgctcaggaagaggaagttgtggcaccgaatcatgctgctgttgaggaagaggatgaaaggaagcctctcagctctgacgagaaatcacagcagacaaatagagctactgatgaagaggctgcaggaagcaaggcaatcaccaaggatcagatggatgtggacagcgggaatgtagacggtggatttgtagggcctatcccaccagcaccagacactgaaggggataatgatgaggtatcagttcaagataacacttctaacaccgagagtagtgagtgtgcctccacgaatgatggcgctgacaagatcgatcaagccaagttagaaggtcaggataaagcagatgacagtatggctgctgatgctggccctcaggagggcaaggatgaacttgcacctgttggcgccagcataagtgaagaaaacaccactatatctttggatcaagctgtctcaaaggaggatgaaggcagtgctcctgagcgaagtattgtttga

SEQ ID NO: 6418 - protein, 986 aa, Sorghum bicolor
  misc_feature: Ceres ANNOT ID no. 6066623
  misc_feature (7)..(53): Pfam Id: Myb_DNA-binding Pfam Desc: Myb-like DNA-binding domain
  misc_feature (59)..(103): Pfam Id: Myb_DNA-binding Pfam Desc: Myb-like DNA-binding domain
  misc_feature (1)..(904): NCBI GI: 18092653 NCBI Desc: cdc5 protein [zea mays]
  misc_feature (1)..(982): NCBI GI: 38346500 NCBI Desc: osjnba0020i02.14 [oryza sativa (japonica cultivar-group)]
  misc_feature (1)..(982): NCBI GI: 116309281 NCBI Desc: osigba0130k07.8 [oryza sativa (indica cultivar-group)]
  misc_feature (1)..(727): NCBI GI: 115457842 NCBI Desc: os04g0348300 [oryza sativa (japonica cultivar-group)]
  misc_feature (1)..(839): NCBI GI: 1747310 NCBI Desc: myb-like dna binding protein [arabidopsis thaliana]
  misc_feature: The sequence is a functional homolog of SEQ ID NO 2260 in the 10/374,780US patent application
  misc_feature: The sequence is a functional homolog of SEQ ID NO 313 in the 11/479,226US patent application
  misc_feature: The sequence is a functional homolog of SEQ ID NO 804 in the 10/225,066US patent application
  misc_feature: Useful for making plants with modulated growth and phenotype characteristics
  misc_feature: The sequence is a functional homolog of SEQ ID NO 804 in the 20050160493 US patent application
  misc_feature: The sequence is a functional homolog of SEQ ID NO 2260 in the 10/374,780 US patent application
  misc_feature: The sequence is a functional homolog of SEQ ID NO 313 in the 11/479,226 US patent application
  misc_feature: The sequence is a functional homolog of SEQ ID NO 804 in the 10/225,066 US patent application
  misc_feature: Down-regulated in shoot tissues in response to salicylic acid treatment
  misc_feature: The sequence is a functional homolog of SEQ ID NO. 395 in the 11/188,298 US application
MRIMIKGGVWKNTEDEILKAAVMKYGKNQWARISSLLVRKSAKQCKARWYEWLDPSIKKTEWTREEDEKLLHLAKLMPTQWRTIAPIVGRTPSQCLERYEKLLDAACAKDENYEANDDPRKLRPGEIDPNPESKPARPDPVDMDEDEKEMLSEARARLANTRGKKAKRKAREKQLEEARRLASLQKRRELKAAGIDTRHRKRKRKGIDYNAEIPFEKRPPPGFYDTVGEDRPLEHVQFPTTIEELEGKRRADIEAQLRKQDIARNKILQRQDAPAAIMQANKLNDPEAVTKRSKLMLPPPQISDHELEEIAKMGSAGDPALADELGEGSTATRTLLASYSQTPRLGMTPLRTPQRTPAGKGDAIMMEAENLARLRESQTPLLGGDNPELHPSDFSGVTPRKEIQTPNPMATPLASPGPGVTPRIGMTPSREGHSFGLTPRGTPFRDELRINEEVEMQDSTKLELRRQAELKKSLRSGFASIPQPRNEYQIVMPPITEDEAEEAEEKIEEDMSDRLARERAEEQARQEALLRKRSKVLQRSLPRPPAASVEIIRQSLIRSGESRSRSTFVPPTSLEQADELINEELLRLLEHDNAKYPLDEKTQKEKKKGKRQQNGGALVPEIDDFDEDELKEASSMVEEEIQYLRVAMGHENESFEDFVKAHDACQEDLMFFPTNNSYGLASVAGNADKISALQNEFETVKKRMDDEAKKASRLEQKIKLLTQGYQVRAGKLWSQVQDTFKQMDTAATELECFQELQKQEHLAASYRILNLTEEVNKQKALERTLQSRYGELVSGFQRIQEQLEEHKKQLKVQEAIEAENRAQEEEVVAPNHAAVEEEDERKPLSSDEKSQQTNRATDEEAAGSKAITKDQMDVDSGNVDGGFVGPIPPAPDTEGDNDEVSVQDNTSNTESSECASTNDGADKIDQAKLEGQDKADDSMAADAGPQEGKDELAPVGASISEENTTISLDQAVSKEDEGSAPERSIV

SEQ ID NO: 6419 - DNA, 1116 bp, Sorghum bicolor
  misc_feature: Ceres ANNOT ID no. 6066757
  misc_feature: Encodes the peptide sequence at SEQ ID NO 6420
atggcctcccagctccgcctccacctcgcggccacaccacctctcctccttccgcaccgccgccgaccgcacctcccgcggccgctccgccccaccctaaacccaatccgagcgccgctccccgctctcccagtcccacgcgttctctcccacgctcgtcccgcctgggcggtcgggggaggcgtcgagccgaaggagggtgttgtcgcggagggggaggcgtctggcggggaggagcccctgctcgtgggggaggattccgctgcgttcgagctcaaggaccagagcatggcgtcgtgggcttacttcgccgttatacttgccgcggtgctcgttgcgctcaacgtgctgtggatcgaccccggtaccggggtcgggaccaaattcctcgacgctgtcgcctccgtctccgatagccacgaggttgttatgttgctccttaccataatttttgctttagttcatagtggtatggcaagcctacgggaaagtggtgagaaaatactaggggagcgtgcttaccgtgtgctgttcgctggaatttcactgcctttagcagttactactattgtatacttcataaatcatcggtatgatggtatccaattatggcaagttcagggaaccactggcattcatgagcttgtttggttatcatcgttcatttcgttcttctttctgtatccatctacattcaatcttttggaagtggcagctgtggacaagcctaaattacatatgtgggaaacaggaataatgcgtatcaccagacatccacagatggttggtcaggtaatttggtgccttgctcatacactatggattggcaactcagttgccgttgcggcctctgtcggacttattggccaccatctctttggtgcttggaacggtgacaggaggctggtgtcacgctatggtgaagccttcgaagtcctgaagaagagaacaagtgttgtgccctttgctgcgatcgttgatggacggcagaaactgcccaaagattatcacaaggagttctttcggttaccatatgtagcaatcacaatattaaccttgggtgcatactttgctcatccattgatgcaggcatccagctaccaacttccctggtaa

SEQ ID NO: 6420 - protein, 371 aa, Sorghum bicolor
  misc_feature: Ceres ANNOT ID no. 6066757
  misc_feature (142)..(364): Pfam Id: NnrU Pfam Desc: NnrU protein
  misc_feature (82)..(371): NCBI GI: 92895122 NCBI Desc: nnru [medicago truncatula]
  misc_feature (136)..(371): NCBI GI: 75907969 NCBI Desc: nnru [anabaena variabilis atcc 29413]
  misc_feature (136)..(371): NCBI GI: 119512525 NCBI Desc: nnru [nodularia spumigena ccy9414]
  misc_feature (135)..(371): NCBI GI: 113475670 NCBI Desc: nnru [trichodesmium erythraeum ims101]
  misc_feature (136)..(371): NCBI GI: 119486271 NCBI Desc: nnru [lyngbya sp. pcc 8106]
MASQLRLHLAATPPLLLPHRRRPHLPRPLRPTLNPIRAPLPALPVPRVLSHARPAWAVGGGVEPKEGVVAEGEASGGEEPLLVGEDSAAFELKDQSMASWAYFAVILAAVLVALNVLWIDPGTGVGTKFLDAVASVSDSHEVVMLLLTIIFALVHSGMASLRESGEKILGERAYRVLFAGISLPLAVTTIVYFINHRYDGIQLWQVQGTTGIHELVWLSSFISFFFLYPSTFNLLEVAAVDKPKLHMWETGIMRITRHPQMVGQVIWCLAHTLWIGNSVAVAASVGLIGHHLFGAWNGDRRLVSRYGEAFEVLKKRTSVVPFAAIVDGRQKLPKDYHKEFFRLPYVAITILTLGAYFAHPLMQASSYQLPW

SEQ ID NO: 6421 - DNA, 954 bp, Sorghum bicolor
  misc_feature: Ceres ANNOT ID no. 6066761
  misc_feature: Encodes the peptide sequence at SEQ ID NO 6422
atggagctccgcgagctgggcggtacgggcctccgagtcagcgccgtcggctttggcgcctccccgctcggcaacgttttcggggacgtgccccgcgataccgcccgcgccgccgtccgccgcgcgctcgacctcggcatcaacttcttcgacacctccccgtactacggcggcacggtctcggagtcagtcctcggcgattgcctccgccacgcggccgttccgcgggaccgagtcgtcgtcgccaccaagtgcggccgctacaaagacgagggtttcgacttctccgccgaccgtgtgacgcgcagcatagacgagagcctcgcccggctggggctggactacgttgacatcctccacgcccacgacatcgagttcacccatctcgaccagattgtgaatgagacaattcccgcgctccagaagattaaggagagtgggaaggcacgtttcattggcatcaccgggctgcccctcagcatctacccttatgtcctcgacagggtagcaccaggctcggtggacctgattctatcttactgccactacgggatcaatgacacctcccttgttgatctgctcccctacttgaagagcaaaggtgttggggttatcagtgcttcgccactctccatgggtcttttaacagataatgggccaccggagtggcaccctgcaccagaacaacttaagtcagcatgcagggctgcagcagatcactgtagaaagaaggggagaagcattaccaagctagctatgcagtatagcttgatgaataatgaaatctcgacaattcttgttggaatgaactcttcagaacaggtggaggagaatgtggctgctgcactggagttgtcaacatcaggcattgatgaagaacttctgcgtgaagttgaagcaattcttgagcctgtgaagaacctgacttggcctagcggcatccaacaagtctga

SEQ ID NO: 6422 - protein, 317 aa, Sorghum bicolor
  misc_feature: Ceres ANNOT ID no. 6066761
  misc_feature (7)..(296): Pfam Id: Aldo_ket_red Pfam Desc: Aldo/keto reductase family
  misc_feature (1)..(316): NCBI GI: 91694279 NCBI Desc: l-galactose dehydrogenase [zea mays]
  misc_feature (1)..(316): NCBI GI: 91694281 NCBI Desc: l-galactose dehydrogenase [hordeum vulgare]
  misc_feature (1)..(316): NCBI GI: 91694283 NCBI Desc: l-galactose dehydrogenase [oryza sativa]
  misc_feature (1)..(316): NCBI GI: 77555701 NCBI Desc: galactose dehydrogenase [oryza sativa (japonica cultivar-group)]
  misc_feature (1)..(316): NCBI GI: 115488578 NCBI Desc: os12g0482700 [oryza sativa (japonica cultivar-group)]
MELRELGGTGLRVSAVGFGASPLGNVFGDVPRDTARAAVRRALDLGINFFDTSPYYGGTVSESVLGDCLRHAAVPRDRVVVATKCGRYKDEGFDFSADRVTRSIDESLARLGLDYVDILHAHDIEFTHLDQIVNETIPALQKIKESGKARFIGITGLPLSIYPYVLDRVAPGSVDLILSYCHYGINDTSLVDLLPYLKSKGVGVISASPLSMGLLTDNGPPEWHPAPEQLKSACRAAADHCRKKGRSITKLAMQYSLMNNEISTILVGMNSSEQVEENVAAALELSTSGIDEELLREVEAILEPVKNLTWPSGIQQV

SEQ ID NO: 6423 - DNA, 1014 bp, Sorghum bicolor
  misc_feature: Ceres ANNOT ID no. 6066790
  misc_feature: Encodes the peptide sequence at SEQ ID NO 6424
atggccgccgccgccgctacacccagcgccgacgacgaccagacagccatcatcacccaccgcaccgtggagctaagcaccggcgtgcgcctgcacctggcggaggccggcccatcgggcgcgcccacggtgctgctgctgcacggcttcccggagctgtggtacacctggcgccaccagatgcgcgcgctggcggcggccgggtaccgcgccgtggcgccggacctgcgcgggtacggcgactccgacgcgcccgcagtggccgaccccgggcagtacaccgcgctgcacgttgtgggggacctggtggcgctcatcgacgacgtcctcggcgagaagcaggtgttcgtcgccgcgcacgactggggcgcgctcaccgcctggagcctctgcctgttccgccccgacaaggtgcgcacgctcgtcgcgctcagcgtcgcctacacgccccgcagcgccgcgcggaagcccgtcgacgggctcagggcgctcttcggcgacgactactacatctgccggatacaggaggccggagaaattgaagcagaatttgcacgccttggcactgagctagtgctcaagaagttctttagttatcgctaccctggaccgttgttcttcccaaagagtggttggggctcactagatgatgaagtacctttgccgagctgggtaacagaggaggacctcaaatactacaccaacaagtttgagaagactggcttcactgggggactcaattactatcgtgccctaaataagacatgggagctcacttcaccatggactttagctaagataaatgtacctgtcaagttcatcattggagatttggatttgacataccatagtcctggcatacaagatttccttcacaagggtggcttcaagaagttcgttccacttcttgatgatgatattgtcgtcatgaaagatgttgggcacttcatcaacgaagaaaaaccaaacgaagttagtgagcacataatcaacttcataaagaaatttagttga

SEQ ID NO: 6424 - protein, 337 aa, Sorghum bicolor
  misc_feature: Ceres ANNOT ID no. 6066790
  misc_feature (69)..(331): Pfam Id: Abhydrolase_1 Pfam Desc: alpha/beta hydrolase fold
  misc_feature (18)..(336): NCBI GI: 25044843 NCBI Desc: epoxide hydrolase [ananas comosus]
  misc_feature (18)..(336): NCBI GI: 407940 NCBI Desc: epoxide hydrolase
  misc_feature (18)..(336): NCBI GI: 407938 NCBI Desc: epoxide hydrolase
  misc_feature (18)..(336): NCBI GI: 124360004 NCBI Desc: epoxide hydrolase [medicago truncatula]
  misc_feature (18)..(336): NCBI GI: 407944 NCBI Desc: epoxide hydrolase
MAAAAATPSADDDQTAIITHRTVELSTGVRLHLAEAGPSGAPTVLLLHGFPELWYTWRHQMRALAAAGYRAVAPDLRGYGDSDAPAVADPGQYTALHVVGDLVALIDDVLGEKQVFVAAHDWGALTAWSLCLFRPDKVRTLVALSVAYTPRSAARKPVDGLRALFGDDYYICRIQEAGEIEAEFARLGTELVLKKFFSYRYPGPLFFPKSGWGSLDDEVPLPSWVTEEDLKYYTNKFEKTGFTGGLNYYRALNKTWELTSPWTLAKINVPVKFIIGDLDLTYHSPGIQDFLHKGGFKKFVPLLDDDIVVMKDVGHFINEEKPNEVSEHIINFIKKFS

SEQ ID NO: 6425 - DNA, 1542 bp, Sorghum bicolor
  misc_feature: Ceres ANNOT ID no. 6066844
  misc_feature: Encodes the peptide sequence at SEQ ID NO 6426
atggcgatggcggcggagggcggcgcggcgagcgaaccggagctggtgtcgatcccggcgacgccgcacggcctgtcgacgccggagggcgcgacgacgccgaccggagccggcggcggcggcggcggcggagggaggagcaagggcggctccggcactcccgggcgtcgtgtggtggagggcctgcgcgggtacctggaggacgtgggccacctcacgcgcctcgacccgcgcgacgcctggctgcccgtcaccgagagccgcggcggcaacggccgctacgccgccttccactccctcaacgccggcctcggcttccaggcgctcctcctcccgctcgccttcccgggtctcggatggagctgggggataatttcattgactattgcttatttctggcaactgtacacactctggatcctagtgaagcttcatgaggctgtgccaggcaggaggtacaacagatatgtggagcttgcacaggctgcatttggagaaaaactgggaatgtggctgtctcttttcccaactatttatctctcggcaggcactgccactgcgttgatccttgttggaggggagaccatgaagctgttcttccaaatagtatgtggcccactctgctcgccaaatcccattacgacggtcgagtggtacttggtgttcacatccttggcagtaattctttcccaacttccaaatctcaattcaatcgctggtctttcactcatcggtggcgcgactgcgataatgtactgtaccatgtcatgggttctctccgtcagccaaccgcgaccaccaacagtatcttatgacccagtgacatccaattctttcggtatatccctattctcaaccttgaacgcccttgggataatagcgtttgccttcagaggacacaatcttgctctggaaatacaggcgacaatgccatcgactttcaaacatccagcacatgtgccaatgtggcgcggggccaaagtagcgtatctcctgattgcaatgtgcctcttccccgtcgccgttggaggctactgggcctacggaaacatgatgccaccaggagggatgcttacggcactctacgccttccacagccatgacatcccacggggcctcctcgcaacgacatgcctcctcgtcgtgctcaactgcctcagcagcttccagatctactccatgccagtgttcgacagcttcgaggcctactacaccggccgcaccaaccgcccgtgctcggcatgggtgcggtcagggttcagggtcttctacgggttcctctcgctgttcatcagcgtggccctgccattcctctccagcctcgcggggctgctgggcgggctcaccttgcctgtgacctttgcctacccgtgcttcatgtggatccgcgtcaagaagcccgagaggttcagcttcagctggtacctcaactggggccttgggctgctcggcacagcgttcagcctggccttctcgctgggtggcatctggagcatcgtcaacaatgggatgaagctcaagttcttcaagcctactaactag

SEQ ID NO: 6426 - protein, 513 aa, Sorghum bicolor
  misc_feature: Ceres ANNOT ID no. 6066844
  misc_feature (88)..(494): Pfam Id: Aa_trans Pfam Desc: Transmembrane amino acid transporter protein
  misc_feature (1)..(511): NCBI GI: 77555731 NCBI Desc: transmembrane amino acid transporter protein [oryza sativa (japonica cultivar-group)]
  misc_feature (12)..(513): NCBI GI: 5688864 NCBI Desc: amino acid transporter-like protein 1 [arabidopsis thaliana]
  misc_feature (53)..(511): NCBI GI: 452593 NCBI Desc: orf [lilium longiflorum]
  misc_feature (14)..(513): NCBI GI: 38345856 NCBI Desc: osjnba0084k11.20 [oryza sativa (japonica cultivar-group)]
  misc_feature (14)..(513): NCBI GI: 116310155 NCBI Desc: h0211b05.6 [oryza sativa (indica cultivar-group)]
  misc_feature: Useful for making plants with altered oil content
  misc_feature: Useful for making plants with modulated biomass
  misc_feature: Useful for making plants with modulated heat sensitivity
  misc_feature: Functional homolog of the protein sequence given in SEQ ID NO 13434
  misc_feature: Functional homolog of the protein sequence given in SEQ ID NO 13448
  misc_feature: The sequence is a functional homolog of SEQ ID NO. 313 in the 11/188,298 US application
MAMAAEGGAASEPELVSIPATPHGLSTPEGATTPTGAGGGGGGGGRSKGGSGTPGRRVVEGLRGYLEDVGHLTRLDPRDAWLPVTESRGGNGRYAAFHSLNAGLGFQALLLPLAFPGLGWSWGIISLTIAYFWQLYTLWILVKLHEAVPGRRYNRYVELAQAAFGEKLGMWLSLFPTIYLSAGTATALILVGGETMKLFFQIVCGPLCSPNPITTVEWYLVFTSLAVILSQLPNLNSIAGLSLIGGATAIMYCTMSWVLSVSQPRPPTVSYDPVTSNSFGISLFSTLNALGIIAFAFRGHNLALEIQATMPSTFKHPAHVPMWRGAKVAYLLIAMCLFPVAVGGYWAYGNMMPPGGMLTALYAFHSHDIPRGLLATTCLLVVLNCLSSFQIYSMPVFDSFEAYYTGRTNRPCSAWVRSGFRVFYGFLSLFISVALPFLSSLAGLLGGLTLPVTFAYPCFMWIRVKKPERFSFSWYLNWGLGLLGTAFSLAFSLGGIWSIVNNGMKLKFFKPTN

SEQ ID NO: 6427 - DNA, 3369 bp, Sorghum bicolor
  misc_feature: Ceres ANNOT ID no. 6066949
  misc_feature: Encodes the peptide sequence at SEQ ID NO 6428
atgactatgatgacgccgccccctctcgagcagcagcaggaggacgacgagatgctggtgccgcaccaggagctccctgttgctggtccggaagccgccccacagccgatggaagttgtggcgcagacagagcccgccaacacagcggagagccagccgcccgaggacccgcagacgtcacgcttcacctggacgatcgagagcttcagccgtcttaacactaagaagcactactctgatgtgtttgtcgttggaggatacaaatggcgtgttctaattttccccaaggggaacaatgtggatcacttctcgatgtatttggatgttgcagattctgggaacctcccatacgggtggagccggtatgctcagttcagcttggctgttgtgaatcagatccaccccaagtatacaattcggaaagatacccagcaccaatttaatgcacgcgagagtgactggggtttcacatcatttatgcctttgagtgacctatatgacccaagcaggggctatcttgtgaatgacacagttgttgtagaagctgaggttgctgtccgcagaatggttgattattggacttatgactcaaaaaaagaaacaggttttgtaggtcttaagaatcaaggtgctacctgttatatgaactctctccttcaaactttataccatacaccatattttagaaaggctgtatatcatatgccaacaactgagaatgacatgccatctgggagtatccctttagccctgcagagccttttttacaagctccagtatagtgacaacagtgtagcaacgaaagagttgaccaaatcctttggatgggatacttatgattctttcatgcaacatgacgtgcaagaactcaacagagttctttgtgagaaactggaagataagatgaagggaactgttgtggaaggaacaattgaacaattatttgaaggccaccacattaattacatcgagtgcattaacgtggactataaatctagcagaaaagaatcattttacgatctacagcttgatgtgaaaggttgtcgtgatgtttatgcatcatttgataagtatgtggaagtggagcgtctagagggtgataacaaataccatgcggagagatatggcttacaggatgcaaggaaaggtgtgctcttccttgatttccctcctgttttgcagcttcaactgaagcgttttgaatatgattacatgcgagatacaatggttaagattaatgaccgctatgagttcccgcttcaacttgatcttgatagagacaatggaaaatatctttctccagatgcagatcgaagtattagaaacctctatacgcttcacagtgttcttgttcatagtgggggagtacatggtggtcactactatgctttcattcggccgacactctcagatcagtggtacaaattcgatgatgaacgagttacaaaagaagacactaaaaaggcacttgaagagcagtatgggggtgaggaagagttgcctcaaataaaccctggtttcaataacacaccattcaaattcacaaagtattcgaacgcctatatgcttgtctatatacgtgagagtgacaaggagaaaataatgtgcaatgttgatgagaaggatatcgctgagcatttgcggataaggttgaagaaagaacaagaagagaaagagcacaagaagaaggagaaggctgaagctcatctctacactatcataaagattgctcgagacgaggatttgaaggagcaaattggtaagaatatatattttgacctggtggaccatgaaaaagttcgcagcttccggattcagaagcagttgccttttacttcattcaaggaggaagttgcaaaggaatttggcatccccgtacagtttcagcgcttctggttgtgggctaagaggcagaaccatacataccggccgaatcgtccattgaccccccatgaggaagcacaatcagttggtcagcttagggaagtctcaaataaggcacacaatgctgagctgaagttgtttctggaagttgaacttggaccagagttatgtccaattcgtccacctgagaaaagcaaagaagacatacttcttttcttcaagctttataatgctgagaaggaagagcttcgttttgtcggtaggctttttgtgaaggctctgggaaagccatctgaaatattgacaaaactgaatgaaatggctggattttctccaaatgaagaaattgagctatatgaggaaattaagtttgagccaaatgtgatgtgtgaacatattgacaagaaacttactttccgttctagtcagcttgaagatggagacatcatctgtttccaaaaggctcctgttccagatggtgatacacaagtgcgctatccagatgttccttcattcttggagtatgtgcacaataggcaggttgtgcactttcggtctctggacaaaccaaaggaggatgatttttctttggaattgtcaaagcttcatacttatgatgatgttgttgagagagttgcacatcaacttgggttggatgatccctcaaagattcggcttacatctcacaattgttactctcagcaacctaaaccacagcccattagatataggggagtagaacatctactggatatgcttgttcattataatcagacttctgatatcttgtattatgaggttctggacattccactgccagaattgcagtgtttgaaaacacttaaagttgcattccaccatgcaacaaaagacgaggttgtcgttcatagcataagacttccaagaaatagcactatcagtgatgtgattactgatttgaaaaccaaggttgaactatctaatcctgatgctgagctccgcttgcttgaagtattttaccataagatttataagatctttccgcctcatgagaagatagagaacataaatgatcagtactggacattacgagctgaggagatcccagaggaagagaagaatctcggtccacatgatcgattgattcatgtttaccatttcatgaaagaccctaatcagaaccagcagattcagaatttcggagatccttttttgatggttatccgtgaaggtgagacttctgcagaggtaatggagcgcatccagagaaaactcagagttcctgatgaggagttctccaagtggaagcttgcattcatatccatgaaccggccagagtacctccaggacactgatgttgtatcagcacgttttcagaggagagatgtatacggtgcttgggaacaataccttggcttggagcacactgatacaacatcgaagaggtcttacacagccaatcagaatcggcacacctatgagaagcccgtgaaaatttataattga

SEQ ID NO: 6428 - protein, 1122 aa, Sorghum bicolor
  misc_feature: Ceres ANNOT ID no. 6066949
  misc_feature (201)..(525): Pfam Id: UCH Pfam Desc: Ubiquitin carboxyl-terminal hydrolase
  misc_feature (66)..(186): Pfam Id: MATH Pfam Desc: MATH domain
  misc_feature (1)..(1122): NCBI GI: 10178116 NCBI Desc: ubiquitin carboxyl-terminal hydrolase [arabidopsis thaliana]
  misc_feature (1)..(1122): NCBI GI: 18415260 NCBI Desc: ubiquitin-specific protease 12 (ubp12) [arabidopsis thaliana]
  misc_feature (1)..(1122): NCBI GI: 11993471 NCBI Desc: ubiquitin-specific protease 12 [arabidopsis thaliana]
  misc_feature (350)..(1120): NCBI GI: 115470711 NCBI Desc: os07g0163800 [oryza sativa (japonica cultivar-group)]
  misc_feature (468)..(1122): NCBI GI: 115485971 NCBI Desc: os11g0573000 [oryza sativa (japonica cultivar-group)]
  misc_feature: Useful for making plants with modulated cold sensitivity
  misc_feature: Useful for making plants with modulated nitrogen use efficiency
  misc_feature: Functional homolog of the protein sequence given in SEQ ID NO 13118
MTMMTPPPLEQQQEDDEMLVPHQELPVAGPEAAPQPMEVVAQTEPANTAESQPPEDPQTSRFTWTIESFSRLNTKKHYSDVFVVGGYKWRVLIFPKGNNVDHFSMYLDVADSGNLPYGWSRYAQFSLAVVNQIHPKYTIRKDTQHQFNARESDWGFTSFMPLSDLYDPSRGYLVNDTVVVEAEVAVRRMVDYWTYDSKKETGFVGLKNQGATCYMNSLLQTLYHTPYFRKAVYHMPTTENDMPSGSIPLALQSLFYKLQYSDNSVATKELTKSFGWDTYDSFMQHDVQELNRVLCEKLEDKMKGTVVEGTIEQLFEGHHINYIECINVDYKSSRKESFYDLQLDVKGCRDVYASFDKYVEVERLEGDNKYHAERYGLQDARKGVLFLDFPPVLQLQLKRFEYDYMRDTMVKINDRYEFPLQLDLDRDNGKYLSPDADRSIRNLYTLHSVLVHSGGVHGGHYYAFIRPTLSDQWYKFDDERVTKEDTKKALEEQYGGEEELPQINPGFNNTPFKFTKYSNAYMLVYIRESDKEKIMCNVDEKDIAEHLRIRLKKEQEEKEHKKKEKAEAHLYTIIKIARDEDLKEQIGKNIYFDLVDHEKVRSFRIQKQLPFTSFKEEVAKEFGIPVQFQRFWLWAKRQNHTYRPNRPLTPHEEAQSVGQLREVSNKAHNAELKLFLEVELGPELCPIRPPEKSKEDILLFFKLYNAEKEELRFVGRLFVKALGKPSEILTKLNEMAGFSPNEEIELYEEIKFEPNVMCEHIDKKLTFRSSQLEDGDIICFQKAPVPDGDTQVRYPDVPSFLEYVHNRQVVHFRSLDKPKEDDFSLELSKLHTYDDVVERVAHQLGLDDPSKIRLTSHNCYSQQPKPQPIRYRGVEHLLDMLVHYNQTSDILYYEVLDIPLPELQCLKTLKVAFHHATKDEVVVHSIRLPRNSTISDVITDLKTKVELSNPDAELRLLEVFYHKIYKIFPPHEKIENINDQYWTLRAEEIPEEEKNLGPHDRLIHVYHFMKDPNQNQQIQNFGDPFLMVIREGETSAEVMERIQRKLRVPDEEFSKWKLAFISMNRPEYLQDTDVVSARFQRRDVYGAWEQYLGLEHTDTTSKRSYTANQNRHTYEKPVKIYN

SEQ ID NO: 6429 - DNA, 4107 bp, Sorghum bicolor
  misc_feature: Ceres ANNOT ID no. 6066989
  misc_feature: Encodes the peptide sequence at SEQ ID NO 6430
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
atggggaaggaggcggcggcagcagcgttgtcgtcgacgacgacggtggtgctggccgtgaacggcaagcggtacgaggcggccggcgtcgacccgtcgatgtcgctgctggagttcctgcgcacccagacgcccgtcagaggccccaagctcggctgcggcgaaggtggctgcggtgcatgcgtggtcctcatctccaagtacgacccggccaccgacgaggcgaccgagttctcggcaagctcctgtctgacgctgctccacagcgtggaccgttgctcggtgatcaccagtgagggcatcggcaacaccaaggatggttaccaccccgtgcagaagcgcctggctggcttccacgcctctcagtgtggcttctgcacgcctggcatgtgcatgtccatcttctccgctctcgttaaggccgacaagaaagatggccgccccaacccacaagcaggcttctccaagctgaccaccaaagaggctgagaaggcagtctcaggcaacctttgccgctgcactggctacaggcccatcgtcgacgcctgcaaaagctttgcctctgatgttgacctcgaggacctgggcctcaactgcttctggaagaagggtgacgaaccggcagaagtcagcaagctgcccggctacaacagtggtgccatctgcacttttccagagttcctcaaatctgagatcaagtccactctgaagcaggcgaatgatgttccagttgcagtctctgatgacggctggtaccatcctaagagcattgaagagctccacaggttgtttgattccaactggtttgatgaaaattctgtgaagattgtggcttcaaacactgggtctggagtgtacaaggatcaggacctctatgacaagtacattgacatcaaaggaatcccagagctttcagtcatcaacagaagcagcgaaggaattgagcttggatcagtcgtgtccatctctaaagctattgaggtgctgttagatggaagtttggtcttcagaaagattgctgatcacctaaacaaagtggcttcaccgtttgttcggaacactgcaaccataggtggaaacataatcatggcacaaaggttgccattcgcatcagacattgcaactgtactactagctgcaggttcgaaagtcacaatccaggttgcttcaaaaaggttgtgcttcactctggaggagttcctgcagcagcctccatgtgattataggaccctgctgctgagcatatttatcccagaatggggttcagatgatgtcacctttgagactttccgagcagcacctcgtccacttggcaatgctgtctcatatgtcaattcagctttcttggcaaggacttcagtagatgcagcatcaagggaccatctcgttgatgatatatgtctagtgtttggtgcgtatggagccgatcatgctattagagctaggaaagttgaggattacctgaagggcaaaacagtgagctcgtctgttatacttgaagctgttcggttgcttaaagagattgttaaaccatcagaaggcacaacacatcctgagtatagaatcagcttggctgtcagtttcttgtttaccttcctatcctcccttgccaatagcttgaatgaatctgcaagggttaatgatcccaatggttcttataataatggagacacaaacggcaccattgagcactcaccagagaagcaacttaagttggacagcaatgatttgccaatacgatcaagacaagaaatatttttcactgatgaatacaagccagttggcaaaccaattaagaaagccggggcagagatccaagcttcaggggaagctgtgtacgttgatgatattcctgctcccaaagattgcctctatggagcatttatctatagcacacaccctcatgcccatgtaaaggctatcaactttaaaccatctttagcttctcagaaggtcatcacagttatcactgcaaaggatattcccagcggtggacaaaatgttggttacagctacccaatgttgggagaagaagcactttttgcagatccagttgctgagtttgctggtcaaaaaatcggtgttgtgattgctcaaacacagaagtatgcctacatggcggcaaagcaagccgtcattgagtatagcacagaaaatctgcagccaccaattctgacaatagaagatgcaatccaacgaagcagctacttcgaaaccctcccatttttagctccaaagccagttggtgattacaaccaagggatgtctgaagctgatcacaagattttatcagcagaggtaaaaattgaatcccaatactatttctacatggagacacaagtggcactagctattcctgatgaagataactgtataaccatctattcatcgacacaattacccgaggtcacacaaaatgtggttgcaaagtgccttggcattccatttcataatgtccgcatcatcaccagaagggtcggaggaggctttggtggaaagggattcaaaggaatgcctgtcgcatgtgcatgtgcggttgctgcattcaagctacagcgtccagttcggatgtacctcgatcgcaagacagacatgataatggcaggcggtcggcatcctatgaaggtgaagtactccgttgggttcaagtcagatggcaagatcacagccttgcaccttgatcttgggatcaatgctggaatatccccggatatgagtccaatcatcgcagcacctattataggtgctctcaaaaagtacaattggggcaatcttgcatttgacaccaaggtctgcaagacaaatgtttcatcaaaatcggcagtgagggctcctggagatgcacagggctctttcatcgctgaagccattattgagcatgttgcctcggcactttcagtcagcactaacaccataaggagaaagaaccttcatgattttgagagccttgtggtgttctacggagatagtgcaggtgaagcttctacatacagccttgttaccatgttcgataagttggcctcctctccagaataccaacaccgagctgcaatggtggagcacttcaacagaagcaacaagtggaagaagcgtggcatttcttgtgtgccagttacatatggggtgcggcttcagccagctccaggcaaggtgtctatcatgaatgatggttccattgctgttgaggttggaggggttgagataggccaagggttgtggacaaaagtgaagcagatgactgcatttggattgggacagttgtgtcctgatggcggcgaaagcctcctggacaaggtgcgggtcatacaggccgacacattgagcatgatccagggaggggtcaccggtgggagcaccacttctgaaactagctgtgaagcagttcgacagtcgtgtgttgcgctcgtcgagaggctgaagccaatcaaggagaatctggaggctaaggctggcacagtggaatggagtgccttgattgctcaggcaagtatggcgagtgtgaacttatctgcgcatgcatactggacccctgatccaactttcacaagctatttgaattatggagctggcgttagtgaggtggaaattgatgtcctgacaggagcaacaacaattctaaggagtgaccttgtctacgattgcgggcaaagcttgaaccctgctgtcgatttgggccaggtggaaggtgcattcatccaaggagtaggcttcttcacaaacgaggagtacgcaaccaactctgacgggttggttatccacgatggcacatggacatacaagatccccactgtcgacaccatcccaaaggagttcaatgttgagctaatcaagagcgcccgtgaccagaagcgtgtcctctcttccaaagcatcgggtgagccgccacttcttctagcttcatcggtgcactgtgcaatgagggaggccatcagggccgccaggaaggaattctcggtctgcactggtccagcgaactcccccatcacgttccagatggacgtgccggcgacgatgcctgtcgtcaaggagctctgcggcctggatattgtggagaggtacctggagagcgtgtccgctgccagcccaacaaccactgcgaaagcataa

SEQ ID NO: 6430 - protein, 1368 aa, Sorghum bicolor
  misc_feature: Ceres ANNOT ID no. 6066989
  misc_feature (730)..(1268): Pfam Id: Ald_Xan_dh_C2 Pfam Desc: Aldehyde oxidase and xanthine dehydrogenase, molybdopterinbinding domain
  misc_feature (247)..(420): Pfam Id: FAD_binding_5 Pfam Desc: FAD binding domain in molybdopterin dehydrogenase
  misc_feature (97)..(185): Pfam Id: Fer2_2 Pfam Desc: [2Fe-2S] binding domain
  misc_feature (608)..(719): Pfam Id: Ald_Xan_dh_C Pfam Desc: Aldehyde oxidase and xanthine dehydrogenase, a/b hammerheaddomain
  misc_feature (428)..(541): Pfam Id: CO_deh_flav_C Pfam Desc: CO dehydrogenase flavoprotein C-terminal domain
  misc_feature (18)..(89): Pfam Id: Fer2 Pfam Desc: 2Fe-2S iron-sulfur cluster binding domain
  misc_feature (10)..(1368): NCBI GI: 2589164 NCBI Desc: aldehyde oxidase-2 [zea mays]
  misc_feature (1)..(1368): NCBI GI: 2589162 NCBI Desc: aldehyde oxidase [zea mays]
  misc_feature (1)..(1359): NCBI GI: 75298566 NCBI Desc: probable aldehyde oxidase 2 (ao-2)
  misc_feature (1)..(1359): NCBI GI: 115455835 NCBI Desc: os03g0790900 [oryza sativa (japonica cultivar-group)]
  misc_feature (1)..(1359): NCBI GI: 75298567 NCBI Desc: probable aldehyde oxidase 3 (ao-3)
  misc_feature (3)..(1355): SWISSPROT Homolog: EC 1.2.3.1 Aldehyde oxidase 1
  misc_feature (104)..(1355): SWISSPROT Homolog: EC 1.2.3.14 Abscisic-aldehyde oxidase
  misc_feature: Up-regulated in root tissues in response to methyl jasmonate treatment
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
MGKEAAAAALSSTTTVVLAVNGKRYEAAGVDPSMSLLEFLRTQTPVRGPKLGCGEGGCGACVVLISKYDPATDEATEFSASSCLTLLHSVDRCSVITSEGIGNTKDGYHPVQKRLAGFHASQCGFCTPGMCMSIFSALVKADKKDGRPNPQAGFSKLTTKEAEKAVSGNLCRCTGYRPIVDACKSFASDVDLEDLGLNCFWKKGDEPAEVSKLPGYNSGAICTFPEFLKSEIKSTLKQANDVPVAVSDDGWYHPKSIEELHRLFDSNWFDENSVKIVASNTGSGVYKDQDLYDKYIDIKGIPELSVINRSSEGIELGSVVSISKAIEVLLDGSLVFRKIADHLNKVASPFVRNTATIGGNIIMAQRLPFASDIATVLLAAGSKVTIQVASKRLCFTLEEFLQQPPCDYRTLLLSIFIPEWGSDDVTFETFRAAPRPLGNAVSYVNSAFLARTSVDAASRDHLVDDICLVFGAYGADHAIRARKVEDYLKGKTVSSSVILEAVRLLKEIVKPSEGTTHPEYRISLAVSFLFTFLSSLANSLNESARVNDPNGSYNNGDTNGTIEHSPEKQLKLDSNDLPIRSRQEIFFTDEYKPVGKPIKKAGAEIQASGEAVYVDDIPAPKDCLYGAFIYSTHPHAHVKAINFKPSLASQKVITVITAKDIPSGGQNVGYSYPMLGEEALFADPVAEFAGQKIGVVIAQTQKYAYMAAKQAVIEYSTENLQPPILTIEDAIQRSSYFETLPFLAPKPVGDYNQGMSEADHKILSAEVKIESQYYFYMETQVALAIPDEDNCITIYSSTQLPEVTQNVVAKCLGIPFHNVRIITRRVGGGFGGKGFKGMPVACACAVAAFKLQRPVRMYLDRKTDMIMAGGRHPMKVKYSVGFKSDGKITALHLDLGINAGISPDMSPIIAAPIIGALKKYNWGNLAFDTKVCKTNVSSKSAVRAPGDAQGSFIAEAIIEHVASALSVSTNTIRRKNLHDFESLVVFYGDSAGEASTYSLVTMFDKLASSPEYQHRAAMVEHFNRSNKWKKRGISCVPVTYGVRLQPAPGKVSIMNDGSIAVEVGGVEIGQGLWTKVKQMTAFGLGQLCPDGGESLLDKVRVIQADTLSMIQGGVTGGSTTSETSCEAVRQSCVALVERLKPIKENLEAKAGTVEWSALIAQASMASVNLSAHAYWTPDPTFTSYLNYGAGVSEVEIDVLTGATTILRSDLVYDCGQSLNPAVDLGQVEGAFIQGVGFFTNEEYATNSDGLVIHDGTWTYKIPTVDTIPKEFNVELIKSARDQKRVLSSKASGEPPLLLASSVHCAMREAIRAARKEFSVCTGPANSPITFQMDVPATMPVVKELCGLDIVERYLESVSAASPTTTAKA

SEQ ID NO: 6431 - DNA, 1122 bp, Sorghum bicolor
  misc_feature: Ceres ANNOT ID no. 6067010
  misc_feature: Encodes the peptide sequence at SEQ ID NO 6432
atgtcgctgccggtgctgatggacgatctcgtcgaccggatcatcatccgcttccctcccgaagaaccggagcttctcgttcgcgcctccctcgtctgcaagcgctggtgccgcctcatctctgaccccgccttccgccgccggttccgcaagctccaccgcgcgcccccgatgctgggcgtcttctgcacccgccattcggtatcctccttcgttcctacctcctccgtcccactcccccacgccatgcgcagcaattggcgcgcgatcgactcccgccacggtcgcgtcctcctccgcagtttgccctgggggcacgacttcctggtgttgtcggcgggtaacctccttgtctgggaccccatcacggacgaacagtgcccgctgcccaagctgccggatcaactattttcccgggtaccgtgcacctggaccgccgcggtgctctgtgctgcggcagatggcgtctgcgaccacatcgactgccacagcggaggctccttcctcgttgtcttcatgtgcactgccgccagagaggcattcacctgtgtctactcatcagagactggtgcgtggagcgaaccgacctctgctaagctccgccatgccgaggtctgtttgtcccctagcgttcttgtgggcaatacactctactttatctctgatcactgtgggaggagtttgaaaattctggaacatgacgtggaaacacaggaaacatctctgattcgtctgccacgtacaaactataggcaaattgctctagtgaagatggtggatggtaggctgggatttagtggcgtgcatgagtccaaactctacttgtggtcgagggaggctggttctgagaaatatgcaggatgggcacaaagccaagtcattgatctagagacactgctcaggccgttaggtaccctgatggactcgctcgatgtgatttgttttgtggatggtgttgctgccattttctcgggaacagatgaggtatttgctattgatctgaagtctggtcggattacaaagataggtgagctcatgggcatcaacaacattgttccctacatgagcttctacacaccagcgcttgttgcggccgctacaggtgggggaccaagagcatga

SEQ ID NO: 6432 - protein, 373 aa, Sorghum bicolor
  misc_feature: Ceres ANNOT ID no. 6067010
  misc_feature (1)..(51): Pfam Id: F-box Pfam Desc: F-box domain
  misc_feature (1)..(372): NCBI GI: 115437584 NCBI Desc: os01g0557400 [oryza sativa (japonica cultivar-group)]
  misc_feature (1)..(360): NCBI GI: 115470391 NCBI Desc: os07g0122900 [oryza sativa (japonica cultivar-group)]
  misc_feature (6)..(360): NCBI GI: 115475786 NCBI Desc: os08g0299900 [oryza sativa (japonica cultivar-group)]
  misc_feature (2)..(181): NCBI GI: 38567955 NCBI Desc: osjnbb0115i21.11 [oryza sativa (japonica cultivar-group)]
  misc_feature (19)..(360): NCBI GI: 115481210 NCBI Desc: os10g0158700 [oryza sativa (japonica cultivar-group)]
MSLPVLMDDLVDRIIIRFPPEEPELLVRASLVCKRWCRLISDPAFRRRFRKLHRAPPMLGVFCTRHSVSSFVPTSSVPLPHAMRSNWRAIDSRHGRVLLRSLPWGHDFLVLSAGNLLVWDPITDEQCPLPKLPDQLFSRVPCTWTAAVLCAAADGVCDHIDCHSGGSFLVVFMCTAAREAFTCVYSSETGAWSEPTSAKLRHAEVCLSPSVLVGNTLYFISDHCGRSLKILEHDVETQETSLIRLPRTNYRQIALVKMVDGRLGFSGVHESKLYLWSREAGSEKYAGWAQSQVIDLETLLRPLGTLMDSLDVICFVDGVAAIFSGTDEVFAIDLKSGRITKIGELMGINNIVPYMSFYTPALVAAATGGGPRA

SEQ ID NO: 6433 - DNA, 1344 bp, Sorghum bicolor
  misc_feature: Ceres ANNOT ID no. 6067015
  misc_feature: Encodes the peptide sequence at SEQ ID NO 6434
atggccgccgcgtccgactctgacgccggcgcccagcagccgcgcgacgaccccagcctcctccctttcgcctccttctcgctcgccctctccatccgcgcgccggccacccccacactcgcctccgtcccctccaccatccacctccccactcaaatctctacactcgccgtctgcctccacccctccgccgcgcagcctccctcccgccgccccacccgcctcaattccgccacctcctccgtcatcgccccgctgccctcctcgacgccgggcctctcccgctccttcccctcgggcgcgcccgccgccgcggggcgccgccgcacgctcgtctggttccgcgccgacctccgcctccacgaccatgagccgttccacgccgcagcgggggcgtcgtcctccctcctccctgtcttcgtcttcgacccgcgggacttcggtaagtccccctcggggttcgaccgaacgggcccgtaccgcgccaacttcctgctcgactccgtcgccgacctgcgccggagcctccgcgcccgcggcggggacctggtggtgcgcgtgggcaggcccgaagtggtcatccccgagctcgcgcgggcggcgggcgcggaggccgtgtacgctcacggcgaggtatcgcgggacgaagtccgcgccgaggagagggtgcaaaaggctgtggagaaggagggcatcaacgtgaagtacttctggggtagcacgctataccatgtggaagaccttcccttccacctcgaggacatgccgtccaactatggcggcttcagggaggccgtgaagggtttggaggttagaaaggtgctggaagcgcccgaggaggtcaagtgcgtgcccatgaagaatgtgctcgagcccggcgacatccccacgcttgctgagctcgggctcactgcgccaccagccatggcacaggactcgaaacctgctgttggatctactctcattggtggtgagacagaagctctggagaggttgaagaagtttgctgtagaatgctctatgcagccaaacaaagcagacaaaagcaatacccaagatagcatatatggtgctaatttctcctgcaaaatttctccatggcttgctacaggttgcctctctccacgcttcatgtatgaggagttgaagaagcatgctactagagcaattccttttgggtcaacacccaagaataatgatggcacatctgatgctgggacaaattggttaatgtttgagttgctatggagagatttcttcaggttcatcacaaagaagtacagttctgtacagaagacatctgaagttgctactggttgcactcccgccccagcgcttgcatga

SEQ ID NO: 6434 - protein, 447 aa, Sorghum bicolor
  misc_feature: Ceres ANNOT ID no. 6067015
  misc_feature (108)..(284): Pfam Id: DNA_photolyase Pfam Desc: DNA photolyase
  misc_feature (12)..(445): NCBI GI: 92878315 NCBI Desc: deoxyribodipyrimidine photolyase, class 1 [medicago truncatula]
  misc_feature (19)..(443): NCBI GI: 21592984 NCBI Desc: photolyase/blue-light receptor phr2 [arabidopsis thaliana]
  misc_feature (19)..(443): NCBI GI: 2529668 NCBI Desc: photolyase/blue-light receptor (phr2) [arabidopsis thaliana]
  misc_feature (112)..(301): NCBI GI: 92429522 NCBI Desc: dna photolyase protein [physalis sp. ta1367]
  misc_feature (113)..(301): NCBI GI: 92429536 NCBI Desc: dna photolyase protein [coffea canephora]
MAAASDSDAGAQQPRDDPSLLPFASFSLALSIRAPATPTLASVPSTIHLPTQISTLAVCLHPSAAQPPSRRPTRLNSATSSVIAPLPSSTPGLSRSFPSGAPAAAGRRRTLVWFRADLRLHDHEPFHAAAGASSSLLPVFVFDPRDFGKSPSGFDRTGPYRANFLLDSVADLRRSLRARGGDLVVRVGRPEVVIPELARAAGAEAVYAHGEVSRDEVRAEERVQKAVEKEGINVKYFWGSTLYHVEDLPFHLEDMPSNYGGFREAVKGLEVRKVLEAPEEVKCVPMKNVLEPGDIPTLAELGLTAPPAMAQDSKPAVGSTLIGGETEALERLKKFAVECSMQPNKADKSNTQDSIYGANFSCKISPWLATGCLSPRFMYEELKKHATRAIPFGSTPKNNDGTSDAGTNWLMFELLWRDFFRFITKKYSSVQKTSEVATGCTPAPALA

SEQ ID NO: 6435 - DNA, 1485 bp, Sorghum bicolor
  misc_feature: Ceres ANNOT ID no. 6067027
  misc_feature: Encodes the peptide sequence at SEQ ID NO 6436
atgaagaataagaagggtagtcgccgcaaccgcaatatgcagaaatcagcagctcacgataaccacttactagtagtggataggttcacaaagcttcctgatgatctcctgctcaatatcctcgaccgccttgacacgcccgacgctgtcagaacctgcctcctttctaagaggacgctctacctccgacatttgctctcaaaattgcacatttgggtcacttcctttgtgcctgattgtggtcatgccactttcaaggatacaattcagatgaatgctgcggtagccgatgcaacagacaacattctcactttcagaagccaagagattccccttggccaactcagcgtaggcttctacttgaaatactacgactgtctcaccattggtaaagctgttgcccgagccatggccacccacaacctccacagtgctgaattcattattatgccagagaagaagctacaatattgcactattgatgatcgccgccgcagtgggaagcttctcatgtcctttttttatgcctgtactgatgcatttgctggccttacacgtctctatctacgcaacttaaagcttgctgaaaatgacattcccaacatcattgccacatgcaaacgactagagtatctccgtttgtccatgtgtgaaacagaagatagtgtgttgcacctgcaggtggaacacccacagcttgttgagcttgatatctccgatgcaggcttagaactagttgagctcaactccctaccgaacctcaaacggctggtttttagtgtgtgggtctgtccccaagaacccttgtcttttggcaacatcccattgctttcaagcctaagcctcactaatgtaagcatgagatggcagaaggttatcagattaagtcagttccttcctagtgtcccctccataagagacctgcacctcagcttcctaagtgaaaagatttgggttcagccagagtgtccgaaacttttgtcgccggttctccagaatctgcaatttttgaatctggaagaactccctgaaggatgtgatatagcttggacaagattcttccttgaggctgcacctaacctaaaggaggtatgcatcacagtttgggaccattggtgtgatatggagacagacaaggtggagcgggaagaacagggttactgtgacaaaagaaacgtggagtgggagtcatctgcccctgatggtttcaggcattacaacctgactaagctcaccatttatggttttcaaccaaatgagaactttatgggatacacaaggcacgtcatggaagccgcagttaacctagaggagatatccttatacgacaggaaggtcctccagtgctgtgaagacttggatccaaagatcgaggttgctccatcaagatatccccagaccgtggaggaacaggaattgctgagggagcagattacagagggattggtgatggcgtcacctcatataattcacttccggtcttaa

SEQ ID NO: 6436 - protein, 494 aa, Sorghum bicolor
  misc_feature: Ceres ANNOT ID no. 6067027
  misc_feature (27)..(77): Pfam Id: F-box Pfam Desc: F-box domain
  misc_feature (1)..(494): NCBI GI: 115449901 NCBI Desc: os02g0825100 [oryza sativa (japonica cultivar-group)]
  misc_feature (58)..(494): NCBI GI: 115449917 NCBI Desc: os02g0826000 [oryza sativa (japonica cultivar-group)]
  misc_feature (89)..(386): NCBI GI: 115449897 NCBI Desc: os02g0824900 [oryza sativa (japonica cultivar-group)]
  misc_feature (351)..(494): NCBI GI: 115449913 NCBI Desc: os02g0825700 [oryza sativa (japonica cultivar-group)]
  misc_feature (27)..(386): NCBI GI: 21741445 NCBI Desc: oj000223_09.1 [oryza sativa (japonica cultivar-group)]
MKNKKGSRRNRNMQKSAAHDNHLLVVDRFTKLPDDLLLNILDRLDTPDAVRTCLLSKRTLYLRHLLSKLHIWVTSFVPDCGHATFKDTIQMNAAVADATDNILTFRSQEIPLGQLSVGFYLKYYDCLTIGKAVARAMATHNLHSAEFIIMPEKKLQYCTIDDRRRSGKLLMSFFYACTDAFAGLTRLYLRNLKLAENDIPNIIATCKRLEYLRLSMCETEDSVLHLQVEHPQLVELDISDAGLELVELNSLPNLKRLVFSVWVCPQEPLSFGNIPLLSSLSLTNVSMRWQKVIRLSQFLPSVPSIRDLHLSFLSEKIWVQPECPKLLSPVLQNLQFLNLEELPEGCDIAWTRFFLEAAPNLKEVCITVWDHWCDMETDKVEREEQGYCDKRNVEWESSAPDGFRHYNLTKLTIYGFQPNENFMGYTRHVMEAAVNLEEISLYDRKVLQCCEDLDPKIEVAPSRYPQTVEEQELLREQITEGLVMASPHIIHFRS

SEQ ID NO: 6437 - DNA, 861 bp, Sorghum bicolor
  misc_feature: Ceres ANNOT ID no. 6067033
  misc_feature: Encodes the peptide sequence at SEQ ID NO 6438
atgagcaggcgctggagccgcacgatctacgtcggcaacctccccggcgacatccgggagagggaggtggaggatctgttctacaagtatggtagaattgttgacattgacctgaaggtccccccaaggccacctggttatgcttttgttgagtttgaagatgctcgtgatgctgaggatgcaattgctgggcgggatggatacaactttgatggacaccgtctaagagtggaggctgctcatggtggtagaggtaatacttcctcgtatgatcgttcaagtggctttggtggtggcggtggtggagcacgtcgtggtgtgtcgagacactcagagtatcgtgttcttgtcactggactgccttcttctgcatcatggcaggatttaaaggatcatatgcggaaggctggtgatgtctgtttctctgaagtgtatcgcgaaggcggtggcaccgtaggaattgtggactacacaaattatgatgatatgaaatatgctataaagaagctggatgatactgaattcaggaacgcctttgggcgagcctatataagggtgaaggaatatgatggcaaacgtggtcgctcctactcacgtagccgaagcccaagccgtagctacagtaaaagcaggagcccgagcaaatcacccaagactcgccgttcatcatctagatcccggtcgaggtctgtttcttcccgttcaaggtctgcatcaaaaggacgttctccgtcaagatcaccagcaagatccaaatctcctaatgcttctccggcaaatggtgaagcagcaagccccaagaagcagagcccaaacaggagcccatctggctcacgctctcctgatgcgaaacctgaataa

SEQ ID NO: 6438 - protein, 286 aa, Sorghum bicolor
  misc_feature: Ceres ANNOT ID no. 6067033
  misc_feature (9)..(77): Pfam Id: RRM_1 Pfam Desc: RNA recognition motif. (a.k.a. RRM, RBD, or RNP domain)
  misc_feature (115)..(182): Pfam Id: RRM_1 Pfam Desc: RNA recognition motif. (a.k.a. RRM, RBD, or RNP domain)
  misc_feature (1)..(286): NCBI GI: 52140005 NCBI Desc: asf/sf2-like pre-mrna splicing factor srp32 [zea mays]
  misc_feature (1)..(285): NCBI GI: 115474019 NCBI Desc: os07g0673500 [oryza sativa (japonica cultivar-group)]
  misc_feature (1)..(246): NCBI GI: 52140006 NCBI Desc: asf/sf2-like pre-mrna splicing factor srp32' [zea mays]
  misc_feature (1)..(286): NCBI GI: 68037673 NCBI Desc: alternative splicing regulator [triticum aestivum]
  misc_feature (1)..(246): NCBI GI: 115452963 NCBI Desc: os03g0344100 [oryza sativa (japonica cultivar-group)]
  misc_feature: Useful for making plants with altered alkaloid content
  misc_feature: Useful for making plants with altered lignin content
  misc_feature: Functional homolog of the protein sequence given in SEQ ID NO 13245
  misc_feature: The sequence is a functional homolog of SEQ ID NO. 339 in the 11/188,298 US application
  misc_feature: The sequence is a functional homolog of SEQ ID NO. 458 in the 11/188,298 US application
MSRRWSRTIYVGNLPGDIREREVEDLFYKYGRIVDIDLKVPPRPPGYAFVEFEDARDAEDAIAGRDGYNFDGHRLRVEAAHGGRGNTSSYDRSSGFGGGGGGARRGVSRHSEYRVLVTGLPSSASWQDLKDHMRKAGDVCFSEVYREGGGTVGIVDYTNYDDMKYAIKKLDDTEFRNAFGRAYIRVKEYDGKRGRSYSRSRSPSRSYSKSRSPSKSPKTRRSSSRSRSRSVSSRSRSASKGRSPSRSPARSKSPNASPANGEAASPKKQSPNRSPSGSRSPDAKPE

SEQ ID NO: 6439 - DNA, 1230 bp, Sorghum bicolor
  misc_feature: Ceres ANNOT ID no. 6067037
  misc_feature: Encodes the peptide sequence at SEQ ID NO 6440
atgaccgcttcggcttccgcgctcttacactacagccgcaagcgccagctcgacgctccccccctgccccgccacttcaacggcccgcagagccacacccgcctaagccagcgcctccaccggttcttgcagctaccaccggaggcgaggttcctcgctttcgacatgggcaattacatctccagctccagcgccatcggctggcccagtgatgacgggctggggctcttcagtcgctgggtcagcacgcggcggggtctcgcggtggccatggatgaggaggcggggacgcgactgcatttggtggacaagagggttacggatccgaggaaggctacgttgaaggcggaggcggtgaagcctcagcagtcgaagaaaacggagccctactacaaggaggcacaccaggcggctacacagcgcaataggaggttggaggaaatagggaccgatgtgaagttctatggggagaagctttctgagatacggaagtcagacaaggctgtcaaggaggatctgtttaaacctctcactgctgaggaggaaaaggaacttcatgactgtttctatggtagaggcccgagtagcaaagtcctagtgctgcatgaaccatctaacattgagattagcaaagagaaattccagtgcttgaggccccgttgctggttgaatgatgaggttattaacctgtaccttgaattgttgaaggagagagagataagagaaccaataaggtttctgaaatgccatttctttaatacattcttttataagaagcttgcttgtggaaaaaatggttatgactacaaatctgttaaaagatggacctcccataagaagttgggatatgaactcgttgaatgcgataaaatatttgtccctgtgcataaagatgtacattggtgtttagcaattataaacatgaaggaaaatacgtttcagtatcttgattcccttggtggcatggatcataatgtaccaagagtactggctcgatatatttcagaggaagtgaaggacaaaagtaacagagtaatcaacaccagttcgtggcatgaagagctagtagatggtattcctttacagcagaatgggtgggactgcggtatgtttatgctcaagtacattgatttccacagcagaggactgcccctgtcttttagtcaggaacacatggaatattttaggaagaggacagcgaaggagatcttaagattaagagctgactga

SEQ ID NO: 6440 - protein, 409 aa, Sorghum bicolor
  misc_feature: Ceres ANNOT ID no. 6067037
  misc_feature (221)..(408): Pfam Id: Peptidase_C48 Pfam Desc: Ulp1 protease family, C-terminal catalytic domain
  misc_feature (157)..(409): NCBI GI: 115436482 NCBI Desc: os01g0355900 [oryza sativa (japonica cultivar-group)]
  misc_feature (131)..(409): NCBI GI: 34787206 NCBI Desc: sumo protease [arabidopsis thaliana]
  misc_feature (73)..(409): NCBI GI: 30680058 NCBI Desc: ulp1 protease family protein [arabidopsis thaliana]
  misc_feature (259)..(409): NCBI GI: 115452965 NCBI Desc: os03g0344300 [oryza sativa (japonica cultivar-group)]
  misc_feature (197)..(409): NCBI GI: 42566204 NCBI Desc: ulp1 protease family protein [arabidopsis thaliana]
  misc_feature: Useful for making plants with modulated flowering time
  misc_feature: Functional homolog of the protein sequence given in SEQ ID NO 13393
MTASASALLHYSRKRQLDAPPLPRHFNGPQSHTRLSQRLHRFLQLPPEARFLAFDMGNYISSSSAIGWPSDDGLGLFSRWVSTRRGLAVAMDEEAGTRLHLVDKRVTDPRKATLKAEAVKPQQSKKTEPYYKEAHQAATQRNRRLEEIGTDVKFYGEKLSEIRKSDKAVKEDLFKPLTAEEEKELHDCFYGRGPSSKVLVLHEPSNIEISKEKFQCLRPRCWLNDEVINLYLELLKEREIREPIRFLKCHFFNTFFYKKLACGKNGYDYKSVKRWTSHKKLGYELVECDKIFVPVHKDVHWCLAIINMKENTFQYLDSLGGMDHNVPRVLARYISEEVKDKSNRVINTSSWHEELVDGIPLQQNGWDCGMFMLKYIDFHSRGLPLSFSQEHMEYFRKRTAKEILRLRAD

SEQ ID NO: 6441 - DNA, 1020 bp, Sorghum bicolor
  misc_feature: Ceres ANNOT ID no. 6067042
  misc_feature: Encodes the peptide sequence at SEQ ID NO 6442
atgacctccgccttcctctctctgcgcctgcccaccccctctccctcccacgccgcgtcctccccttccctcccctcgcctctgctccggcaggcgcgtggcggcgtggcgtcctcggcgctggtggcgcgggcggcagggccggcgggagcggcgggggctccgtcgccgctattcaacccccggggagacccgttcctgtctaccctcgcagccgcctcaccggaggaccttgcggccgccgctggcggcgagcgccgtggagaggaccatctgccgttcctcgagatcttccagaacgccaagctcatggcctcgcccgcgcaggtggaacggtctagcagctcatacagtcagcacaggcctagaaggcctcctccagatttgccttcattgcttcttcatggccgaattgtttatattggcatgccgttggtaccagcagtgactgagctcgttgttgcccagttgatgtaccttgaatggatgaacagtaaagaacctgtttatatatacatcaactcaactggaacggctcgcgatgatggtgaaccggtcggaatggagagcgaaggttttgcaatctatgatgcaatgatgcgtatgaatactgagatccacacactttgtataggagctgcagcaggtcatgcatgtcttgtgcttgcggctggaaagaaaggcaaacgctatatgttccctcatgccaaagctatgattcagcaaccacgtattccttcttatgggatgatgcaagcatcagatgttgttattcgtgcaaaggaggttgtgcacaataggaacacgttggtcaaacttttggcaaggcatactggaaatccaccagagaaaatagacaaggtaatgagaggaccattttacatggattccttgaaggcaaaggagtttggggtcatcgacaagatcctttggcgtggtcaggagaagtacatggcggacatgctctccccagatgagtgggacaaagttgctggagtcagacgtcctgatccaatgtga

SEQ ID NO: 6442 - protein, 339 aa, Sorghum bicolor
  misc_feature: Ceres ANNOT ID no. 6067042
  misc_feature (123)..(313): Pfam Id: CLP_protease Pfam Desc: Clp protease
  misc_feature (20)..(334): NCBI GI: 51970012 NCBI Desc: clpp protease complex subunit clpr3 [arabidopsis thaliana]
  misc_feature (20)..(334): NCBI GI: 51971563 NCBI Desc: clpp protease complex subunit clpr3 [arabidopsis thaliana]
  misc_feature (59)..(334): NCBI GI: 92895843 NCBI Desc: peptidase s14, clpp [medicago truncatula]
  misc_feature (20)..(203): NCBI GI: 2342674 NCBI Desc: similar to atp-dependent clp protease (gbd90915). est gbn65461 comes from this gene. [arabidopsis thaliana]
  misc_feature (70)..(333): NCBI GI: 119358826 NCBI Desc: clpp2 clp protease proteolytic subunit, probable (ic) [ostreococcus tauri]
MTSAFLSLRLPTPSPSHAASSPSLPSPLLRQARGGVASSALVARAAGPAGAAGAPSPLFNPRGDPFLSTLAAASPEDLAAAAGGERRGEDHLPFLEIFQNAKLMASPAQVERSSSSYSQHRPRRPPPDLPSLLLHGRIVYIGMPLVPAVTELVVAQLMYLEWMNSKEPVYIYINSTGTARDDGEPVGMESEGFAIYDAMMRMNTEIHTLCIGAAAGHACLVLAAGKKGKRYMFPHAKAMIQQPRIPSYGMMQASDVVIRAKEVVHNRNTLVKLLARHTGNPPEKIDKVMRGPFYMDSLKAKEFGVIDKILWRGQEKYMADMLSPDEWDKVAGVRRPDPM

SEQ ID NO: 6443 - DNA, 1329 bp, Sorghum bicolor
  misc_feature: Ceres ANNOT ID no. 6067044
  misc_feature: Encodes the peptide sequence at SEQ ID NO 6444
atggagctgtcgatgagcggcggctcgctgcggacgttcggccggtgcgtgaccttcctcgcgcgcgtcgcctccgagctcgtgctccaggcgcaccccgccaagctggagatgcacacgctcaacagctcgcggtcggcgtacgcttcggtctccctagcgcgcgacttcttcgaccagtacaccctcgccgccgcggcgtcggcaccgtcttccacgccgctgcagtgcagcgtcctcctcaagtccctgctcgccgtcctccgcaccccgcacgccgcgctcgaccggctcgccgtctccctcccagaacccgacgcacccaagctccaggtcaccctccactgcctcaacggtgtgaggaagacgtactggatcgtgtgcagcgcggagcctgaggtgcagtcgctgtcgctagaccggggacgtttcccgagccgcctcgccatccggccacgggagctcgcgcgcctgctgtccaacttccagtcctcgctgcaggagctcactatcatcgccacagatcctgcttcagggctacctgatgccggcggggacgtcgggggcaaggctgttgagctccggagctacaatgatccgacaaaagatgactgtgacactagactgcacacacaactgtggatcgaccctgccgaggagttcgtggagtttgttcatgctggtgatccggtggatgtcacctttggggtaaaagaactgaaggcttttttaacattttgtgaaggatgtgaggttgacatcctcctattctttgagaagactggcgaacctgttcttttggtcccgagattcggattggatgatggagcaacttctgattttgaagctactctagttctggcaactatgactgtatcacaactatctgacagcaatgatgcccaacaaccagctacatcagcacaacatacgggagaaccaagggctgctgccacaccagttcctgaaaatgtctccaaccatactaaaatctggtcagaactttcaggtagtactcccaaaagctttgaagctaacagagaaaagcgtgcccagacgcacagaaatgcaagcaccaatgtgctgaatgccacgtcaatgctgcccaacgttgcaaatgctccaagcaggccaccagttgcagataatgcaaacaatgcaatgcagccttcacaaatggatcacatggaagaacatcctgaagttatcagtgctattcctcgatcgcagcatcacccgagcaactgggtaggtgctgatgacaacgatgatgacaatgaagatgacgaggagcttttagtccaaacaacaccgcactatatggactga

SEQ ID NO: 6444 - protein, 442 aa, Sorghum bicolor
  misc_feature: Ceres ANNOT ID no. 6067044
  misc_feature (13)..(290): Pfam Id: Rad9 Pfam Desc: Rad9
  misc_feature (5)..(442): NCBI GI: 115452973 NCBI Desc: os03g0345100 [oryza sativa (japonica cultivar-group)]
  misc_feature (1)..(442): NCBI GI: 30679518 NCBI Desc: cell cycle checkpoint control protein family [arabidopsis thaliana]
  misc_feature (1)..(377): NCBI GI: 124360013 NCBI Desc: rad9 [medicago truncatula]
  misc_feature (5)..(267): NCBI GI: 34148782 NCBI Desc: rad9b [homo sapiens]
  misc_feature (5)..(267): NCBI GI: 119618330 NCBI Desc: rad9 homolog b (s. cerevisiae), isoform cra_e [homo sapiens]
MELSMSGGSLRTFGRCVTFLARVASELVLQAHPAKLEMHTLNSSRSAYASVSLARDFFDQYTLAAAASAPSSTPLQCSVLLKSLLAVLRTPHAALDRLAVSLPEPDAPKLQVTLHCLNGVRKTYWIVCSAEPEVQSLSLDRGRFPSRLAIRPRELARLLSNFQSSLQELTIIATDPASGLPDAGGDVGGKAVELRSYNDPTKDDCDTRLHTQLWIDPAEEFVEFVHAGDPVDVTFGVKELKAFLTFCEGCEVDILLFFEKTGEPVLLVPRFGLDDGATSDFEATLVLATMTVSQLSDSNDAQQPATSAQHTGEPRAAATPVPENVSNHTKIWSELSGSTPKSFEANREKRAQTHRNASTNVLNATSMLPNVANAPSRPPVADNANNAMQPSQMDHMEEHPEVISAIPRSQHHPSNWVGADDNDDDNEDDEELLVQTTPHYMD

SEQ ID NO: 6445 - DNA, 618 bp, Sorghum bicolor
  misc_feature: Ceres ANNOT ID no. 6067055
  misc_feature: Encodes the peptide sequence at SEQ ID NO 6446
atgaggcggcagcagcatccgagctcgccgacgacgccgagtaggttcaagacgatttgtgtcttctgcggcagcaggcaaggcaacaggacgagctaccacgacgccgccattgcccttgcccaacagttggtgtcgagaggcatcgacctggtgtatggcggcggcggcataggcctcatggggctcgtctcagtgattcccaggactttgatggccactcctgagataatcggagagacggcgggggaggtgattgcggtggcggacatgcaccaaaggaaggcagagatggagaggcaatctgatgcgttcatagcccttcccggaggatatggaacactggaggagctgcttgagatgatcacatgggcgcagttaggcatccaccgtaagccggttggattgctgaacgttgatggctactacgactccctgctggcgttcatggaccaggccgtggaggaagggttcatcagctccagcgctcgcggcatcatagtccaggctcccacggcgcaggacctcatggacaaacttgaggtgctgattcagggacgatcagcgtttcaggcatatgaagttcgcatggcgcaacttagagcaactccgacctaa

SEQ ID NO: 6446 - protein, 205 aa, Sorghum bicolor
  misc_feature: Ceres ANNOT ID no. 6067055
  misc_feature (43)..(183): Pfam Id: Lysine_decarbox Pfam Desc: Possible lysine decarboxylase
  misc_feature (14)..(205): NCBI GI: 19548083 NCBI Desc: t3b23.2/t3b23.2 [arabidopsis thaliana]
  misc_feature (14)..(181): NCBI GI: 32487858 NCBI Desc: osjnbb0061c13.8 [oryza sativa (japonica cultivar-group)]
  misc_feature (14)..(181): NCBI GI: 115459456 NCBI Desc: os04g0518800 [oryza sativa (japonica cultivar-group)]
  misc_feature (12)..(181): NCBI GI: 79507209 NCBI Desc: carboxy-lyase [arabidopsis thaliana]
  misc_feature (14)..(181): NCBI GI: 73536067 NCBI Desc: chain b, x-ray structure of a lysine decarboxylase-like protein from arabidopsis thaliana gene at2g37210
MRRQQHPSSPTTPSRFKTICVFCGSRQGNRTSYHDAAIALAQQLVSRGIDLVYGGGGIGLMGLVSVIPRTLMATPEIIGETAGEVIAVADMHQRKAEMERQSDAFIALPGGYGTLEELLEMITWAQLGIHRKPVGLLNVDGYYDSLLAFMDQAVEEGFISSSARGIIVQAPTAQDLMDKLEVLIQGRSAFQAYEVRMAQLRATPT

SEQ ID NO: 6447 - DNA, 1500 bp, Sorghum bicolor
  misc_feature: Ceres ANNOT ID no. 6067061
  misc_feature: Encodes the peptide sequence at SEQ ID NO 6448
atgggattccgcttcgcccgcctcgccgcccgcgccgcggcctctcgccggggcatgaccccagcagcctccgcccgccgcgcgctcgccccacccgccttgccggcggagtcacgctgcgggccccactggctcgtccccgcccgcggccacgtgggccactcgcaccaccacggcggggaggacgggggcgagacgtccgagaggatcttccggctgggactcgccgctgacgtcgtactcaccgtggggaaggccgtcacaggatatctctccggcagcaccgccatcgctgccgacgccgcccactccctctcggacattgtgcttagcggggtggctctgctgtcgtacagggcggccaaggctcccagagacaaggaacatccctatgggcatggaaagttcgaaagtttaggagctcttgggatttcaagtatgctgttggttacttcaggtgggattgcatggcatgcttttgaagttcttcagggagttatgtcttctgctcctgatataattggcaacacattgcatgcccaccacgaccatggtagcagtgggcatcatcatggaatagatttggaacatccagttcttgcattgagcatgacaactttagcaatatctatcaaagaagggctctactggatcacaaaaagagctggggaaaaggaaggcagtgggctgatgaaagctaatgcatggcaccatcgtgcagatgctatttcatctgttgttgccctagtaggggtaggtggttccattcttgggttgcctcttcttgatccactagctggacttgttgtctctggcatgattctgaaagctggtattcagactggatatgagagtgtgatggaattggttgacgctgctgtggatccttcacttctagaaccaatcaaggaaactattttgagggttcacggtgtgaaggggtgccatcgattgaggggaagaaaagctgggacatcattatatcttgatgtacatatagaggtatatccttttctgagtgttagcgcagcacatgatatcggtgaaactgttcgtcatcaaattcaaaaggagcacaatcaagttgctgaagttttcatacacatagatccctcatactcagtaggcctgagcatggacctgaaaaggaatatgaagaactctgatggaacgaattcagaagctatcccacggcaacagagtgcagaagccattgtgtctaatattatttcatctcatttttcgaagaaaatggcgcttgaacatctaatgctgcattacgtgcaaggaagagtgttgctccaggtccaagtttcaatgtctccagaaattttgattcgggatgcaatggaagtcgcaaagcaagctgaagaggagatactgagggctgatgcgagcataagccaagtcagcttacagttaagattgggccaacaaatcaagcaacttcagcaagcatcaagcaagaacgtcgctggtctacatgcaggagattactga

SEQ ID NO: 6448 - protein, 499 aa, Sorghum bicolor
  misc_feature: Ceres ANNOT ID no. 6067061
  misc_feature (71)..(376): Pfam Id: Cation_efflux Pfam Desc: Cation efflux family
  misc_feature (195)..(432): NCBI GI: 118602703 NCBI Desc: cation diffusion facilitator family transporter [candidatus ruthia magnifica str. cm (calyptogena magnifica)]
  misc_feature (200)..(373): NCBI GI: 93452807 NCBI Desc: cation efflux protein [delta proteobacterium mlms-1]
  misc_feature (200)..(373): NCBI GI: 93453469 NCBI Desc: cation efflux protein [delta proteobacterium mlms-1]
  misc_feature (193)..(432): NCBI GI: 146326633 NCBI Desc: cation-efflux family protein [candidatus vesicomyosocius okutanii ha]
  misc_feature (195)..(371): NCBI GI: 83649875 NCBI Desc: cation efflux family protein [burkholderia thailandensis e264]
MGFRFARLAARAAASRRGMTPAASARRALAPPALPAESRCGPHWLVPARGHVGHSHHHGGEDGGETSERIFRLGLAADVVLTVGKAVTGYLSGSTAIAADAAHSLSDIVLSGVALLSYRAAKAPRDKEHPYGHGKFESLGALGISSMLLVTSGGIAWHAFEVLQGVMSSAPDIIGNTLHAHHDHGSSGHHHGIDLEHPVLALSMTTLAISIKEGLYWITKRAGEKEGSGLMKANAWHHRADAISSVVALVGVGGSILGLPLLDPLAGLVVSGMILKAGIQTGYESVMELVDAAVDPSLLEPIKETILRVHGVKGCHRLRGRKAGTSLYLDVHIEVYPFLSVSAAHDIGETVRHQIQKEHNQVAEVFIHIDPSYSVGLSMDLKRNMKNSDGTNSEAIPRQQSAEAIVSNIISSHFSKKMALEHLMLHYVQGRVLLQVQVSMSPEILIRDAMEVAKQAEEEILRADASISQVSLQLRLGQQIKQLQQASSKNVAGLHAGDY

SEQ ID NO: 6449 - DNA, 1605 bp, Sorghum bicolor
  misc_feature: Ceres ANNOT ID no. 6067074
  misc_feature: Encodes the peptide sequence at SEQ ID NO 6450
atggcgggattcgatgggatggatgaaaaatttttgggtgggaaactaaacagggctttagtatattatcagaagaagtcggaggaatggacagcagagagggtgaaccaactaaaagagaaaataagtgggctatttgaagcttgcacaactacagttgagcaactcaacttagtggacacactccaacatcttagtatagaccatcatttcaacaaccagattaactccgttttgactagcacccatggtgcggagttcaacagcacctgtctccatgatgttgcccttcgattccgcctactgaggcagcacgggttttggatatctccagatgaattcaacaggttcaaagacaaaaatgggaactttgatgttgacataacaaatgatgcaaggggactactaagtttatacaatgcagcttaccttttcacacatggagaggcagaacttgaggaggctattttatttgccagacaacatcttgaatcgatgagaaataaccttgaatacccattggctcagctagtgaaccgagcccttcacctgccactgccacggaccttcagaagagttgaggctctacattatatctcagagtacaaaggaactccaacgcataacccctcccttctggagtttgcccagctggattttgacctcttgcaacgtctccacttgaaggagctcaaggctctttctagatggtggaaagatctttacaatgaaggggaattgacctactcacgggatcgtgtggttgaatgctacttgtggtcttatacagcatactttgagaaagaacacacaagggcaaggatgatccttgctaagataatcgcactaataatcttgacagacgatacttacgatgttcgtgctactttggaggagtgtcgaaaattcaatgaagcaatacaaagatgggaagagagtgctatctctcttctaccagattacctgaagaaattctacctcaagctgatgaacatctttaaggagtttgaggacgaattggaaccacatgagaagtacagagtcgcttttagtagaaaagcgtttcaaatattatcaagtaattatctccaagaagcggaatggtttcatggtggttacaagccaacatttaaagaccaagtgaagatatctactgtgtgctcaggtgctccatttgcatctgttgggttactagttggcatgggagatgatgtagcaaccaaggaggcacttgagtgggcaatcagttgcacagatgctgtcaaggctttcgcagaggtgactcgcttcatgaatgaccttgcttcgtttaagcgtggaaagaacaaaaatgatgtggacagctcggtggaatgctacatcagtgagcatggcgttacaactgaggttgcctttgcaaagataaattccctgattgaagaagcatggaaaactataaacagagcacgctttgagagcaaggaactacttccagcagtgcaacgagttgccaacataactgccagcatgccgttaatgtacggtgataacaaggatgcattcacattcagcgacggtctcaagggtgtcatcaagcgcctgtttttcaaacctatcctgctatag

SEQ ID NO: 6450 - protein, 534 aa, Sorghum bicolor
  misc_feature: Ceres ANNOT ID no. 6067074
  misc_feature (211)..(480): Pfam Id: Terpene_synth_C Pfam Desc: Terpene synthase family, metal binding domain
  misc_feature (16)..(206): Pfam Id: Terpene_synth Pfam Desc: Terpene synthase, N-terminal domain
  misc_feature (25)..(534): NCBI GI: 115607550 NCBI Desc: farnesol synthase [oryza sativa (japonica cultivar-group)]
  misc_feature (54)..(534): NCBI GI: 115453005 NCBI Desc: os03g0348200 [oryza sativa (japonica cultivar-group)]
  misc_feature (27)..(534): NCBI GI: 46358535 NCBI Desc: terpene synthase 7 [zea mays]
  misc_feature (25)..(531): NCBI GI: 116309481 NCBI Desc: osigba0106g08.3 [oryza sativa (indica cultivar-group)]
  misc_feature (27)..(534): NCBI GI: 38345358 NCBI Desc: osjnba0032i19.10 [oryza sativa (japonica cultivar-group)]
MAGFDGMDEKFLGGKLNRALVYYQKKSEEWTAERVNQLKEKISGLFEACTTTVEQLNLVDTLQHLSIDHHFNNQINSVLTSTHGAEFNSTCLHDVALRFRLLRQHGFWISPDEFNRFKDKNGNFDVDITNDARGLLSLYNAAYLFTHGEAELEEAILFARQHLESMRNNLEYPLAQLVNRALHLPLPRTFRRVEALHYISEYKGTPTHNPSLLEFAQLDFDLLQRLHLKELKALSRWWKDLYNEGELTYSRDRVVECYLWSYTAYFEKEHTRARMILAKIIALIILTDDTYDVRATLEECRKFNEAIQRWEESAISLLPDYLKKFYLKLMNIFKEFEDELEPHEKYRVAFSRKAFQILSSNYLQEAEWFHGGYKPTFKDQVKISTVCSGAPFASVGLLVGMGDDVATKEALEWAISCTDAVKAFAEVTRFMNDLASFKRGKNKNDVDSSVECYISEHGVTTEVAFAKINSLIEEAWKTINRARFESKELLPAVQRVANITASMPLMYGDNKDAFTFSDGLKGVIKRLFFKPILL

SEQ ID NO: 6451 - DNA, 1071 bp, Sorghum bicolor
  misc_feature: Ceres ANNOT ID no. 6067078
  misc_feature: Encodes the peptide sequence at SEQ ID NO 6452
atggatcggcggagatggatcggcaaagcggcggcggcggctgctgttgctgttgcgctcttgctgctgtcgacccctcctcctggaggagcaaggagagaaccccacgtcaacaacaatgggcggagttttgtttttaactatactctggccaaggctgttgtggaatatgctgcagctgtatatatgacagatctgacggctctatatacatggacatgctcaagatgcaatgacttgactcgaggctttgagatgacttgtataattgttgatgtccagaattgcttgcaggcattcatcggtgttgatcacaatctcaatgctatcattgtttcaatcaggggaactcaagagaacagtgtacagaattggattaaggacataatatggaagcaggttaatcttaatgatccaaacatgcccaatgctaaggtccactttgggttttactcttcttacaataatacagttttacgttcagccatcacgaatgctgttcgcaaggcaaggaagctacatggacatagtgacataattgtaacagggcattcgatgggtggagcaatagcttctttttgtgcgcttgatcttgccatgagctttggcagtaacaatgttcatctgatgacttttgggcaaccacgcgttggcaatgctgcttttgcctcctacttcgctaagtatgtgccaaacacaatgcgaatgacacatgaacatgatattgtacctcatctgccaccttattacttcttcctcccaaaactgacgtacaagcacttccccagagaggtgtgggaacacgaagtcgatggcaacacaacctatcaagtctgcgatggcagtggtgaagacccaaattgttccaggagcgtgtttgtgctgctctggagcgcttctgaccacttgacctacatgggagttgagatagcggccgacgactggagcacctgcaggatcgtcctggggcgaagcgtcgagcagctcaaagggagccttgccagcgacattgtgatgtccggactgtccgtcgaagttgtcatcgcggatgatagcgtgcaagttgagtga

SEQ ID NO: 6452 - protein, 356 aa, Sorghum bicolor
  misc_feature: Ceres ANNOT ID no. 6067078
  misc_feature (111)..(251): Pfam Id: Lipase_3 Pfam Desc: Lipase (class 3)
  misc_feature (33)..(340): NCBI GI: 21425569 NCBI Desc: triacylglycerol lipase [triticum aestivum]
  misc_feature (33)..(340): NCBI GI: 21425571 NCBI Desc: triacylglycerol lipase [triticum aestivum]
  misc_feature (38)..(327): NCBI GI: 15238889 NCBI Desc: lipase class 3 family protein [arabidopsis thaliana]
  misc_feature (3)..(333): NCBI GI: 77552336 NCBI Desc: triacylglycerol lipase [oryza sativa (japonica cultivar-group)]
  misc_feature (45)..(328): NCBI GI: 50198977 NCBI Desc: at5g18630 [arabidopsis thaliana]
MDRRRWIGKAAAAAAVAVALLLLSTPPPGGARREPHVNNNGRSFVFNYTLAKAVVEYAAAVYMTDLTALYTWTCSRCNDLTRGFEMTCIIVDVQNCLQAFIGVDHNLNAIIVSIRGTQENSVQNWIKDIIWKQVNLNDPNMPNAKVHFGFYSSYNNTVLRSAITNAVRKARKLHGHSDIIVTGHSMGGAIASFCALDLAMSFGSNNVHLMTFGQPRVGNAAFASYFAKYVPNTMRMTHEHDIVPHLPPYYFFLPKLTYKHFPREVWEHEVDGNTTYQVCDGSGEDPNCSRSVFVLLWSASDHLTYMGVEIAADDWSTCRIVLGRSVEQLKGSLASDIVMSGLSVEVVIADDSVQVE

SEQ ID NO: 6453 - DNA, 2625 bp, Sorghum bicolor
  misc_feature: Ceres ANNOT ID no. 6067080
  misc_feature: Encodes the peptide sequence at SEQ ID NO 6454
atggccggcgtcggcggcagcggcagcggcggtggagctgggggcgacgcggagatgggcggttggacggggcttctgcactcctccacgaagctcctcgagcaggcggcgcccaccccgcacttccctccccttcagaggaacctggaccagctcgaggcgctctccaccaagctcaaggccaagaccatccgcgctgaggctccgtcccagtcgctctccgccaccagattgctagcgcgcgaagggatcaatgccgaacagctcgccagggacctcaagtcattcgaactcaagacaacctttgaggatgtttttccatctgaagcaactactgttgaggagtacttgcagcagcttcatgaaatggccatagtttcatccatccaagaagctcaaaaggacaacttaaggagttttaacaattatatgatgcaagttcttgaggatgactggcagaaagagaagagagacttcttgcagagtctaagccggctttctacattacccaagagaaacactaatctctcgactagtgggctggctcgccctgctttaatgccaccatcaacttccaatcttcatgctccatcaggcctgccttctgcagaagtcatgcctataccgaacaagactattatcgaaaaaaaatcttcagtttatgctggggttgtgagggacctcaacgatgctagaggacgcagtctaccttttaatcctgctacggcgtttaggtctgcttatgagtccttgtctgttgatgctgttggcacaaagtcagtgactatgcagaaagtgtggcatctaattcaggcattagttggggaagggtcgactcatcgaaatggttcaagaaaaatgtcactagtggcaggtgcaaggcgtcatcttgaatggggtcatgagaagtacatacttgacaccatcagcagccatccagctcttgctgctcttggtggatctgttggcaatcttcagaagatccgagcatttcttcgggtaaggctgcgggatcaaggtgtgctagactttgacgcaaccgatctacgcagacagcctccagtggatacaacctggcagcagatttatttctgcttgagaaccggatactatgatgaagcaagacaagttgcccaatcatctcgtactgcgtataacttcgctcccctgcttgcagattggatttctaccaatggtgctgtatcaccagagactgctctggcagcttctgaggaatgtgataaaatgctcagaatgggtgatcggccagggcgtcctggttacgacaggaagaagttgctgctttatgccataatttgtggttgtcggcggcaaattgaaaggctgctaaaagacctaccaacactttttaacactatagaggatttcttgtggtttaagttgtcagctctgcgggaatacaccaatgcatcttcttctaatcttatgaatgaaggcttggtgccttatacgctggatgacctgcaaagttacttgaataaattcgagccatcatattatacaaagagtgggaaagatcccctagtctatccctacattctgttcttaagcatccaattactcccagcaattctttatttgtctaaagaagttggagaggatggataccatgttgacgctgtgcatatttcaatcgctttagctgaccatagtgttctccctgacggtattggatcaggccagaaaattggcgtcatggatgcctgtgcagaggctgcaagcataatacggcagtatggctctatatacttgcgtaatggtaatattgatctagccttggaatattatgcacaagctgctgctgccatgggtggaggtgagttatcgtggatgggtgaagggcaagctgataagcagcgacaacgaagtttgatgttgaagcaactactgacggagatattactaagggatggtggtattcaacttttgcttggtccaaatggaatgggagaagaaggagagctgaaaaagtatatgatggattggagaagtaggcagcaattcttacttgaagctgcccatcggtgtcaagaggctgggctctatgacaaagctgtggaaattcacaaaagagtaggagcctttgccatggctcttcagacaataaacaagtgcctgtccgatgcagtctgtgccatggcacggagtatgctagatggcgagagtcatgctgctgccctaattcattctggcaatgaaattttggagacagctagatattcttctgaagccagcactcaagagaaggatctcatttctgaacaacaaactgtgctgagacagcttgaagctattctccatatttataggctagctcgagctggacagactgtagatgctttgagggaaaccatcaggctacccttccttcatttgggcactcaggctccaaatgtgactgttgacattttcaggaacttgtcaccccatgttcaagcttgcgtgccagatctcctgaaggttgctctaaattgcattgacaatgttagagatactgatgggaccttgcgtgctgtcaaatcaaagattgcaaaccttgtagcaagcaacatgagccggaattggccacaggatttgtatcagaaggtggcacagtgcatatga

SEQ ID NO: 6454 - protein, 874 aa, Sorghum bicolor
  misc_feature: Ceres ANNOT ID no. 6067080
  misc_feature (266)..(563): Pfam Id: NIC Pfam Desc: Nucleoporin interacting component
  misc_feature (18)..(872): NCBI GI: 87162600 NCBI Desc: nucleoporin interacting component; protein prenyltransferase [medicago truncatula]
  misc_feature (21)..(163): NCBI GI: 27924242 NCBI Desc: dye-prov protein [xenopus laevis]
  misc_feature (21)..(163): NCBI GI: 18606331 NCBI Desc: nucleoporin 93 [mus musculus]
  misc_feature (21)..(163): NCBI GI: 1490628 NCBI Desc: an4a
  misc_feature (12)..(163): NCBI GI: 40788963 NCBI Desc: kiaa0095 [homo sapiens]
MAGVGGSGSGGGAGGDAEMGGWTGLLHSSTKLLEQAAPTPHFPPLQRNLDQLEALSTKLKAKTIRAEAPSQSLSATRLLAREGINAEQLARDLKSFELKTTFEDVFPSEATTVEEYLQQLHEMAIVSSIQEAQKDNLRSFNNYMMQVLEDDWQKEKRDFLQSLSRLSTLPKRNTNLSTSGLARPALMPPSTSNLHAPSGLPSAEVMPIPNKTIIEKKSSVYAGVVRDLNDARGRSLPFNPATAFRSAYESLSVDAVGTKSVTMQKVWHLIQALVGEGSTHRNGSRKMSLVAGARRHLEWGHEKYILDTISSHPALAALGGSVGNLQKIRAFLRVRLRDQGVLDFDATDLRRQPPVDTTWQQIYFCLRTGYYDEARQVAQSSRTAYNFAPLLADWISTNGAVSPETALAASEECDKMLRMGDRPGRPGYDRKKLLLYAIICGCRRQIERLLKDLPTLFNTIEDFLWFKLSALREYTNASSSNLMNEGLVPYTLDDLQSYLNKFEPSYYTKSGKDPLVYPYILFLSIQLLPAILYLSKEVGEDGYHVDAVHISIALADHSVLPDGIGSGQKIGVMDACAEAASIIRQYGSIYLRNGNIDLALEYYAQAAAAMGGGELSWMGEGQADKQRQRSLMLKQLLTEILLRDGGIQLLLGPNGMGEEGELKKYMMDWRSRQQFLLEAAHRCQEAGLYDKAVEIHKRVGAFAMALQTINKCLSDAVCAMARSMLDGESHAAALIHSGNEILETARYSSEASTQEKDLISEQQTVLRQLEAILHIYRLARAGQTVDALRETIRLPFLHLGTQAPNVTVDIFRNLSPHVQACVPDLLKVALNCIDNVRDTDGTLRAVKSKIANLVASNMSRNWPQDLYQKVAQCI

SEQ ID NO: 6455 - DNA, 1710 bp, Sorghum bicolor
  misc_feature: Ceres ANNOT ID no. 6067082
  misc_feature: Encodes the peptide sequence at SEQ ID NO 6456
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
atgttggtgctcttcgagacccccgcggggttcgccctgttcaaggtactcgacgaggggaagctcgacaaagtcgaggatctatggaaggagttcacgacgtcggattcagcgagaaaggtggttgagctgaaggctttcaacaagtttgagaacacatctgatgccctatccgcggcaaccctgattattgatagcaagcctagcaagggtctgcgcaagttcttgcagaaacattgtgagggtgaaacattggcagttgctgattctaagcttggaaatgctataaaagaaaagctgaaaattgactgccttcacaatagtgctgtgatggagctgatgagagggctgagaaatcagctcaccgagcttataactgggttgggtgcacaagaccttggtccaatgagcttgggattgtcccacagcttgtctaggtataagctgaagttcagtcccgagaaggttgataccatgatcattcaagccattggattattggatgatcttgacaaggagcttaacacttacgccatgagagttcgtgaatggtatggctggcactttccagaactcaccaaaatagttacagataatatacagtatgccaaagttgtgaagatgatgggcaacagaactaatgcagtcgaccttgacttttctgagatattgtcagatgaagagatagaaacacagctaaaggaggcagcagtaatatccatgggaacagaagttagtgaccttgacttgtcaaatatcaaagagctatgtgatcaagtgttggccctttctgagtacagagcccagctgtatgactatttaaaaagcaggatgaacaccatagcaccaaatctgacagcactggtgggcgaattagttggtgctcgccttattgcgcatggtggaagtttgctaaatttggctaagcagcctggtagcacaattcagatactcggtgcagagaaggctttattcagagctctaaagacaaagcattctacaccaaagtatggcctcatctaccatgcatccttaattgggaaggcttctcaaaagcacaagggaaaaatctctcgttctcttgctgcaaaaactgctctggccatccgatatgatgcccttggtgatggtgaggacaactccattggcactgagagtcgactcaagcttgagacacggcttcaagttcttgagaatagagaacttgggaaatctgctggttctataaaggggaagcccaagatagaagtgtatgaaaaggaccggaagaagggtgctggggctttaacaactcctgctaagacatacaaccctgcagctgatctggtacttaccgaagaaacaccaaagaagtccgaattggcttcaaagaagaggaaacatcatgaggtgaaaactgaaccatcagcagtgcctgcagaggaagcaattcaagaggatggtgaccaggaggatcggaagaagaagaagaaaaagaagtccaaggaaagcgaggaggctcctgctgttgaaggtgatggtgagaagaaaaagaaaaagaagtccaaggaggcccaggaagagcctgccgtggctgctgcctcagaaggtgagaagaagaagaagaaaaagaagtctgatgccgatggtgaggatgttgcaatgcaaaccgaagagtctggtaagaaagataagaagaaaaagaagaaaaagcatgctgatgatgagtga

SEQ ID NO: 6456 - protein, 569 aa, Sorghum bicolor
  misc_feature: Ceres ANNOT ID no. 6067082
  misc_feature (252)..(400): Pfam Id: Nop Pfam Desc: Putative snoRNA binding domain
  misc_feature (159)..(211): Pfam Id: NOSIC Pfam Desc: NOSIC (NUC001) domain
  misc_feature (1)..(66): Pfam Id: NOP5NT Pfam Desc: NOP5NT (NUC127) domain
  misc_feature (1)..(556): NCBI GI: 115453023 NCBI Desc: os03g0350100 [oryza sativa (japonica cultivar-group)]
  misc_feature (1)..(484): NCBI GI: 3288883 NCBI Desc: sar dna binding protein [oryza sativa]
  misc_feature (1)..(564): NCBI GI: 13623892 NCBI Desc: mar-binding protein [nicotiana tabacum]
  misc_feature (1)..(563): NCBI GI: 99646745 NCBI Desc: matrix attachment region binding protein [beta vulgaris]
  misc_feature (1)..(540): NCBI GI: 92879200 NCBI Desc: pre-mrna processing ribonucleoprotein, binding region [medicago truncatula]
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
MLVLFETPAGFALFKVLDEGKLDKVEDLWKEFTTSDSARKVVELKAFNKFENTSDALSAATLIIDSKPSKGLRKFLQKHCEGETLAVADSKLGNAIKEKLKIDCLHNSAVMELMRGLRNQLTELITGLGAQDLGPMSLGLSHSLSRYKLKFSPEKVDTMIIQAIGLLDDLDKELNTYAMRVREWYGWHFPELTKIVTDNIQYAKVVKMMGNRTNAVDLDFSEILSDEEIETQLKEAAVISMGTEVSDLDLSNIKELCDQVLALSEYRAQLYDYLKSRMNTIAPNLTALVGELVGARLIAHGGSLLNLAKQPGSTIQILGAEKALFRALKTKHSTPKYGLIYHASLIGKASQKHKGKISRSLAAKTALAIRYDALGDGEDNSIGTESRLKLETRLQVLENRELGKSAGSIKGKPKIEVYEKDRKKGAGALTTPAKTYNPAADLVLTEETPKKSELASKKRKHHEVKTEPSAVPAEEAIQEDGDQEDRKKKKKKKSKESEEAPAVEGDGEKKKKKKSKEAQEEPAVAAASEGEKKKKKKKSDADGEDVAMQTEESGKKDKKKKKKKHADDE

SEQ ID NO: 6457 - DNA, 1242 bp, Sorghum bicolor
  misc_feature: Ceres ANNOT ID no. 6067084
  misc_feature: Encodes the peptide sequence at SEQ ID NO 6458
atgggtgaggatgacgacgaccagcggaaccagatgctgggcgcgggcctggaccatgagccggagcggcgcccaggggaggcggagccggaggagggcaagaaacctgcggccagcgaggcggaggccggcggcgacggcgccggcacggaggcggcgacctgcgactactgcgggaccgcggcggcggcggtctactgccgcgccgactccgccaggctgtgcctgccgtgcgaccgcctcgtgcacggcgccaacggggtgtgctcccgccacgcccgcgccccgctctgcgccgactgccgcgccgccggggccgtcttccgccgcgcctcgtcctccgctttcctctgctccaactgcgacttcgggaggcaccgggacggcggtgacccgccgctccatgaccgctgcgccgtgcagccttactccgggtgcccccctgcgagcgacctcgcggcgctcctcggggtgcccctcttcgacaagccggccaccgaagatggtggtgcctggtggaacatctgggaggagccccaggtactgagcttggaggatctgatcgtgcccacaaccccttgccatggattcgaacctctcttaacgccgtcctcgcccaagaaccggagcatctcgccggacggcaagatgaacgaggagatccttcggcagctgggtgagctcgcagagtcagatggcggtgtgcaggcatcagcaggtcgtgaggaggcagagcaagctggtggagatcagttcccttcctgggcgtcgccacagtatgccactggacatggcaattttggaacagagaacaaccatgaggttgcaaccatgcctactcctctttacgagaatggcagatggaataactgtgatttggatgccctaaatgatgcatgcaaggtcgaggtcgcatatgatcaggttccagtcagctcagctgaaccgtgcttgtcatcatttgccccattgtcggaaatctgccccagcattagcaatggtaatagtatggaagataaccaccaggttaatcctggcattggcatgcccatgcaaggtctacccaaaaggactggctttgatgttgtgccttgccctgatcgtgactcggtcatttcgcgctataaagcgaagaggaagacaagaagattcgacaggcaggtccggtatgagtcacgcaaagttcgtgctgatggcaggctcaggatcaaggggcgttttgcaaaggcaaaccagacatga

SEQ ID NO: 6458 - protein, 413 aa, Sorghum bicolor
  misc_feature: Ceres ANNOT ID no. 6067084
  misc_feature (368)..(412): Pfam Id: CCT Pfam Desc: CCT motif
  misc_feature (50)..(97): Pfam Id: zf-B_box Pfam Desc: B-box zinc finger
  misc_feature (36)..(411): NCBI GI: 115473951 NCBI Desc: os07g0667300 [oryza sativa (japonica cultivar-group)]
  misc_feature (253)..(412): NCBI GI: 73811199 NCBI Desc: truncated col1 [lolium perenne]
  misc_feature (44)..(232): NCBI GI: 45736091 NCBI Desc: zinc-finger protein c60910-like [oryza sativa (japonica cultivar-group)]
  misc_feature (44)..(232): NCBI GI: 115477535 NCBI Desc: os08g0536300 [oryza sativa (japonica cultivar-group)]
  misc_feature (50)..(168): NCBI GI: 42571031 NCBI Desc: zinc finger (b-box type) family protein [arabidopsis thaliana]
  misc_feature: The sequence is a functional homolog of SEQ ID NO 1628 in the 11/479,226US patent application
  misc_feature: The sequence is a functional homolog of SEQ ID NO 798 in the 10/412,699US patent application
  misc_feature: Useful for making plants with modulated growth and phenotype characteristics
  misc_feature: The sequence is a functional homolog of SEQ ID NO 798 in the 20040045049 US patent application
  misc_feature: The sequence is a functional homolog of SEQ ID NO. 370 in the 11/188,298 US application
MGEDDDDQRNQMLGAGLDHEPERRPGEAEPEEGKKPAASEAEAGGDGAGTEAATCDYCGTAAAAVYCRADSARLCLPCDRLVHGANGVCSRHARAPLCADCRAAGAVFRRASSSAFLCSNCDFGRHRDGGDPPLHDRCAVQPYSGCPPASDLAALLGVPLFDKPATEDGGAWWNIWEEPQVLSLEDLIVPTTPCHGFEPLLTPSSPKNRSISPDGKMNEEILRQLGELAESDGGVQASAGREEAEQAGGDQFPSWASPQYATGHGNFGTENNHEVATMPTPLYENGRWNNCDLDALNDACKVEVAYDQVPVSSAEPCLSSFAPLSEICPSISNGNSMEDNHQVNPGIGMPMQGLPKRTGFDVVPCPDRDSVISRYKAKRKTRRFDRQVRYESRKVRADGRLRIKGRFAKANQT

SEQ ID NO: 6459 - DNA, 1068 bp, Sorghum bicolor
  misc_feature: Ceres ANNOT ID no. 6067087
  misc_feature: Encodes the peptide sequence at SEQ ID NO 6460
  misc_feature: Up-regulated in shoot tissues in response to salicylic acid treatment
  misc_feature: Up-regulated in root tissues in response to salicylic acid treatment
atggtgtccgccgtgctccggaccatcctggtgacgggcggcgccgggtacatcggcagccacacggtgctgcagctgctgcagcagggcttccgcgtcgtcgtcgtcgacaacctcgacaacgcctccgaggtcgccctcgtccgcgtcgccgagctcgccggccacaacggcgccaacctcgtcttccacaaggttgaccttcgcgacaggcacgctttggaggaaatcttctcgtcccacaggtttgaggctgtcattcactttgctgggctcaaagctgttggcgagagcgtgcacaagcccctgctttactatgacaacaacctcatcggcaccatcacccttctcgaggtgatggctgcaaatggctgcaagaagctggtgttttcgtcatctgcaactgtctacgggtggcctaaggaagttccatgcaccgaagaattcccgctttgcgccaccaatccctatgggcggaccaagcttgtgattgaagacatctgtcgcgatgtgcaccgttcagaccctgattggaagatcatactgctcaggtacttcaatcctgttggtgctcatccaagcggatacatcggcgaagacccctgtggtgtcccaaacaacttgatgccctatgttcagcaagtcgctgttgggaggttacctcacctcacggtctatggaacagactacaatacaaaggatggaactggggtgcgtgattacatccatgttgttgacctggctgatggccacatagcagccctaaggaagctctatgaagactccgacaaaataggatgtgaagtatacaacctggggacaggaaaggggacatcggtgttggaaatggtggctgcattcgagaaggtttctgggaagaaaatcccactggtgtttgctgggcgaagacctggagacgcagagatcgtctatgccgcaactgccaaggcagagaaagatctcaaatggaaggcaaaatacgggatcgaggagatgtgcagagatctgtggaattgggcaagcaagaacccatacggctatgctggatcacaagacaacggcaaatga

SEQ ID NO: 6460 - protein, 355 aa, Sorghum bicolor
  misc_feature: Ceres ANNOT ID no. 6067087
  misc_feature (9)..(273): Pfam Id: Epimerase Pfam Desc: NAD dependent epimerase/dehydratase family
  misc_feature (10)..(297): Pfam Id: 3Beta_HSD Pfam Desc: 3-beta hydroxysteroid dehydrogenase/isomerase family
  misc_feature (11)..(216): Pfam Id: NAD_binding_4 Pfam Desc: Male sterility protein
  misc_feature (7)..(144): Pfam Id: adh_short Pfam Desc: short chain dehydrogenase
  misc_feature (1)..(355): NCBI GI: 32130594 NCBI Desc: udp-glucose-4-epimerase [zea mays]
  misc_feature (1)..(354): NCBI GI: 61658230 NCBI Desc: udp-d-galactose epimerase 1 [hordeum vulgare]
  misc_feature (7)..(353): NCBI GI: 92898077 NCBI Desc: udp-glucose 4-epimerase [medicago truncatula]
  misc_feature (7)..(353): NCBI GI: 3021357 NCBI Desc: udp-galactose 4-epimerase [cyamopsis tetragonoloba]
  misc_feature (7)..(353): NCBI GI: 92898076 NCBI Desc: udp-glucose 4-epimerase [medicago truncatula]
  misc_feature (7)..(353): SWISSPROT Homolog: EC 5.1.3.2 UDP-glucose 4-epimerase GEPI48
  misc_feature: Useful for making plants with altered cell wall content and/or composition
  misc_feature: Functional homolog of the protein sequence encoded by LOCUS at1g64440
  misc_feature: GREAT-hit functional homolog of the protein sequence encoded by LOCUS at4g10960
  misc_feature: GREAT-hit functional homolog of the protein sequence encoded by LOCUS at4g23920
  misc_feature: Useful for making plants with altered carbohydrate content
  misc_feature: Functional homolog of the protein sequence given in SEQ ID NO 13954
  misc_feature: Useful for making plants with altered cell wall content and/or composition
  misc_feature: Functional homolog of the protein sequence given in SEQ ID NO 13955
  misc_feature: Up-regulated in shoot tissues in response to salicylic acid treatment
  misc_feature: Up-regulated in root tissues in response to salicylic acid treatment
MVSAVLRTILVTGGAGYIGSHTVLQLLQQGFRVVVVDNLDNASEVALVRVAELAGHNGANLVFHKVDLRDRHALEEIFSSHRFEAVIHFAGLKAVGESVHKPLLYYDNNLIGTITLLEVMAANGCKKLVFSSSATVYGWPKEVPCTEEFPLCATNPYGRTKLVIEDICRDVHRSDPDWKIILLRYFNPVGAHPSGYIGEDPCGVPNNLMPYVQQVAVGRLPHLTVYGTDYNTKDGTGVRDYIHVVDLADGHIAALRKLYEDSDKIGCEVYNLGTGKGTSVLEMVAAFEKVSGKKIPLVFAGRRPGDAEIVYAATAKAEKDLKWKAKYGIEEMCRDLWNWASKNPYGYAGSQDNGK

SEQ ID NO: 6461 - DNA, 453 bp, Sorghum bicolor
  misc_feature: Ceres ANNOT ID no. 6067096
  misc_feature: Encodes the peptide sequence at SEQ ID NO 6462
atggtgaaggctgttgctgtgcttggtagcagtgagggtgtcaagggcaccatcttcttcacccaagagggagatggccctaccactgtcactggaagtgtctctggcctcaagcctggcctccatgggttccatgtgcatgctcttggtgacaccaccaatggctgcatgtcaactggaccacattacaatcctgcgagcaaggagcatggagcaccagaagatgagaaccgccatgccggtgatcttggaaatgtgacagctggagcagatggtgttgctaacatcagtgttaccgacagccagattccacttactggaccgaactcaatcattggcagagctgttgttgttcatgccgatcctgatgatcttggaaagggtaatgatgttatttactgtccacacttgtgccttttgtgtgttgaatgtggtgcttttcctttgttttga

SEQ ID NO: 6462 - protein, 150 aa, Sorghum bicolor
  misc_feature: Ceres ANNOT ID no. 6067096
  misc_feature (1)..(135): Pfam Id: Sod_Cu Pfam Desc: Copper/zinc superoxide dismutase (SODC)
  misc_feature (1)..(128): NCBI GI: 6018682 NCBI Desc: superoxide dismutase-4ap [zea mays]
  misc_feature (1)..(128): NCBI GI: 134598 NCBI Desc: superoxide dismutase [cu-zn] 4ap
  misc_feature (1)..(124): NCBI GI: 1574938 NCBI Desc: superoxide dismutase 4
  misc_feature (1)..(128): NCBI GI: 145388988 NCBI Desc: cu-zn superoxide dismutase [pennisetum glaucum]
  misc_feature (1)..(128): NCBI GI: 6018746 NCBI Desc: superoxide dismutase-4a [zea mays]
  misc_feature (1)..(128): SWISSPROT Homolog: EC 1.15.1.1 Superoxide dismutase [Cu-Zn] 4A
MVKAVAVLGSSEGVKGTIFFTQEGDGPTTVTGSVSGLKPGLHGFHVHALGDTTNGCMSTGPHYNPASKEHGAPEDENRHAGDLGNVTAGADGVANISVTDSQIPLTGPNSIIGRAVVVHADPDDLGKGNDVIYCPHLCLLCVECGAFPLF

SEQ ID NO: 6463 - DNA, 858 bp, Sorghum bicolor
  misc_feature: Ceres ANNOT ID no. 6067103
  misc_feature: Encodes the peptide sequence at SEQ ID NO 6464
atgtcagttggcaggcaatcatactggtgttaccaatgccgacagagggtgaggcctcgtggccgggagatggtgtgcccctactgtgattctgggtttgtggccgaaatggatgatgtagatgctctcatgagccacttcgttgggatggatcctgacttccaccgtgacccaaggttcgggatcatggaggcgatctccgccgtgatgcggcatggtatgtcagggatgaacagggaggttgatgtcagaggaaggccaaacatcttttcagacctggagatggagtttggttcagggccatggctgctcttccgtggtcagctccctggtcatctcacggaggacaacggattcgatgttttcatcaatggacgacgcggtgttggcatgaggagggccaacattgcagactactttgttgggcctggattggatgatcttatcgagcaattgactcagaatgatcgtcgaggaccaccacctgctgcgcagtcctcaatcgatgctatgcccacagttaagatcactcagaggcatctcagtggggactcacactgccctgtctgcaaggagaagttcgagttgggatccgaagcaagagagatgccatgcaagcatttataccactccgattgcatagttccttggttagagcagcataattcctgtcccgtttgccgttatgagctcccaacacagggttctactacgggagctagctgctcgcacacaagatcaaccaaccaaagccagagctcaagtagttcaagcagcagcgggagaaccagtgggcgtcaaaggagaaggaacccgttctcgttcctgtggcctttccgctcatcaagttctcgctag

SEQ ID NO: 6464 - protein, 285 aa, Sorghum bicolor
  misc_feature: Ceres ANNOT ID no. 6067103
  misc_feature (187)..(227): Pfam Id: zf-C3HC4 Pfam Desc: Zinc finger, C3HC4 type (RING finger)
  misc_feature (5)..(281): NCBI GI: 115440527 NCBI Desc: os01g0802000 [oryza sativa (japonica cultivar-group)]
  misc_feature (138)..(280): NCBI GI: 46806079 NCBI Desc: zinc finger -like [oryza sativa (japonica cultivar-group)]
  misc_feature (138)..(241): NCBI GI: 51090501 NCBI Desc: zinc finger-like [oryza sativa (japonica cultivar-group)]
  misc_feature (132)..(285): NCBI GI: 3249088 NCBI Desc: contains similarity to goliath protein gbm97204 from d. melanogster. [arabidopsis thaliana]
  misc_feature (136)..(284): NCBI GI: 92888063 NCBI Desc: zinc finger, ring-type; ringv [medicago truncatula]
  misc_feature: The sequence is a functional homolog of SEQ ID NO 1201 in the 10/374,780US patent application
  misc_feature: Useful for making plants with modulated growth and phenotype characteristics
  misc_feature: Useful for making plants with modulated nitrogen use efficiency
  misc_feature: Functional homolog of the protein sequence given in SEQ ID NO 13208
  misc_feature: The sequence is a functional homolog of SEQ ID NO 1201 in the 20060162006 US patent application
  misc_feature: The sequence is a functional homolog of SEQ ID NO. 271 in the 11/188,298 US application
  misc_feature: The sequence is a functional homolog of SEQ ID NO. 329 in the 11/188,298 US application
  misc_feature: The sequence is a functional homolog of SEQ ID NO. 350 in the 11/188,298 US application
MSVGRQSYWCYQCRQRVRPRGREMVCPYCDSGFVAEMDDVDALMSHFVGMDPDFHRDPRFGIMEAISAVMRHGMSGMNREVDVRGRPNIFSDLEMEFGSGPWLLFRGQLPGHLTEDNGFDVFINGRRGVGMRRANIADYFVGPGLDDLIEQLTQNDRRGPPPAAQSSIDAMPTVKITQRHLSGDSHCPVCKEKFELGSEAREMPCKHLYHSDCIVPWLEQHNSCPVCRYELPTQGSTTGASCSHTRSTNQSQSSSSSSSSGRTSGRQRRRNPFSFLWPFRSSSSR

SEQ ID NO: 6465 - DNA, 1563 bp, Sorghum bicolor
  misc_feature: Ceres ANNOT ID no. 6067117
  misc_feature: Encodes the peptide sequence at SEQ ID NO 6466
atggagaaccccaggccccagcccccggcccccactcctcccatggctccgcttcccgtccacccgccaatcgctcccatccccgtccctccgccccgcgcgcccgccgccgctgcttccatggcctccacctccacttcctccgccgggggcggaggcgaggccgagtacgagctctccgacgaccaccgcgccgcgcgggagcgccacgagcgcgcggtgcaggagctcctccagcggcgccgcgcctacgccatggccgtgcccaccaacgactccgccgtgcgggcccgcctccgccgcctcggcgagcccatcacgctattcggcgagcgcgagatggagcgccgcgaccgcctccgagccctcatggtccggctcgaggccgatggccaggtcgaccgtctcctccgcgcgcaggaggacgaccaggccgcgcgcgccggcgaggaggaggaggaggaggagcagatccagtaccccttcttcaccgagggcacgcaggagcttcttaaggcgcgtgtcgacattgcacagtactcgctcccccgtgccaaggccaggatcgagagggccaagcgccgccacgaggatcccgatgaggacccagaggcggaggccgaactcgtcgtgaagcaggctggggagtttgtcctggagtgcagcgagattggagatgatcgccctctcaccggctgttccttctctcgtgatgcatcaatgctggccacaagttcctggagtggaataatcaaagtatggagcatgccacaaataaccaaggtcgcaaccctgaaaggtcacacagaacgtgcaactgatgttgccttctctcctgctgatgactgcttagcaacagcttcagctgatagaactgcaaaattatggaaaccagatgggtcacttttgatgtcttttgatggccaccttgatcgtcttgctcgccttgcttttcatccatctggaaagtaccttggtacagctagctttgacaagacttggagattgtgggacatcaatactggaaaggagctgctactccaagaggggcacagcagaagtgtgtatggggttagctttcaccctgatggttctttggcagcatcttgtggtcttgatgcatatgctcgagtatgggatctgagatcaggaagattgttctttgccctcaagggccatgtgaaacctgtcctaggagtcagcttctctcctaatggttatctggttgcaactggaagtgaagacaatttctgtcgaatatgggatttgaggaaaaagcaaatgttgtattctataccagctcataagagtcttatttcacatgtaaaatttgaacctcaagaagggtattatttagtgacttcttcctatgacaccaaagcagcactgtggtcagctcgggattacaaaccaatcaacagtttggtgggccacgagtcaaaggttactagtttggatattagtggagatggacagaagattgtgactgtgtcgcatgatcgtacgataaaaatttggtcatgcagaagtagcacacaagataatgcaatggaattggattga

SEQ ID NO: 6466 - protein, 520 aa, Sorghum bicolor
  misc_feature: Ceres ANNOT ID no. 6067117
  misc_feature (259)..(297): Pfam Id: WD40 Pfam Desc: WD domain, G-beta repeat
  misc_feature (300)..(338): Pfam Id: WD40 Pfam Desc: WD domain, G-beta repeat
  misc_feature (342)..(380): Pfam Id: WD40 Pfam Desc: WD domain, G-beta repeat
  misc_feature (384)..(422): Pfam Id: WD40 Pfam Desc: WD domain, G-beta repeat
  misc_feature (426)..(465): Pfam Id: WD40 Pfam Desc: WD domain, G-beta repeat
  misc_feature (469)..(507): Pfam Id: WD40 Pfam Desc: WD domain, G-beta repeat
  misc_feature (95)..(124): Pfam Id: PRP4 Pfam Desc: pre-mRNA processing factor 4 (PRP4) like
  misc_feature (53)..(506): NCBI GI: 62089180 NCBI Desc: prpf4 protein variant [homo sapiens]
  misc_feature (53)..(506): NCBI GI: 119607768 NCBI Desc: prp4 pre-mrna processing factor 4 homolog (yeast), isoform cra_a [homo sapiens]
  misc_feature (53)..(506): NCBI GI: 13938549 NCBI Desc: prp4 pre-mrna processing factor 4 homolog [homo sapiens]
  misc_feature (53)..(506): NCBI GI: 48146327 NCBI Desc: prpf4 [homo sapiens]
  misc_feature (68)..(506): NCBI GI: 2708305 NCBI Desc: u4/u6 small nuclear ribonucleoprotein hprp4 [homo sapiens]
  misc_feature: The sequence is a functional homolog of SEQ ID NO. 502 in the 11/188,298 US application
  misc_feature: The sequence is a functional homolog of SEQ ID NO. 485 in the 11/188,298 US application
MENPRPQPPAPTPPMAPLPVHPPIAPIPVPPPRAPAAAASMASTSTSSAGGGGEAEYELSDDHRAARERHERAVQELLQRRRAYAMAVPTNDSAVRARLRRLGEPITLFGEREMERRDRLRALMVRLEADGQVDRLLRAQEDDQAARAGEEEEEEEQIQYPFFTEGTQELLKARVDIAQYSLPRAKARIERAKRRHEDPDEDPEAEAELVVKQAGEFVLECSEIGDDRPLTGCSFSRDASMLATSSWSGIIKVWSMPQITKVATLKGHTERATDVAFSPADDCLATASADRTAKLWKPDGSLLMSFDGHLDRLARLAFHPSGKYLGTASFDKTWRLWDINTGKELLLQEGHSRSVYGVSFHPDGSLAASCGLDAYARVWDLRSGRLFFALKGHVKPVLGVSFSPNGYLVATGSEDNFCRIWDLRKKQMLYSIPAHKSLISHVKFEPQEGYYLVTSSYDTKAALWSARDYKPINSLVGHESKVTSLDISGDGQKIVTVSHDRTIKIWSCRSSTQDNAMELD

SEQ ID NO: 6467 - DNA, 999 bp, Sorghum bicolor
  misc_feature: Ceres ANNOT ID no. 6067122
  misc_feature: Encodes the peptide sequence at SEQ ID NO 6468
atggtcttattagcggcagatgaggcgtcatggcccatttcctcgccgccgccggcgtggttcgccgccctggtcgccatcggcctctacatcgtcgtgcggtccgccgccaccttcctcctctggctccaccgcgcgttcctgcggccgggcagggacctggcggggtggtacgggacgtgggcggtggtgaccggcgccacggacggcatcggccgcgcggtggcgctggagctggcgcgcgcggggctccacctcgtgctcgtggggcggagcccggacaagctggcgcgggtggcgaaggaggtcctggccgccgcgccgccgtcgtgcaaggtgcggaccgtggagttcgacctcgccgtgaccggggacgacgacgcgcggcgcggggtggcgcgggtggtggccgccgtggagggccgcgacgtgggcgtcctcgtcaacaacgccggcgccacgtacccgtgcgccgcctacttccacgaggtggagcgccccgtgtgggaggccgtcctgcgggtgaacgtcgaggccgcgacgcggatcacgcgcgccctgctgccgatgatggcggccaaggggaggggcgccgtcgtcaacgtgggctccggctccagcgtcgtcgtgccggcgttcccgctctacgccgtctacgcggcgagcaaagcgtacgttgatcaattttctcgaagcctgagtgtcgaatacaaacaatatggtgtagacgtgcaatgccagatccccctgtatgtggctaccaagatgtcgcctgtgaagggtgcttctccgttcataccatcgcctgaggagtacgccagagcagctcttcgctgcatcggctacgaggcgaggtgcgtcccgtactggcgccactcggtccagtggttcttggcatccctaatgccagatgcggttctgaatcactggcgcctccaaactggcatccggaaacgaaacgagatgaaggctctgctcggagaaaaagcctgcggttaa

SEQ ID NO: 6468 - protein, 332 aa, Sorghum bicolor
  misc_feature: Ceres ANNOT ID no. 6067122
  misc_feature (60)..(238): Pfam Id: adh_short Pfam Desc: short chain dehydrogenase
  misc_feature (60)..(254): Pfam Id: KR Pfam Desc: KR domain
  misc_feature (18)..(321): NCBI GI: 33327267 NCBI Desc: beta-ketoacyl reductase gl8b [zea mays]
  misc_feature (18)..(323): NCBI GI: 2586127 NCBI Desc: b-keto acyl reductase [hordeum vulgare]
  misc_feature (18)..(321): NCBI GI: 15824366 NCBI Desc: beta-ketoacyl reductase [zea mays]
  misc_feature (18)..(323): NCBI GI: 115447099 NCBI Desc: os02g0597900 [oryza sativa (japonica cultivar-group)]
  misc_feature (15)..(323): NCBI GI: 116310470 NCBI Desc: h0805a05.3 [oryza sativa (indica cultivar-group)]
  misc_feature: The sequence is a functional homolog of SEQ ID NO. 389 in the 11/188,298 US application
MVLLAADEASWPISSPPPAWFAALVAIGLYIVVRSAATFLLWLHRAFLRPGRDLAGWYGTWAVVTGATDGIGRAVALELARAGLHLVLVGRSPDKLARVAKEVLAAAPPSCKVRTVEFDLAVTGDDDARRGVARVVAAVEGRDVGVLVNNAGATYPCAAYFHEVERPVWEAVLRVNVEAATRITRALLPMMAAKGRGAVVNVGSGSSVVVPAFPLYAVYAASKAYVDQFSRSLSVEYKQYGVDVQCQIPLYVATKMSPVKGASPFIPSPEEYARAALRCIGYEARCVPYWRHSVQWFLASLMPDAVLNHWRLQTGIRKRNEMKALLGEKACG

SEQ ID NO: 6469 - DNA, 822 bp, Sorghum bicolor
  misc_feature: Ceres ANNOT ID no. 6067139
  misc_feature: Encodes the peptide sequence at SEQ ID NO 6470
atgctgtacatcgtgggcctcggcctcggcgacgagcgcgacatcacggtgcgggggctcgacgccgtccgcagctgctccaagatatacatggaggcatacacttccctcctctccctcggcctcgacccggccgcgcttgccaacctggagaagctgtacgggaaggagataacggtcgccgatcgagagatggtggaggagcgcgtcgaccaggtgctaagcgaggctgccgacactgacgtcgccttccttgttgttggcgacccgttcggggcaactacacatactgatctggttgttcgtgccaagaaaatgggggtagaggtgaaggtgatccacaacgcatctgtcatgaatgcaattggagtttgtgggctgcaactttaccgctatggagagactatctcaataccatttttcacagacgaatggagaccagatagtttctatgagaagattcagaacaatcgcaagcttgggctgcacacactttgcctgcttgatatccgtgttaaggagccaacatgggaatctttagccagaggaaagaaagtctatgaaccaccaagattcatgactgtaaacactgcaataagtcagctttttgaggtggaggaagcgcgtgggggatctgcatatggcagggatacattgtgcataggagtggcgcgacttggaagtgatgatcagaagatcgttgctgggcctatggagaagctactagatgttgattttggcccaccccttcactgcctgatcatagtgggagagactcatcctttggaagaagagatgctagagttttacatgatcaagtag

SEQ ID NO: 6470 - protein, 273 aa, Sorghum bicolor
  misc_feature: Ceres ANNOT ID no. 6067139
  misc_feature (1)..(213): Pfam Id: TP_methylase Pfam Desc: Tetrapyrrole (Corrin/Porphyrin) Methylases
  misc_feature (1)..(273): NCBI GI: 42733847 NCBI Desc: similar to arabidopsis thaliana (mouse-ear cress). methyltransferase - like protein (methyltransferase-like protein) (at4g31790/f28m20_20) [dictyostelium discoideum]
  misc_feature (1)..(272): NCBI GI: 117190324 NCBI Desc: diphthine synthase isoform b [homo sapiens]
  misc_feature (1)..(272): NCBI GI: 31753136 NCBI Desc: cgi-30 protein [homo sapiens]
  misc_feature (1)..(270): NCBI GI: 55250844 NCBI Desc: zgc:101823 [danio rerio]
  misc_feature (1)..(272): NCBI GI: 40254183 NCBI Desc: riken cdna 2410012m04 [mus musculus]
  misc_feature (1)..(269): SWISSPROT Homolog: EC 2.1.1.98 Diphthine synthase
MLYIVGLGLGDERDITVRGLDAVRSCSKIYMEAYTSLLSLGLDPAALANLEKLYGKEITVADREMVEERVDQVLSEAADTDVAFLVVGDPFGATTHTDLVVRAKKMGVEVKVIHNASVMNAIGVCGLQLYRYGETISIPFFTDEWRPDSFYEKIQNNRKLGLHTLCLLDIRVKEPTWESLARGKKVYEPPRFMTVNTAISQLFEVEEARGGSAYGRDTLCIGVARLGSDDQKIVAGPMEKLLDVDFGPPLHCLIIVGETHPLEEEMLEFYMIK

SEQ ID NO: 6471 - DNA, 1014 bp, Sorghum bicolor
  misc_feature: Ceres ANNOT ID no. 6067141
  misc_feature: Encodes the peptide sequence at SEQ ID NO 6472
atggcggtgggttgcttcaaccccgtgctctcgccgctcgttccttcgccgccgggtaggcgcgtccgagcggcgctgcggtctcagtctcaccagccgaccgcggtctccctccggctgctcccgtgcggcgtggcagctggtcgtggcacgcggcggctcgtggcggcggcggcggcagagtcgcaggccgtgcaggagcagccggcgcggacggaagagtccggtgaggccggcggggcgggtgccgccgaggcgtcctccaagctcgttctggtcgttggcggaaccggcggcgttgggcagttggttgtagcatcgttgctaagcaggaacatcaagtcaagattgctcctaagagatccagaaaaggcatcgtccctatttggcaagcaggatgacagtgtactgcaggtttacaaagcggacacaagaaactctaacgatttggatccacaaatgtttgagggagttacgcatgtgatatgttgtactggaactacagcatttccatctaaacgctgggatggagataatactccagaacgtgtagattgggatggcatcagaaatcttgtaagtgccttgccacagacaatcaagagactggttcttgtgtcatctgttggtgttacaaaatacaatgagataccatggagcatcatgaatctctttggtgtgctcaagtacaagaagatgggagaagacttcgtccgcaattcagggataccattcaccattatcaggcctggaagattgacagatgggccctacacttcgtatgatcttaatacacttcttaaagctacagctggagagcgtcgagcagtagtcataggcaaaggtgacaagcttgtgggggaagttagcagacttgtggtggcagaagcttgtatccaagctttagatattgaatccactgaaggacaaatatatgagattaattcagtgaagggtgaaggaccagggactgacccagagaaatgggaggagctattcagatctgttcaatga

SEQ ID NO: 6472 - protein, 337 aa, Sorghum bicolor
  misc_feature: Ceres ANNOT ID no. 6067141
  misc_feature (93)..(302): Pfam Id: NAD_binding_4 Pfam Desc: Male sterility protein
  misc_feature (91)..(315): Pfam Id: Epimerase Pfam Desc: NAD dependent epimerase/dehydratase family
  misc_feature (179)..(333): NCBI GI: 75907223 NCBI Desc: nad-dependent epimerase/dehydratase [anabaena variabilis atcc 29413]
  misc_feature (91)..(337): NCBI GI: 113477971 NCBI Desc: male sterility-like [trichodesmium erythraeum ims101]
  misc_feature (173)..(336): NCBI GI: 119492924 NCBI Desc: nad-dependent epimerase/dehydratase [lyngbya sp. pcc 8106]
  misc_feature (87)..(336): NCBI GI: 67923343 NCBI Desc: similar to nucleoside-diphosphate-sugar epimerases [crocosphaera watsonii wh 8501]
  misc_feature (92)..(314): NCBI GI: 67923632 NCBI Desc: similar to nucleoside-diphosphate-sugar epimerases [crocosphaera watsonii wh 8501]
MAVGCFNPVLSPLVPSPPGRRVRAALRSQSHQPTAVSLRLLPCGVAAGRGTRRLVAAAAAESQAVQEQPARTEESGEAGGAGAAEASSKLVLVVGGTGGVGQLVVASLLSRNIKSRLLLRDPEKASSLFGKQDDSVLQVYKADTRNSNDLDPQMFEGVTHVICCTGTTAFPSKRWDGDNTPERVDWDGIRNLVSALPQTIKRLVLVSSVGVTKYNEIPWSIMNLFGVLKYKKMGEDFVRNSGIPFTIIRPGRLTDGPYTSYDLNTLLKATAGERRAVVIGKGDKLVGEVSRLVVAEACIQALDIESTEGQIYEINSVKGEGPGTDPEKWEELFRSVQ

SEQ ID NO: 6473 - DNA, 681 bp, Sorghum bicolor
  misc_feature: Ceres ANNOT ID no. 6067142
  misc_feature: Encodes the peptide sequence at SEQ ID NO 6474
atggcgtccctctccccttccctccacctcccctgcaattcaagaactggtttccttggaaagacacatgggattcgtcctcgtgttctccctgctggaagagtcggatttgtcagaacagtagtggaatgcaaggaatctagaattggaaagcaacccatcgaagtcccatcaaatgttactctcacattagaggagcaatttgtcaaagctaagggtccgcttggggagttatctctaagctttccaggtgatgtgaagattgtgaaagaagaatctggtatgctgagagtttataagactgcagagaccaagagggcaaaccagatgcatggacttttcagaacactgacagacaacatcatcgttggtgtgtccaaaggattcgataagaagcttcagttagtgggtgtcgggtatcgtgcagcggtggagggcaacgatctcgtgatgaacctgggattctcccaccctgttcggatggccattcctgaaggcctggcggtcaaggtggaagagaacacgaggatcaccgtgagtggctacgacaagagcgcgatcggtcagtttgctgccactatcaagaagtggaggccacctgagccatacaagggaaagggtatcagatatatggatgaggttgtcagaaggaaggaaggaaaagctgggaagaagaaatag

SEQ ID NO: 6474 - protein, 226 aa, Sorghum bicolor
  misc_feature: Ceres ANNOT ID no. 6067142
  misc_feature (56)..(128): Pfam Id: Ribosomal_L6 Pfam Desc: Ribosomal protein L6
  misc_feature (136)..(211): Pfam Id: Ribosomal_L6 Pfam Desc: Ribosomal protein L6
  misc_feature (25)..(224): NCBI GI: 145354079 NCBI Desc: plastid ribosomal protein l6 large ribosomal subunit [ostreococcus lucimarinus cce9901]
  misc_feature (47)..(225): NCBI GI: 126697655 NCBI Desc: 50s ribosomal protein l6 [clostridium difficile 630]
  misc_feature (47)..(225): NCBI GI: 67923553 NCBI Desc: ribosomal protein l6 [crocosphaera watsonii wh 8501]
  misc_feature (47)..(224): NCBI GI: 77686523 NCBI Desc: ribosomal protein l6 [alkaliphilus metalliredigenes qymf]
  misc_feature (47)..(226): NCBI GI: 119484818 NCBI Desc: 50s ribosomal protein l6 [lyngbya sp. pcc 8106]
MASLSPSLHLPCNSRTGFLGKTHGIRPRVLPAGRVGFVRTVVECKESRIGKQPIEVPSNVTLTLEEQFVKAKGPLGELSLSFPGDVKIVKEESGMLRVYKTAETKRANQMHGLFRTLTDNIIVGVSKGFDKKLQLVGVGYRAAVEGNDLVMNLGFSHPVRMAIPEGLAVKVEENTRITVSGYDKSAIGQFAATIKKWRPPEPYKGKGIRYMDEVVRRKEGKAGKKK

SEQ ID NO: 6475 - DNA, 612 bp, Sorghum bicolor
  misc_feature: Ceres ANNOT ID no. 6067143
  misc_feature: Encodes the peptide sequence at SEQ ID NO 6476
atggacgacgtcagcggcggtgcaccgggcagtgcgtgccccaagaacaagaagccccggcacttgtcccgatcgctgacctaccaccaccaccacccgtaccaggggcgccacctgccgcctccaccgtccccggcgcccaccccgccgcagcgcccgcagtcggtggtcctctacacgacgtcgctccgcggcgtgcgccgcacgtttgcggactgctgcgcggtgcgcgccgcgctgcgggggctccgcgtcgccgtggacgagcgcgacgtctccatggacgccgcgctccggcgggagctccagggggtcctcgccgcccggggccgcgggttctcgctcccgcagctcctggtcgggggcgtgctcgtcggcggcgccgacgaggtccgccggctgcacgagtccggcgagctccgccgcatcctcgagggcgcacccgggcaggaccccgccttcgtctgcggtgcctgcggtgggttccggttcgcgccctgccccgcctgcgacggctcgcgcaaggtgttcgtggaggaagaggggcgaccccgccgctgcatagagtgcaatgagaacggcttggtacgctgccccaattgctgttcttga

SEQ ID NO: 6476 - protein, 203 aa, Sorghum bicolor
  misc_feature: Ceres ANNOT ID no. 6067143
  misc_feature (57)..(125): Pfam Id: Glutaredoxin Pfam Desc: Glutaredoxin
  misc_feature (50)..(203): NCBI GI: 124359980 NCBI Desc: thioredoxin fold [medicago truncatula]
  misc_feature (56)..(202): NCBI GI: 92885098 NCBI Desc: thioredoxin fold [medicago truncatula]
  misc_feature (56)..(203): NCBI GI: 115463369 NCBI Desc: os05g0353600 [oryza sativa (japonica cultivar-group)]
  misc_feature (40)..(201): NCBI GI: 115448683 NCBI Desc: os02g0748800 [oryza sativa (japonica cultivar-group)]
  misc_feature (44)..(201): NCBI GI: 15624060 NCBI Desc: glutaredoxin-like [oryza sativa (japonica cultivar-group)]
MDDVSGGAPGSACPKNKKPRHLSRSLTYHHHHPYQGRHLPPPPSPAPTPPQRPQSVVLYTTSLRGVRRTFADCCAVRAALRGLRVAVDERDVSMDAALRRELQGVLAARGRGFSLPQLLVGGVLVGGADEVRRLHESGELRRILEGAPGQDPAFVCGACGGFRFAPCPACDGSRKVFVEEEGRPRRCIECNENGLVRCPNCCS

SEQ ID NO: 6477 - DNA, 909 bp, Sorghum bicolor
  misc_feature: Ceres ANNOT ID no. 6067145
  misc_feature: Encodes the peptide sequence at SEQ ID NO 6478
atgatggccacaactgcttatattgatgattcctgttcggaggttattgatcccccaaagactgaggtactggatgttgttgagctccctggtgaccatactcagcacccaccaaaaccaaatgtggtggtgtctagcagtgtgcgtgaacttctggaatgtccagtctgcttgagtgccatgtatcctcctattcatcagtgctctaatggtcataccttgtgttctggatgcaaaccaagggttcataatcgttgtccaacttgtaggcatgaactgggtaatataaggtgccttgctctcgagaaggtggctgcatctcttgaagttccatgcaagtaccagagctttgggtgctcaggcatttatccttactacagcaagctgaagcatgagtcacagtgccaatataggccttatagttgtccatatgctggatctgaatgcacagttgttggtgacattccatatttggtaaatcacttgaaagatgaccacaaagttgacatgcacaatggctgtaccttcaaccatcgctatgtaaagccaaaccctcatgaagttgagaatgccacctggatgcttacggttttcagctgctttggccagtacttttgtctacactttgaagcctttcagttgggcatgtcacctgtctacatcgccttcctgaggttcatgggagatgacgcagaagcaaagaactacagctacagcctggaggtagggggcactgggcgcaagatgatctggcaaggggtgccccggagcatcagagacagccaccggaaggtccgggatagctacgacgggctcatcatccagaggaacatggccctgttcttctcgggcggtgacaggaaggagctcaagctgcgcgtcactgggagaatctggaaggaacaataa

SEQ ID NO: 6478 - protein, 302 aa, Sorghum bicolor
  misc_feature: Ceres ANNOT ID no. 6067145
  misc_feature (96)..(295): Pfam Id: Sina Pfam Desc: Seven in absentia protein family
  misc_feature (45)..(302): NCBI GI: 63095207 NCBI Desc: sina [phyllostachys praecox]
  misc_feature (45)..(302): NCBI GI: 6850870 NCBI Desc: seven in absentia-like protein [arabidopsis thaliana]
  misc_feature (42)..(302): NCBI GI: 46577512 NCBI Desc: ubiquitin ligase sinat5 (seven in absentia homolog 5)
  misc_feature (45)..(302): NCBI GI: 21536945 NCBI Desc: seven in absentia-like protein [arabidopsis thaliana]
  misc_feature (42)..(302): NCBI GI: 20136190 NCBI Desc: ring finger e3 ligase sinat5 [arabidopsis thaliana]
MMATTAYIDDSCSEVIDPPKTEVLDVVELPGDHTQHPPKPNVVVSSSVRELLECPVCLSAMYPPIHQCSNGHTLCSGCKPRVHNRCPTCRHELGNIRCLALEKVAASLEVPCKYQSFGCSGIYPYYSKLKHESQCQYRPYSCPYAGSECTVVGDIPYLVNHLKDDHKVDMHNGCTFNHRYVKPNPHEVENATWMLTVFSCFGQYFCLHFEAFQLGMSPVYIAFLRFMGDDAEAKNYSYSLEVGGTGRKMIWQGVPRSIRDSHRKVRDSYDGLIIQRNMALFFSGGDRKELKLRVTGRIWKEQ

SEQ ID NO: 6479 - DNA, 1827 bp, Sorghum bicolor
  misc_feature: Ceres ANNOT ID no. 6067149
  misc_feature: Encodes the peptide sequence at SEQ ID NO 6480
atggcgacatcgccgccgcagaaccctagctccggcgatccctccgatgcgtcgagcctcgccgccgcggcgctcgaggcgcccgggcgcgtatggagatccctcgtcgcgcgcctccctcccctcccggactcctccagcttccttgctgccgtctccgacctccagcgccgctacttcggcgtccgccggccccgccgccgcaggcgctccgctctacctctcccgctccgtcccgcggccgcacactccgctcggattgctggtgagatgcccaaagcctttgtcatcttagatgatgttgtgcaacacaccctgactaatttgcacactattcacaaaagcttactattttggcaggccaaagctgagggaacaaattctcagaaagtgtactttatgatctttgagagaggtccaagggcctttgttgatgcaacatatcaaacactcactagacccggaagcaatggacgtccagtccaatacattttgcattctgcatctgatatggtgtcaacaaaacttgctgccttgacaagtatgcaacattgcttggccgcttttcttgcagagattcattctgaagttgatagatgcagagaaggattaactgaaaactcagacaaatctctgcatacattgttcattgttttaaatacgacattctccaagttggaggtatcactgagaaatgctggtgaggggcaagatgaactatttacacatgatggaaattcatatgagctgtttgggaaattgccggaagtcgatgtagagagttcagaatggacagaggccttggcaacagatggtacaagtttagtctatcaaaaccttcagaagttggatagtttcctgtcctctcagctctcaagccataaaagaccaaacagattgaccatatactggttaccctatacatgtggagcagtgggtctctctgtgtgttctctgtggcttttacgtcatagcagcttgatgggaagtcccgatatcgacaattgggttcgagatgctaaggagtctgtggctggattttgggatgaacatgttgagaaaccaatcatttccattagagatgagcttttcgagacattcaagcaaagagataaaggtgtaatggaacagcaagaggtccaactgactgaagattcattgcgcaggatgttagttgccttttgtgagcaaacagagggtcggaagttgccagaagatttagcagtgcaggcgatgttggagactctcacgaagagatatgagaaggaattgatacatccaattcaaaacctcttcagtggagaattagcccgtgctatgcttattcagattcaaaagcttaaactggatcttgaatcgggactgctggagatggatcagattcttagggcaaatgctataaactttgccgttcttgcagctctgcctgcttttggtctctcacttctgctgcttgtgttactgcgaacatggattcagcgtgatcatggtgctgagggaagaggtaatattgcacgatgtcaacggaggctgcttcttgttgatgtagagagaaggcttatggagtttcagcattacagggataatggaatggaggaagaggcacggtgcaagtttggactagtactttacacgcttgatagactgtgcaaagctgttgagtcacacgcaaaagaaacaggcgaatggttaagcttgagagaagacatttttgatctggcaaagctcgacatgggaacgccagacaagatgattgtcgtgtcacggttgaagtggatgtataactgcttgcttccattctcatcgagccgtttgccacgtctctag

SEQ ID NO: 6480 - protein, 608 aa, Sorghum bicolor
  misc_feature: Ceres ANNOT ID no. 6067149
  misc_feature (315)..(594): Pfam Id: NCA2 Pfam Desc: ATP synthase regulation protein NCA2
  misc_feature (151)..(608): NCBI GI: 115453253 NCBI Desc: os03g0377500 [oryza sativa (japonica cultivar-group)]
  misc_feature (1)..(356): NCBI GI: 115453249 NCBI Desc: os03g0377300 [oryza sativa (japonica cultivar-group)]
  misc_feature (253)..(590): NCBI GI: 3169089 NCBI Desc: spbc4b4.02c [schizosaccharomyces pombe]
  misc_feature (296)..(598): NCBI GI: 6325413 NCBI Desc: nca2p [saccharomyces cerevisiae]
  misc_feature (296)..(594): NCBI GI: 74692685 NCBI Desc: nuclear control of atpase protein 2
MATSPPQNPSSGDPSDASSLAAAALEAPGRVWRSLVARLPPLPDSSSFLAAVSDLQRRYFGVRRPRRRRRSALPLPLRPAAAHSARIAGEMPKAFVILDDVVQHTLTNLHTIHKSLLFWQAKAEGTNSQKVYFMIFERGPRAFVDATYQTLTRPGSNGRPVQYILHSASDMVSTKLAALTSMQHCLAAFLAEIHSEVDRCREGLTENSDKSLHTLFIVLNTTFSKLEVSLRNAGEGQDELFTHDGNSYELFGKLPEVDVESSEWTEALATDGTSLVYQNLQKLDSFLSSQLSSHKRPNRLTIYWLPYTCGAVGLSVCSLWLLRHSSLMGSPDIDNWVRDAKESVAGFWDEHVEKPIISIRDELFETFKQRDKGVMEQQEVQLTEDSLRRMLVAFCEQTEGRKLPEDLAVQAMLETLTKRYEKELIHPIQNLFSGELARAMLIQIQKLKLDLESGLLEMDQILRANAINFAVLAALPAFGLSLLLLVLLRTWIQRDHGAEGRGNIARCQRRLLLVDVERRLMEFQHYRDNGMEEEARCKFGLVLYTLDRLCKAVESHAKETGEWLSLREDIFDLAKLDMGTPDKMIVVSRLKWMYNCLLPFSSSRLPRL

SEQ ID NO: 6481 - DNA, 513 bp, Sorghum bicolor
  misc_feature: Ceres ANNOT ID no. 6067152
  misc_feature: Encodes the peptide sequence at SEQ ID NO 6482
atggacgggcccgtcggcaagctcatcgactcggtgggctccatcttccgcggcagcgacatcctcccctggtgcgaccgcgacatcatcgccggtttcgaaagcgaggttctggaggctaaaaatgaagaacaaaagaatgagagcctgatgaggctctcctgggcacttgttcactcgaggcagcctgaagacgtcaaccggggcattgggatgcttgaagcttcattggacaggcctagcagcccagagcaagcaagggagaagctctacttgttagctgttggacgttatagaactggggattatacaagaagccgacagcttttggaaagatgtttagagatccaacatgactggagacaagccatgactttgcaaaggctcgttgaagaaaaaaccagaagagatggtatgattggcatggctatcatcacaggcgcctttggagttgtgggtctcgttgctggtggtataattgctgcggcttcttcgtcatccaggaggagatga

SEQ ID NO: 6482 - protein, 170 aa, Sorghum bicolor
  misc_feature: Ceres ANNOT ID no. 6067152
  misc_feature (1)..(164): NCBI GI: 115463619 NCBI Desc: os05g0383000 [oryza sativa (japonica cultivar-group)]
  misc_feature (1)..(156): NCBI GI: 115442269 NCBI Desc: os01g0951800 [oryza sativa (japonica cultivar-group)]
  misc_feature (1)..(159): NCBI GI: 124359978 NCBI Desc: protein kinase [medicago truncatula]
  misc_feature (33)..(168): NCBI GI: 7705632 NCBI Desc: tetratricopeptide repeat domain 11 [homo sapiens]
  misc_feature (33)..(168): NCBI GI: 119570597 NCBI Desc: fission 1 (mitochondrial outer membrane) homolog (yeast), isoform cra_a [homo sapiens]
MDGPVGKLIDSVGSIFRGSDILPWCDRDIIAGFESEVLEAKNEEQKNESLMRLSWALVHSRQPEDVNRGIGMLEASLDRPSSPEQAREKLYLLAVGRYRTGDYTRSRQLLERCLEIQHDWRQAMTLQRLVEEKTRRDGMIGMAIITGAFGVVGLVAGGIIAAASSSSRRR

SEQ ID NO: 6483 - DNA, 885 bp, Sorghum bicolor
  misc_feature: Ceres ANNOT ID no. 6067153
  misc_feature: Encodes the peptide sequence at SEQ ID NO 6484
atggcggcgccggcgacgctgcgctcggcggcggcgcgggcgcgggcgcgcgcagcggagctcgtgggaggagggcggtggccgcagcggcgtctggggacgacgtccgcggcggagacggagagcaaaaaggacaaggaggaggagggggccggggccgggtgggagctctcggcggcgcgggagtactacgactaccgcaagtccatctacggcgacgtcacgcaccgcgccctcctcgtcgacgccgtcggcaccctcgtcgtccccgcccagcccaccgcgcaggtgtataagagcattggtgagaagtatggagtgaagtactcagaagatgagatcttgatgagataccggcgggcatacgagaaaccatggggtggatcacggctcaggtatgtggatgatgggagacccttttggcagcacatagtcacttcttctacaggctgttcagatgcacaatactttgaggaactttatcagtactttatgacagaaaaggcctggaagttttgtgatcctgatgctgaaaatgtatttaaagctttaaggaaagctggtgttaaaactgccgttgtctccaattttgatacccgtctacgaccacttctgcaggtcttgaaatgtgaccactggtttgatgcagttgcagtttctgcagaggttgcagcagagaagccaaatccaataatatttttgaaggcttgtgagctcttaggtgtgaagcctgaagaagctgtgcatgttggtgatgatcgtagaaacgatatatggggagccagagatgcaggctgtgatgcttggctctggggcagcgatgttcgctccttcaaggaggtcgccgaacggatcggtgttgaggtgaccaagggaggatggtga

SEQ ID NO: 6484 - protein, 294 aa, Sorghum bicolor
  misc_feature: Ceres ANNOT ID no. 6067153
  misc_feature (76)..(274): Pfam Id: Hydrolase Pfam Desc: haloacid dehalogenase-like hydrolase
  misc_feature (60)..(289): NCBI GI: 70927822 NCBI Desc: dt-related protein [oryza sativa (japonica cultivar-group)]
  misc_feature (61)..(289): NCBI GI: 92898439 NCBI Desc: haloacid dehalogenase/epoxide hydrolase [medicago truncatula]
  misc_feature (79)..(285): NCBI GI: 50897254 NCBI Desc: at1g14310 [arabidopsis thaliana]
  misc_feature (77)..(270): NCBI GI: 86609760 NCBI Desc: haloacid dehalogenase, ia family protein [cyanobacteria bacterium yellowstone b-prime]
  misc_feature (77)..(286): NCBI GI: 86605887 NCBI Desc: haloacid dehalogenase, ia family protein [cyanobacteria bacterium yellowstone a-prime]
MAAPATLRSAAARARARAAELVGGGRWPQRRLGTTSAAETESKKDKEEEGAGAGWELSAAREYYDYRKSIYGDVTHRALLVDAVGTLVVPAQPTAQVYKSIGEKYGVKYSEDEILMRYRRAYEKPWGGSRLRYVDDGRPFWQHIVTSSTGCSDAQYFEELYQYFMTEKAWKFCDPDAENVFKALRKAGVKTAVVSNFDTRLRPLLQVLKCDHWFDAVAVSAEVAAEKPNPIIFLKACELLGVKPEEAVHVGDDRRNDIWGARDAGCDAWLWGSDVRSFKEVAERIGVEVTKGGW

SEQ ID NO: 6485 - DNA, 2595 bp, Sorghum bicolor
  misc_feature: Ceres ANNOT ID no. 6067162
  misc_feature: Encodes the peptide sequence at SEQ ID NO 6486
atgtcgtctgcgccggtggcgggggcggcgttcgagcggtaccagcagcagcgcggaggtggcggcgccgcgacggccaacggcaacacggttttcaagagtgggcctcttttcatatcatccaaagggattggatggaaatcatggaagaaacgttggttcatcctcacacgaacatcattggttttcttcaagagtgatcctagtaccttgccccagagaggtggtgaagtgaatgttactctaggagggattgatttgaacaattctgggagtgtggtagtcagagaagacaagaagttgttgaccgtccttttcccagatggccgtgatggtcgtgcatttactcttaaggcagaaacatctgaagatttgtttgagtggaaaacagcattggaagaagctcttgcacaagctccaaatgcagctcttgtgatgggacataatgggatatttcgtaatgacacagctgacacatatgaaggagctattccaaattggagagagaagaggccgatcaagtcattggtgacaggcaggccaattctgcttgcacttgaggatattgatggcagcccttcttttttagaaaaagccctgcgctttcttgagaaacatggaataaaagtggaaggaattttaaggcaggctgcagatgtggaagaagttgacaggaggttgcaagaatatgaacaaggaaggaccgagttttcagcagatgaggatgctcacattgtcggtgactgtgtaaagcatgttctccgagagctaccatcatcccccgtgcctgcttcttgctgtacagcattgttggaagcgtttcgcctggaaactaaggatgctaggataaatgctatgcgttcagctatatctgagacatttcctgagcccaatcggaggttgttgcagagaattttaaaaatgatgcacaccattgcatctcacacttctgaaaatcgaatgactgcatcggcagttgctgcctgtatggcgcctcttttgttgcgtccacttctggctggtgaatgtgagatggatgaggtatttgatatggatggtgacgattctgctcagcttcttgctgcagcaaacgccgcaaacagtgctcaaggaattgtcgcaactctcttggaggaatatgatggcatttttcatgatgaacacctcagatgttccttgtcacctgagtctcaaattgaagatagtggtactgaagcatcaactgatgatgggaatttggatgccaagggcaatggatttcatgatgcagaaaatgatgtagatcaagaaatggatgatgacaacggtgtggagcgtatacttagtggaaaattgagtgagagcagtggatatgctggcagcgacctctatgactacaaggcagtcaatgctgaagagtcatacactgaacgccctgtggaggtgttggaaggaaatttgaatttgagcaaagtacaaaatagccgttcaactgaaaacggttctgcgaatgtggacaccttactcagtgaaaacaatccttctaatccagcagttggtcatgagactctgtctatgggggagatcctttcttcttttgatcctggaatttctgttccgagccaaagttctgaatattctgtagagagacagtcaaacaaaatgaatggatctcacccacatgtgaagcggagtaacttttgggggaggaataacgcaaggaagagccaaaattcagaatcagtcgattcatctggagaagaagagcttgctattcaaaggctcgagattgcgaagaatgatctgcaaaacagaattgccaaagaggcgagtttggaaagaagaaaacaagcgctacatgaacgcagattggctttggaacaggatgtctccaggttgcaagaacagctacaagctgagagggatctgcgagctgcattggaggttggcttgagcatgtcttctggacagttttcaagtgctcgttcgatggacgtgaagacaagggcagagcttgaggagattgctctcgctgaagctgatgttgcaaggttaaaacagaaggttgcagagcttcacctccaactcaatcaacaacgtcaacaccagtatggctctgtagtggatgcaaatgatcgtcatcaccgccttcctggtcacttctcacagcaaaactttgttcaacaaggatttgatatgaaccttgctttctgcaatcaagagaagcaaagaaatgaggagaattcggtggagtcatcacaatggagaaacatcaaacagcatgtgctaccttatggttcttcgaggccactcacacgaaagctttcatttgatgcctcctcaagtgaatcaagaggcacagaagcctcaacaagtatgtcaacagagaacacctctgtgtccatcaatgtcccaaagttggcagagggcattgaatttgggaggcaaccaatggtcacatcctccacattggtagaactaacaactagactagatttcttcaaggagcgaaggtcgcaactgatggaacaacttcatagtcttgatttaggacgtggatctgctcctcagggttttccttacaagccaccctctccttggaaccacccaaggtag

SEQ ID NO: 6486 - protein, 864 aa, Sorghum bicolor
  misc_feature: Ceres ANNOT ID no. 6067162
  misc_feature (193)..(340): Pfam Id: RhoGAP Pfam Desc: RhoGAP domain
  misc_feature (31)..(137): Pfam Id: PH Pfam Desc: PH domain
  misc_feature (2)..(864): NCBI GI: 50510139 NCBI Desc: pleckstrin homology (ph) domain-containing protein-like [oryza sativa (japonica cultivar-group)]
  misc_feature (2)..(864): NCBI GI: 115473841 NCBI Desc: os07g0658300 [oryza sativa (japonica cultivar-group)]
  misc_feature (2)..(739): NCBI GI: 56202382 NCBI Desc: pleckstrin homology (ph) domain-containing protein-like [oryza sativa (japonica cultivar-group)]
  misc_feature (31)..(706): NCBI GI: 115451999 NCBI Desc: os03g0256800 [oryza sativa (japonica cultivar-group)]
  misc_feature (17)..(863): NCBI GI: 42567107 NCBI Desc: pleckstrin homology (ph) domain-containing protein-related / rhogap domain-containing protein [arabidopsis thaliana]
MSSAPVAGAAFERYQQQRGGGGAATANGNTVFKSGPLFISSKGIGWKSWKKRWFILTRTSLVFFKSDPSTLPQRGGEVNVTLGGIDLNNSGSVVVREDKKLLTVLFPDGRDGRAFTLKAETSEDLFEWKTALEEALAQAPNAALVMGHNGIFRNDTADTYEGAIPNWREKRPIKSLVTGRPILLALEDIDGSPSFLEKALRFLEKHGIKVEGILRQAADVEEVDRRLQEYEQGRTEFSADEDAHIVGDCVKHVLRELPSSPVPASCCTALLEAFRLETKDARINAMRSAISETFPEPNRRLLQRILKMMHTIASHTSENRMTASAVAACMAPLLLRPLLAGECEMDEVFDMDGDDSAQLLAAANAANSAQGIVATLLEEYDGIFHDEHLRCSLSPESQIEDSGTEASTDDGNLDAKGNGFHDAENDVDQEMDDDNGVERILSGKLSESSGYAGSDLYDYKAVNAEESYTERPVEVLEGNLNLSKVQNSRSTENGSANVDTLLSENNPSNPAVGHETLSMGEILSSFDPGISVPSQSSEYSVERQSNKMNGSHPHVKRSNFWGRNNARKSQNSESVDSSGEEELAIQRLEIAKNDLQNRIAKEASLERRKQALHERRLALEQDVSRLQEQLQAERDLRAALEVGLSMSSGQFSSARSMDVKTRAELEEIALAEADVARLKQKVAELHLQLNQQRQHQYGSVVDANDRHHRLPGHFSQQNFVQQGFDMNLAFCNQEKQRNEENSVESSQWRNIKQHVLPYGSSRPLTRKLSFDASSSESRGTEASTSMSTENTSVSINVPKLAEGIEFGRQPMVTSSTLVELTTRLDFFKERRSQLMEQLHSLDLGRGSAPQGFPYKPPSPWNHPR

SEQ ID NO: 6487 - DNA, 516 bp, Sorghum bicolor
  misc_feature: Ceres ANNOT ID no. 6067187
  misc_feature: Encodes the peptide sequence at SEQ ID NO 6488
atgggggcggccgagtccgtgccggagacctccatacacgaattcaccgtcaaggattgcaacggcaaggaagtgagcctggagacctacaaggggaaggtcctccttgttgttaacgtcgcctccaaatgtgggttcaccgaggttaattacacgcagctgacggagctttatcggaagtacagggacaaagactttgagatattggcattcccctgcaatcagttcttgcgacaagagccaggttctaatcagcagataaaagactttgcttgcaccagatttaaagctgaatacccagtttttcagaaggtgcgtgtaaatggcccggacgccgcgccggtttacaagtttctgaaagctagcaagcctggtttgtttggatcagcaagagtcaaatggaattttaccaagtttctcgtggataaaaatgggaaggtcgttgagagatacggaacatcgacggctccaatgtcaattgagaaggacatccagaaggcccttgatgaggaataa

SEQ ID NO: 6488 - protein, 171 aa, Sorghum bicolor
  misc_feature: Ceres ANNOT ID no. 6067187
  misc_feature (12)..(120): Pfam Id: GSHPx Pfam Desc: Glutathione peroxidase
  misc_feature (1)..(164): NCBI GI: 25285637 NCBI Desc: probable glutathione peroxidase [imported] - arabidopsis thaliana
  misc_feature (1)..(168): NCBI GI: 44663004 NCBI Desc: phospholipid-hydroperoxide glutathione peroxidase [setaria italica]
  misc_feature (1)..(168): NCBI GI: 21360380 NCBI Desc: glutathione peroxidase 1 [oryza sativa]
  misc_feature (1)..(168): NCBI GI: 115459848 NCBI Desc: os04g0556300 [oryza sativa (japonica cultivar-group)]
  misc_feature (1)..(168): NCBI GI: 27544804 NCBI Desc: phospholipid hydroperoxide glutathione peroxidase-like protein [hordeum vulgare]
  misc_feature (4)..(168): SWISSPROT Homolog: EC 1.11.1.12 Phospholipid hydroperoxide glutathione peroxidase, chloroplast precursor
  misc_feature (11)..(168): SWISSPROT Homolog: EC 1.11.1.9 Glutathione peroxidase 1
  misc_feature: The plant flowers significantly late compared to wild-type.
  misc_feature: Useful for making plants with modulated flowering time
  misc_feature: GREAT-hit functional homolog of the protein sequence given in SEQ ID NO 12921
  misc_feature: Useful for making plants with modulated flowering time
  misc_feature: Functional homolog of the protein sequence given in SEQ ID NO 12921
  misc_feature: Useful for making plants with modulated nitrogen use efficiency
  misc_feature: Functional homolog of the protein sequence given in SEQ ID NO 13071
MGAAESVPETSIHEFTVKDCNGKEVSLETYKGKVLLVVNVASKCGFTEVNYTQLTELYRKYRDKDFEILAFPCNQFLRQEPGSNQQIKDFACTRFKAEYPVFQKVRVNGPDAAPVYKFLKASKPGLFGSARVKWNFTKFLVDKNGKVVERYGTSTAPMSIEKDIQKALDEE

SEQ ID NO: 6489 - DNA, 1719 bp, Sorghum bicolor
  misc_feature: Ceres ANNOT ID no. 6067189
  misc_feature: Encodes the peptide sequence at SEQ ID NO 6490
atggaccagctcgtcaatttcatcatccgcccgcccagagctgactacagtccaaatgatgatttattagagcaggagtttatgctgaagggaagatggttcctgaggaaggatttggaggtaaaaaatggccagggaaaaacgttgcagtgtagtcactacatgcctgttgtggttcctgaaggaaaagctcttccttgtgtcatatattgtcatggaaacagtgggtgcagagctgatgctagtgaagccgctattattcttctaccatcaaacattacagtctttacactggacttttcagggtctggactctctgaaggagagcatgtcaccttaggctggaatgaaagagaagatctgaaagctgtggttaactatttgcgaacagatgggaatgtatcttgcattggtttgtggggtcgctcaatgggtgcggtcacaagtctaatgtatggagcggaggatccatcaattgcaggaatggttcttgatagcccattctccaacttggtcgacttaatgatggagctagtggacacctacaaatatccactgccaaaattcactgtcaaacttgcaatacagcatatgcgaaagattgtcaagaggaaagctagttttgacatcatggatcttgataccattcaggttgcaaaacgatgttttgttcctgctttgtttggacatgcaactgaggatgattttatacttccccatcattcagacaaaatatatgaatcatatattggtgacaaaaacattataaaatttgatggggaccacaattcaccacgtcctcaattttactttgactcaatcactatatttttccataatgtgctaaaccctcctgaagtggcagaggatcattatttcctgacaccacgtagtagccttggtcagggtcattgggatacagaacaggacatagagtataggttctctcaatcacctacagggacagcccgtgcggctacgacagaagatgccattgcacagttgcgttctagaaggctcatgagtagaatggaggttccatctggtgccaccactgaagacagggctgatcgaactgagggtttggatagtgatcaaggtccctcctcatctagtgtgtcaacagcaactcctcccaacggccgcaacggaaggttgctgactccaacctctgatgatggcgagtatgtggagtactcatttgatagcttgtcagatatgccttacaccgtggaagatgaagatagaatgctgatgcaagcaattcttgaatcactgaaagactatgaacagtcaaatataaaaaatgtgcaatccactgcatctgatgctgcacccaaagagaacgatactgtaagagagagcaatggtgtggctgctgcagcattggagcaagatgcagcctctgcatcattcgatgctcctgccaaacatacgaatgtctgcaacagtggagaaaaagtcagtgaagggcaaactacagattgcgacgctgtaaagaacagtgcttcggtctctgcttctggttcttcagagcccttagcgtcaacacagatgaccaatggaaaacctgcttcggcagaatcccagaaagtgactcagaatgccaatggggaggacggcactagagcaactttggtagtccagaagagccgtacgggcggcctgatagatggtttgacacaaaaatggggttctttcttcaagaacaacgactaa

SEQ ID NO: 6490 - protein, 572 aa, Sorghum bicolor
  misc_feature: Ceres ANNOT ID no. 6067189
  misc_feature (121)..(572): NCBI GI: 115453097 NCBI Desc: os03g0359000 [oryza sativa (japonica cultivar-group)]
  misc_feature (1)..(571): NCBI GI: 79415968 NCBI Desc: catalytic [arabidopsis thaliana]
  misc_feature (1)..(489): NCBI GI: 79474471 NCBI Desc: catalytic [arabidopsis thaliana]
  misc_feature (2)..(284): NCBI GI: 28828687 NCBI Desc: similar to dictyostelium discoideum (slime mold). random slug cdna-11 (fragment)
  misc_feature (2)..(289): NCBI GI: 46229712 NCBI Desc: protein with a conserved n-terminal region [cryptosporidium parvum]
MDQLVNFIIRPPRADYSPNDDLLEQEFMLKGRWFLRKDLEVKNGQGKTLQCSHYMPVVVPEGKALPCVIYCHGNSGCRADASEAAIILLPSNITVFTLDFSGSGLSEGEHVTLGWNEREDLKAVVNYLRTDGNVSCIGLWGRSMGAVTSLMYGAEDPSIAGMVLDSPFSNLVDLMMELVDTYKYPLPKFTVKLAIQHMRKIVKRKASFDIMDLDTIQVAKRCFVPALFGHATEDDFILPHHSDKIYESYIGDKNIIKFDGDHNSPRPQFYFDSITIFFHNVLNPPEVAEDHYFLTPRSSLGQGHWDTEQDIEYRFSQSPTGTARAATTEDAIAQLRSRRLMSRMEVPSGATTEDRADRTEGLDSDQGPSSSSVSTATPPNGRNGRLLTPTSDDGEYVEYSFDSLSDMPYTVEDEDRMLMQAILESLKDYEQSNIKNVQSTASDAAPKENDTVRESNGVAAAALEQDAASASFDAPAKHTNVCNSGEKVSEGQTTDCDAVKNSASVSASGSSEPLASTQMTNGKPASAESQKVTQNANGEDGTRATLVVQKSRTGGLIDGLTQKWGSFFKNND

SEQ ID NO: 6491 - DNA, 1677 bp, Sorghum bicolor
  misc_feature: Ceres ANNOT ID no. 6067194
  misc_feature: Encodes the peptide sequence at SEQ ID NO 6492
atggcgccggaggcggaagcggagtcgcccgtggtgatccacgcgtggtcggcgccgcgctccctcagcaccagcctcatgtactccttcgcccagagggatgacatggaggtgcttgacgagcctctctacgcgaatttcctgcgtgctactggcgtcgacaggccctaccgacaggagctcctgtctaaaatggaccctgatggaaataaggttgtcaaagaggtgatttttggcccaggagacaaaaagtatcgttactgcaagcacatctcaaagcaacgtctcccaaacctgtcaagcgacctcatgaagaagggaaagcatttcatattgatacgtaaccctctaaatatactgccatcttttgataaagttgttccaccatccttcatggagcttggcataggcgaacttgtctcaatatacagtgaattatgtggacttgggagcccaccccctgtgatagatgcagatgatctgcaacaggatcctgaggctgtcctgagtggactctgtgaggatctgggcattcctttccagccacaaatgttgaaatgggaagctggccccaaggaatttgatggtatatgggccccctggtggtatgggagtgtgcacaagtcttcgggcttctctaagcctcgccaatatcctctgactttcccattcgcgttttatgacctgcttgagcaaagcttgcctttctacaacatgttgaagcgccaaatgaggaagacaagaggactccagcaaccaccattacctgaccctcctctgcctgtccctgcaaataaaaacattcttgtttgggttggagatgaacttttgccccgtgacagtgcaaaggtttcagtgtttgattcagttgtacaaggaggagatgctgtttgggaaggtttacgtatatatgatggaaaagtattcaaactagatgaacatttggacagattgtttgattctgcaaaagctatggccttcataaatgtgcctactcgtgattggattaaggatgccatctttaagactctgattgcaaatggaatgtttgataatgctcatataaggctcacgctcacccgtgggaaaaaggtgacatctggaatgagtcctggtttcaatctttatgggtgcgccttgattgagtggaaaccgccagtgtatgataactctcatggaataaaattggttaccgccaccacacgtcgaaattctccaaatagtgtagactccaagatacatcacaacaatcttatcaacaatattctggcaaagatagaaggtaatcttgcccaggctgaggatgccattatgctagacaaggatggctttgtatcagaaacaaatgcaacaaacatttttatggttaaaaagggaattgtattgacacctcatgctgactattgccttccaggcattacgcgagcaactgtcatggatcttgtggtgaaagaaaactttgtgttacatgaacgacgcattagtctgtcagaatttcatgctgcagatgaggtatggacaactggaacaatgggtgaaattactccggttgtaatgattgacgggcgagaaatcggcgatgggaaaattggtccagtcactagacaaatccagaacgcatacaaagtcctgacagcagggcaaggagtaccgataccgaggattgctgaggtgtaa

SEQ ID NO: 6492 - protein, 558 aa, Sorghum bicolor
  misc_feature: Ceres ANNOT ID no. 6067194
  misc_feature (273)..(542): Pfam Id: Aminotran_4 Pfam Desc: Aminotransferase class IV
  misc_feature (12)..(558): NCBI GI: 23308233 NCBI Desc: at5g27410/f21a20_120 [arabidopsis thaliana]
  misc_feature (12)..(552): NCBI GI: 28949887 NCBI Desc: branched-chain amino acid aminotransferase-like protein [cicer arietinum]
  misc_feature (12)..(545): NCBI GI: 92871671 NCBI Desc: aminotransferase, class iv [medicago truncatula]
  misc_feature (12)..(552): NCBI GI: 140071492 NCBI Desc: aminotransferase, class iv [medicago truncatula]
  misc_feature (66)..(478): NCBI GI: 115453099 NCBI Desc: os03g0359100 [oryza sativa (japonica cultivar-group)]
  misc_feature: The sequence is a functional homolog of SEQ ID NO. 504 in the 11/188,298 US application
MAPEAEAESPVVIHAWSAPRSLSTSLMYSFAQRDDMEVLDEPLYANFLRATGVDRPYRQELLSKMDPDGNKVVKEVIFGPGDKKYRYCKHISKQRLPNLSSDLMKKGKHFILIRNPLNILPSFDKVVPPSFMELGIGELVSIYSELCGLGSPPPVIDADDLQQDPEAVLSGLCEDLGIPFQPQMLKWEAGPKEFDGIWAPWWYGSVHKSSGFSKPRQYPLTFPFAFYDLLEQSLPFYNMLKRQMRKTRGLQQPPLPDPPLPVPANKNILVWVGDELLPRDSAKVSVFDSVVQGGDAVWEGLRIYDGKVFKLDEHLDRLFDSAKAMAFINVPTRDWIKDAIFKTLIANGMFDNAHIRLTLTRGKKVTSGMSPGFNLYGCALIEWKPPVYDNSHGIKLVTATTRRNSPNSVDSKIHHNNLINNILAKIEGNLAQAEDAIMLDKDGFVSETNATNIFMVKKGIVLTPHADYCLPGITRATVMDLVVKENFVLHERRISLSEFHAADEVWTTGTMGEITPVVMIDGREIGDGKIGPVTRQIQNAYKVLTAGQGVPIPRIAEV

SEQ ID NO: 6493 - DNA, 999 bp, Sorghum bicolor
  misc_feature: Ceres ANNOT ID no. 6067198
  misc_feature: Encodes the peptide sequence at SEQ ID NO 6494
atgtccttcttcttccgcatggcgtcgcggctgcggccgtcgacgccggaggaggtggtccgctccatcaaggactccttcctggcgctccacacgcggacccacgccaaggctctggaagaggtcgagaaaaatatctcatccttgagattgttgatctatggtgatggcgaagtagaaccaaatcaagagcaggtcctacaaataacccttgagatttgcaaggaggacgtcatttccctgatcatccagaatcttccttctttgggttggggagtaagaaaagatctggttctctgctggtgcatttttcttaggcagaaagttgatgaaacttattgctgtgtgcagtatattgaaaatcatctggagcttttagatttccttgttggttgctacaagaacttggatattgcattgaactgtgggaatatgctaagagaatgcataaagtaccctacacttgcaaaatacatattggaatctggtagctttgagctgttctttgagtatgttgagctgccaaactttgatattgcttcagatgctctgaacaccttcaaggatctgcttaccaagcacgaagatgtagtcgcagggtttttgagttcccactacgagcagttttttgaactctactcaaggctcttgtcgtcaactaattatgtaactagaaggcaggcaatcaagttcctttcagaatttctactagaggctcctaactctcaaataatgaagagatacattgtggaagttcgctttttaaatattatgatcaatctactaaaggattcaagcaaaaatatcagaatatgtgccttccatgtttttaaggtatttgttgccaatccgaacaagcctcagtgtatcattgtagctttgctagacaatcgcagggaagttttgaagctactgcacagtcttcctacaagtaaaggtgacgatgaacttgatgaggagaaagacctaatcattcaggaaatccagaaactggcatag

SEQ ID NO: 6494 - protein, 332 aa, Sorghum bicolor
  misc_feature: Ceres ANNOT ID no. 6067198
  misc_feature (1)..(333): Pfam Id: Mo25 Pfam Desc: Mo25-like
  misc_feature (1)..(332): NCBI GI: 145362644 NCBI Desc: mo25 family protein [arabidopsis thaliana]
  misc_feature (12)..(331): NCBI GI: 115473049 NCBI Desc: os07g0585100 [oryza sativa (japonica cultivar-group)]
  misc_feature (12)..(331): NCBI GI: 140064512 NCBI Desc: calcium-binding protein 39-like , related [medicago truncatula]
  misc_feature (12)..(331): NCBI GI: 89257483 NCBI Desc: mo25 protein -related [brassica oleracea]
  misc_feature (12)..(331): NCBI GI: 15238126 NCBI Desc: mo25 family protein [arabidopsis thaliana]
MSFFFRMASRLRPSTPEEVVRSIKDSFLALHTRTHAKALEEVEKNISSLRLLIYGDGEVEPNQEQVLQITLEICKEDVISLIIQNLPSLGWGVRKDLVLCWCIFLRQKVDETYCCVQYIENHLELLDFLVGCYKNLDIALNCGNMLRECIKYPTLAKYILESGSFELFFEYVELPNFDIASDALNTFKDLLTKHEDVVAGFLSSHYEQFFELYSRLLSSTNYVTRRQAIKFLSEFLLEAPNSQIMKRYIVEVRFLNIMINLLKDSSKNIRICAFHVFKVFVANPNKPQCIIVALLDNRREVLKLLHSLPTSKGDDELDEEKDLIIQEIQKLA

SEQ ID NO: 6495 - DNA, 1485 bp, Sorghum bicolor
  misc_feature: Ceres ANNOT ID no. 6067236
  misc_feature: Encodes the peptide sequence at SEQ ID NO 6496
atgacgaaggcagcaactctttatgggagcaagacgcagagcgatgccctgcggccagggccattgcgtccagcaaattttatcagaaataaattccccacatacaagaatggttcaaatggtatagtgatcaagctggctgatggtccagaaatgccacctctcaaggagatcgttgcaaaggagactgcagatctacttgaccgtcgtcagcgtctctctgtccgtgaactcgcgatgaagtttgagaagggtctcaacactgccaccctgctgtcgaatgaggttaaatggagacaagtagctttgctggagcgggatatccttttgaagaatctaaagagtgtattagagtcactgagaggtcaggtgacgggcaaaactaaggatgaaatcgaggagtctatatctatggtggagatcctcgcggttcagctctccaaaagagaggctgagttgcttcagcaaaaagaagaagtcacaaaattagcaaaatcattaaagcaggcttctgaagacgcaaagagaattgttgaagaagaaagagctaatgctcatacagaaatagaaactgctaagagtgctgtccagagagttcagcaagcagttcaggagcatgagaagatgtcccaaaatactgggaaacaagacatggaagaactaaagaaagaagttagagaagcccggaggatcaaaatgttgcatcagcccagcaaggcaatggatctggaaaatgaaatacgaattttacgtaacacgtttgctgagaagtccaaggattgtgttaatcttttgaaagagttggaaatgcataaaaggttaaaagaaaatggtaccatcccttcatttgatttggagggtctccaatgcttaggatcaatgctacgtatagttggtctgagtggtacccacatggatttgtcaaatatttcaatccagtggttccggatacatccaaaagaaagcaacaaagagattatttcaggtgccacaagaccagtatatgctctagagccacatgatgttggacgctatttgcaagctgaaatcgatgttggcggtgaaattgcagtagcaaagacagctgggccagtagaccctgatgctggattggttgattatgtggagacactcgtaaggaaacctgaaactgaattcaatgttgttgtgcttcaattgaatggcgttgaccagccaaaagagtcagttcatgtactcaatgtcggaagactgcggatgaggcttactaaagggaagtcggtagttgccaaggaattctattcctcatcaatgcagttatgtggtgttagaggtggtggcgaagcagcctcgcaggcaatgttttggcgacccagaaacgacctcagcttggtgctagccttcgagagcactcgggaacgcaacacagccatcatgcttgctcggcgattcgctatagattgcaatatcatccttgctgggccaggcgacaaaactccctggtga

SEQ ID NO: 6496 - protein, 494 aa, Sorghum bicolor
  misc_feature: Ceres ANNOT ID no. 6067236
  misc_feature (1)..(491): NCBI GI: 115440567 NCBI Desc: os01g0805700 [oryza sativa (japonica cultivar-group)]
  misc_feature (26)..(491): NCBI GI: 55296828 NCBI Desc: plectin-related protein-like [oryza sativa (japonica cultivar-group)]
  misc_feature (250)..(494): NCBI GI: 115453143 NCBI Desc: os03g0364500 [oryza sativa (japonica cultivar-group)]
  misc_feature (26)..(433): NCBI GI: 42569815 NCBI Desc: proline-rich family protein [arabidopsis thaliana]
  misc_feature (55)..(272): NCBI GI: 18977539 NCBI Desc: smc-like [pyrococcus furiosus dsm 3638]
  misc_feature: Useful for making plants with altered alkaloid content
  misc_feature: Useful for making plants with altered terpenoid content
  misc_feature: Functional homolog of the protein sequence given in SEQ ID NO 13203
  misc_feature: Useful for making plants with altered alkaloid content
  misc_feature: Useful for making plants with altered terpenoid content
  misc_feature: Functional homolog of the protein sequence given in SEQ ID NO 13203
MTKAATLYGSKTQSDALRPGPLRPANFIRNKFPTYKNGSNGIVIKLADGPEMPPLKEIVAKETADLLDRRQRLSVRELAMKFEKGLNTATLLSNEVKWRQVALLERDILLKNLKSVLESLRGQVTGKTKDEIEESISMVEILAVQLSKREAELLQQKEEVTKLAKSLKQASEDAKRIVEEERANAHTEIETAKSAVQRVQQAVQEHEKMSQNTGKQDMEELKKEVREARRIKMLHQPSKAMDLENEIRILRNTFAEKSKDCVNLLKELEMHKRLKENGTIPSFDLEGLQCLGSMLRIVGLSGTHMDLSNISIQWFRIHPKESNKEIISGATRPVYALEPHDVGRYLQAEIDVGGEIAVAKTAGPVDPDAGLVDYVETLVRKPETEFNVVVLQLNGVDQPKESVHVLNVGRLRMRLTKGKSVVAKEFYSSSMQLCGVRGGGEAASQAMFWRPRNDLSLVLAFESTRERNTAIMLARRFAIDCNIILAGPGDKTPW

SEQ ID NO: 6497 - DNA, 294 bp, Sorghum bicolor
  misc_feature: Ceres ANNOT ID no. 6067242
  misc_feature: Encodes the peptide sequence at SEQ ID NO 6498
atggcgaagcgtctgatcccgtcgctgaaccgggtgctggtggagaagctgctgcagcccaagaagagcgtcggcggcatcctcctcccggagaccaccaagcagctgaatgctgctaatgtcattgctgttggccctggtgatcgtgatagggatggtaagctgatccctgtatctctgaatgaaggcgacactgttctgcttccggagtatggtggaacagaagtgaagcttgctgaaaaagagtaccttcttttcagagagcacgacatactgggaaagcttgaggagtag

SEQ ID NO: 6498 - protein, 97 aa, Sorghum bicolor
  misc_feature: Ceres ANNOT ID no. 6067242
  misc_feature (4)..(95): Pfam Id: Cpn10 Pfam Desc: Chaperonin 10 Kd subunit
  misc_feature (1)..(95): NCBI GI: 2267597 NCBI Desc: 10 kda chaperonin [oryza sativa]
  misc_feature (1)..(97): NCBI GI: 1519241 NCBI Desc: 10 kda chaperonin
  misc_feature (1)..(97): NCBI GI: 125620176 NCBI Desc: small molecular heat shock protein 10 [nelumbo nucifera]
  misc_feature (1)..(85): NCBI GI: 124360531 NCBI Desc: groes-like [medicago truncatula]
  misc_feature (1)..(83): NCBI GI: 92870392 NCBI Desc: groes-like [medicago truncatula]
MAKRLIPSLNRVLVEKLLQPKKSVGGILLPETTKQLNAANVIAVGPGDRDRDGKLIPVSLNEGDTVLLPEYGGTEVKLAEKEYLLFREHDILGKLEE

SEQ ID NO: 6499 - DNA, 675 bp, Sorghum bicolor
  misc_feature: Ceres ANNOT ID no. 6067259
  misc_feature: Encodes the peptide sequence at SEQ ID NO 6500
atgggttccgaggggccatcttctccgatcaccaccaccgtccatgtcactggattcaagaagttccatggggtcgctgagaaccccacagagaaaatcgtacgcaacctcccgtcattcatggagacgaaagggttgcccaagggtcttgtgcttgggagctgcaccgtccttgaggctgccgggcagggtgcgcttggtccgttgtatgaattgctggagtcgactgtctccggccgggaatgtggaatgccaagtcaggaccgagtaattctgctccattttggcgccaacagtggttcacataggtttgctcttgagaatcaagctgttaatgaagctactttccgttgccctgatgagctaggatggaaaccacagaggatgcctatcataccatctgatggaagcattttacacgcaagacagactacactgccagtgaaggacataaacaagtctctccaacagatgggatatgatgtgatgccttcagatgatgctggtcgatttgtgtgcaattatgtctattatcactcgcttaagtttgcagaggaacatggcatcaggtccctcttcgttcatttccctctcttcttggcaattgatgaggaagttcagatgcaatttgttgcttcccttcttgaagtcctcgcttccttgaacttacagtaa

SEQ ID NO: 6500 - protein, 224 aa, Sorghum bicolor
  misc_feature: Ceres ANNOT ID no. 6067259
  misc_feature (12)..(224): Pfam Id: Peptidase_C15 Pfam Desc: Pyroglutamyl peptidase
  misc_feature (1)..(222): NCBI GI: 38175741 NCBI Desc: pyrrolidone carboxyl peptidase-like protein [oryza sativa (japonica cultivar-group)]
  misc_feature (1)..(219): NCBI GI: 50252601 NCBI Desc: pyrrolidone carboxyl peptidase-like protein [oryza sativa (japonica cultivar-group)]
  misc_feature (95)..(220): NCBI GI: 8778575 NCBI Desc: f28c11.8 [arabidopsis thaliana]
  misc_feature (33)..(221): NCBI GI: 145325451 NCBI Desc: pyrrolidone-carboxylate peptidase family protein [arabidopsis thaliana]
  misc_feature (1)..(79): NCBI GI: 9295697 NCBI Desc: f26f24.31 [arabidopsis thaliana]
MGSEGPSSPITTTVHVTGFKKFHGVAENPTEKIVRNLPSFMETKGLPKGLVLGSCTVLEAAGQGALGPLYELLESTVSGRECGMPSQDRVILLHFGANSGSHRFALENQAVNEATFRCPDELGWKPQRMPIIPSDGSILHARQTTLPVKDINKSLQQMGYDVMPSDDAGRFVCNYVYYHSLKFAEEHGIRSLFVHFPLFLAIDEEVQMQFVASLLEVLASLNLQ

SEQ ID NO: 6501 - DNA, 1014 bp, Sorghum bicolor
  misc_feature: Ceres ANNOT ID no. 6067260
  misc_feature: Encodes the peptide sequence at SEQ ID NO 6502
atggccattgctgctacttcacccaagatgtcgtccgttttagccgcacttagcttgctgctcctagccgttgcgtgccaggccagcccttactaccctctggagctagggtactaccgttacaagtgtccccaggctgaggccatcgtgaaggccatcatggagaaggccatcgcccagaaccctggcaatggcgctggtctcatccgtatgctcttccatgactgtttcgtcgagggctgtgatgcttccgtgcttctggacccgaccccgttcagcccgacgccggagaagacaagcccgcccaacaacccaagcctacgcgggttcgagctgatcgacgccatcaaggacgccctggaggccgcgtgccccggggtcgtctcctgcgccgacatcatcgccttcgcggcccgcgacgcgtcctacttcctgagcggcggcaaggtccgcttcgacatgccggcgggccgcctggacggcaccttctccaacgcctccgagtcgctcaagttcctggtcccgccgacgtccaacctcagcaccctcgtctccagcttcgccgtcaaggggatgtcggtggaggacctggtcgtgctctccggcgcgcacaccgtcggccgctcccactgctcctccttcgtctccgaccgcctcaatgcctcggtcccctccgacatcagccccgggctagccggcttcctcaagagccgctgcccggccaacccgacgagcagcggcaacgaccccacggtgatgcaggacgtggtgacgcccaacgccatggacaaccagtactacaagaacgtgctgtcgcacaccgtgctcttcacctccgacgccgatctcctcacgtcggcgcagacggccaagctggtgctggacaacgccaatatccccgggtggtgggaggacaagttcgagaaggccatggtgaagatggccagcatcgaagtcaagaccggctaccaaggccaggtgaggaagaactgcagggcgatcaatcactactag

SEQ ID NO: 6502 - protein, 337 aa, Sorghum bicolor
  misc_feature: Ceres ANNOT ID no. 6067260
  misc_feature (50)..(299): Pfam Id: peroxidase Pfam Desc: Peroxidase
  misc_feature (4)..(337): NCBI GI: 12056450 NCBI Desc: peroxidase [zea mays]
  misc_feature (3)..(335): NCBI GI: 115453175 NCBI Desc: os03g0368600 [oryza sativa (japonica cultivar-group)]
  misc_feature (22)..(335): NCBI GI: 115453171 NCBI Desc: os03g0368000 [oryza sativa (japonica cultivar-group)]
  misc_feature (14)..(335): NCBI GI: 55700953 NCBI Desc: tpa: class iii peroxidase 43 precursor [oryza sativa (japonica cultivar-group)]
  misc_feature (12)..(335): NCBI GI: 55701005 NCBI Desc: tpa: class iii peroxidase 69 precursor [oryza sativa (japonica cultivar-group)]
  misc_feature: Useful for making plants with altered carbohydrate content
  misc_feature: Functional homolog of the protein sequence given in SEQ ID NO 13714
  misc_feature: Useful for making plants with altered cell wall content and/or composition
  misc_feature: Functional homolog of the protein sequence given in SEQ ID NO 13958
  misc_feature: Useful for making plants with modulated oxidative stress sensitivity
  misc_feature: Functional homolog of the protein sequence given in SEQ ID NO 13607
MAIAATSPKMSSVLAALSLLLLAVACQASPYYPLELGYYRYKCPQAEAIVKAIMEKAIAQNPGNGAGLIRMLFHDCFVEGCDASVLLDPTPFSPTPEKTSPPNNPSLRGFELIDAIKDALEAACPGVVSCADIIAFAARDASYFLSGGKVRFDMPAGRLDGTFSNASESLKFLVPPTSNLSTLVSSFAVKGMSVEDLVVLSGAHTVGRSHCSSFVSDRLNASVPSDISPGLAGFLKSRCPANPTSSGNDPTVMQDVVTPNAMDNQYYKNVLSHTVLFTSDADLLTSAQTAKLVLDNANIPGWWEDKFEKAMVKMASIEVKTGYQGQVRKNCRAINHY

SEQ ID NO: 6503 - DNA, 999 bp, Sorghum bicolor
  misc_feature: Ceres ANNOT ID no. 6067262
  misc_feature: Encodes the peptide sequence at SEQ ID NO 6504
atggcggcgagcaaggtgcctgcactgctctcatgtgcgttcttgctcctaggagcagcagctggttactacagtcctccgagtcctgcttcgtgcgagctcaaggtgggatactaccaccacaagtgcccccccgccgaggccatcgtcaagagcgtcgtcggagccgccgtccggcagaaccccggcgtcggcgccggcctcattcgcatgctcttccacgactgcttcgtcgagggctgcgacgcctccgtcctgctggacccgacgccggccaacccgcagccagagaagctcggctcgcccaacaaccccagcctccggggcttcgaggtcatcgacgccgccaaggccgcggtcgagcgggcgtgcccgggcgtcgtctcctgcgcggacatcgtcgccttcgccgcccgcgacgcctccttcttcctcggcggccgcggggtcgacttcgacatgcccgccggccgcctcgacggccgcgtctccaacgcctcgcgcaccctcgacttcctcccgccgccgacctccaacctctccgggctcgtccagagcttcgccgccaagggcctcggcgtcgatgacatggtcgtgctctcgggcgcgcacaccgtcggccgctcccactgctcgtccttcgtccccgaccgcctcgccgttccttcggacatcagcccctccttcgccgcgtctctgaggggccagtgcccggcaagccccagctccagcaatgaccccaccgtcgtgcaggacgtcgtgacgcccgacaagctggacagccagtattacaagaacgtgctggcgcacagagttctcttcacgtcggacgcctcactcctctcgtcaccggcgacggcgaagatggtctcggacaatgccaacatccctgggtggtgggaggacaggttcaaggcggccatggtgaagatggccagtgtcgaggtgaagaccggcaacagcggcgagatcaggaggaactgccgggtcgtcaactag

SEQ ID NO: 6504 - protein, 332 aa, Sorghum bicolor
  misc_feature: Ceres ANNOT ID no. 6067262
  misc_feature (50)..(296): Pfam Id: peroxidase Pfam Desc: Peroxidase
  misc_feature (1)..(332): NCBI GI: 12056450 NCBI Desc: peroxidase [zea mays]
  misc_feature (30)..(332): NCBI GI: 115453175 NCBI Desc: os03g0368600 [oryza sativa (japonica cultivar-group)]
  misc_feature (30)..(332): NCBI GI: 115453171 NCBI Desc: os03g0368000 [oryza sativa (japonica cultivar-group)]
  misc_feature (30)..(332): NCBI GI: 55700953 NCBI Desc: tpa: class iii peroxidase 43 precursor [oryza sativa (japonica cultivar-group)]
  misc_feature (11)..(332): NCBI GI: 55701005 NCBI Desc: tpa: class iii peroxidase 69 precursor [oryza sativa (japonica cultivar-group)]
  misc_feature: Useful for making plants with altered carbohydrate content
  misc_feature: Functional homolog of the protein sequence given in SEQ ID NO 13714
  misc_feature: Useful for making plants with altered cell wall content and/or composition
  misc_feature: Functional homolog of the protein sequence given in SEQ ID NO 13958
MAASKVPALLSCAFLLLGAAAGYYSPPSPASCELKVGYYHHKCPPAEAIVKSVVGAAVRQNPGVGAGLIRMLFHDCFVEGCDASVLLDPTPANPQPEKLGSPNNPSLRGFEVIDAAKAAVERACPGVVSCADIVAFAARDASFFLGGRGVDFDMPAGRLDGRVSNASRTLDFLPPPTSNLSGLVQSFAAKGLGVDDMVVLSGAHTVGRSHCSSFVPDRLAVPSDISPSFAASLRGQCPASPSSSNDPTVVQDVVTPDKLDSQYYKNVLAHRVLFTSDASLLSSPATAKMVSDNANIPGWWEDRFKAAMVKMASVEVKTGNSGEIRRNCRVVN

SEQ ID NO: 6505 - DNA, 582 bp, Sorghum bicolor
  misc_feature: Ceres ANNOT ID no. 6067267
  misc_feature: Encodes the peptide sequence at SEQ ID NO 6506
atggcggcgccacggagcgtgagcgtgagggtggcggaccgcgcgctgcgaggcgtggcggacctgatcaagctgctgccgagcggcacggtgttcatgttccagttcctctccccgctggtgaccaacaacgggcactgcgcgctggcgctcaacaaggtgctgagcggcgcgctggtggcgctctgcggcgcctcctgcgccttctcctccttcaccgacagctacgtgggcgccgacggccgcgtctactacggcgtggtgacgccgcggggcctccgcaccttcgcgaccgacccggacgccgccgccagggacctgtcgccgtaccgcctccgcgcgggggacttcgtccacgccgcgctggcgctgctcgtgttcgccgccatcgcgctcctcgacgccgacaccgtcgcctgcctctacccggcgctcgagctcagcgagcgcaccatgatggccgtgctcccgcctgtcgttggtgccgtcgccgggtacgtgttcatggtgttcccgaataaccgccatggcgttgggtaccagcccaccaccgccaccgaggacttccagcacaaatactag

SEQ ID NO: 6506 - protein, 193 aa, Sorghum bicolor
  misc_feature: Ceres ANNOT ID no. 6067267
  misc_feature (11)..(180): NCBI GI: 15528693 NCBI Desc: p0560b06.26 [oryza sativa (japonica cultivar-group)]
  misc_feature (11)..(180): NCBI GI: 115436576 NCBI Desc: os01g0368700 [oryza sativa (japonica cultivar-group)]
  misc_feature (16)..(187): NCBI GI: 115441457 NCBI Desc: os01g0882400 [oryza sativa (japonica cultivar-group)]
  misc_feature (22)..(179): NCBI GI: 72384432 NCBI Desc: 52o08_3 [brassica rapa subsp. pekinensis]
  misc_feature (13)..(90): NCBI GI: 15528687 NCBI Desc: p0560b06.19 [oryza sativa (japonica cultivar-group)]
MAAPRSVSVRVADRALRGVADLIKLLPSGTVFMFQFLSPLVTNNGHCALALNKVLSGALVALCGASCAFSSFTDSYVGADGRVYYGVVTPRGLRTFATDPDAAARDLSPYRLRAGDFVHAALALLVFAAIALLDADTVACLYPALELSERTMMAVLPPVVGAVAGYVFMVFPNNRHGVGYQPTTATEDFQHKY

SEQ ID NO: 6507 - DNA, 396 bp, Sorghum bicolor
  misc_feature: Ceres ANNOT ID no. 6067281
  misc_feature: Encodes the peptide sequence at SEQ ID NO 6508
atgccggactccaagaagattgtgctgaaggtggacgtcctcggcgacgggtgcaaggccaaagccatgagcaccgtggccaacttccagggcgtgaagtcggtggcggtggacggggaggggacgctgacggtggtgggggaggtggacgtggtgcgcgtggccaaggcgctgcgcaaggccaggttcgaggcgcgcgtcctcagcgtcggcccggagaagcagcccgacaacaagaagcccgccgccgccgaggaggccaagaagccgccgccgtgctgcgccggctgcagcgcctgctgtccaccggtcccggcgtacgcgcatcctttccccggtgccgtggtgtgctacgaggagcaggccgccgcgggcaacgtgtgcgtcatcctctga

SEQ ID NO: 6508 - protein, 131 aa, Sorghum bicolor
  misc_feature: Ceres ANNOT ID no. 6067281
  misc_feature (7)..(67): Pfam Id: HMA Pfam Desc: Heavy-metal-associated domain
  misc_feature (5)..(130): NCBI GI: 32488374 NCBI Desc: osjnba0043a12.4 [oryza sativa (japonica cultivar-group)]
  misc_feature (5)..(121): NCBI GI: 116310363 NCBI Desc: osigba0128p10.10 [oryza sativa (indica cultivar-group)]
  misc_feature (5)..(131): NCBI GI: 140066203 NCBI Desc: heavy metal transport/detoxification protein [medicago truncatula]
  misc_feature (5)..(131): NCBI GI: 116310418 NCBI Desc: osigba0150f01.6 [oryza sativa (indica cultivar-group)]
  misc_feature (4)..(114): NCBI GI: 116310040 NCBI Desc: h0112g12.8 [oryza sativa (indica cultivar-group)]
MPDSKKIVLKVDVLGDGCKAKAMSTVANFQGVKSVAVDGEGTLTVVGEVDVVRVAKALRKARFEARVLSVGPEKQPDNKKPAAAEEAKKPPPCCAGCSACCPPVPAYAHPFPGAVVCYEEQAAAGNVCVIL

SEQ ID NO: 6509 - DNA, 813 bp, Sorghum bicolor
  misc_feature: Ceres ANNOT ID no. 6067282
  misc_feature: Encodes the peptide sequence at SEQ ID NO 6510
atgccgcggaacttccgcaagcggggcatcgagccggacactgacgaccgctccgacgacgaggacactcgccgcgtcgccctcgaggagatcaagtacatgcagaagctccgtgagaggaagctgggtatccccgccggcaccgccgccgcatccactaacgggtcctccgcccgtggtggtcgagtgggcagcggggcagcggccgctggcgaggctgagaaggaggacctcgtcctccaggacaccttcgctcaggagaccgccgtcaccatcgaggaccccaacatgttgaggtatgtggagactgagcttgcgaagaagaggggtaagatggttgatgtgggacacaaggaagagatggaccatgtggacgagctctacactgtgccagaccacctcaaggtgaagaagaagaactcagaggagagctcgacacaatggaccactggcattgctgaagttcagctgcccattgagtacaaattaagaaatattgaagaaactgaggcagctaaaaaggtgctgcaagagaaaaggcttgctagtaaaccaaaatcagatgcaaacattccatcaagttacagtgctgattatttccaccgtgggaaagaatatgatgagaaactgcgaagagagaatcctggattgtacaaagataatgattctcggcctagaggaagttcaggaggcaaagcaacagatactaaaaatccaggtggcgttggtgcaggacggagagaagccgcgagtgatgagttcatgcttgagcgtttccgcaaacgagaaaaattccgtgcccttcgaagatag

SEQ ID NO: 6510 - protein, 270 aa, Sorghum bicolor
  misc_feature: Ceres ANNOT ID no. 6067282
  misc_feature (97)..(187): Pfam Id: Hep_59 Pfam Desc: Hepatocellular carcinoma-associated antigen 59
  misc_feature (97)..(270): NCBI GI: 22137212 NCBI Desc: at1g02330/t6a9_12 [arabidopsis thaliana]
  misc_feature (25)..(264): NCBI GI: 51950077 NCBI Desc: mgc84248 protein [xenopus laevis]
  misc_feature (6)..(264): NCBI GI: 17068385 NCBI Desc: chromosome 9 open reading frame 78 [homo sapiens]
  misc_feature (6)..(264): NCBI GI: 7706557 NCBI Desc: chromosome 9 open reading frame 78 [homo sapiens]
  misc_feature (3)..(264): NCBI GI: 53734462 NCBI Desc: zgc:103692 [danio rerio]
MPRNFRKRGIEPDTDDRSDDEDTRRVALEEIKYMQKLRERKLGIPAGTAAASTNGSSARGGRVGSGAAAAGEAEKEDLVLQDTFAQETAVTIEDPNMLRYVETELAKKRGKMVDVGHKEEMDHVDELYTVPDHLKVKKKNSEESSTQWTTGIAEVQLPIEYKLRNIEETEAAKKVLQEKRLASKPKSDANIPSSYSADYFHRGKEYDEKLRRENPGLYKDNDSRPRGSSGGKATDTKNPGGVGAGRREAASDEFMLERFRKREKFRALRR

SEQ ID NO: 6511 - DNA, 1035 bp, Sorghum bicolor
  misc_feature: Ceres ANNOT ID no. 6067285
  misc_feature: Encodes the peptide sequence at SEQ ID NO 6512
atggcgcgcgtcctcccgctcagcatcgaggcgggggagatggccagaagcgaagaggcagtgacggacatgccaaggtcttcagcaggggcatcatgcacagcaattgaccattctgagcagaacacaaaggatgatgaatatgagaggctggttatacgggctcaacatgaaacatctggcacggcaattttatctgagcaaacaaagtcaagatccttcatttggtggatgaaagttctgcttggctgcttccttcttatattagtgggttatgtcttcgtgaaatggggagtcccctttgcctttgagaaggttctcgtgccaatcatgcaatgggaagcaagtgcttttgggcgtccagtattagctgttgttcttgttgcatctttggctctctttccagttattctagttccttctggaccttctatgtggttagcaggaatgatctttggatatggttggggtttcttgattataatggtcgggactactattggcatggtggtaccatactggattggctcattattccgtgaacgtctgcatgtatggttagcaaagtggcctcagcagatagcattaataaaacttgcaggtgaagggaattggttccagcagtttcgggttgttgcgcttttcagaatctcgccattcccatatacaatttttaattatgccgtaactgtgactgaaattaagttcaacccttatctctgtggttctgttgctggaatgatacctgaggccttcatctatatttacagtgggcgtttaatacggacattggctgacatgaagtacggcaactataaaatgacaccagtggaaatagcatacaacgccatttccttggttatcgccatcgtcctcacagtcgccttcacggtgtatgccaagagagctctgaatgacattgaaagttcggacggtatcactaaagaagatcacagcccaaatggctcaggggcgcgtgtgagtcatcgtcaggagcgcgccgatgcgcgttccatacaactagatgttgtatga

SEQ ID NO: 6512 - protein, 344 aa, Sorghum bicolor
  misc_feature: Ceres ANNOT ID no. 6067285
  misc_feature (139)..(260): Pfam Id: SNARE_assoc Pfam Desc: SNARE associated Golgi protein
  misc_feature (47)..(325): NCBI GI: 124359825 NCBI Desc: f5o11.19, related [medicago truncatula]
  misc_feature (72)..(257): NCBI GI: 92892046 NCBI Desc: at1g12450-related [medicago truncatula]
  misc_feature (40)..(185): NCBI GI: 8778630 NCBI Desc: f5o11.19 [arabidopsis thaliana]
  misc_feature (65)..(310): NCBI GI: 67922563 NCBI Desc: deda [crocosphaera watsonii wh 8501]
  misc_feature (80)..(323): NCBI GI: 53688163 NCBI Desc: cog0398: uncharacterized conserved protein [nostoc punctiforme pcc 73102]
MARVLPLSIEAGEMARSEEAVTDMPRSSAGASCTAIDHSEQNTKDDEYERLVIRAQHETSGTAILSEQTKSRSFIWWMKVLLGCFLLILVGYVFVKWGVPFAFEKVLVPIMQWEASAFGRPVLAVVLVASLALFPVILVPSGPSMWLAGMIFGYGWGFLIIMVGTTIGMVVPYWIGSLFRERLHVWLAKWPQQIALIKLAGEGNWFQQFRVVALFRISPFPYTIFNYAVTVTEIKFNPYLCGSVAGMIPEAFIYIYSGRLIRTLADMKYGNYKMTPVEIAYNAISLVIAIVLTVAFTVYAKRALNDIESSDGITKEDHSPNGSGARVSHRQERADARSIQLDVV

SEQ ID NO: 6513 - DNA, 789 bp, Sorghum bicolor
  misc_feature: Ceres ANNOT ID no. 6067298
  misc_feature: Encodes the peptide sequence at SEQ ID NO 6514
atggcggccacgctcttctccacctccctctcgccccagttcctctccctctccgtcaagcccactcccgccgccccgtccgccgcagcatttttcccatcgggcctgccgcagctccacgcggtctccgccgccgcggcgggcttcaggccgctcgagcccgtgcgcgcggccgcgaccgcggccgtgacggaggaactcgaagcggaggggcagccgggcggggaggaggagttctcggaggatctcagggtcttcgttggcaaccttcccttcagcgtcgacagcgcccagctcgcgggacttttcgagcaggccggctccgtcgagatggtcgaggtcatctatgacaagttgaccggaagaagccgtggattcggatttgtgaccatgtcttcagtccaagaagttgaggcggctgttgagcaattcaatggctatgtacttgatggaagaagtttgagggtgaattctgggccaccaccacccagggatccatcctcacaaagaggacccaggggtgatgccaacagggtctacgtgggcaacctttcctggggtgttgacaattcagctctcgcaaacctgttcagtgagcaaggtgaggtcctggaagcgaggattgtatatgacagggagagtggaaggtcaaggggttttggtttcgtcacgtatggttccgctgaagaggttgagaatgcgatatcgaaccttgatggctccgacttggatggcagacagatccgtgtcacggtagcagagtcgaagccacctaggcggcaattctga

SEQ ID NO: 6514 - protein, 262 aa, Sorghum bicolor
  misc_feature: Ceres ANNOT ID no. 6067298
  misc_feature (85)..(156): Pfam Id: RRM_1 Pfam Desc: RNA recognition motif. (a.k.a. RRM, RBD, or RNP domain)
  misc_feature (179)..(250): Pfam Id: RRM_1 Pfam Desc: RNA recognition motif. (a.k.a. RRM, RBD, or RNP domain)
  misc_feature (2)..(262): NCBI GI: 19754 NCBI Desc: 29kd a ribonucleoprotein [nicotiana sylvestris]
  misc_feature (2)..(262): NCBI GI: 19708 NCBI Desc: rna binding protein 30 [nicotiana plumbaginifolia]
  misc_feature (7)..(182): NCBI GI: 14135 NCBI Desc: 29kd b ribonucleoprotein [nicotiana sylvestris]
  misc_feature (7)..(182): NCBI GI: 19710 NCBI Desc: rna binding protein 31 [nicotiana plumbaginifolia]
  misc_feature (1)..(173): NCBI GI: 681902 NCBI Desc: cp29 [arabidopsis thaliana]
  misc_feature: The plant is abnormally small.
  misc_feature: The sequence is a functional homolog of SEQ ID NO 1039 in the 10/374,780US patent application
  misc_feature: The sequence is a functional homolog of SEQ ID NO 1042 in the 10/374,780US patent application
  misc_feature: The sequence is a functional homolog of SEQ ID NO 849 in the 10/666,642US patent application
  misc_feature: The sequence is a functional homolog of SEQ ID NO 852 in the 10/666,642US patent application
  misc_feature: Useful for making plants with modulated biomass
  misc_feature: Useful for making plants with modulated growth and phenotype characteristics
  misc_feature: Useful for making plants with modulated nitrogen use efficiency
  misc_feature: Functional homolog of the protein sequence given in SEQ ID NO 12896
  misc_feature: The sequence is a functional homolog of SEQ ID NO 1039 in the 20060162006 US patent application
  misc_feature: The sequence is a functional homolog of SEQ ID NO 1042 in the 20060162006 US patent application
  misc_feature: The sequence is a functional homolog of SEQ ID NO 22 in US patent 7244875
  misc_feature: The sequence is a functional homolog of SEQ ID NO. 339 in the 11/188,298 US application
  misc_feature: The sequence is a functional homolog of SEQ ID NO. 458 in the 11/188,298 US application
MAATLFSTSLSPQFLSLSVKPTPAAPSAAAFFPSGLPQLHAVSAAAAGFRPLEPVRAAATAAVTEELEAEGQPGGEEEFSEDLRVFVGNLPFSVDSAQLAGLFEQAGSVEMVEVIYDKLTGRSRGFGFVTMSSVQEVEAAVEQFNGYVLDGRSLRVNSGPPPPRDPSSQRGPRGDANRVYVGNLSWGVDNSALANLFSEQGEVLEARIVYDRESGRSRGFGFVTYGSAEEVENAISNLDGSDLDGRQIRVTVAESKPPRRQF

SEQ ID NO: 6515 - DNA, 447 bp, Sorghum bicolor
  misc_feature: Ceres ANNOT ID no. 6067299
  misc_feature: Encodes the peptide sequence at SEQ ID NO 6516
atggagaggcgggcgcaggccgagctggaccttgagctcaggctccttcccggcgactcggatccggagccgctcggcttcttcgtctgcacctactgcgaccgcaagttctacacctcgcaggcgctcggcggccaccagaacgcgcataagtacgagcgcaccctcgccaagcgccgccgggagatcgccgccgccatgcgcgcgcacggggcgcctgcggtggccgcctgggccgccgccgctgccgccacgaggaccggctgtgctgggactgtcaacgtcgctgctggaggtgaccctggcagagagaggctgcgggaagtgcagcaagccgttctgtcgccagagcaatcgtctcgcctgctgctgcgcgacaagaagagctcgtcgtcggagtacggcgtcgagcgccacggcgagctggacttgagcctcaggctatga

SEQ ID NO: 6516 - protein, 148 aa, Sorghum bicolor
  misc_feature: Ceres ANNOT ID no. 6067299
  misc_feature (28)..(73): NCBI GI: 30725290 NCBI Desc: at5g25160 [arabidopsis thaliana]
  misc_feature (28)..(63): NCBI GI: 9758313 NCBI Desc: cchh finger protein 2-like protein [arabidopsis thaliana]
  misc_feature (28)..(59): NCBI GI: 124360460 NCBI Desc: histone h4; zinc finger, c2h2-type [medicago truncatula]
  misc_feature (28)..(73): NCBI GI: 8979731 NCBI Desc: zinc finger-like protein [arabidopsis thaliana]
  misc_feature (28)..(59): NCBI GI: 6503285 NCBI Desc: identical to gis55881 zinc finger protein 1 from arabidopsis thaliana
  misc_feature: The plant is abnormally small.
  misc_feature: The plant produces a reduced number of seeds.
  misc_feature: The sequence is a functional homolog of SEQ ID NO 10 in the 10/412,699US patent application
  misc_feature: The sequence is a functional homolog of SEQ ID NO 1013 in the 10/666,642US patent application
  misc_feature: The sequence is a functional homolog of SEQ ID NO 1090 in the 10/412,699US patent application
  misc_feature: The sequence is a functional homolog of SEQ ID NO 1091 in the 10/412,699US patent application
  misc_feature: The sequence is a functional homolog of SEQ ID NO 1092 in the 10/412,699US patent application
  misc_feature: The sequence is a functional homolog of SEQ ID NO 1093 in the 10/412,699US patent application
  misc_feature: The sequence is a functional homolog of SEQ ID NO 1094 in the 10/412,699US patent application
  misc_feature: The sequence is a functional homolog of SEQ ID NO 124 in the 11/479,226US patent application
  misc_feature: The sequence is a functional homolog of SEQ ID NO 1279 in the 10/666,642US patent application
  misc_feature: The sequence is a functional homolog of SEQ ID NO 2306 in the 10/374,780US patent application
  misc_feature: The sequence is a functional homolog of SEQ ID NO 2310 in the 10/374,780US patent application
  misc_feature: The sequence is a functional homolog of SEQ ID NO 497 in the 11/479,226US patent application
  misc_feature: The sequence is a functional homolog of SEQ ID NO 518 in the 10/225,066US patent application
  misc_feature: The sequence is a functional homolog of SEQ ID NO 635 in the 10/374,780US patent application
  misc_feature: The sequence is a functional homolog of SEQ ID NO 636 in the 10/374,780US patent application
  misc_feature: The sequence is a functional homolog of SEQ ID NO 637 in the 10/374,780US patent application
  misc_feature: The sequence is a functional homolog of SEQ ID NO 638 in the 10/374,780US patent application
  misc_feature: The sequence is a functional homolog of SEQ ID NO 639 in the 10/374,780US patent application
  misc_feature: The sequence is a functional homolog of SEQ ID NO 712 in the 10/225,066US patent application
  misc_feature: The sequence is a functional homolog of SEQ ID NO 760 in the 10/666,642US patent application
  misc_feature: The sequence is a functional homolog of SEQ ID NO 761 in the 10/666,642US patent application
  misc_feature: The sequence is a functional homolog of SEQ ID NO 762 in the 10/666,642US patent application
  misc_feature: The sequence is a functional homolog of SEQ ID NO 763 in the 10/666,642US patent application
  misc_feature: Useful for biocontainment applications
  misc_feature: Useful for making plants with modulated biomass
  misc_feature: Useful for making plants with modulated growth and phenotype characteristics
  misc_feature: The sequence is a functional homolog of SEQ ID NO 10 in the 20040045049 US patent application
  misc_feature: The sequence is a functional homolog of SEQ ID NO 1090 in the 20040045049 US patent application
  misc_feature: The sequence is a functional homolog of SEQ ID NO 1091 in the 20040045049 US patent application
  misc_feature: The sequence is a functional homolog of SEQ ID NO 1092 in the 20040045049 US patent application
  misc_feature: The sequence is a functional homolog of SEQ ID NO 1093 in the 20040045049 US patent application
  misc_feature: The sequence is a functional homolog of SEQ ID NO 1094 in the 20040045049 US patent application
  misc_feature: The sequence is a functional homolog of SEQ ID NO 518 in the 20050160493 US patent application
  misc_feature: The sequence is a functional homolog of SEQ ID NO 712 in the 20050160493 US patent application
  misc_feature: The sequence is a functional homolog of SEQ ID NO 1013 in the 20070033671 US patent application
  misc_feature: GREAT-hit functional homolog of the protein sequence given in SEQ ID NO 13581
MERRAQAELDLELRLLPGDSDPEPLGFFVCTYCDRKFYTSQALGGHQNAHKYERTLAKRRREIAAAMRAHGAPAVAAWAAAAAATRTGCAGTVNVAAGGDPGRERLREVQQAVLSPEQSSRLLLRDKKSSSSEYGVERHGELDLSLRL

SEQ ID NO: 6517 - DNA, 396 bp, Sorghum bicolor
  misc_feature: Ceres ANNOT ID no. 6067307
  misc_feature: Encodes the peptide sequence at SEQ ID NO 6518
atggagcatcatcatcatcaggagctggaccttgagctcagcctccagcccttctcggcggatgcagcggcggccgcggatgaccctcccggcttcttcgtctgcacctactgcgaccgcaagttctacagctcgcaggcgctcggcggccaccagaacgcgcacaagtacgagcgcaccctcgccaagcgccgccgggagatcgccgccgccatgcgcgcgcacggcgcccggcaggtcgacgccgccgccgcatccacctgcagcaggccaggcggggaccgagcgcccgcggtgcagtctgccgccgccttgctgcgcggcaagagcagctctctggagcgcggcggcgtcgagcgcgccgccgccgagttggacttgtctctcaggctatga

SEQ ID NO: 6518 - protein, 131 aa, Sorghum bicolor
  misc_feature: Ceres ANNOT ID no. 6067307
  misc_feature (3)..(68): NCBI GI: 9758313 NCBI Desc: cchh finger protein 2-like protein [arabidopsis thaliana]
  misc_feature (33)..(71): NCBI GI: 8979731 NCBI Desc: zinc finger-like protein [arabidopsis thaliana]
  misc_feature (33)..(76): NCBI GI: 30725290 NCBI Desc: at5g25160 [arabidopsis thaliana]
  misc_feature (30)..(64): NCBI GI: 6503285 NCBI Desc: identical to gis55881 zinc finger protein 1 from arabidopsis thaliana
  misc_feature (33)..(64): NCBI GI: 790679 NCBI Desc: zinc finger protein
  misc_feature: The plant is abnormally small.
  misc_feature: The plant produces a reduced number of seeds.
  misc_feature: The sequence is a functional homolog of SEQ ID NO 10 in the 10/412,699US patent application
  misc_feature: The sequence is a functional homolog of SEQ ID NO 1013 in the 10/666,642US patent application
  misc_feature: The sequence is a functional homolog of SEQ ID NO 1090 in the 10/412,699US patent application
  misc_feature: The sequence is a functional homolog of SEQ ID NO 1091 in the 10/412,699US patent application
  misc_feature: The sequence is a functional homolog of SEQ ID NO 1093 in the 10/412,699US patent application
  misc_feature: The sequence is a functional homolog of SEQ ID NO 124 in the 11/479,226US patent application
  misc_feature: The sequence is a functional homolog of SEQ ID NO 1279 in the 10/666,642US patent application
  misc_feature: The sequence is a functional homolog of SEQ ID NO 2306 in the 10/374,780US patent application
  misc_feature: The sequence is a functional homolog of SEQ ID NO 2308 in the 10/374,780US patent application
  misc_feature: The sequence is a functional homolog of SEQ ID NO 2310 in the 10/374,780US patent application
  misc_feature: The sequence is a functional homolog of SEQ ID NO 497 in the 11/479,226US patent application
  misc_feature: The sequence is a functional homolog of SEQ ID NO 501 in the 11/479,226US patent application
  misc_feature: The sequence is a functional homolog of SEQ ID NO 516 in the 10/225,066US patent application
  misc_feature: The sequence is a functional homolog of SEQ ID NO 518 in the 10/225,066US patent application
  misc_feature: The sequence is a functional homolog of SEQ ID NO 635 in the 10/374,780US patent application
  misc_feature: The sequence is a functional homolog of SEQ ID NO 636 in the 10/374,780US patent application
  misc_feature: The sequence is a functional homolog of SEQ ID NO 638 in the 10/374,780US patent application
  misc_feature: The sequence is a functional homolog of SEQ ID NO 712 in the 10/225,066US patent application
  misc_feature: The sequence is a functional homolog of SEQ ID NO 760 in the 10/666,642US patent application
  misc_feature: The sequence is a functional homolog of SEQ ID NO 762 in the 10/666,642US patent application
  misc_feature: Useful for biocontainment applications
  misc_feature: Useful for making plants with modulated biomass
  misc_feature: Useful for making plants with modulated growth and phenotype characteristics
  misc_feature: The sequence is a functional homolog of SEQ ID NO 10 in the 20040045049 US patent application
  misc_feature: The sequence is a functional homolog of SEQ ID NO 1090 in the 20040045049 US patent application
  misc_feature: The sequence is a functional homolog of SEQ ID NO 1091 in the 20040045049 US patent application
  misc_feature: The sequence is a functional homolog of SEQ ID NO 1093 in the 20040045049 US patent application
  misc_feature: The sequence is a functional homolog of SEQ ID NO 516 in the 20050160493 US patent application
  misc_feature: The sequence is a functional homolog of SEQ ID NO 518 in the 20050160493 US patent application
  misc_feature: The sequence is a functional homolog of SEQ ID NO 712 in the 20050160493 US patent application
  misc_feature: The sequence is a functional homolog of SEQ ID NO 1013 in the 20070033671 US patent application
  misc_feature: Functional homolog of the protein sequence given in SEQ ID NO 13580
  misc_feature: Functional homolog of the protein sequence given in SEQ ID NO 13581
  misc_feature: Useful for biocontainment applications
  misc_feature: Useful for making plants with modulated biomass
  misc_feature: Functional homolog of the protein sequence given in SEQ ID NO 13581
  misc_feature: The sequence is a functional homolog of SEQ ID NO. 351 in the 11/188,298 US application
MEHHHHQELDLELSLQPFSADAAAAADDPPGFFVCTYCDRKFYSSQALGGHQNAHKYERTLAKRRREIAAAMRAHGARQVDAAAASTCSRPGGDRAPAVQSAAALLRGKSSSLERGGVERAAAELDLSLRL

SEQ ID NO: 6519 - DNA, 375 bp, Sorghum bicolor
  misc_feature: Ceres ANNOT ID no. 6067308
  misc_feature: Encodes the peptide sequence at SEQ ID NO 6520
atggagagggagcaagagctggaccttgagctcaccctcctcccctccgcgtgggctacgcaggaggaggaggaggcgcccggcggcttcttcctctgcacgtactgcggccgcaagttctgcacctcccaggcgctcggcggccaccagaacgcgcacaagtacgagcgcgccctagccaagcgccgccgggagatcgccgccgccttgcgtaagcaccaccgtgttttcgcgacgcgccctggccaggtcgacgccggggccagtcctaggccttctggagtcgtccaagtgatcactggatctgagcctgatgctgctgagactgagaggatgaggccagtggaccagctagatttatccctcaggctatga

SEQ ID NO: 6520 - protein, 124 aa, Sorghum bicolor
  misc_feature: Ceres ANNOT ID no. 6067308
  misc_feature (21)..(89): NCBI GI: 6503285 NCBI Desc: identical to gis55881 zinc finger protein 1 from arabidopsis thaliana
  misc_feature (3)..(66): NCBI GI: 9758313 NCBI Desc: cchh finger protein 2-like protein [arabidopsis thaliana]
  misc_feature (33)..(68): NCBI GI: 21592423 NCBI Desc: zinc finger protein 5, zfp5 [arabidopsis thaliana]
  misc_feature (33)..(68): NCBI GI: 5091540 NCBI Desc: t10o24.9 [arabidopsis thaliana]
  misc_feature (27)..(74): NCBI GI: 7268534 NCBI Desc: superman like protein [arabidopsis thaliana]
  misc_feature: The plant is abnormally small.
  misc_feature: The plant produces a reduced number of seeds.
  misc_feature: The sequence is a functional homolog of SEQ ID NO 10 in the 10/412,699US patent application
  misc_feature: The sequence is a functional homolog of SEQ ID NO 1090 in the 10/412,699US patent application
  misc_feature: The sequence is a functional homolog of SEQ ID NO 1093 in the 10/412,699US patent application
  misc_feature: The sequence is a functional homolog of SEQ ID NO 124 in the 11/479,226US patent application
  misc_feature: The sequence is a functional homolog of SEQ ID NO 635 in the 10/374,780US patent application
  misc_feature: The sequence is a functional homolog of SEQ ID NO 638 in the 10/374,780US patent application
  misc_feature: The sequence is a functional homolog of SEQ ID NO 760 in the 10/666,642US patent application
  misc_feature: The sequence is a functional homolog of SEQ ID NO 762 in the 10/666,642US patent application
  misc_feature: Useful for biocontainment applications
  misc_feature: Useful for making plants with modulated biomass
  misc_feature: Useful for making plants with modulated growth and phenotype characteristics
  misc_feature: The sequence is a functional homolog of SEQ ID NO 10 in the 20040045049 US patent application
  misc_feature: The sequence is a functional homolog of SEQ ID NO 1090 in the 20040045049 US patent application
  misc_feature: The sequence is a functional homolog of SEQ ID NO 1093 in the 20040045049 US patent application
  misc_feature: Functional homolog of the protein sequence given in SEQ ID NO 13581
  misc_feature: The sequence is a functional homolog of SEQ ID NO 2310 in the 10/374,780 US patent application
  misc_feature: The sequence is a functional homolog of SEQ ID NO 518 in the 10/225,066 US patent application
MEREQELDLELTLLPSAWATQEEEEAPGGFFLCTYCGRKFCTSQALGGHQNAHKYERALAKRRREIAAALRKHHRVFATRPGQVDAGASPRPSGVVQVITGSEPDAAETERMRPVDQLDLSLRL

SEQ ID NO: 6521 - DNA, 1524 bp, Sorghum bicolor
  misc_feature: Ceres ANNOT ID no. 6067314
  misc_feature: Encodes the peptide sequence at SEQ ID NO 6522
atgcctgaccccaccgccaaacccccctcgccacggccccgccgccgccgcaggctctgcggcctctgcctcggcaccgcgctcctcgcgctcctcgtctccgcgctcgtccacgccgtcgcctcgccgccgcgtcgtcccgcccccggcccggcctccgcgcgcttctccgtcgtcatagacggaggcagcacgggcacgcgggcccacgtcttcgccacggggcacgacggccgcccggatctggcgcgctccaccgtgatgcgcgtctcaccgggcctctcgtccttcgccgccgacccggcgcgggccggggagtctctgaagccgctgatagatttcgcgagggatgagattgtcggctcgggaggcgccgctcgggaggcggaggtgcggctcatggctaccgcagggctgcgcctgctcgaggagcgcgcccaggaggcgatcttagcgtcctgcagggacgtactacgagcctctgggttccgattcgaggacgcgtgggccaaagtgatcccaggctcggatgaaggtatctatgcttgggttgcggcaaattatgctcttggcagacttggaggggatcctaacaaaaccgttggaataattgaacttgggggcgcttcagctcagcttacctttgtttctgatgaagtacttccacccgaactgtcatataattatacttttggtgaaagaacatacactctctataccaacagctttttaaactttggtcaaaatgcagctcaagactcatttcatgaaatgctgaggtcaagaggctcttccaaaaatggtacacttgctgatccttgtgctcccagaggatattcacgcaatgaagaagtgatggtgaggatgagcagcacttcaaggtcaacattagagaatcaatatgttgataatgggactggaaactttactgagtgcatatcttcttcgctgctgttactgcaaaaaggaaaggaaaagtgccagtatcaacattgtcacctgggacctactttcgtacctgagctgcgtggatacttcttggcaactgaaaatttctattttacttcaaagttctttggacttaagaagtcgtcatcactatctgattttatgtttgctggagaacaatcttgcaatcaggatttgtccactcttagaaaaaagtatcctaataggtctgatgaagatttttcacggtattgcttctcgatggcatatattgtggctctactgcatgacagtcttggtgtaccactggatgataagaggattgagtattcaaaccaggttggagacgttcaggttgaatgggctctaggagctttcatcacattgatgcaaaatacaagtttaaagccattgcacaccgccgcagaaccaatccatagcaatagaccattgtttgctgtgctgggaatgtttcttttatgtggagtactttttgtatcaagatggaggaagcccaagacgaaaatcatatatgacttagagaaaggccgatacatcataacacgcatcagctga

SEQ ID NO: 6522 - protein, 507 aa, Sorghum bicolor
  misc_feature: Ceres ANNOT ID no. 6067314
  misc_feature (47)..(457): Pfam Id: GDA1_CD39 Pfam Desc: GDA1/CD39 (nucleoside phosphatase) family
  misc_feature (48)..(422): NCBI GI: 92880822 NCBI Desc: nucleoside phosphatase gda1/cd39 [medicago truncatula]
  misc_feature (70)..(443): NCBI GI: 7262666 NCBI Desc: strong similarity to ecto-apyrase from rattus norvegicus gbu81295 and is a member of the gda1/cd39 (nucleoside phosphatase) pf01150 family. this gene is cut off at the 5' end.
  misc_feature (70)..(443): NCBI GI: 7262666 (continued) [arabidopsis thaliana]
  misc_feature (55)..(443): NCBI GI: 79317964 NCBI Desc: hydrolase [arabidopsis thaliana]
  misc_feature (11)..(489): NCBI GI: 49256550 NCBI Desc: mgc80631 protein [xenopus laevis]
  misc_feature (24)..(489): NCBI GI: 49898932 NCBI Desc: ectonucleoside triphosphate diphosphohydrolase 1 [xenopus tropicalis]
MPDPTAKPPSPRPRRRRRLCGLCLGTALLALLVSALVHAVASPPRRPAPGPASARFSVVIDGGSTGTRAHVFATGHDGRPDLARSTVMRVSPGLSSFAADPARAGESLKPLIDFARDEIVGSGGAAREAEVRLMATAGLRLLEERAQEAILASCRDVLRASGFRFEDAWAKVIPGSDEGIYAWVAANYALGRLGGDPNKTVGIIELGGASAQLTFVSDEVLPPELSYNYTFGERTYTLYTNSFLNFGQNAAQDSFHEMLRSRGSSKNGTLADPCAPRGYSRNEEVMVRMSSTSRSTLENQYVDNGTGNFTECISSSLLLLQKGKEKCQYQHCHLGPTFVPELRGYFLATENFYFTSKFFGLKKSSSLSDFMFAGEQSCNQDLSTLRKKYPNRSDEDFSRYCFSMAYIVALLHDSLGVPLDDKRIEYSNQVGDVQVEWALGAFITLMQNTSLKPLHTAAEPIHSNRPLFAVLGMFLLCGVLFVSRWRKPKTKIIYDLEKGRYIITRIS

SEQ ID NO: 6523 - DNA, 1353 bp, Sorghum bicolor
  misc_feature: Ceres ANNOT ID no. 6067315
  misc_feature: Encodes the peptide sequence at SEQ ID NO 6524
atggagggccgcctcttcgacaagcccctgaacccgaataagctcctcaaggagcaattcgtgagcaacctgacggggtcttcctgctggagatcgcggcgctctccaccgtcgtgccggaaggattcagcaaagaaaaatgatgatcaagttcaccctgttcataaagattggatgcagtacttctctacactaggtgtagattatctcactgttgtattgccaattattttggttttcacagtcttatctgaatgggcctttacgtgtgctatttctcttgtagttctgatatccatctacatcatgtttgaaaggtctcagcttcatcttaaagatgggttcagtcagctgccttcgctcagggcagacatatcttcttaccgtgtctcagtggttctggtgacatgtttgtgcatattagctgtggacttcaaaatatttccaagacgctatgccaaggctgaaacatatggtagtggcatcatggatcttggagtaggatcttttgtagtggctaacgcactggtatctagacaagcacgaaacatagcctcaatgagtttcaaggcagcgctgagttccacaagtccactggtatttctcggctttgctcgcattatctccacatggggtgttgattatcaggtccatgtaggagaatatggtgttcattggaacttctttttcaccctcgcagctgtttctatccttacatctattgtcaggattcatccaaaacattgtggattagttggtctgcttatccttgctggttaccagatttggttatcttctggattgaatgagtacctcatttctgataaaagaaatgctgatataatcagccagaataaggagggcatttatagcatcctcggatactggggtatgtttctatttggtgtttctttgggtttctatctgttcgttgacactagttcaaagggcaagaacaggaacactcaagtcatgaaaatctgggttcttgccgcatctttttggtttttggcaatcatctttgatagctatattgagagagtttctcggcgaatgtgcaacttcgcttatgttatgcttgtttttggccagaattttcaggttttatctatcctcacattagctgggttcgcctcatataaaaagaacctggttcttgaagatgcactcaatcaaaacatgcttggttcattccttctggcaaatatccttactggtctggttaatctctcagttaacacgctctctgcctcttccctcactgccttcatgattctgtcagtatacacctttactttgtgcatggttaccggccttgcccatttttgtggtgttagaatgaagttctggtga

SEQ ID NO: 6524 - protein, 450 aa, Sorghum bicolor
  misc_feature: Ceres ANNOT ID no. 6067315
  misc_feature (284)..(409): Pfam Id: GWT1 Pfam Desc: GWT1
  misc_feature (26)..(450): NCBI GI: 140063708 NCBI Desc: gwt1 [medicago truncatula]
  misc_feature (216)..(450): NCBI GI: 140060410 NCBI Desc: gwt1 [medicago truncatula]
  misc_feature (10)..(306): NCBI GI: 74604186 NCBI Desc: gpi-anchored wall transfer protein 1
  misc_feature (105)..(331): NCBI GI: 115492641 NCBI Desc: gpi-anchored wall transfer protein 1 [aspergillus terreus nih2624]
  misc_feature (118)..(329): NCBI GI: 146448450 NCBI Desc: gpi-anchored wall transfer protein 1 [lodderomyces elongisporus nrrl yb-4239]
MEGRLFDKPLNPNKLLKEQFVSNLTGSSCWRSRRSPPSCRKDSAKKNDDQVHPVHKDWMQYFSTLGVDYLTVVLPIILVFTVLSEWAFTCAISLVVLISIYIMFERSQLHLKDGFSQLPSLRADISSYRVSVVLVTCLCILAVDFKIFPRRYAKAETYGSGIMDLGVGSFVVANALVSRQARNIASMSFKAALSSTSPLVFLGFARIISTWGVDYQVHVGEYGVHWNFFFTLAAVSILTSIVRIHPKHCGLVGLLILAGYQIWLSSGLNEYLISDKRNADIISQNKEGIYSILGYWGMFLFGVSLGFYLFVDTSSKGKNRNTQVMKIWVLAASFWFLAIIFDSYIERVSRRMCNFAYVMLVFGQNFQVLSILTLAGFASYKKNLVLEDALNQNMLGSFLLANILTGLVNLSVNTLSASSLTAFMILSVYTFTLCMVTGLAHFCGVRMKFW

SEQ ID NO: 6525 - DNA, 960 bp, Sorghum bicolor
  misc_feature: Ceres ANNOT ID no. 6067317
  misc_feature: Encodes the peptide sequence at SEQ ID NO 6526
atggggcggccgccgtgctgcgacaaggagggcgtgaagaaggggccgtggacgcccgaggaggacctcgtcctcgtctcctacgtccaggagcacggccccggcaactggcgcgcagtccccggcaacacagggctgctgcggtgcagcaagagctgccgcctccggtggaccaactacctccgcccgggcatccgccggggcggcttctccgaccacgaggacaggctcatcgtccacctccaggcgctcctcggcaaccgctgggccgccatcgcctcctacctccccgaccgcaccgacaacgacgtcaagaactactggaacacgcacctcaagaagaagctcctcctccagcaccagcagcgccagcgcgcctccaccgccgccgcctcgtcgctgccgtcgcccagcaaggggcagtgggagctcaagctgcagaccgacatcgacctcgccaggcgcgctctccgcgacgccctctccgtcgacgccgccgccggcccgccggggatggccgccgcgggctcggcgccgacggcggcgccagcacaaccgtacgcgcccactgcgcgcagcgtcgacgggatgctgctggacgggtgggcggcggctccagcggcagggaggagctgcgccgtcgtcggtggcaccgtcatcccggccccggccccggcgacgccgcccggcgcgaccgacagcacgtcggggtcgtcgtcggtgctaacgacggagtgttctggctccatctccagcgcctctaataaacgcgccgcgccgccggtggctgccgggcaccggctgctgctcgtgcacgaggagaactcgacatcggccgggcaaggggaggtgccactgtcggcgatcgagtcgtggctgctggaggacgccggcggcgagcagaagctgccgcacgaaagcctccttctcgatgccgccctgcataatttcggtttctaa

SEQ ID NO: 6526 - protein, 319 aa, Sorghum bicolor
  misc_feature: Ceres ANNOT ID no. 6067317
  misc_feature (14)..(61): Pfam Id: Myb_DNA-binding Pfam Desc: Myb-like DNA-binding domain
  misc_feature (67)..(112): Pfam Id: Myb_DNA-binding Pfam Desc: Myb-like DNA-binding domain
  misc_feature (1)..(208): NCBI GI: 19072762 NCBI Desc: typical p-type r2r3 myb protein [oryza sativa]
  misc_feature (1)..(171): NCBI GI: 19072744 NCBI Desc: typical p-type r2r3 myb protein [zea mays]
  misc_feature (1)..(298): NCBI GI: 115479147 NCBI Desc: os09g0414300 [oryza sativa (japonica cultivar-group)]
  misc_feature (1)..(297): NCBI GI: 256828 NCBI Desc: myb oncoprotein homolog {clone 306} [antirrhinum majus=snapdragons, j1:522, flowers, peptide, 316 aa]
  misc_feature (1)..(316): NCBI GI: 117957143 NCBI Desc: myb60-like protein [vitis vinifera]
  misc_feature: The sequence is a functional homolog of SEQ ID NO 1071 in the 10/412,699 US patent application
  misc_feature: The sequence is a functional homolog of SEQ ID NO 587 in the 10/374,780 US patent application
  misc_feature: The sequence is a functional homolog of SEQ ID NO 728 in the 11/435,388 US patent application
  misc_feature: The sequence is a functional homolog of SEQ ID NO 1072 in the 10/412,699 US patent application
  misc_feature: The sequence is a functional homolog of SEQ ID NO 1073 in the 10/412,699 US patent application
  misc_feature: The sequence is a functional homolog of SEQ ID NO 588 in the 10/374,780 US patent application
  misc_feature: The sequence is a functional homolog of SEQ ID NO 589 in the 10/374,780 US patent application
  misc_feature: The sequence is a functional homolog of SEQ ID NO 730 in the 11/435,388 US patent application
  misc_feature: The sequence is a functional homolog of SEQ ID NO 594 in the 10/374,780 US patent application
  misc_feature: The sequence is a functional homolog of SEQ ID NO 784 in the 11/435,388 US patent application
  misc_feature: The sequence is a functional homolog of SEQ ID NO 790 in the 11/435,388 US patent application
  misc_feature: The sequence is a functional homolog of SEQ ID NO 792 in the 11/435,388 US patent application
  misc_feature: The sequence is a functional homolog of SEQ ID NO 788 in the 11/435,388 US patent application
  misc_feature: Useful for making plants with modulated low light sensitivity
  misc_feature: Functional homolog of the protein sequence given in SEQ ID NO 13959
  misc_feature: The sequence is a functional homolog of SEQ ID NO 1031 in the 11/479,226 US patent application
  misc_feature: The sequence is a functional homolog of SEQ ID NO 1804 in the 10/412,699 US patent application
  misc_feature: The sequence is a functional homolog of SEQ ID NO 2050 in the 10/374,780 US patent application
  misc_feature: The sequence is a functional homolog of SEQ ID NO 444 in the 10/412,699 US patent application
  misc_feature: The sequence is a functional homolog of SEQ ID NO 598 in the 10/225,066 US patent application
  misc_feature: The sequence is a functional homolog of SEQ ID NO 620 in the 11/435,388 US patent application
  misc_feature: Useful for making plants with altered alkaloid content
  misc_feature: Useful for making plants with altered lignin content
  misc_feature: Useful for making plants with modulated nitrogen use efficiency
  misc_feature: Functional homolog of the protein sequence given in SEQ ID NO 13600
  misc_feature: The sequence is a functional homolog of SEQ ID NO 1004 in the 11/435,388 US patent application
  misc_feature: The sequence is a functional homolog of SEQ ID NO 266 in the 10/374,780 US patent application
  misc_feature: The sequence is a functional homolog of SEQ ID NO 536 in the 11/435,388 US patent application
  misc_feature: The sequence is a functional homolog of SEQ ID NO 640 in the 10/225,066 US patent application
  misc_feature: The sequence is a functional homolog of SEQ ID NO 856 in the 10/412,699 US patent application
  misc_feature: The sequence is a functional homolog of SEQ ID NO 2 in the 10/225,068 US patent application
  misc_feature: The sequence is a functional homolog of SEQ ID NO 22 in the 10/225,068 US patent application
  misc_feature: The sequence is a functional homolog of SEQ ID NO 230 in the 10/225,066 US patent application
  misc_feature: The sequence is a functional homolog of SEQ ID NO 258 in the 10/374,780 US patent application
  misc_feature: The sequence is a functional homolog of SEQ ID NO 442 in the 11/435,388 US patent application
  misc_feature: The sequence is a functional homolog of SEQ ID NO 842 in the 10/412,699 US patent application
  misc_feature: The sequence is a functional homolog of SEQ ID NO 98 in the 11/375,241 US patent application
  misc_feature: The sequence is a functional homolog of SEQ ID NO 126 in the 10/412,699 US patent application
  misc_feature: The sequence is a functional homolog of SEQ ID NO 1564 in the 10/374,780 US patent application
  misc_feature: The sequence is a functional homolog of SEQ ID NO 1625 in the 10/412,699 US patent application
  misc_feature: The sequence is a functional homolog of SEQ ID NO 978 in the 10/666,642 US patent application
  misc_feature: Useful for making plants with altered cell wall content and/or composition
  misc_feature: Functional homolog of the protein sequence given in SEQ ID NO 13602
  misc_feature: The sequence is a functional homolog of SEQ ID NO. 395 in the 11/188,298 US application
MGRPPCCDKEGVKKGPWTPEEDLVLVSYVQEHGPGNWRAVPGNTGLLRCSKSCRLRWTNYLRPGIRRGGFSDHEDRLIVHLQALLGNRWAAIASYLPDRTDNDVKNYWNTHLKKKLLLQHQQRQRASTAAASSLPSPSKGQWELKLQTDIDLARRALRDALSVDAAAGPPGMAAAGSAPTAAPAQPYAPTARSVDGMLLDGWAAAPAAGRSCAVVGGTVIPAPAPATPPGATDSTSGSSSVLTTECSGSISSASNKRAAPPVAAGHRLLLVHEENSTSAGQGEVPLSAIESWLLEDAGGEQKLPHESLLLDAALHNFGF

SEQ ID NO: 6527 - DNA, 1833 bp, Sorghum bicolor
  misc_feature: Ceres ANNOT ID no. 6067320
  misc_feature: Encodes the peptide sequence at SEQ ID NO 6528
atggcacgaaacttgactgagaacaggaccagaaatacattaattgtgattgtgattttgggcctctgttccttcttctatctcttgggtgcttggcagaaaagtggttctggaggaggagacaaaacacatcagtgggtcattgagcagatgaaatgtgcacagctcccaaatctgagttttgagacccatcatagtgcatccaaccttccgaatgatactggtagttccaaaattgaacctttcaagccatgtgatgagcagtacactgattacactccttgtgaggagcaaaagcgtgcgatgagcttccctagagataacatgatctatcgggagaggcattgtccactggataaggagaagcttcattgcctgatcccagcaccaaagggttatgttactccttttcgatggccaaagagccgtgattttgttccttatgccaatgtaccacacaagagccttactgttgagaaggctatccagaactgggtgcactatgagggcaatgttttcaggtttcctggtggtggaacacagtttcctcagggtgcagataaatatatagaccagcttgcttctgtcatcccaatagctgaagggaaagtgagaactgcactggatactggttgtggggttgccagtttgggtgcttacctgttgaagaaaaatgttttgaccatgtcatttgcaccacgggataatcatgaggcacaagtacagtttgcattggagagaggtgtgcctgcatatattggtgtccttgggtcaataaagctgccatttccatctcgtgtctttgacatggcccattgctcgagatgtttaattccatggagtggaaatgatggtatgtacatgatggaagttgacagagtactacggcctggcggatattgggtgctgtcaggcccacccataggctggaagattcactataaggggtggcaacgttcaaaggaagatcttcggaatgagcaaagaaacatagaacaattcgcacaacttctttgttggaataagatatcagagaaggatggtatcgccatatggagaaagagattgaatgacaagtcttgctccatgaaacaagataatccaaaaggtggcaaatgtgatttgacaagtgacagtgatgtatggtacaagaagatggaagtttgtatcacccccctacccgaggttaatagtgtatctgaggttgccggtggtcaattagagccttttcctaagaggctctatgcagtacctcctcgtataacccttggttctgtgcctggtttctcagttcagtcatatgaagaggacaataacctttggcagaaacatgttaaggcttacaagaaaaccaataacttacttgatactggaagatatcgcaatataatggacatgaatgctggcctcggtagctttgctgctgcactagagtccccaaagctatgggtcatgaatgtcattccaacaattgcaaatacttccactttaggtgtaatctacgagcgtggattaataggaatgtatcatgactggtgcgaaggattttctacatatccaaggacatatgacctcatacattctaatgacatcttcagtttgtaccagaacaagtgtcaatttgaagatatactcctggaaatggacagaatcttacgcccagagggtgcagtcataattcgtgacaaggttgatgttcttgtaaaagtggagaaaatagccaatgccatgaggtggaagacaagattggctgatcatgagggtggccctcatgtacctgagaagatactcttcgtggtcaagcaatactgggatgtttcaacaagcagctaa

SEQ ID NO: 6528 - protein, 610 aa, Sorghum bicolor
  misc_feature: Ceres ANNOT ID no. 6067320
  misc_feature (7)..(610): NCBI GI: 23308473 NCBI Desc: at1g26850/t2p11_4 [arabidopsis thaliana]
  misc_feature (7)..(604): NCBI GI: 51469000 NCBI Desc: ankyrin protein kinase-like [poa pratensis]
  misc_feature (7)..(513): NCBI GI: 4262174
  misc_feature (4)..(604): NCBI GI: 115483554 NCBI Desc: os10g0569300 [oryza sativa (japonica cultivar-group)]
  misc_feature (8)..(604): NCBI GI: 15294146 NCBI Desc: at4g18030/t6k21_210 [arabidopsis thaliana]
  misc_feature: Useful for making plants with altered cell wall content and/or composition
  misc_feature: Functional homolog of the protein sequence given in SEQ ID NO 13686
  misc_feature: The sequence is a functional homolog of SEQ ID NO 758 in the 10/412,699 US patent application
  misc_feature: The sequence is a functional homolog of SEQ ID NO 2740 in the 10/374,780 US patent application
  misc_feature: The sequence is a functional homolog of SEQ ID NO 388 in the 10/225,066 US patent application
  misc_feature: The sequence is a functional homolog of SEQ ID NO 1593 in the 11/479,226 US patent application
  misc_feature: The sequence is a functional homolog of SEQ ID NO 2432 in the 10/374,780 US patent application
  misc_feature: The sequence is a functional homolog of SEQ ID NO 558 in the 10/412,699 US patent application
  misc_feature: The sequence is a functional homolog of SEQ ID NO 730 in the 10/225,066 US patent application
  misc_feature: The sequence is a functional homolog of SEQ ID NO 560 in the 10/412,699 US patent application
MARNLTENRTRNTLIVIVILGLCSFFYLLGAWQKSGSGGGDKTHQWVIEQMKCAQLPNLSFETHHSASNLPNDTGSSKIEPFKPCDEQYTDYTPCEEQKRAMSFPRDNMIYRERHCPLDKEKLHCLIPAPKGYVTPFRWPKSRDFVPYANVPHKSLTVEKAIQNWVHYEGNVFRFPGGGTQFPQGADKYIDQLASVIPIAEGKVRTALDTGCGVASLGAYLLKKNVLTMSFAPRDNHEAQVQFALERGVPAYIGVLGSIKLPFPSRVFDMAHCSRCLIPWSGNDGMYMMEVDRVLRPGGYWVLSGPPIGWKIHYKGWQRSKEDLRNEQRNIEQFAQLLCWNKISEKDGIAIWRKRLNDKSCSMKQDNPKGGKCDLTSDSDVWYKKMEVCITPLPEVNSVSEVAGGQLEPFPKRLYAVPPRITLGSVPGFSVQSYEEDNNLWQKHVKAYKKTNNLLDTGRYRNIMDMNAGLGSFAAALESPKLWVMNVIPTIANTSTLGVIYERGLIGMYHDWCEGFSTYPRTYDLIHSNDIFSLYQNKCQFEDILLEMDRILRPEGAVIIRDKVDVLVKVEKIANAMRWKTRLADHEGGPHVPEKILFVVKQYWDVSTSS

SEQ ID NO: 6529 - DNA, 471 bp, Sorghum bicolor
  misc_feature: Ceres ANNOT ID no. 6067322
  misc_feature: Encodes the peptide sequence at SEQ ID NO 6530
atggtgcacgtgagcttctatcgcaactatggtaagactttcaagaagccaaggcgtccgtatgagaaggagcgccttgatgctgagctcaaattggtgggtgagtatggcttgaggtgcaagcgtgagctgtggcgtgtgcagtatgccctcagccgcatccgaaatgctgcaagggagctgctcacccttgatgagaagaacccccgccgtatctttgagggcgagcgccgccttcagaccattgtcttcaagaatggcatggcaaagtccattcatcatgctcgtgtgctcatcagagttgggaggcaacttgtcaacattccctctttcatggtgagagttgactctgagaagcacattgacttctcccttaccagcccacttgttggtggtgaacctggaagggtgaagagaaagaactcaaagaaggcatctggtggaggcggtgatgatgaggaggaagagtga

SEQ ID NO: 6530 - protein, 156 aa, Sorghum bicolor
  misc_feature: Ceres ANNOT ID no. 6067322
  misc_feature (7)..(103): Pfam Id: Ribosomal_S4 Pfam Desc: Ribosomal protein S4/S9 N-terminal domain
  misc_feature (1)..(88): NCBI GI: 92874682 NCBI Desc: ribosomal protein s4, bacterial and organelle form [medicago truncatula]
  misc_feature (1)..(80): NCBI GI: 77551805 NCBI Desc: ribosomal protein s4 [oryza sativa (japonica cultivar-group)]
  misc_feature (5)..(76): NCBI GI: 145350813 NCBI Desc: ribosomal protein s9, component of cytosolic 80s ribosome and 40s small subunit [ostreococcus lucimarinus cce9901]
  misc_feature (76)..(155): NCBI GI: 6440857 NCBI Desc: 40s ribosomal protein s9 [chlamydomonas sp. hs-5]
  misc_feature (76)..(156): NCBI GI: 15294029 NCBI Desc: 40s ribosomal protein s9 [ictalurus punctatus]
MVHVSFYRNYGKTFKKPRRPYEKERLDAELKLVGEYGLRCKRELWRVQYALSRIRNAARELLTLDEKNPRRIFEGERRLQTIVFKNGMAKSIHHARVLIRVGRQLVNIPSFMVRVDSEKHIDFSLTSPLVGGEPGRVKRKNSKKASGGGGDDEEEE

SEQ ID NO: 6531 - DNA, 759 bp, Sorghum bicolor
  misc_feature: Ceres ANNOT ID no. 6067325
  misc_feature: Encodes the peptide sequence at SEQ ID NO 6532
atggaggcggcgatggatctgatgcggcggatgccgccgcggagcgcggagacggcgctcaacgcgctgctctccctcctccccgaccactccctcgacctcctctcccaggtcgacctcccgctccaggtttgcatggataaggagagcttgaaggcatacattctatgcgaatataaccgtgacgctgactcctaccgatctccttggtcgaataaatatgacccccctttggaagacgggacagttccttctcaagcgatgaggaatcttgaggttgaggcaaatgaagttttctcagtgtatcgtgaccagtactatgaaggtggcatctcgtctgtttacatttgggaggatgaagataatgggtttatcgcatgcttcttaattaagaaagatggacaaggaaaaagagggtacatgcagattggttcatgggatgctattcatgttattcaggttggtcctgaagaagaaggagcggcacattactgcttgaacagcactgtgatgctctcattgacaacagacaacaagcagtcgggaaccttcaacttgtctggatcgataagacggcagatgagtatgacccttgctgtagctgatggacaccttgttaatatggggaaaatgatagaagaaatggaggggaagctgagaaattcactggaccaggtttatttcgggaagaccagagaaatggtttgcactcttcggccaccaccagaagtgcttaataggagactacctgacagctga

SEQ ID NO: 6532 - protein, 252 aa, Sorghum bicolor
  misc_feature: Ceres ANNOT ID no. 6067325
  misc_feature (1)..(253): Pfam Id: F_actin_cap_B Pfam Desc: F-actin capping protein, beta subunit
  misc_feature (1)..(252): NCBI GI: 117958773 NCBI Desc: at1g71790 [arabidopsis thaliana]
  misc_feature (1)..(248): NCBI GI: 54644876 NCBI Desc: ga14356-pa [drosophila pseudoobscura]
  misc_feature (1)..(248): NCBI GI: 17136938 NCBI Desc: cg17158-pa [drosophila melanogaster]
  misc_feature (1)..(239): NCBI GI: 27370869 NCBI Desc: capzb-prov protein [xenopus laevis]
  misc_feature (1)..(239): NCBI GI: 119352599 NCBI Desc: capping protein beta subunit [xenopus laevis]
MEAAMDLMRRMPPRSAETALNALLSLLPDHSLDLLSQVDLPLQVCMDKESLKAYILCEYNRDADSYRSPWSNKYDPPLEDGTVPSQAMRNLEVEANEVFSVYRDQYYEGGISSVYIWEDEDNGFIACFLIKKDGQGKRGYMQIGSWDAIHVIQVGPEEEGAAHYCLNSTVMLSLTTDNKQSGTFNLSGSIRRQMSMTLAVADGHLVNMGKMIEEMEGKLRNSLDQVYFGKTREMVCTLRPPPEVLNRRLPDS

SEQ ID NO: 6533 - DNA, 1422 bp, Sorghum bicolor
  misc_feature: Ceres ANNOT ID no. 6067333
  misc_feature: Encodes the peptide sequence at SEQ ID NO 6534
atggagctgcttcctcttctcacgtggctcctcctcgcgcacgccatggcgtaccttgcctggacggccgcggcgcgccgccggcagtcgcggtgctacctcctggactacgtctgccacaagccccgtgacgaccgcaagctgtcgacggagacggccggcgacgtgatccagcgcaacgcgcggctcggtctgaccgactaccgcttcctcctccgcgtcgtcgtccgctccggcatcggcgaggagacctacgccccgcgcagcatcctggagggccgcgaggacaccccgaccctcaaggactcgctggaggagatggacgccttcctcgacgaggccgtcgccgagctgttcgcccggacgggggtctctccgggcgacgtcgacgtgctggtcttcaacgtctccatgctctccccgtccccgtcgctgtcgtcccgggtcgtgcgccggtacggcctccgcgacgacgtcgccgcgtacaacctcgcggggatgggctgcagcgcggggctcgtcgcgctggacctcgcccggaacgcgctccgggcgcgcccccgccgcgcgtcgctggcgctcgtggtgtcgtccgagtccatcgcgcccaactggtactccggcaccgacaagtccatgatgctcgccaactgcctgttccgctgcggcggcgccgcggcgctggtcaccaacgacccggcgcgccgcgggcgcgccaagatggagctcaggtgcctggtgcgcgcgcacatcggcgccagcgacgacgcgcacgcgtgcgcgctgcagcgggaggacggcgagggccgcgtcgggatcagcctcagcaaggcgctgcccaaggccgccgtgcgcgccttcgccgtcaacctgcgccgcctcgcgccgcgcgtgctccccgtcgccgagctcgcgcggttcaccgcgcgacacctcgcccggaggctcttcttccagttcccgcacatgctgcagggctcgggaaagcagcagcagaagggcggcggcgacgcggcggcaaagatcaacttcaaggccggggtggagcacttctgcctgcaccccggcgggacggcggtgatcgaggcggtgaagcagagcctggggctggaggacgaggacgtggagccggcgaggatgacgctgcaccggtgggggaacacgtcggcgagcagcctgtggtacgtgctgtcgtacatggaggccaaggggaggctcaaggtcggggacagggtgctcatggtcaccttcgggtccggcttcaagtgcaacagctgcgtgtgggaggtgaccggcgacatggccgacaggggagcctgggccgactgcatcgacgactacccgccggagacgctcgccaacccgtacatggacaagttcggctggatcaacgacgtccaaggcgacaccatgatgctctaa

SEQ ID NO: 6534 - protein, 473 aa, Sorghum bicolor
  misc_feature: Ceres ANNOT ID no. 6067333
  misc_feature (23)..(316): Pfam Id: FAE1_CUT1_RppA Pfam Desc: FAE1/Type III polyketide synthase-like protein
  misc_feature (339)..(430): Pfam Id: ACP_syn_III_C Pfam Desc: 3-Oxoacyl-[acyl-carrier-protein (ACP)] synthase III C terminal
  misc_feature (290)..(432): Pfam Id: Chal_sti_synt_C Pfam Desc: Chalcone and stilbene synthases, C-terminal domain
  misc_feature (1)..(467): NCBI GI: 92877047 NCBI Desc: chalcone and stilbene synthases, n-terminal [medicago truncatula]
  misc_feature (1)..(470): NCBI GI: 92877054 NCBI Desc: probable fatty acid elongase [imported] - arabidopsis thaliana [medicago truncatula]
  misc_feature (1)..(467): NCBI GI: 92877056 NCBI Desc: chalcone and stilbene synthases, n-terminal [medicago truncatula]
  misc_feature (1)..(467): NCBI GI: 140054927 NCBI Desc: chalcone and stilbene synthases, c-terminal; very-long-chain 3-ketoacyl-coa synthase [medicago truncatula]
  misc_feature (1)..(473): NCBI GI: 114149943 NCBI Desc: 3-ketoacyl-coa synthase 3 (kcs-3) (very-long-chain fatty acid condensing enzyme 3) (vlcfa condensing enzyme 3)
MELLPLLTWLLLAHAMAYLAWTAAARRRQSRCYLLDYVCHKPRDDRKLSTETAGDVIQRNARLGLTDYRFLLRVVVRSGIGEETYAPRSILEGREDTPTLKDSLEEMDAFLDEAVAELFARTGVSPGDVDVLVFNVSMLSPSPSLSSRVVRRYGLRDDVAAYNLAGMGCSAGLVALDLARNALRARPRRASLALVVSSESIAPNWYSGTDKSMMLANCLFRCGGAAALVTNDPARRGRAKMELRCLVRAHIGASDDAHACALQREDGEGRVGISLSKALPKAAVRAFAVNLRRLAPRVLPVAELARFTARHLARRLFFQFPHMLQGSGKQQQKGGGDAAAKINFKAGVEHFCLHPGGTAVIEAVKQSLGLEDEDVEPARMTLHRWGNTSASSLWYVLSYMEAKGRLKVGDRVLMVTFGSGFKCNSCVWEVTGDMADRGAWADCIDDYPPETLANPYMDKFGWINDVQGDTMML

SEQ ID NO: 6535 - DNA, 528 bp, Sorghum bicolor
  misc_feature: Ceres ANNOT ID no. 6067349
  misc_feature: Encodes the peptide sequence at SEQ ID NO 6536
atggccctcgcctcccgcgccgccgccatggcgtgcgtcctcctggcgctcgccgcctccgccgcgggggcgggctcccactcccctgccccggcgcccgcggtggactgcgtcacccaggccaccaccctcatcgactgcctcgactacgtccagccggggagcaccgcaaagcggccgtccgctgcctgctgtgcggaggtcaagaccgccgtggccagccccgccatcgtgggctgcctctgctccctcgccggcaacaaggacctgggcattcccatcgacatgaagcgcgtcctggcgctccccggcgcgtgcggcgcgtccaacgccgccttcagcaagtgcaacatttccgcgctttccccagcaggagcacctgcaccatcatccaccgctgggggatcgtcgagtggcggggcggccgcatcaccacccaaagccgcggcagccagttctccaatgacggcgaccgctctggtggctgccgtggcggctcccctgctcgcctacttctacctcttctga

SEQ ID NO: 6536 - protein, 175 aa, Sorghum bicolor
  misc_feature: Ceres ANNOT ID no. 6067349
  misc_feature (37)..(116): Pfam Id: Tryp_alpha_amyl Pfam Desc: Protease inhibitor/seed storage/LTP family
  misc_feature (1)..(162): NCBI GI: 115453301 NCBI Desc: os03g0385100 [oryza sativa (japonica cultivar-group)]
  misc_feature (7)..(172): NCBI GI: 49204581 NCBI Desc: xylogen protein 1 [zinnia elegans]
  misc_feature (13)..(173): NCBI GI: 20147301 NCBI Desc: at5g64080/mhj24_6 [arabidopsis thaliana]
  misc_feature (13)..(173): NCBI GI: 21618136 NCBI Desc: nonspecific lipid-transfer protein-like protein [arabidopsis thaliana]
  misc_feature (13)..(173): NCBI GI: 42573786 NCBI Desc: protease inhibitor/seed storage/lipid transfer protein (ltp) family protein [arabidopsis thaliana]
MALASRAAAMACVLLALAASAAGAGSHSPAPAPAVDCVTQATTLIDCLDYVQPGSTAKRPSAACCAEVKTAVASPAIVGCLCSLAGNKDLGIPIDMKRVLALPGACGASNAAFSKCNISALSPAGAPAPSSTAGGSSSGGAAASPPKAAAASSPMTATALVAAVAAPLLAYFYLF

SEQ ID NO: 6537 - DNA, 477 bp, Sorghum bicolor
  misc_feature: Ceres ANNOT ID no. 6067365
  misc_feature: Encodes the peptide sequence at SEQ ID NO 6538
atgatgcacatgaccttctactggggcaagtcggccacgatcctcttcgacggctggcgcacctccacgtggttcgactacctcctctccctcgcggccctgctcctcgccgccgccttctaccagtacctcgaggccctgcgagtccgcgtgaagctcgccgcggaaggaggaggaggaggcggcgccgccgctaaggctaagccagcctcctccatcccgccacccgccagcgacgacccgcgggcgccactcctcgtggccgtcgccgggcgccgctggccggcgcgtgtggccgtggccgccatggtcggggtcaactccggcctcggctacctgctcatgctcgccgtcatgtcgttcaacggcggcgtgttcatcgccgtcgtcgtgggcctcgcgctcggctacctcgcgttccgcagcagcgacggcgaggatctcgtcgtcgtcgacaacccctgcgcctgcgcctaa

SEQ ID NO: 6538 - protein, 158 aa, Sorghum bicolor
  misc_feature: Ceres ANNOT ID no. 6067365
  misc_feature (2)..(147): Pfam Id: Ctr Pfam Desc: Ctr copper transporter family
  misc_feature (1)..(158): NCBI GI: 92873269 NCBI Desc: ctr copper transporter [medicago truncatula]
  misc_feature (1)..(146): NCBI GI: 42409140 NCBI Desc: copt5-like protein [oryza sativa (japonica cultivar-group)]
  misc_feature (1)..(158): NCBI GI: 21592530 NCBI Desc: copt5 [arabidopsis thaliana]
  misc_feature (15)..(158): NCBI GI: 18496860 NCBI Desc: copt5 [arabidopsis thaliana]
  misc_feature (81)..(142): NCBI GI: 115440201 NCBI Desc: os01g0770800 [oryza sativa (japonica cultivar-group)]
MMHMTFYWGKSATILFDGWRTSTWFDYLLSLAALLLAAAFYQYLEALRVRVKLAAEGGGGGGAAAKAKPASSIPPPASDDPRAPLLVAVAGRRWPARVAVAAMVGVNSGLGYLLMLAVMSFNGGVFIAVVVGLALGYLAFRSSDGEDLVVVDNPCACA

SEQ ID NO: 6539 - DNA, 1053 bp, Sorghum bicolor
  misc_feature: Ceres ANNOT ID no. 6067391
  misc_feature: Encodes the peptide sequence at SEQ ID NO 6540
  misc_feature: Up-regulated in shoot tissues in response to methyl jasmonate treatment
atgaacttcggcggaaatggcaacgcgacgacgatccggtgcaagtactgcagcgcgtgcctgaccgtgatccccggcgagcgcgccatccagtgcgcgcaatgcaactgcgtgacgcgcatccggcgcggcgaccgcatcccgccggcgcggccgccggcgcacgtgccgccggcgttccagcgcgcccgcggcaagaagcgcgccgtcctgatcggcatcacctacgccggcatgcgccgcgggtgcggcgagctcagggggcccatcaacgacgtcaagtgcatgaggaacctcctctgccagcgcttcggcttccccagcgagtgcatcatcatgctcaccgatgaccagagggatccgttcaggctgccgaccaaggagaacatccggatggcgatgcactggctggtgcagggctgcagctacggcgactccctggtgttccacttctccgggctgggcgcgcaggtggccgacgacgacggcgacgaggcggacgggtacgacgaggccatctgcccgctggacgcgttccagaggggccccatcctggacgacgagatcaacgaggccatcgtgcgcccgctggtgcacggcgtcaggctgcacgccgtggtggacgcctgctacagcgccacggtgctggacctcccctacgtgtgccacatgtccaggaacgggttctggcagtgggaggacgagagccccccgtcgggcgcctggaagggcaccagcggcggccacgccgtgctcatcagcggctacagcgagggcaaaagcaacttcgccatgatgccggatgcgtacgcgtcggtgggggcaatgacgcacagcttcatccgggcgctggagtgcgagccgcgcggggtcacctacggccgcctgctgacctccatgagagccatcatgaagaaccgcggcgggggacacgatctgcagggccccatcggagcacccatccacacggtggccaacttcagcggcgtgcaggagccgaacctgtcctcgtcggagatgtttgacatacaccgcaagccgttcgtcctgtaa

SEQ ID NO: 6540 - protein, 350 aa, Sorghum bicolor
  misc_feature: Ceres ANNOT ID no. 6067391
  misc_feature (67)..(346): Pfam Id: Peptidase_C14 Pfam Desc: Caspase domain
  misc_feature (1)..(350): NCBI GI: 115453333 NCBI Desc: os03g0388900 [oryza sativa (japonica cultivar-group)]
  misc_feature (12)..(350): NCBI GI: 32482812 NCBI Desc: metacaspase 1 [arabidopsis thaliana]
  misc_feature (4)..(350): NCBI GI: 115483494 NCBI Desc: os10g0565100 [oryza sativa (japonica cultivar-group)]
  misc_feature (50)..(350): NCBI GI: 37788549 NCBI Desc: metacaspase 3 [arabidopsis thaliana]
  misc_feature (50)..(262): NCBI GI: 30697974 NCBI Desc: latex-abundant family protein (amc3) / caspase family protein [arabidopsis thaliana]
  misc_feature: The sequence is a functional homolog of SEQ ID NO 110 in the 11/479,226US patent application
  misc_feature: The sequence is a functional homolog of SEQ ID NO 1289 in the 11/479,226US patent application
  misc_feature: The sequence is a functional homolog of SEQ ID NO 180 in the 10/374,780US patent application
  misc_feature: The sequence is a functional homolog of SEQ ID NO 234 in the 10/225,068US patent application
  misc_feature: The sequence is a functional homolog of SEQ ID NO 596 in the 10/412,699US patent application
  misc_feature: Useful for making plants with modulated growth and phenotype characteristics
  misc_feature: The sequence is a functional homolog of SEQ ID NO 596 in the 20040045049 US patent application
  misc_feature: Up-regulated in shoot tissues in response to methyl jasmonate treatment
MNFGGNGNATTIRCKYCSACLTVIPGERAIQCAQCNCVTRIRRGDRIPPARPPAHVPPAFQRARGKKRAVLIGITYAGMRRGCGELRGPINDVKCMRNLLCQRFGFPSECIIMLTDDQRDPFRLPTKENIRMAMHWLVQGCSYGDSLVFHFSGLGAQVADDDGDEADGYDEAICPLDAFQRGPILDDEINEAIVRPLVHGVRLHAVVDACYSATVLDLPYVCHMSRNGFWQWEDESPPSGAWKGTSGGHAVLISGYSEGKSNFAMMPDAYASVGAMTHSFIRALECEPRGVTYGRLLTSMRAIMKNRGGGHDLQGPIGAPIHTVANFSGVQEPNLSSSEMFDIHRKPFVL

SEQ ID NO: 6541 - DNA, 1191 bp, Sorghum bicolor
  misc_feature: Ceres ANNOT ID no. 6067394
  misc_feature: Encodes the peptide sequence at SEQ ID NO 6542
atggcgagcgcgcggccgccgcaggcgcaggcgcagcgcacgatgtggtgcggcggctgcggcgcgtacctgtccgtggcgcccggggcgcgctccgtgcggtgcgggctctgccacaccgtcacgcgcgtcgagcgccgccgcccgcacggcctgcaccacgccaccgtgggcttcatcaagggcctcatcaacgccttcacgtcgccgcagccggcgtcggggtcgccgcgggcggcgctccaggagcaggtgccggctgcgaggagtgcgagcttcccgcgcgtccgcggctgcaagaagcgcgcgctcctggtggggatcagctacgccgccaccaagtacgagctccggggcgccgtcaacgacgtcaactgcatgagctacctcctccgcgagcgcttcggcttcccggccgactgcatcctcgtgctcacacaggaggacaaggacgctgcacgggtgccgacgcgagcgaacctgatgcgcgcgctgcggtggctggtggacggcaccagcgccggggactcgctggtgttccacttctcgggccacggcgtgcagaagctggacagggacggcgacgaggcggacgggtacgacgaggcgctgtgcccggtggacttcgaggacccgcgcggcggcggcggggtgatcctggacgacgagatcaacgccaccatcgtgcggccgctggggaaaggcgtgaagctgcacgccatcgtggacacctgccacagcggcaccatcctcgacctcccctacctctgccgcctgtcgaggaccgggtactggcagtgggagaaccagcagacgacccggctctcctcctcctccggcggcggcggcgagaccgccaccagcaagtgcaccagcggcggactcgccatctccatcagcggctgcggcgacagccagacgtcgcaggacaccacggccttctccgggtccgcttccacgggcgccatgacgtacagcttcatcaaggcggtggagtcggagccgggcaccacctacggccgcctgctgacggcgatgagggccaccatccgcgacaacggcggggagttcggcataccgggccccatcggcaccttcttccgccgggtcatcacattcagctgcgcgcaggagccccagctgtgcgcttcagaaacgttcgacatctacaggaaaccctttctattgtga

SEQ ID NO: 6542 - protein, 396 aa, Sorghum bicolor
  misc_feature: Ceres ANNOT ID no. 6067394
  misc_feature (101)..(391): Pfam Id: Peptidase_C14 Pfam Desc: Caspase domain
  misc_feature (17)..(41): Pfam Id: zf-LSD1 Pfam Desc: LSD1 zinc finger
  misc_feature (33)..(396): NCBI GI: 32482812 NCBI Desc: metacaspase 1 [arabidopsis thaliana]
  misc_feature (85)..(396): NCBI GI: 115453333 NCBI Desc: os03g0388900 [oryza sativa (japonica cultivar-group)]
  misc_feature (5)..(396): NCBI GI: 115483494 NCBI Desc: os10g0565100 [oryza sativa (japonica cultivar-group)]
  misc_feature (11)..(352): NCBI GI: 37788549 NCBI Desc: metacaspase 3 [arabidopsis thaliana]
  misc_feature (11)..(290): NCBI GI: 30697974 NCBI Desc: latex-abundant family protein (amc3) / caspase family protein [arabidopsis thaliana]
  misc_feature: The sequence is a functional homolog of SEQ ID NO 110 in the 11/479,226US patent application
  misc_feature: The sequence is a functional homolog of SEQ ID NO 1289 in the 11/479,226US patent application
  misc_feature: The sequence is a functional homolog of SEQ ID NO 180 in the 10/374,780US patent application
  misc_feature: The sequence is a functional homolog of SEQ ID NO 234 in the 10/225,068US patent application
  misc_feature: The sequence is a functional homolog of SEQ ID NO 596 in the 10/412,699US patent application
  misc_feature: Useful for making plants with modulated growth and phenotype characteristics
  misc_feature: The sequence is a functional homolog of SEQ ID NO 596 in the 20040045049 US patent application
  misc_feature: The sequence is a functional homolog of SEQ ID NO 1888 in the 10/412,699 US patent application
MASARPPQAQAQRTMWCGGCGAYLSVAPGARSVRCGLCHTVTRVERRRPHGLHHATVGFIKGLINAFTSPQPASGSPRAALQEQVPAARSASFPRVRGCKKRALLVGISYAATKYELRGAVNDVNCMSYLLRERFGFPADCILVLTQEDKDAARVPTRANLMRALRWLVDGTSAGDSLVFHFSGHGVQKLDRDGDEADGYDEALCPVDFEDPRGGGGVILDDEINATIVRPLGKGVKLHAIVDTCHSGTILDLPYLCRLSRTGYWQWENQQTTRLSSSSGGGGETATSKCTSGGLAISISGCGDSQTSQDTTAFSGSASTGAMTYSFIKAVESEPGTTYGRLLTAMRATIRDNGGEFGIPGPIGTFFRRVITFSCAQEPQLCASETFDIYRKPFLL

SEQ ID NO: 6543 - DNA, 1656 bp, Sorghum bicolor
  misc_feature: Ceres ANNOT ID no. 6067396
  misc_feature: Encodes the peptide sequence at SEQ ID NO 6544
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
atggcgctctccaccaacgccgccgccgccgccgccgccatctccggcgggtccgcgtccgcgtcgcagccggcccgtcgcacgccctcgtctctcctcccgctgacgcgccgccgccgcgccgtcgtccgcgccgtgcacgccgcggagccgtcgaagaaccccggcgtcgtcgtcccggccgccgccaaggcctcgtcgccgacgacggtcgcgcctgagaacgacgcggcccctgctccggccccggcccgtgcgccggcgaagtgggcggtggacagctggaggacgaagaaagcgctacagctgccggagtatccgaacccggcagagctagaggcggtgctcaagaccatcgaggcgttcccacccatcgtcttcgctggggaggcgcgccacctggaagagcgcctcgccgacgccgccatgggacgcgccttcctcctccagggcggcgactgcgctgagagcttcaaggagttcaacagcaacaacatccgcgacaccttccgcgtcctcctgcagatgtccgccgttctcatgttcggcgcccagatgcccgtcgtcaaggttggtaggatggccggccaattcgcgaagccaaggtcggatccgttcgaggttagagatggcgtcaagctgcccagctaccggggcgataacattaatggcgaggcattcgacgagaagagccgtgtccccgacccacagaggatgatccgcgcgtatgcgcagtctgccgcaacgctgaacttgctccgcgccttcgccaccggaggctacgctgccatgcagcgcgtcacgcagtggaacctcgatttcaccgaacacagcgagcagggcgacaggtaccgtgaattggcacatcgggttgatgaagcccttggcttcatgtctgcagctggcctaacaccggaccaccctttgacgacgaccactgagttctggacctcacatgagtgcctcctcctaccttacgagcaagctttaacccgtcaagactccacctctggtcttttctacgattgctctgcccacatgctctgggttggtgagcgcactcgccagcttgatggcgcccatgttgagttcctcaggggtattgccaaccctcttggcatcaaggtaagtgacaaaatgaaccccagcgacttggtgaagctgattgatatactgaacccaacaaacaagcccgggaggatcaccgttattacaaggatgggggcagagaacatgagggtgaagttacctcaccttatccgtgcggtccgccaggctggacaaattgtcacctggatcactgacccgatgcacggcaacaccatcaaggctccttgtggtctaaagactcgtccatttgacaatattctggctgaggtacgggccttctttgatgtgcacgagcaagaggggagccaccctggaggtgtccaccttgagatgactgggcaaaacgtaactgaatgcattggcgggtcacgcaccgtgaccttcgatgacctgagcgaccgctaccacacccactgtgaccccaggctgaacgcgtcccagtctctggagctcgcgttcattatcgccgagaggctgaggaagaggaggatccggtcatcgtccgggctcaacaacatcttgcccttgccgccttttggtttctga

SEQ ID NO: 6544 - protein, 551 aa, Sorghum bicolor
  misc_feature: Ceres ANNOT ID no. 6067396
  misc_feature (89)..(526): Pfam Id: DAHP_synth_2 Pfam Desc: Class-II DAHP synthetase family
  misc_feature (9)..(550): NCBI GI: 110832750 NCBI Desc: phospho-2-dehydro-3-deoxyheptonate aldolase 1, chloroplast precursor (phospho-2-keto-3-deoxyheptonate aldolase 1) (dahp synthetase 1) (3-deoxy-d-arabino-heptulosonate
  misc_feature (9)..(550): NCBI GI: 110832750 (continued) 7-phosphate synthase 1)
  misc_feature (9)..(550): NCBI GI: 115453341 NCBI Desc: os03g0389700 [oryza sativa (japonica cultivar-group)]
  misc_feature (1)..(551): NCBI GI: 75138360 NCBI Desc: phospho-2-dehydro-3-deoxyheptonate aldolase 2, chloroplast precursor (phospho-2-keto-3-deoxyheptonate aldolase 2) (dahp synthetase 2) (3-deoxy-d-arabino-heptulosonate
  misc_feature (1)..(551): NCBI GI: 75138360 (continued) 7-phosphate synthase 2)
  misc_feature (1)..(551): NCBI GI: 46359608 NCBI Desc: 3-deoxy-d-arabino heptulosonate-7-phosphate synthase [oryza sativa (japonica cultivar-group)]
  misc_feature (14)..(528): NCBI GI: 46093428 NCBI Desc: 3-deoxy-d-arabino heptulosonate-7-phosphate synthase [oryza sativa (japonica cultivar-group)]
  misc_feature (9)..(550): SWISSPROT Homolog: EC 2.5.1.54 Phospho-2-dehydro-3-deoxyheptonate aldolase 1, chloroplast precursor
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
MALSTNAAAAAAAISGGSASASQPARRTPSSLLPLTRRRRAVVRAVHAAEPSKNPGVVVPAAAKASSPTTVAPENDAAPAPAPARAPAKWAVDSWRTKKALQLPEYPNPAELEAVLKTIEAFPPIVFAGEARHLEERLADAAMGRAFLLQGGDCAESFKEFNSNNIRDTFRVLLQMSAVLMFGAQMPVVKVGRMAGQFAKPRSDPFEVRDGVKLPSYRGDNINGEAFDEKSRVPDPQRMIRAYAQSAATLNLLRAFATGGYAAMQRVTQWNLDFTEHSEQGDRYRELAHRVDEALGFMSAAGLTPDHPLTTTTEFWTSHECLLLPYEQALTRQDSTSGLFYDCSAHMLWVGERTRQLDGAHVEFLRGIANPLGIKVSDKMNPSDLVKLIDILNPTNKPGRITVITRMGAENMRVKLPHLIRAVRQAGQIVTWITDPMHGNTIKAPCGLKTRPFDNILAEVRAFFDVHEQEGSHPGGVHLEMTGQNVTECIGGSRTVTFDDLSDRYHTHCDPRLNASQSLELAFIIAERLRKRRIRSSSGLNNILPLPPFGF

SEQ ID NO: 6545 - DNA, 2784 bp, Sorghum bicolor
  misc_feature: Ceres ANNOT ID no. 6067397
  misc_feature: Encodes the peptide sequence at SEQ ID NO 6546
atggaagcggcgggcaatggccggagggacgcggcgctgggcgcccttgccgtgctccccgacgaggtgctctgcgccgtcgtcgacctactcccgcccgccgacatcggacgcctcgcgtgcgtcagcagtgtcatgtacatactttgtaatgaagaacctctctggatgaccaaatgtctttcaattgggggccctcttgaatacaaagaaaacatggagattttgcagaagcctcgtcagttcgatggattcaattctttgcatctatacaggagatggtatagatgttttactactttgagtagtttttcctttgacgatggacatgtggaaaggaaagatgaccttttattggatcaatttcgttctcagtatgatggaaaaggcccagttttgcttacaaagttggctgaaacctggcctgcaaggacaaaatggacactgcagcaactgactaaggattttggtgaagttccattcaggatatcacaaagaagtcctcagaagataacaatgaaactgaaggattatgtttcttacatggaactccagcatgatgaagaccctctatacatatttgatgataagtttggagaatcagcaccaacattacttgaagattatagtgtccctcatttattccaagaagatttttttgatatcttggattatgaccaacgaccagcattcagatggcttattattggaccagagagatcaggtgcttcttggcatgttgatccaggactgacgagtgcatggaatactcttctttgtggccgaaaaagatgggcattgtaccctccaggaagagtgcctggtggtgtcacagtacatgtaaatgatgaagacggtgatgttgacattgaaactccgacgtcattgcagtggtggcttgatatctatccacaccttcctgaacaagagaagccattggaatgcacacaattgccaggagagaccatttttgttcctagtgggtggtggcattgcgttctgaatctcgagacaacaattgcagtgacacagaactttgtaaaccagtctaattttcagcatgtatgtttggatatggcacctggtcacagacacaaaggagtttgccgtgctggcttacttgctgttccaggaaaattcattaaagataatgaaaatcatccatctgtcacaatgagtggatggaaccaccctgatatgagtcgtaaggaaaaaaggcttaaaagttctgaaccactaagaacctcaaatagcataaatcattgttctgcatttgagttctcaggtgttcaggagagtttggagaatcaagatttctcatatgatattgatttcttgtcacaattccttgagaaagaaagggatcattattcttctctctggagtccaactaattcattagggcagagagaagcaagagaatggctgcgcaggctttgggttcttaaacctgaactgagagaactaatatggaagggtgcgtgccttgcaataaatgttgacaaatggtattcatgcttagaggagatatgtgcatgccatagtttaccgccacccacagaggatgagaagcttcctgttggcactggtagcaacccagtcttcattgtctcgggcaatgtgattaaaatatatgctgaaggaggattagtctatgctgtccatggtttgggcacagagcttgagttctatgatctcctgcaaaaaagtggttcacctttgatcaatcacattcctgagataattgctagtggcttccttgagtataaggatgatatctacaggacggttccatggaatggaaaaggaataccagaaattttggttaaacactacccattggaggtttcttatgcaaacagttgctttcctcttgggctttggagcaagcaacgatttggaatgagtagttcaactgatgtttcagacagaccaatttggccttacatggttacgagaaaccgtgatatgctgtcaaagactgatgttcttcatcttgcatcatccttgggagttcaaatgcaaaacatacatctattatccctgccacctgtggagcaattatctgaatctgggaacaatgatgtgaaagaagtggtaggaacatgtgatgatgccacggttctacctgaatggcagcaactagtctctactctaaataggagaaagcaaaatgtaaagaagcacctagctaactgggggaactctgttccacaagttctagtagaaaaagctgaagaatatctccctcccaatatgggcttcctcttcaagtttgttaaggataatggtgacttggtgtacccatgcccctcttggatacattcagatataatggatgataacattcttattgaggggatcacaaaattgaattcttctggtgagagggaaagagtttatgaagcagatcaggaaaaaatgaatgcaattcacatcattgatttcagtgatctgtctatcggggatcctatatgtgacataattccgctgcacttggatattttccggggtgatacagaccttctcaaggaattcctacggagctataaacttccccttctgagggggggatcaattactgatgtctacaattcagtgcgaaattcgaagttcagcagggcatcgtatcgcgcaatgtgctactgtatactacacgaggacaatgttttgggagctatattcggcttgtggaaggagctgagggctgcaacgtcctgggaggatgttgaaaacttagtctggggagagctgaatcggtaccaggagtcatgcactctgtag

SEQ ID NO: 6546 - protein, 927 aa, Sorghum bicolor
  misc_feature: Ceres ANNOT ID no. 6067397
  misc_feature (233)..(346): Pfam Id: JmjC Pfam Desc: JmjC domain
  misc_feature (14)..(61): Pfam Id: F-box Pfam Desc: F-box domain
  misc_feature (56)..(921): NCBI GI: 142993104 NCBI Desc: f-box protein at1g78280
  misc_feature (127)..(685): NCBI GI: 144923663 NCBI Desc: transcription factor jumonji, jmjc [medicago truncatula]
  misc_feature (8)..(921): NCBI GI: 8052543 NCBI Desc: f3f9.18 [arabidopsis thaliana]
  misc_feature (8)..(786): NCBI GI: 30699319 NCBI Desc: transcription factor jumonji (jmjc) domain-containing protein [arabidopsis thaliana]
  misc_feature (101)..(352): NCBI GI: 34785436 NCBI Desc: phosphatidylserine receptor [danio rerio]
  misc_feature: The sequence is a functional homolog of SEQ ID NO. 293 in the 11/188,298 US application
MEAAGNGRRDAALGALAVLPDEVLCAVVDLLPPADIGRLACVSSVMYILCNEEPLWMTKCLSIGGPLEYKENMEILQKPRQFDGFNSLHLYRRWYRCFTTLSSFSFDDGHVERKDDLLLDQFRSQYDGKGPVLLTKLAETWPARTKWTLQQLTKDFGEVPFRISQRSPQKITMKLKDYVSYMELQHDEDPLYIFDDKFGESAPTLLEDYSVPHLFQEDFFDILDYDQRPAFRWLIIGPERSGASWHVDPGLTSAWNTLLCGRKRWALYPPGRVPGGVTVHVNDEDGDVDIETPTSLQWWLDIYPHLPEQEKPLECTQLPGETIFVPSGWWHCVLNLETTIAVTQNFVNQSNFQHVCLDMAPGHRHKGVCRAGLLAVPGKFIKDNENHPSVTMSGWNHPDMSRKEKRLKSSEPLRTSNSINHCSAFEFSGVQESLENQDFSYDIDFLSQFLEKERDHYSSLWSPTNSLGQREAREWLRRLWVLKPELRELIWKGACLAINVDKWYSCLEEICACHSLPPPTEDEKLPVGTGSNPVFIVSGNVIKIYAEGGLVYAVHGLGTELEFYDLLQKSGSPLINHIPEIIASGFLEYKDDIYRTVPWNGKGIPEILVKHYPLEVSYANSCFPLGLWSKQRFGMSSSTDVSDRPIWPYMVTRNRDMLSKTDVLHLASSLGVQMQNIHLLSLPPVEQLSESGNNDVKEVVGTCDDATVLPEWQQLVSTLNRRKQNVKKHLANWGNSVPQVLVEKAEEYLPPNMGFLFKFVKDNGDLVYPCPSWIHSDIMDDNILIEGITKLNSSGERERVYEADQEKMNAIHIIDFSDLSIGDPICDIIPLHLDIFRGDTDLLKEFLRSYKLPLLRGGSITDVYNSVRNSKFSRASYRAMCYCILHEDNVLGAIFGLWKELRAATSWEDVENLVWGELNRYQESCTL

SEQ ID NO: 6547 - DNA, 1575 bp, Sorghum bicolor
  misc_feature: Ceres ANNOT ID no. 6067424
  misc_feature: Encodes the peptide sequence at SEQ ID NO 6548
atggccaacgcggccactgcccctctgctagcaagcagccatgacggcgagccggcgaaggagccatccatcgatgacgtgatggagatgtacatcggcgccacaggcatcctgcagctgctcaaggccgtcttggtggccttcgcgtgggccttcgacgcgcagcaggtgttcatctccgcgttcacggacgccgagccgcggtggcactgccttgctgcctccaccggcaactcctcatgctcacgctcttcgaccgcggcctcgccgtgcgcactcccgcccggcacatgggcgtgggaccggccggcggtggcgtcagtggtctccgagtgggccctcagctgcgccggcggcccggcgctcgtctccctgccggcgtcgtccttcttcgccggctgcctggccggcggcttcctcctcacgacgctcgcggactcgctcctcggccgcaagaagatgctcctcgtgtccctggtgtccatgtccgtcgccggcgtgctcgccatcttcgcgcccaacgtttgggtgtacgccgccctacgcctgctgtccggcttcttcaggtccatggtgggcacgtgcacgctggtgctgtccacggagctcgtcgggaagaggtgtcgccacatggtcagcgcggcggcgttcttcggcttcgccctcgggttcttgtccctcccggcgctcgcctacgcgttccgcgacgcgtcatggcggaacatgtacttctggacgtccgtgccttgtctctgttactgcgtcctgctctacttcctagtcccggagtcgccacggtggctgctggtgcgcggccggaagctggacgccatggaggcgctgaagcagatcatctcgctcaacggcagctgcgcaacggccagcttctccctgctggaccggtgcaccgtgcacgaggacgacgacggcgcgagcagcgggggcggcgtcttcgccacgctgcaggcgatgtgggagcggcggtgggcgttccagaggctggccgcgaccatggcggccagcttcggcgtggggatgttctactttggcatgccgctcaacgtcggcagcctgggatccgacctctacctgagcgtcacgctcaacgcgctggccgagctggcggcggccgtcctcacgtggctcctcgtcagccggagcgacaggcggagcgcggtgatcgcgctcaccgcggcggcgggggcgtgcagcctcgcgtgcgtggccatcccgcggcgcgccgcgtcggcgcggatggccgccgaggtgctgtccttcttcgcggcgtgcacggcgttcgacgtcctgctgatctactccaccgagatgttcccgacgtccgtgcgcaactcggcggtggggctggtgcggcagacgatggtgctgggcggcgcggcggcgcccgtgctcatcgcgctgggccgcgagagcagcctctggtcgttcggcgtgttcgggatcgccatcggctgctccggcctcttcatcccgtgtctaccggagacgaggggaaaacgcatgtcggacaccatggaagaggaggagcgcaacgaggccgccatgggccttgtttag

SEQ ID NO: 6548 - protein, 524 aa, Sorghum bicolor
  misc_feature: Ceres ANNOT ID no. 6067424
  misc_feature (72)..(468): Pfam Id: MFS_1 Pfam Desc: Major Facilitator Superfamily
  misc_feature (46)..(514): Pfam Id: Sugar_tr Pfam Desc: Sugar (and other) transporter
  misc_feature (1)..(515): NCBI GI: 115436340 NCBI Desc: os01g0330600 [oryza sativa (japonica cultivar-group)]
  misc_feature (6)..(515): NCBI GI: 3152576 NCBI Desc: similar to liver-specific transport protein gbl27651 from rattus norviegicus. [arabidopsis thaliana]
  misc_feature (1)..(515): NCBI GI: 23507793 NCBI Desc: at1g16390/f3o9_19 [arabidopsis thaliana]
  misc_feature (1)..(521): NCBI GI: 4835768 NCBI Desc: is a member of the pf00083 sugar transporter family. [arabidopsis thaliana]
  misc_feature (16)..(521): NCBI GI: 58532109 NCBI Desc: osjnbb0015d13.11 [oryza sativa (japonica cultivar-group)]
  misc_feature: The sequence is a functional homolog of SEQ ID NO. 449 in the 11/188,298 US application
MANAATAPLLASSHDGEPAKEPSIDDVMEMYIGATGILQLLKAVLVAFAWAFDAQQVFISAFTDAEPRWHCLAASTGNSSCSRSSTAASPCALPPGTWAWDRPAVASVVSEWALSCAGGPALVSLPASSFFAGCLAGGFLLTTLADSLLGRKKMLLVSLVSMSVAGVLAIFAPNVWVYAALRLLSGFFRSMVGTCTLVLSTELVGKRCRHMVSAAAFFGFALGFLSLPALAYAFRDASWRNMYFWTSVPCLCYCVLLYFLVPESPRWLLVRGRKLDAMEALKQIISLNGSCATASFSLLDRCTVHEDDDGASSGGGVFATLQAMWERRWAFQRLAATMAASFGVGMFYFGMPLNVGSLGSDLYLSVTLNALAELAAAVLTWLLVSRSDRRSAVIALTAAAGACSLACVAIPRRAASARMAAEVLSFFAACTAFDVLLIYSTEMFPTSVRNSAVGLVRQTMVLGGAAAPVLIALGRESSLWSFGVFGIAIGCSGLFIPCLPETRGKRMSDTMEEEERNEAAMGLV

SEQ ID NO: 6549 - DNA, 1329 bp, Sorghum bicolor
  misc_feature: Ceres ANNOT ID no. 6067445
  misc_feature: Encodes the peptide sequence at SEQ ID NO 6550
atggaggtgcacgccgacgtcgatgggtccggtgtgcccctggccgtgctcctcaagcgggagctgtggaaccagaaggtggagaggccggacatcctgttcggggaggccaacaagagcaagaaaggggaggacttcacgctcctcatgcccaggtgccaccgcaccacgggcggcggcggcggcgagaatgcaggcgacgacgacgccatttccgtgtttgcgatttttgatggacacaatggctctacagctgccatatacacccgggagaatctaataaacaatgtgttggctgctatacctccaaatctcacaagtgaggagtggacagctgcgttgccaagggcactagttgctggttttgtaaaaacagacaaagacttccaaacaaaaggtattataaatgggatgtcagctgcacgttcagggaccactgtgacatttgttataatagatggatgggttgtcactgtagcatcagttggtgattcgcgatgtattctagaatctgctgagggttcagtatattttttatcagcagatcatcgcctggatgctaatgaagaggaggtggagcgtgtaacagcaagtggaggtgaagttgggagaataaatattgctgggggtgctgggattggtccactcagatgctggccaggtggattgtgtctatcaaggtcaataggtgatatcgacgtcggggaatttatagttcctgtcccacatgtgaagcaattgtccaatgctggtggccggcttgtcattgccagtgatggggtgtgggatgcactgcgctttcaagaggctctgaactacaccaggggtctgccagctgaagctgctgctaatcgaattgttaaggaagctgtcacttcaaagggattaagagatgatactacttgcatagtagttgacatactacctgcagaaaagttaagccccccactaaagaggcctggaaaaggagtcatcaaagctctgttccgtcggaggccctctgatgaaatgtctgaagaccagatggacagaggatgtttggaacctgatgttgtggaggaaatatacgaggagggctctgcaatgcttgctcgaaggttgaatataaattatccagcaggaaatatgttcaagctgcatgattgtgctgtctgccaattggagatgaaacctggtgagggcacctctgttcatggtaacgtgcccaagcattcaagagttgacccctggggtggtccttttctctgttcctcctgtcaagtgaaaaaggaggccatggaagggaagctacattcaagaagtatggatgtgtttacccagaagctataa

SEQ ID NO: 6550 - protein, 442 aa, Sorghum bicolor
  misc_feature: Ceres ANNOT ID no. 6067445
  misc_feature (43)..(300): Pfam Id: PP2C Pfam Desc: Protein phosphatase 2C
  misc_feature (1)..(431): NCBI GI: 115453381 NCBI Desc: os03g0395100 [oryza sativa (japonica cultivar-group)]
  misc_feature (72)..(435): NCBI GI: 115458662 NCBI Desc: os04g0449400 [oryza sativa (japonica cultivar-group)]
  misc_feature (72)..(433): NCBI GI: 38344839 NCBI Desc: osjnba0064h22.20 [oryza sativa (japonica cultivar-group)]
  misc_feature (72)..(433): NCBI GI: 116310073 NCBI Desc: h0818e04.11 [oryza sativa (indica cultivar-group)]
  misc_feature (10)..(433): NCBI GI: 92879648 NCBI Desc: protein phosphatase 2c-like [medicago truncatula]
  misc_feature: The sequence is a functional homolog of SEQ ID NO. 363 in the 11/188,298 US application
  misc_feature: The sequence is a functional homolog of SEQ ID NO. 386 in the 11/188,298 US application
  misc_feature: The sequence is a functional homolog of SEQ ID NO. 448 in the 11/188,298 US application
  misc_feature: The sequence is a functional homolog of SEQ ID NO. 406 in the 11/188,298 US application
MEVHADVDGSGVPLAVLLKRELWNQKVERPDILFGEANKSKKGEDFTLLMPRCHRTTGGGGGENAGDDDAISVFAIFDGHNGSTAAIYTRENLINNVLAAIPPNLTSEEWTAALPRALVAGFVKTDKDFQTKGIINGMSAARSGTTVTFVIIDGWVVTVASVGDSRCILESAEGSVYFLSADHRLDANEEEVERVTASGGEVGRINIAGGAGIGPLRCWPGGLCLSRSIGDIDVGEFIVPVPHVKQLSNAGGRLVIASDGVWDALRFQEALNYTRGLPAEAAANRIVKEAVTSKGLRDDTTCIVVDILPAEKLSPPLKRPGKGVIKALFRRRPSDEMSEDQMDRGCLEPDVVEEIYEEGSAMLARRLNINYPAGNMFKLHDCAVCQLEMKPGEGTSVHGNVPKHSRVDPWGGPFLCSSCQVKKEAMEGKLHSRSMDVFTQKL

SEQ ID NO: 6551 - DNA, 1548 bp, Sorghum bicolor
  misc_feature: Ceres ANNOT ID no. 6067459
  misc_feature: Encodes the peptide sequence at SEQ ID NO 6552
atgcagagcgccacgcggctgacgctgctgctgtgcgcggcgtgggcggccgcgctgctctacggcgagatgggcgcctactgggcctcctacctcgcatgctcgtggccctcgccgtcctcctcctcctcctcgccgccgcttatggacagcacctcccttggtcttccatcaagctcagttggtctccaagctgctgagttttacacggatttgaacatgagaaggtccttccagtctgccatactgccattcaaacctgatgtggtcttatttcttggtgatcactttgatggaggcccttacatgtccgatgaagagtggcaggaatcattgtttcgatttaaacatatattcagcctgaatgaacaaataacaaagccacagatccctatctactacctttcaggaaatcatgatattggttactcagcatttcattcagttcatcctgaggtgctcagtcggtatgaaaaagaatttggatcaagaaattatcaattttctgctgggaaggtggactttgttgttgttgatgcccaaacacttgatggagctaaaaaaagcaaagaaagatcctcctcctgggagttcattaaaactctatctccaggtaatgcatcgaacccaaaggttctgctaacgcatattccactataccgacctgataactctccttgtggtccacatcgttcttcacctattataaatcagagggtatcttatgctgccttagaccaaggaatcacctaccaaaattatctaactaaagagacttctgaccttttgctaagcttgttgaagccggtccttgtgctctcaggccatgatcatgaccaatgcacagtcgtccactccactccttttggtccagttacagagcatacattggggacaataagttggcagcaaggaaatctctatccatcttttatgctgctatctgctggacccaaggtgtcacaaaattcaactgatccggagcatgaggttgttacaaacctttgttttctgcctaaacaaacccatatttatgtctggtatatctgccagtttgtagtgaccatccttcttctagtcttctggccaacaaatggtctcagttctcttccttgcatgaacacattggtgagcttcatgaggtcggttggtgctgaactgctttcaagaaccaaggaaaaagatgacgaggaagatggtgaatatgatatgatttttgatgcggaaggatccatgcacctcgttaaaaaggcagcggtaaagagcccaagtgctagctcagactccagacctacagggcgtggaagcgttgttgcaagggcaacagcaggaaaacaccgtttggagcctgattcatcatcaattcttgtggacgtgggttctgagatgacatcagaagatggagggaagttggcccgcggtagcaaatcgagagtaaggaaggtgctccaacggctgttccgtgtgattcagtcgattgttgtcattgccgctctgaatgtccccctgtacatgatgctcctgttcaaggattggattgatcgttga

SEQ ID NO: 6552 - protein, 515 aa, Sorghum bicolor
  misc_feature: Ceres ANNOT ID no. 6067459
  misc_feature (16)..(280): Pfam Id: Metallophos Pfam Desc: Calcineurin-like phosphoesterase
  misc_feature (7)..(515): NCBI GI: 92873667 NCBI Desc: metallophosphoesterase [medicago truncatula]
  misc_feature (1)..(515): NCBI GI: 79365227 NCBI Desc: hydrolase/ protein serine/threonine phosphatase [arabidopsis thaliana]
  misc_feature (28)..(375): NCBI GI: 19113820 NCBI Desc: similar to s. cerevisiae cell division control protein 1, cc1_yeast [schizosaccharomyces pombe]
  misc_feature (28)..(375): NCBI GI: 5734473 NCBI Desc: spac630.12 [schizosaccharomyces pombe]
  misc_feature (18)..(359): NCBI GI: 54644940 NCBI Desc: ga21091-pa [drosophila pseudoobscura]
MQSATRLTLLLCAAWAAALLYGEMGAYWASYLACSWPSPSSSSSSPPLMDSTSLGLPSSSVGLQAAEFYTDLNMRRSFQSAILPFKPDVVLFLGDHFDGGPYMSDEEWQESLFRFKHIFSLNEQITKPQIPIYYLSGNHDIGYSAFHSVHPEVLSRYEKEFGSRNYQFSAGKVDFVVVDAQTLDGAKKSKERSSSWEFIKTLSPGNASNPKVLLTHIPLYRPDNSPCGPHRSSPIINQRVSYAALDQGITYQNYLTKETSDLLLSLLKPVLVLSGHDHDQCTVVHSTPFGPVTEHTLGTISWQQGNLYPSFMLLSAGPKVSQNSTDPEHEVVTNLCFLPKQTHIYVWYICQFVVTILLLVFWPTNGLSSLPCMNTLVSFMRSVGAELLSRTKEKDDEEDGEYDMIFDAEGSMHLVKKAAVKSPSASSDSRPTGRGSVVARATAGKHRLEPDSSSILVDVGSEMTSEDGGKLARGSKSRVRKVLQRLFRVIQSIVVIAALNVPLYMMLLFKDWIDR

SEQ ID NO: 6553 - DNA, 1407 bp, Sorghum bicolor
  misc_feature: Ceres ANNOT ID no. 6067469
  misc_feature: Encodes the peptide sequence at SEQ ID NO 6554
atggggagcagcgcggcgcagcggcggcgatggacgctggctctggtgaccacggcggcgctgctggagcgcgcggatgagcagctgcttcccgcggtgtacaaggaggtcggcgaggcgctgcgcgtgtcccccaccgcgttgggctccctctcgctgtgccgcgcgctcgtgcaggccgtctgctacccgctcgcgacgtgcgccgcggcgcgctgcgaccgcgcgcgcgtcgtcgccgccggcgcagtcctctgggccgtggccacactgctcgtcggcgcctcgggcacttttctccatatggcgttggccaggggcttcaacggcgtcgggctggcgctcgttgtgccggcgatctactccctggtggcggactacagcgacgacggcacgcgcggctcggcgttcgggtgggtggggatggcgcagttcatgggccgtgtcgccgggaacaccctcggcgtgctgctagcggcgacgagcttcctcggcgtcccaggctggcggctggcgttctacgccctcgcgctcgtcagcgcctccatcgccgccctaacgtggctgctcggcgccgacccccgccgccccgtcaccgtccgcggcgcgaagtccgccacggccgcggcggccacgctggcccagctcgcccgagaagccagggacgtggtgaaggtgccgacgttccagatcatcgtggcgcagggcgtggccgggtcggtgccgtggtcggcgctcagcttcgccgccatgtggctggagctcgccgggttcacgcactggcagaccagcgcgctgaccggcctcaacaacctcgccaacgcggtcggcgcgctgttcgcggggttcgtcggggacccactggcgcggcggttcccggacacgggcaggatcgcgcttgcgcaggtgtgcaccgcgtccaccgtcccgctcgccgccgtcctgctgctcgcgctccccgacgaccccgccgcggtggccgcgtacgccgccacgttcttcgtcctgggcttcgtcatgccctggtgccccgtcgccacaaacaacccaattttcgcggaggtcgtgccggagaaggcgaggacgacggtgtacgcgctggacaggtgcttcgagacggtgttcgcctcgttcgcgccgccgctcgtgggcatcctggcggagcgcgtcttcgggtaccaaccggcggccgcgtccgagatcgccgtgccggttgccgtctgttgcctcgcctacaccgggctgtactggacttaccccgccgacagacagcacgcgcagacggccgctctgcaactgcaagcggcgggggatcaggactgcgactgcgaagcccatgctgctgcaggagctgagggcttgaaccaagcgctattgccggaacaagaacggagtagcaaattctga

SEQ ID NO: 6554 - protein, 468 aa, Sorghum bicolor
  misc_feature: Ceres ANNOT ID no. 6067469
  misc_feature (16)..(380): Pfam Id: MFS_1 Pfam Desc: Major Facilitator Superfamily
  misc_feature (1)..(452): NCBI GI: 37806448 NCBI Desc: transporter-like protein [oryza sativa (japonica cultivar-group)]
  misc_feature (7)..(395): NCBI GI: 115478853 NCBI Desc: os09g0371200 [oryza sativa (japonica cultivar-group)]
  misc_feature (10)..(395): NCBI GI: 37806444 NCBI Desc: transporter-like protein [oryza sativa (japonica cultivar-group)]
  misc_feature (100)..(395): NCBI GI: 49389121 NCBI Desc: transporter-like protein [oryza sativa (japonica cultivar-group)]
  misc_feature (7)..(394): NCBI GI: 49389120 NCBI Desc: membrane transport protein-like [oryza sativa (japonica cultivar-group)]
MGSSAAQRRRWTLALVTTAALLERADEQLLPAVYKEVGEALRVSPTALGSLSLCRALVQAVCYPLATCAAARCDRARVVAAGAVLWAVATLLVGASGTFLHMALARGFNGVGLALVVPAIYSLVADYSDDGTRGSAFGWVGMAQFMGRVAGNTLGVLLAATSFLGVPGWRLAFYALALVSASIAALTWLLGADPRRPVTVRGAKSATAAAATLAQLAREARDVVKVPTFQIIVAQGVAGSVPWSALSFAAMWLELAGFTHWQTSALTGLNNLANAVGALFAGFVGDPLARRFPDTGRIALAQVCTASTVPLAAVLLLALPDDPAAVAAYAATFFVLGFVMPWCPVATNNPIFAEVVPEKARTTVYALDRCFETVFASFAPPLVGILAERVFGYQPAAASEIAVPVAVCCLAYTGLYWTYPADRQHAQTAALQLQAAGDQDCDCEAHAAAGAEGLNQALLPEQERSSKF

SEQ ID NO: 6555 - DNA, 1263 bp, Sorghum bicolor
  misc_feature: Ceres ANNOT ID no. 6067488
  misc_feature: Encodes the peptide sequence at SEQ ID NO 6556
atggaaccgccgcgggccaacaacaacggcggcaggaagcgcaagcccacgccgcctcccgccgccgccggcggcctgggggacctccacgacgacatgctcgagggcgtcctcgcgcgcctcccgccggccgcctacttccgcctccgcgccgtctgccgccgctggcgcgccgccgcggagtccccgaccttcctcgacgcctgcgcccgcgtcccgtcccgtgacccctggttcctcatgctctccgactccgactccgcctccggctccgtcgccttcgacgccgccggccgcagctggaaccggctttgccgcgccgcgccgggggccgcggccgccgtgcccgtggccgcgtggggcggcttcgtcctctaccgcgcgccggacacgggcgcgctcaccgtcgccaacccgctcacgggcgcgtcccgcgcgctcccctcgccgccgccgccgctgcagagcgcgcagcagcagctgcaggccatcgccatgtacggcgccggcgccggccactactaccgcgtggccctcttcgcgggcgacctcccggacctctccatggcggtcttcgactcgtccagcaactcgtgggagggccccctgccgctcgcccgcaaggccggggacgactcctcctgctaccccgacgcgccggcgcagggcggcggcggcggcgacgacgacacggtctacttcctcagcaagtccggggacgtggtgtccaccaacatgcagcgcagcgcgtccaagcagtactcgtcggtggtcgtgccctcgtccgctcccggcgacggtgacgcggtcgcctacttcctcagctactcgggcaccgtcgtggcctgcgacacggcgcgccgcacgttcgcggagctgccccgcatcctccccgtctacttcgagtactccatcgacgtcgtggcgtgcggcgccgcggcctacgccgtggtgctctccgagtacctggacacggccagcctgcgggtctgggagttcgccgggggcgcgtggcggcaggtggccgccatgccgcccgccatgtcgcacggcttccacggcacgcgggccgacatcaactgcgtcggccacggcgaccgcctcatggtctgcgtcacctccgccgaggccagcggctgcttcatgtgcgacgtggccagcaaccagtgggaggagctgcccaagcacgtcaatggcgacggcgaggccaacgagttcttggccgccttctccttcgagcccagagtggagatcaccgtctaa

SEQ ID NO: 6556 - protein, 420 aa, Sorghum bicolor
  misc_feature: Ceres ANNOT ID no. 6067488
  misc_feature (24)..(71): Pfam Id: F-box Pfam Desc: F-box domain
  misc_feature (6)..(420): NCBI GI: 24060044 NCBI Desc: f-box protein family, atfbx13-like protein [oryza sativa (japonica cultivar-group)]
  misc_feature (10)..(420): NCBI GI: 55741098 NCBI Desc: f-box protein [zea mays]
  misc_feature (10)..(420): NCBI GI: 55741056 NCBI Desc: f-box protein [zea mays]
  misc_feature (26)..(420): NCBI GI: 115646859 NCBI Desc: at4g33160 [arabidopsis thaliana]
  misc_feature (26)..(420): NCBI GI: 42567346 NCBI Desc: f-box family protein (fbx13) [arabidopsis thaliana]
MEPPRANNNGGRKRKPTPPPAAAGGLGDLHDDMLEGVLARLPPAAYFRLRAVCRRWRAAAESPTFLDACARVPSRDPWFLMLSDSDSASGSVAFDAAGRSWNRLCRAAPGAAAAVPVAAWGGFVLYRAPDTGALTVANPLTGASRALPSPPPPLQSAQQQLQAIAMYGAGAGHYYRVALFAGDLPDLSMAVFDSSSNSWEGPLPLARKAGDDSSCYPDAPAQGGGGGDDDTVYFLSKSGDVVSTNMQRSASKQYSSVVVPSSAPGDGDAVAYFLSYSGTVVACDTARRTFAELPRILPVYFEYSIDVVACGAAAYAVVLSEYLDTASLRVWEFAGGAWRQVAAMPPAMSHGFHGTRADINCVGHGDRLMVCVTSAEASGCFMCDVASNQWEELPKHVNGDGEANEFLAAFSFEPRVEITV

SEQ ID NO: 6557 - DNA, 5484 bp, Sorghum bicolor
  misc_feature: Ceres ANNOT ID no. 6067489
  misc_feature: Encodes the peptide sequence at SEQ ID NO 6558
atggaggaccctaataaaacatttgctgacgtagttaagcttttgacatcatggctgccgcgacgctccaacccagacaatgtctccagggacttctggatgcccgatcacagttgtcgagtttgctatgactgtgacacgcaattcaccatattcaaccgcaggcatcattgtcgccgctgtggacgaattttctgtggtaagtgtactgcaaactccatcccagtttcgagtggccctgacagaaatgtcgatgagggggacaggatacgggtctgcaacttctgcttcaagcaatgggagcaagaaagagtcacttccctcaaacaggtgcagccggtgctcagcccttccctgtctgaggcgagtttgttcagcaccaagtcagctatcaccatcaatagtgttaccacaacggctggctcttactctactggaaattatcagcatgtgggctgtgttaccagcattagtcctccaaagtgttgccatgacaagacctcccataatatgcaagacgctcatgctcctgagaaatgtatgtccactgtttcaaacaaagatgactcttcagttcagtttggctactacacaaacaggagtgatgatgaagatgaagaataccctgcttactgctctgataggcaggaacaacatcagcaacagaatggacaatattatggcccagatgagttttatgaccttgatacacccgaaccctacaattcaaaaacgtcgcagacagttgaagaatctgtgacctctaaagaactacccccgcatgtgcttgatcaaggatttcctagcacactgactgttacaaaatcagacaatgaaccagaaccagataatagttctgaatgtggtgctgcttcatccatttatgctttagaaagtaatgatacaaacccagttgattttgaaaaggatgaacttttctggcttcctcctgaaccagaagatgaagaagatgagatgcaaactgacttgtttgatgatgatgacgatgacgacgaatccgtagctgatgttgaacggtgtcgaattcgatcgtcaagtagttttggcagtggagagttccgaagtagagatcggtcaggcgaagaacataagaaagtaatgaagaatgtcgttgatggacacttcagggctttgatttctcagctactagaggtggagaatatttcattacatgaaggtgatgacatgggctggttggagattgttacttctgtatcatgggaagctgccaacttcctcaggccagacacaagccagggtggtggcatggatcctggtggatatgtcaaggttaagtgtttagcatgtgggcaccgcagtgaaagcaccgttgtaaaaggagtagtttgtaagaagaatgtcgcacataggcgcatgacaactagaatagagaagccccgtctcctactacttgcaggagctcttgagtaccatcgagtcacaaatcagctgtcaagtattgatacattgctccagcaggaaacagatcaccttaaaatggcagtagcaaagattgtagctcaaaaacccaacttgcttttggttgagaattcagtttctcgatatgctcaagatttgcttctagaaaagaacatatcattggttttaaatatcaagcagcccctcttgcagcgcatttctcgttgcacaggtgctcagatagttccttctattgatctcctaccatctcagaagcttggttactgtgagttatttcatgtggataaatacgatgagcagtctgttacctcgggtaatgtgtcaaagaaaatggtgaagaccatgatgttctttgaaggatgcccaaaaccattgggttgcactgttctgctaaagggtggtagcatggatgagctcaagaaaattaagcatgtggtccagtatggcatttttgcagcatatcacttggcgttggaaacatctttccttgcagatgaaggtgcaaccctaccagaacttccattgaagtctccattgactgtagccttgccagacaaacgatctactgcagacagctccatttcagcagtgccaggcttcacaattaatgtttcaaatagccagcaaactgatagttttgaccaccttggtaccaactacatgtcaattcacccaggtgaaattgctgtggttgaagcaccagtatccagtgaatcctttacttctcagaatacctactctcattctcttggaccttggtgtgctgataacagcaatttcaacaacgggactggtgatggagatggattagttgaggtcactgcaacttcaacatccgtttccatatcttctacgtctacatctggtgcactcacaaaccatactcctagatattctagtgtagacaaaaagagtatgcattttggtgattatcatgatggttcgacaagattacatggtaagacagtgacaatggattcaaccagcacatcaagttgttttcaccagagcactgtcaaagctagcactaatatcaatagttctaatgtcaaggagtcattagaaggttcatatgctttggctaatgtgaaaaccatcaacaagaacaactctgtggtagttcaaccagtgcctactgttgctgtacaaaaccaagagaccagtcaaggagatgatagcacatcaaataaggatgaagttgtgccttctgatcatcaaagcatcttagtctcattgtccacacgttgtgtatggaaaggtactatttgtgagcgttcccagctgttacgcatcaagtattatggtaactttgacaagcctcttggcaggtttctgcgggactacttgtttgatcagggctaccagtgtcgttcctgtgataagccacctgaagcccatgtccattgctatactcatcgccagggaagtctaaccatatcagttagaaaacttaccgaatttgttttgtcgggtgaaagggatgggaaaatttggatgtggcacagatgtctgaaatgcccttggagtaatgggtttcctccagcaactcaaaggattgtcatgtctgatgctgcctggggtttgtcacttggtaaatttttggagcttagcttttcaaaccatgcagctgcaagtagggtggccagttgtggccattctctccacagggactgcctccggttctatgggtttggcaaaatggttgcttgcttccgatatgctcctattagtgttcattctgtttacttaccacctcataaacttgattttggtcaccagcccttggattggatacaaaaggaagcaaatgaggttattgagcgagcaaaacatctctttgatgaagtattgcattctttacacttgatatctgacaaaaaggttcaaggcagttctcctaacatggaatttagcaattacattgctgatcttgaaatcatgcttcgaaaggaaaagtcagaattcgagggatgcctgaataaagtcttgagaagggatatgcagaaaggccaaccagacatccttgagatcaataggctgcaaaggcagttactcttccattcatacttgtgggataaaagactggtatttgctgcaagatcagatagatatcgtcacgagaagatcaattctatagatagtgttgctgagcaaaatgtactactaaagcctcaaagtgagtgcaatgggaataggtctgccaacaaagatgctaaatttgagtgccttcaggaaagcatttatggagggaatcacactggagttgattcaggtactgtcagtgcaaatcatgtccaggaaatggctacaggcgaattggattcgcttcaaagagacatcaaaactcctctatacagctgtgtcagtgtaagtggtgattcaattcccttggagccagatcttgttgctcgacgcaccctttcagaaggtcagtttcctagtgtattggatgtgactaatgcacttgaagcaaaatggactggtaaagatgatcctgtttctagcaaggtaaccatgccagaatctacagcatcctcagaggattcagaagaacatatgggtgatactacaccttcttatgcctctatattgctgagcaagctaggggacagtgcagcagaccattctaattggataggaatgcctttcttactattttaccgttctctcaataagcaatggaatcgttcaaaccgatttgatgcgctcaacgaatatactcctgaatatgtttcttttttaagggaagtggagcgtcagattggacctaaatttctctttcctataggaatcagtgacactgtcattggagtttttgatgacgaacctactagcattatcgcttatgcgctggcctcccatgaatatcatcttcagatgtcagatgaactggaacaagaaacgacagacacttcactcccacaatgtgactcaagaagtgcctcgttaactgaaatggatgaatgtacttctgaacttctaagaagtgttgtctctacagaggacattatcttctccatgtctggaagcaagaacccacttgcttccgattcacttgtacctcaaaaagtaagtcacattaaagtgaattttggggatgaaggtcctctaggacaggtgaagtacagtgttatttgttactatgccaaacaatttgatgctctgaggagattatgctgtccatcagagcgtgattttgttaggtcccttagtcgttgcaagaaatggggtgctcaaggaggcaagagcaatgtattctttgcaaaatcaatggatgatcgattcataattaagcaggttaccaaaactgaattagagtctttcatgaagtttgctccagactacttcaaatatgtatcagagtcgatttgcactggaagtcctacttgcattgcaaaaattcttggtatttatcaggttaagagcctcaaaggaggtaaggagatgaggatggatgttctagtgatggaaaatcttttgtttgagcgtaatgtgacaacattgtatgatttaaagggttctacaagatcaagatataacccagactcaaatggtagtgataaagtacttcttgatcagaacttaattgaagcgatgcctacgtcgcctatttttgtcggaaacaaggcaaagaggttgctggagagagctgtttggaatgacacatcctttcttgcttccatcgatgtaatggattactctttacttgttggtgttgatgagaaaaggcatgaacttgtgatgggaatcatagatttcatgagacaatacacgtgggacaaacacctagagacatgggtgaaagcttcagggatattaggtggaccaaagaatgtgtcgccaacagtaatttcaccaaagcagtacaagaagcggtttaggaaagccatgtcggcctactttcttgtggttccagaccagtggtcgcctctagtgatcatccccagcaagcaagctgagagtggtcaggacagggatagcgaccaggttctcttgacagaatcgcgagttatgcatgcataa

SEQ ID NO: 6558 - protein, 1827 aa, Sorghum bicolor
  misc_feature: Ceres ANNOT ID no. 6067489
  misc_feature (1555)..(1788): Pfam Id: PIP5K Pfam Desc: Phosphatidylinositol-4-phosphate 5-Kinase
  misc_feature (31)..(102): Pfam Id: FYVE Pfam Desc: FYVE zinc finger
  misc_feature (341)..(782): Pfam Id: Cpn60_TCP1 Pfam Desc: TCP-1/cpn60 chaperonin family
  misc_feature (1)..(1740): NCBI GI: 115453415 NCBI Desc: os03g0399500 [oryza sativa (japonica cultivar-group)]
  misc_feature (66)..(1808): NCBI GI: 42407620 NCBI Desc: 1-phosphatidylinositol-3-phosphate 5-kinase-like [oryza sativa (japonica cultivar-group)]
  misc_feature (1)..(842): NCBI GI: 92884025 NCBI Desc: chaperonin cpn60/tcp-1; phosphatidylinositol-4-phosphate 5-kinase; zinc finger, fyve/phd-type [medicago truncatula]
  misc_feature (1)..(842): NCBI GI: 140072141 NCBI Desc: chaperonin cpn60/tcp-1; phosphatidylinositol-4-phosphate 5-kinase; zinc finger, fyve/phd-type [medicago truncatula]
  misc_feature (1353)..(1816): NCBI GI: 144924365 NCBI Desc: chaperonin cpn60/tcp-1; phosphatidylinositol-4-phosphate 5-kinase [medicago truncatula]
MEDPNKTFADVVKLLTSWLPRRSNPDNVSRDFWMPDHSCRVCYDCDTQFTIFNRRHHCRRCGRIFCGKCTANSIPVSSGPDRNVDEGDRIRVCNFCFKQWEQERVTSLKQVQPVLSPSLSEASLFSTKSAITINSVTTTAGSYSTGNYQHVGCVTSISPPKCCHDKTSHNMQDAHAPEKCMSTVSNKDDSSVQFGYYTNRSDDEDEEYPAYCSDRQEQHQQQNGQYYGPDEFYDLDTPEPYNSKTSQTVEESVTSKELPPHVLDQGFPSTLTVTKSDNEPEPDNSSECGAASSIYALESNDTNPVDFEKDELFWLPPEPEDEEDEMQTDLFDDDDDDDESVADVERCRIRSSSSFGSGEFRSRDRSGEEHKKVMKNVVDGHFRALISQLLEVENISLHEGDDMGWLEIVTSVSWEAANFLRPDTSQGGGMDPGGYVKVKCLACGHRSESTVVKGVVCKKNVAHRRMTTRIEKPRLLLLAGALEYHRVTNQLSSIDTLLQQETDHLKMAVAKIVAQKPNLLLVENSVSRYAQDLLLEKNISLVLNIKQPLLQRISRCTGAQIVPSIDLLPSQKLGYCELFHVDKYDEQSVTSGNVSKKMVKTMMFFEGCPKPLGCTVLLKGGSMDELKKIKHVVQYGIFAAYHLALETSFLADEGATLPELPLKSPLTVALPDKRSTADSSISAVPGFTINVSNSQQTDSFDHLGTNYMSIHPGEIAVVEAPVSSESFTSQNTYSHSLGPWCADNSNFNNGTGDGDGLVEVTATSTSVSISSTSTSGALTNHTPRYSSVDKKSMHFGDYHDGSTRLHGKTVTMDSTSTSSCFHQSTVKASTNINSSNVKESLEGSYALANVKTINKNNSVVVQPVPTVAVQNQETSQGDDSTSNKDEVVPSDHQSILVSLSTRCVWKGTICERSQLLRIKYYGNFDKPLGRFLRDYLFDQGYQCRSCDKPPEAHVHCYTHRQGSLTISVRKLTEFVLSGERDGKIWMWHRCLKCPWSNGFPPATQRIVMSDAAWGLSLGKFLELSFSNHAAASRVASCGHSLHRDCLRFYGFGKMVACFRYAPISVHSVYLPPHKLDFGHQPLDWIQKEANEVIERAKHLFDEVLHSLHLISDKKVQGSSPNMEFSNYIADLEIMLRKEKSEFEGCLNKVLRRDMQKGQPDILEINRLQRQLLFHSYLWDKRLVFAARSDRYRHEKINSIDSVAEQNVLLKPQSECNGNRSANKDAKFECLQESIYGGNHTGVDSGTVSANHVQEMATGELDSLQRDIKTPLYSCVSVSGDSIPLEPDLVARRTLSEGQFPSVLDVTNALEAKWTGKDDPVSSKVTMPESTASSEDSEEHMGDTTPSYASILLSKLGDSAADHSNWIGMPFLLFYRSLNKQWNRSNRFDALNEYTPEYVSFLREVERQIGPKFLFPIGISDTVIGVFDDEPTSIIAYALASHEYHLQMSDELEQETTDTSLPQCDSRSASLTEMDECTSELLRSVVSTEDIIFSMSGSKNPLASDSLVPQKVSHIKVNFGDEGPLGQVKYSVICYYAKQFDALRRLCCPSERDFVRSLSRCKKWGAQGGKSNVFFAKSMDDRFIIKQVTKTELESFMKFAPDYFKYVSESICTGSPTCIAKILGIYQVKSLKGGKEMRMDVLVMENLLFERNVTTLYDLKGSTRSRYNPDSNGSDKVLLDQNLIEAMPTSPIFVGNKAKRLLERAVWNDTSFLASIDVMDYSLLVGVDEKRHELVMGIIDFMRQYTWDKHLETWVKASGILGGPKNVSPTVISPKQYKKRFRKAMSAYFLVVPDQWSPLVIIPSKQAESGQDRDSDQVLLTESRVMHA

SEQ ID NO: 6559 - DNA, 1479 bp, Sorghum bicolor
  misc_feature: Ceres ANNOT ID no. 6067505
  misc_feature: Encodes the peptide sequence at SEQ ID NO 6560
  misc_feature: Down-regulated in shoot tissues in response to salicylic acid treatment
atggcggcggccgtggcgccgccgctctgcacctggctcgtcgccgcctgcctctccgcggcctgcggcgatggcgagaaggagaagcagcgcaggcaccgcggcgtcgggggtctcttcggctcgcaccgccgcctcggctctgggcgccgcggcggggcgcgctctggaatggccatgtctgttgccttgcagcctgaaaggacagctgtggaaagtaagaaacctgatatgaaacaaaggagagtggtggtcactggcatgggcgtagtgacgccactaggtcatgatcctgatgaattctacaataaccttttaaggggtatcagtggaataagcgagatagaggcatttgattgctctcactatcccacgagaatcgcgggagaaatcaaatcattttcgacagatggttgggttgcaccaaagctagctaagcggatggacaagtttatgcaatatttgataacggctggaaagaaagcattggagaatgctggaatcactgaagaagtcatggatgagttggaaaaatcaagatgtggagtcctcattgggtctgctatgggtggcatgaaggttttcagtgatgcaattgaagctttgagggtttcctacaagaagatgaacccattttgtgtaccttttgcaactacaaacatgggttctgcgatacttgctatggatctgggttggatgggcccaaattactctatctctaccgcttgtgctactagcaacttctgcattctgaatgcagctaatcatatcaggagaggggaagctgatttgatgctctgtggtggttcagatgcaccaatcatccctattggactgggaggttttgtggcctgcagagctctttcacagagaaacagtgatccagcaaaagcttctcgaccttgggatgtggatcgggatggatttgttatgggagaagggtctggtgtgcttgttttggaagaacttgagcatgcaaagcaaagaggtgcagaaatatatgctgaatttctaggaggaagtttcacatgtgatgcataccatatgacagagcctcatcctgaagggaaaggggttattctttgtattgaaaacgcattagcagattctggagtaacaaaggaggacattaactatataaatgctcatgcaacatctacacagatgggtgatttgaaggaatttgaagctctcaaccgttgttttggccagaatcctcagatacgagtgaactcaacgaagtcgatgacaggccatctgctaggagctgctggtggaatagaagctgttgctgctatacaagctataagaacaggttgggtgcatccaaatgtcaatttggataatccagagaaaaatgtggatgtcagcatgctggtgggtccacagaaggagagatgcgatgtgaaggtggcactgtcaaactcatttggatttggtgggcacaactcatcgattctatttgcaccattcaagtga

SEQ ID NO: 6560 - protein, 492 aa, Sorghum bicolor
  misc_feature: Ceres ANNOT ID no. 6067505
  misc_feature (81)..(326): Pfam Id: ketoacyl-synt Pfam Desc: Beta-ketoacyl synthase, N-terminal domain
  misc_feature (334)..(448): Pfam Id: Ketoacyl-synt_C Pfam Desc: Beta-ketoacyl synthase, C-terminal domain
  misc_feature (3)..(491): NCBI GI: 498742 NCBI Desc: beta-ketoacyl-acp synthase [hordeum vulgare subsp. vulgare]
  misc_feature (3)..(492): NCBI GI: 498740 NCBI Desc: beta-ketoacyl-acp synthase [hordeum vulgare subsp. vulgare]
  misc_feature (13)..(490): NCBI GI: 1698690 NCBI Desc: beta-ketoacyl-acp synthase ii [cuphea wrightii]
  misc_feature (13)..(490): NCBI GI: 30795125 NCBI Desc: beta-ketoacyl-acp synthase ii [elaeis guineensis]
  misc_feature (35)..(490): NCBI GI: 1698688 NCBI Desc: beta-ketoacyl-acp synthase ii [cuphea wrightii]
  misc_feature (42)..(492): SWISSPROT Homolog: EC 2.3.1.41 3-oxoacyl-[acyl-carrier-protein] synthase I, chloroplast precursor
  misc_feature: Down-regulated in shoot tissues in response to salicylic acid treatment
MAAAVAPPLCTWLVAACLSAACGDGEKEKQRRHRGVGGLFGSHRRLGSGRRGGARSGMAMSVALQPERTAVESKKPDMKQRRVVVTGMGVVTPLGHDPDEFYNNLLRGISGISEIEAFDCSHYPTRIAGEIKSFSTDGWVAPKLAKRMDKFMQYLITAGKKALENAGITEEVMDELEKSRCGVLIGSAMGGMKVFSDAIEALRVSYKKMNPFCVPFATTNMGSAILAMDLGWMGPNYSISTACATSNFCILNAANHIRRGEADLMLCGGSDAPIIPIGLGGFVACRALSQRNSDPAKASRPWDVDRDGFVMGEGSGVLVLEELEHAKQRGAEIYAEFLGGSFTCDAYHMTEPHPEGKGVILCIENALADSGVTKEDINYINAHATSTQMGDLKEFEALNRCFGQNPQIRVNSTKSMTGHLLGAAGGIEAVAAIQAIRTGWVHPNVNLDNPEKNVDVSMLVGPQKERCDVKVALSNSFGFGGHNSSILFAPFK

SEQ ID NO: 6561 - DNA, 636 bp, Sorghum bicolor
  misc_feature: Ceres ANNOT ID no. 6067510
  misc_feature: Encodes the peptide sequence at SEQ ID NO 6562
atggtggagaaggcgaggaccatgaccatggcgcgcaagctagagatcccgcagtggaagcccgacggcctgctgccgtcgccgacgagcccgctggaccgcgcgtcgccccgcgggtggcgccaccgcgacgccgtcgggggcgtcgggctcgggatcctcgcggcgctggaggccgaggagggcccgcgcgcgcagcccgccgccgcgctggcggtgccgagggtgtccatcccgcgtcgcgcggcgcggctggaggtgtcggagctcgggtgcagcgggcggtgcgccaccagcctgtgcggcggcggtggcacggcgtccgccaggcggccttccgcgttccgcgtggcggagttcctgtcgtgctgcgacatgtgccggcgggcgctggacgggaaggacatcttcatgtaccgcggcgagcgcgccttctgcagcatggagtgccggtaccacgccatcgtgagcgacgagttccaggaggagaaggagcggaagcgccgcgccgccgccgccgccgccatgtcttccgccgccgacgtgcccaagaagtctgccgcggcggagatggccgggtcgccgtgcagcggcagcgggcagatcttcttcaccaccggcatcgtcgccgcctga

SEQ ID NO: 6562 - protein, 211 aa, Sorghum bicolor
  misc_feature: Ceres ANNOT ID no. 6067510
  misc_feature (119)..(163): NCBI GI: 15221976 NCBI Desc: senescence-associated protein-related [arabidopsis thaliana]
  misc_feature (102)..(193): NCBI GI: 116309823 NCBI Desc: h0307d04.5 [oryza sativa (indica cultivar-group)]
  misc_feature (102)..(195): NCBI GI: 115469958 NCBI Desc: os06g0714800 [oryza sativa (japonica cultivar-group)]
  misc_feature (107)..(195): NCBI GI: 115476698 NCBI Desc: os08g0451200 [oryza sativa (japonica cultivar-group)]
  misc_feature (119)..(163): NCBI GI: 115482076 NCBI Desc: os10g0422600 [oryza sativa (japonica cultivar-group)]
  misc_feature: Useful for making plants with modulated nitrogen use efficiency
  misc_feature: Functional homolog of the protein sequence encoded by LOCUS at1g22160
MVEKARTMTMARKLEIPQWKPDGLLPSPTSPLDRASPRGWRHRDAVGGVGLGILAALEAEEGPRAQPAAALAVPRVSIPRRAARLEVSELGCSGRCATSLCGGGGTASARRPSAFRVAEFLSCCDMCRRALDGKDIFMYRGERAFCSMECRYHAIVSDEFQEEKERKRRAAAAAAMSSAADVPKKSAAAEMAGSPCSGSGQIFFTTGIVAA

SEQ ID NO: 6563 - DNA, 1665 bp, Sorghum bicolor
  misc_feature: Ceres ANNOT ID no. 6067536
  misc_feature: Encodes the peptide sequence at SEQ ID NO 6564
atggaggccgctggaggcgatgggaggtggtgcgtggtcactggcggccgcgggttcgccgcgaggcacctggtgacgatgctgctccgctccggcgagtggcgggtgcgcgtggccgacctgccccccgccatcacgctcgaccgcgaagaagaagagggtttcctgggtgctgctctccgcgaaggccaggctgtctacgcctccgccgacctccgcgacaaggcccaggtcgccagagcttttgaaggggcagaagtagttttccatatggctgctccagattcatccatcaacaacttccaccttcattatgcagtcaatgttgagggaacaaagaatgttattgatgcttgtatccgttgcaaggtgaagagactcatctacactagttcacctagtgtcgtgtttgatggagttcatggaatttttaatgcagatgaatcaatgccttacccagataagtttaatgattcatattcagaaacaaaagcagatgcagaaagaattgtgatgagggctaatggtagggaagggcttcttacgtgctgtatacgcccaagtagcatttttggccctggtgataagctcatggttccatctttggttgctgctgcaagggcagggaaatccaaatacattattggtgatgggaacaactactatgatttcacctatgtggaaaatgtggcatatggtcatgtttgtgcagagaaaactctatcatctgaagatggtgcaaagatagccgctggaaaaacttatttcataacaaatatggagcctataaaattctgggagttcatgtcattgatattagaaggtcttggatatgaaaggccttcaataaaaataccagtctctgttatgatgccagtggctcatgttgtagaatggacttaccagaaatttgctaagtatggaatgaaagttcctcagctgaccccttcaaggatcaggctgctctcatgtaacaggacattcagctgctcaagagcaaaggaccagcttggttatgaacctcttgtgtcccttaaggatggactgaagagaacagtagagtcgtactcccatctacaagctcagaatcagaggagtatatcaaaggcttcaattttccttgggaatggaaatcttgcaaaaacagtactttgggaagatgcgaagcaaactgtgacagtgcttctactgttggctgttatctactaccatttatttacatgtggttataccttcatcacagcgatggcaaagcttttgtcactgactgctctgttcttattcattcatggcattctaccatcaaatctgtttggtcacaagattgagaaacttgaggcctctaattttcacatcacacaggcacaggctcatcatattgctcattccactacttcatgttggaactctttagtcagttcgctaagatctctttgcagaggaaatgattggctattgtttctcaaggtttcactctctctgctggttgtcagcatccttagttccatgtcttctcatgctgcatttaaaataggtactgctctggttttcacaggcttcaaagcatatgaaaaatgggaggacagcatcgacagtatggtgggcgacgcgtgcaccattattctgaacattggttctgctaagaaatcatctagccaaaaataa

SEQ ID NO: 6564 - protein, 554 aa, Sorghum bicolor
  misc_feature: Ceres ANNOT ID no. 6067536
  misc_feature (12)..(287): Pfam Id: 3Beta_HSD Pfam Desc: 3-beta hydroxysteroid dehydrogenase/isomerase family
  misc_feature (11)..(252): Pfam Id: Epimerase Pfam Desc: NAD dependent epimerase/dehydratase family
  misc_feature (13)..(234): Pfam Id: NAD_binding_4 Pfam Desc: Male sterility protein
  misc_feature (379)..(550): Pfam Id: Reticulon Pfam Desc: Reticulon
  misc_feature (3)..(534): NCBI GI: 42569340 NCBI Desc: 3-beta hydroxysteroid dehydrogenase/isomerase family protein [arabidopsis thaliana]
  misc_feature (91)..(534): NCBI GI: 79323109 NCBI Desc: 3-beta-hydroxy-delta5-steroid dehydrogenase [arabidopsis thaliana]
  misc_feature (9)..(373): NCBI GI: 18401656 NCBI Desc: 3-beta hydroxysteroid dehydrogenase/isomerase family protein [arabidopsis thaliana]
  misc_feature (9)..(373): NCBI GI: 63034416 NCBI Desc: 4alpha-carboxysterol-c3-dehydrogenase/c4-decarboxylase isoform 1-1 [arabidopsis thaliana]
  misc_feature (3)..(377): NCBI GI: 3075392 NCBI Desc: 3-beta-hydroxysteroid dehydrogenase [arabidopsis thaliana]
MEAAGGDGRWCVVTGGRGFAARHLVTMLLRSGEWRVRVADLPPAITLDREEEEGFLGAALREGQAVYASADLRDKAQVARAFEGAEVVFHMAAPDSSINNFHLHYAVNVEGTKNVIDACIRCKVKRLIYTSSPSVVFDGVHGIFNADESMPYPDKFNDSYSETKADAERIVMRANGREGLLTCCIRPSSIFGPGDKLMVPSLVAAARAGKSKYIIGDGNNYYDFTYVENVAYGHVCAEKTLSSEDGAKIAAGKTYFITNMEPIKFWEFMSLILEGLGYERPSIKIPVSVMMPVAHVVEWTYQKFAKYGMKVPQLTPSRIRLLSCNRTFSCSRAKDQLGYEPLVSLKDGLKRTVESYSHLQAQNQRSISKASIFLGNGNLAKTVLWEDAKQTVTVLLLLAVIYYHLFTCGYTFITAMAKLLSLTALFLFIHGILPSNLFGHKIEKLEASNFHITQAQAHHIAHSTTSCWNSLVSSLRSLCRGNDWLLFLKVSLSLLVVSILSSMSSHAAFKIGTALVFTGFKAYEKWEDSIDSMVGDACTIILNIGSAKKSSSQK

SEQ ID NO: 6565 - DNA, 948 bp, Sorghum bicolor
  misc_feature: Ceres ANNOT ID no. 6067537
  misc_feature: Encodes the peptide sequence at SEQ ID NO 6566
atggcctcctccctcgccgcgcgccgcctcctctcccgcgccgccgcggtgcgccgtatccccgtccccttcgcctccgcccccgcctccgcgatggctccccgccgcttctcggccgacgcgggaccgcctccgccgctcccgccgccgccgctggagcccgtcgtcgagccgcccacgtcggagggcgcgggcacctcgtcttcctccaccaccgccggtgcaggaggcggcgcccacaggtcgtcgcctggagcctccgcgggggcgcggcgccagggtggtgcgggctacgaggaggaacaggagaaagtcctccgcgcgtcgctgctccacccgcgcatggggtggagcgagtcggccatggtcgcgggggcgagggacgttggcgtttctcctgccatcgtgggtgcattcccaaggaaggaggccgcccttgtcgagtttttcatggatgactgcctccaacaactgatcgatcgaattgatgctggagaaggagagcagttgaagaacttgatactgagtgagagactctcaaaacttgtccggatgaggctggaaatgcaggcaccttatatatctaagtggcctcaagcactgagtatccaggctcaaccagcaaacgtctcaacaagcttgaagcagcgagctgtcctggtcgatgagatatggcatgctgctggagattctggatcagatattgattggtatgtgaaacgtacagtgcttggtggtatctactcaacctcagaggtgtatatgttgacagacaattctccagagttccgcgatacttggacgtttgtgaaccgcagaataaaggatgctcttgatcttcagaaaacattccaagaggccgcatacctggctgaagccgtgggagcaggcatgggcggcaccgtgcagggtgttctcaacagggtcttccagaaacgtagtggatga

SEQ ID NO: 6566 - protein, 315 aa, Sorghum bicolor
  misc_feature: Ceres ANNOT ID no. 6067537
  misc_feature (207)..(285): Pfam Id: COQ9 Pfam Desc: COQ9
  misc_feature (59)..(260): NCBI GI: 8778288 NCBI Desc: f14d16.30 [arabidopsis thaliana]
  misc_feature (56)..(300): NCBI GI: 122890482 NCBI Desc: novel protein similar to vertebrate coenzyme q9 homolog (s. cerevisiae) (coq9) [danio rerio]
  misc_feature (78)..(286): NCBI GI: 119603331 NCBI Desc: hcg2025883, isoform cra_a [homo sapiens]
  misc_feature (20)..(302): NCBI GI: 6841302 NCBI Desc: hspc326 [homo sapiens]
  misc_feature (59)..(204): NCBI GI: 18655389 NCBI Desc: t29m8.1/t29m8.1 [arabidopsis thaliana]
MASSLAARRLLSRAAAVRRIPVPFASAPASAMAPRRFSADAGPPPPLPPPPLEPVVEPPTSEGAGTSSSSTTAGAGGGAHRSSPGASAGARRQGGAGYEEEQEKVLRASLLHPRMGWSESAMVAGARDVGVSPAIVGAFPRKEAALVEFFMDDCLQQLIDRIDAGEGEQLKNLILSERLSKLVRMRLEMQAPYISKWPQALSIQAQPANVSTSLKQRAVLVDEIWHAAGDSGSDIDWYVKRTVLGGIYSTSEVYMLTDNSPEFRDTWTFVNRRIKDALDLQKTFQEAAYLAEAVGAGMGGTVQGVLNRVFQKRSG

SEQ ID NO: 6567 - DNA, 726 bp, Sorghum bicolor
  misc_feature: Ceres ANNOT ID no. 6067548
  misc_feature: Encodes the peptide sequence at SEQ ID NO 6568
atggcggtagttttgtcaaatgtcaactccaaggccggcctccaaaagcttaatgaccaccttctcacccgcagttacatgactgcgtaccaagcttcaaaggatgacatggctgtcttccctgcactttcatcttctcccccatcaagctatgtcaatgttacgaggtggtatgatcatatcagtgctctcctaaggtcctgtggaatcacagcagagggtaatggtgtcagggttgaggcaacttgttctgtgtcttcagctcctggagttgctgaacaaaaggcaccggcggttgatgaagatgatgatgttgacctatttggtaaggagaccgaagaagagcatgcagcaacggatgcacgtgcagcagctgttaaggcttccggcaagaagaaagagtctgggaagtcgtcaattcttctggatgtcaagccatgggacgatgaaactgaaatgcaaaagctagaggaagctgttagaagtgtgaagatggagggactgctctggggtgcatcaaaacttgttccagttggatatggcatcaagaagatgcaaattatgatgaccattgtggatgaccttgtttctgtcgacagtctgatagaggatcatctctgcactgaacctgccaatgagtacatccaaagctgtgacattgtagccttcaacaaaatctttgagtcatcgatcttgccaatccttagtggtttaaatagttcctag

SEQ ID NO: 6568 - protein, 241 aa, Sorghum bicolor
  misc_feature: Ceres ANNOT ID no. 6067548
  misc_feature (137)..(226): Pfam Id: EF1_GNE Pfam Desc: EF-1 guanine nucleotide exchange domain
  misc_feature (1)..(226): NCBI GI: 90101284 NCBI Desc: elongation factor 1-delta 2 (ef-1-delta 2) (elongation factor 1b-beta 2) (eef-1b beta 2)
  misc_feature (1)..(226): NCBI GI: 23237926 NCBI Desc: elongation factor 1 beta [oryza sativa (japonica cultivar-group)]
  misc_feature (1)..(226): NCBI GI: 6166140 NCBI Desc: elongation factor 1-beta (ef-1-beta)
  misc_feature (1)..(226): NCBI GI: 1841870 NCBI Desc: elongation factor 1-beta [pimpinella brachycarpa]
  misc_feature (1)..(226): NCBI GI: 38232568 NCBI Desc: translational elongation factor 1 subunit bbeta [pisum sativum]
MAVVLSNVNSKAGLQKLNDHLLTRSYMTAYQASKDDMAVFPALSSSPPSSYVNVTRWYDHISALLRSCGITAEGNGVRVEATCSVSSAPGVAEQKAPAVDEDDDVDLFGKETEEEHAATDARAAAVKASGKKKESGKSSILLDVKPWDDETEMQKLEEAVRSVKMEGLLWGASKLVPVGYGIKKMQIMMTIVDDLVSVDSLIEDHLCTEPANEYIQSCDIVAFNKIFESSILPILSGLNSS

SEQ ID NO: 6569 - DNA, 2271 bp, Sorghum bicolor
  misc_feature: Ceres ANNOT ID no. 6067552
  misc_feature: Encodes the peptide sequence at SEQ ID NO 6570
atggacgaggccttcgcgcgcgcggtggaggacggcctcaagctcaccaagcgcctggtcctgcccaacgggggcgggttgccgccgccgcgcccgcacctggcgatggaccgggacaacgaccccgccgcggcgctgctgcagctcatgcccgcgtcccccatggcctacgcggtcgtcgtcgacccgggcgccgtcgacagccccgacgtgcccagctaccagccccacgtgtacggccgcctcgacccgcccgcgctcatcccgctccagatgcgtgaggtcgacctccgcgtcgactgcgccgccgccggctgcgccaccgccgaggtcgccctgcgcgcgcgctggtgggtgcactgcatcacccgcagccgcgcctgccactgccgcatcgtcgtgcccatgggccaccagggttcaattctaggcgctgaggttactgttgggaaaagatcatacaatactcatgtaatcgatatagaggataactgtgcagtgaagattgaaatccctgagagtgggggtcttttaaaacaggaactattttccttaacaataccacaggttggaggcggagaagatatatttgccacaatcagatggtcacagaagttgctatatcacaacggacagttttctgtcgaagtaccttttcgtttcccacagtatgtgaaccctttgccgaaggttttcatgaaaaaggagaaaatacagttgactgtcaatagtggtgcaagtaaagaggttatattgcagggaacaagccatcccttgaaggaaaaaaatcggcaaggtgagaaattgtctttcctgcacgaagcagttgttgagaattggtcaaccaaagattttacctttgcatataccgtttattctggtgatttgtctggtggagttcttgtgcagccctcaacattgcgtgactatgacgacagagatatgttctgcctttttcttttacctggaaataacgcgaacagaaaggtcttcagaaaggctgttgtttatatcattgatacaagtggaagcatgcaaggaaagcctcttgagagtgttaagaatgccatgtccactactctctctgatcttatgcaaggagattacttcaacataataacatttaatgatgagcttcactcattctcatcacgtttggagcaagtaaatgaaagaacaattggaaatgctattgaatggatgaacctaaactttgtcgctcagggtggcactgacatgatgcatcctttgagtgaggcaatggctttgctgtcaagttctcatgatgtccttccacaaatctattttgttactgatgggtcagttgatgatgaaaggaatatctgccatactttgaaaactcagcttattaaaagtggatcgaagtctcctcgaatttctacttttgggctaggttcatattgcaaccactatttcttgaggatgttggcatcaattggtaagggtcactatgctgctgcacttgatacaggatcaattgagggtcgaatgcttcaatggttccagaaagcctcgagcactatagtgtcaaatgtttccattgatggcataaaacatattcaaggttttgaagtggattctgaatatattccagacatttcagcaaaatatccattgtgtgtttctggaaggtacaatggcaagcttccggagacacttatcgccaagggtcacttggctgacacgagtgaaatatctattgaattgaaagtccaacatataaaggatatacctcttgataaagtattggcaaagcaacagatggatcttctcacagcaaaatcatggcttatggagaataaagagcttgagcgcaaggttgtgaaattaagcatacaaaatagccttccttctgagtacacacgcatggtactacttcaaaccagcttggacaaaatagatccagcacaacaggcgaagaataaaccaacaaaacaaagcagcccagatgagctaccagctatgccgcttggtggcctagcactcggatttggtgatgtcgcggcaacaagggagaacctgacaacaggattcggagacatgaaagcaccggagaagtttgtgatattcgagaaggccgttggctgctgcagccgcgtggcggattgctgctgctgcatgtgcttcatcaaggcgtgcagcaagatgaacgaccagtgtgccattgtcatggcgcaggcctgcgctgccctcgcgtgcctgggatgcttcgagtgctgctcagagttgtgctgcggcgggtcgaactga

SEQ ID NO: 6570 - protein, 756 aa, Sorghum bicolor
  misc_feature: Ceres ANNOT ID no. 6067552
  misc_feature (334)..(504): Pfam Id: VWA Pfam Desc: von Willebrand factor type A domain
  misc_feature (1)..(613): NCBI GI: 53370749 NCBI Desc: von willebrand factor type a domain containing protein [oryza sativa (japonica cultivar-group)]
  misc_feature (167)..(756): NCBI GI: 8778285 NCBI Desc: f14d16.26 [arabidopsis thaliana]
  misc_feature (1)..(471): NCBI GI: 92868122 NCBI Desc: imp dehydrogenase/gmp reductase [medicago truncatula]
  misc_feature (414)..(756): NCBI GI: 115453469 NCBI Desc: os03g0407000 [oryza sativa (japonica cultivar-group)]
  misc_feature (314)..(645): NCBI GI: 90019771 NCBI Desc: inter-alpha-trypsin inhibitor domain protein [saccharophagus degradans 2-40]
MDEAFARAVEDGLKLTKRLVLPNGGGLPPPRPHLAMDRDNDPAAALLQLMPASPMAYAVVVDPGAVDSPDVPSYQPHVYGRLDPPALIPLQMREVDLRVDCAAAGCATAEVALRARWWVHCITRSRACHCRIVVPMGHQGSILGAEVTVGKRSYNTHVIDIEDNCAVKIEIPESGGLLKQELFSLTIPQVGGGEDIFATIRWSQKLLYHNGQFSVEVPFRFPQYVNPLPKVFMKKEKIQLTVNSGASKEVILQGTSHPLKEKNRQGEKLSFLHEAVVENWSTKDFTFAYTVYSGDLSGGVLVQPSTLRDYDDRDMFCLFLLPGNNANRKVFRKAVVYIIDTSGSMQGKPLESVKNAMSTTLSDLMQGDYFNIITFNDELHSFSSRLEQVNERTIGNAIEWMNLNFVAQGGTDMMHPLSEAMALLSSSHDVLPQIYFVTDGSVDDERNICHTLKTQLIKSGSKSPRISTFGLGSYCNHYFLRMLASIGKGHYAAALDTGSIEGRMLQWFQKASSTIVSNVSIDGIKHIQGFEVDSEYIPDISAKYPLCVSGRYNGKLPETLIAKGHLADTSEISIELKVQHIKDIPLDKVLAKQQMDLLTAKSWLMENKELERKVVKLSIQNSLPSEYTRMVLLQTSLDKIDPAQQAKNKPTKQSSPDELPAMPLGGLALGFGDVAATRENLTTGFGDMKAPEKFVIFEKAVGCCSRVADCCCCMCFIKACSKMNDQCAIVMAQACAALACLGCFECCSELCCGGSN

SEQ ID NO: 6571 - DNA, 687 bp, Sorghum bicolor
  misc_feature: Ceres ANNOT ID no. 6067556
  misc_feature: Encodes the peptide sequence at SEQ ID NO 6572
atggacgccggcggcgcacgtccatcggcaccgtcggccgccgctgccgcaggcaccgcagttgcgggggcctccgcggcggacgagccccgggacgcgcgggtggtgcgggagctcctgcgctcgatgggtctcggcgagggcgagtacgagccccgcgtcgtgcaccagttcctcgacctggcataccggtacgtcggagacgtgctcggggacgcccaggtctacgccgaccacgccgggaaggctcagatcgacgccgacgacgtcagcctcgccatccaggccaaggtcaatttctccttctcccagccgccgccgcgcgaggttctccttgagctggcccgtagccgaaacagaattccactgcccaaatcaattgctcctccaggctcaattcccctcccacctgagcaggacacactgttggcccagaactaccaactcctacctccattgaagccaccacctcaatatgaggaaacagaggatgagaatgaagaatccaacccaagtctgacaccgaacccagcaaattctaatccaaccttctcgcaggatcagagaaataacgagcaacagcacactccccaacatggtcagagggtttcattccaactcaatgctgtggcagctgctgctgcaaagcgtcctcggatgaccattgatcagctgaacatgggctaa

SEQ ID NO: 6572 - protein, 228 aa, Sorghum bicolor
  misc_feature: Ceres ANNOT ID no. 6067556
  misc_feature (21)..(150): Pfam Id: TFIID-31kDa Pfam Desc: Transcription initiation factor IID, 31kD subunit
  misc_feature (1)..(187): NCBI GI: 115473307 NCBI Desc: os07g0612500 [oryza sativa (japonica cultivar-group)]
  misc_feature (24)..(216): NCBI GI: 80478685 NCBI Desc: taf9 protein [mus musculus]
  misc_feature (24)..(216): NCBI GI: 28175808 NCBI Desc: taf9 rna polymerase ii, tata box binding protein (tbp)-associated factor [mus musculus]
  misc_feature (24)..(216): NCBI GI: 33086648 NCBI Desc: cb1-739 [rattus norvegicus]
  misc_feature (24)..(216): NCBI GI: 34068042 NCBI Desc: liver regeneration related protein; lrrg210 [rattus norvegicus]
  misc_feature: The sequence is a functional homolog of SEQ ID NO. 433 in the 11/188,298 US application
MDAGGARPSAPSAAAAAGTAVAGASAADEPRDARVVRELLRSMGLGEGEYEPRVVHQFLDLAYRYVGDVLGDAQVYADHAGKAQIDADDVSLAIQAKVNFSFSQPPPREVLLELARSRNRIPLPKSIAPPGSIPLPPEQDTLLAQNYQLLPPLKPPPQYEETEDENEESNPSLTPNPANSNPTFSQDQRNNEQQHTPQHGQRVSFQLNAVAAAAAKRPRMTIDQLNMG

SEQ ID NO: 6573 - DNA, 1593 bp, Sorghum bicolor
  misc_feature: Ceres ANNOT ID no. 6067557
  misc_feature: Encodes the peptide sequence at SEQ ID NO 6574
atgaagcccatgagctgccacgagcaagagcacccggagctcgccgccaccacgaccaacagcagcgccttcgactggcttgaggattccatctccttcctcaccgcagatgtcgacatcgccgccggctacgggtggtggtccgatcccgcggcggtgcagcaagatgatattggcagcgtcgtggcgcagacgctttcgcccccggcgccgctgctgacgactaccagtaccagtccgcccctggcgcacacctcgccaagcattgcgtcaccggccgtgtcgtcgccgtcggagccttcttcgaccaagaagcgcaagtccccggctcacagggcgtccgcccacagtggcagcaaccagcgccgccgcgctgaccaggacaggccagcacgtgccggtggcggcggcggcagcaagaagggcggctccaagggcgggggagcgggatccgaccgggacacgcggtgggcggagcagctcctgaacccgtgcgcggcggccgtcgaggccagcaacctgtcgcgcgtgcagcacctgttctacgtgctcggcgagctcgcctccttctccggcgacgccaccaccggctggctccccgccgccgtcggcccggcggccgcggcgaccgtgcgtgtgccgccctgcgagtgcccgacgccggcgttcgcgggcgcggagccccggctgttccgcgcgtcgctcatcaggttccacgaggtgagcccgtggttcgcgctcccgaacgcgctcgccaacgcggccatcgcgcaggccgcgtcgcgcggcggccccgcggcggagccccggccgctccacgtcgtcgacctcggcgtctcgcacggcgtgcagtggccgacgctgctggagtcgctgaccaggcagcccggcgggcgcgcgccgccctccgtccgcctcaccgtcgcgggcgccgcggccacaccgccggcgcccttctcggcgtcgcctccggggtacgacttctcgccgcacctcatccggtacgccaagtccatcaacctgcagctcgccgtcagccgcgcggcgtccctggactccgtgcagcatgggttcgcctccccgccgggcggtggggaggccctcgtcgtgtgtctccagttccggctgggccacgccagcgccgacgagcggacagagatcctaaggaaggtgcgaggcctcaacccggagctggtggtggtctcggagctcgacggcggcggtgacggcaccgcggcgggcgagttcacggcgaggctggagctgctgtggcggttcctggagtcgacgtccgcggcgttcaaggggagggacggggacgagaggcgcctgctggaggccgaggcggggacgtccgtcgcgtcggaggcggcgggagcagggaaggaggcgtggcgggagcgcatggcggcggccgggttcgaggagtccgcgttcggcgacgaggcggtggagtcggccaagtcgctgctgaggaagtacgacggcggctgggagatgtcggcgtcgggtgcggccggcgcggtggcgctgcggtggaaggggcagccggtgtcgttctgctcgctgtggcggccggcgtgcagcggctga

SEQ ID NO: 6574 - protein, 530 aa, Sorghum bicolor
  misc_feature: Ceres ANNOT ID no. 6067557
  misc_feature (132)..(443): Pfam Id: GRAS Pfam Desc: GRAS family transcription factor
  misc_feature (17)..(525): NCBI GI: 66947640 NCBI Desc: nodulation signaling pathway 1 protein homologue 1 [populus trichocarpa]
  misc_feature (54)..(525): NCBI GI: 117518689 NCBI Desc: nodulation signaling pathway 1 protein [lotus japonicus]
  misc_feature (66)..(525): NCBI GI: 66947642 NCBI Desc: nodulation signaling pathway 1 protein homologue 2 [populus trichocarpa]
  misc_feature (17)..(513): NCBI GI: 117518700 NCBI Desc: truncated nodulation signaling pathway 1 protein [lotus japonicus]
  misc_feature (43)..(525): NCBI GI: 116006458 NCBI Desc: nodulation signaling pathway 1-like protein [nicotiana benthamiana]
MKPMSCHEQEHPELAATTTNSSAFDWLEDSISFLTADVDIAAGYGWWSDPAAVQQDDIGSVVAQTLSPPAPLLTTTSTSPPLAHTSPSIASPAVSSPSEPSSTKKRKSPAHRASAHSGSNQRRRADQDRPARAGGGGGSKKGGSKGGGAGSDRDTRWAEQLLNPCAAAVEASNLSRVQHLFYVLGELASFSGDATTGWLPAAVGPAAAATVRVPPCECPTPAFAGAEPRLFRASLIRFHEVSPWFALPNALANAAIAQAASRGGPAAEPRPLHVVDLGVSHGVQWPTLLESLTRQPGGRAPPSVRLTVAGAAATPPAPFSASPPGYDFSPHLIRYAKSINLQLAVSRAASLDSVQHGFASPPGGGEALVVCLQFRLGHASADERTEILRKVRGLNPELVVVSELDGGGDGTAAGEFTARLELLWRFLESTSAAFKGRDGDERRLLEAEAGTSVASEAAGAGKEAWRERMAAAGFEESAFGDEAVESAKSLLRKYDGGWEMSASGAAGAVALRWKGQPVSFCSLWRPACSG

SEQ ID NO: 6575 - DNA, 930 bp, Sorghum bicolor
  misc_feature: Ceres ANNOT ID no. 6067558
  misc_feature: Encodes the peptide sequence at SEQ ID NO 6576
atggccctcaggaccctgcaccttccatccaaactggcaaggccaaacagccacagcttcagtccatcgtcctcgcctcctcaccagccaaagcttcctccaggacccggcccacaacaacaaacaagagttgccactgccacgaagcagcagcagcagcagctctgtaagaggagtacaccgttgctgaaggtgaaatgcagggccaatctgcacgactgcatggacgacgagattgttgacactccgaaagaccagaccaccgagatccccatcgtcgcgtacccatcggtcgtcttcccgggcgccacgctccagctgcaggcgttcgagttcaggcaccgcatcatgatgcacaccctgctccagcagggcctcaggttcggggtcctctgctcggcgggcaagaccgggaccgggaggatggcggacgtggggtgcgtcgtccacgtcgtcgagtgcgagaggctcaccgacgaccgcttcttcctcacctgcgtcggcaaagaccgcttccgggtcatcgacatcgtcaggacgaagccctacgttgttgcaaggatccaggtgctgctgagtgaccgccaccactctgtgccactgccacagggtgacttgggtagcctgatgcagcaggtggaacagcaagtcaagaatgtggccatgctctcggagaagctgaacaggaaaccgttgccgtatcgtcagggcgatcagctccacaggctgcataccgctgcctcgctctcgttcctcgtcgcacgcttgttcatcgatgatcgcctggagcagcagacgctgctgcagatggacgacaccgggcagcggctggtgcgggaggggatgtacctggagcgcaggagcaagtacctggcggccatagcagcgatcaaggacgcctttcagcacttgtcctgcaacgagatgtag

SEQ ID NO: 6576 - protein, 309 aa, Sorghum bicolor
  misc_feature: Ceres ANNOT ID no. 6067558
  misc_feature (89)..(286): Pfam Id: LON Pfam Desc: ATP-dependent protease La (LON) domain
  misc_feature (8)..(301): NCBI GI: 18700087 NCBI Desc: at1g75460/f1b16_22 [arabidopsis thaliana]
  misc_feature (89)..(303): NCBI GI: 119510870 NCBI Desc: peptidase s16, lon [nodularia spumigena ccy9414]
  misc_feature (89)..(305): NCBI GI: 86607988 NCBI Desc: atp-dependent protease la domain protein [cyanobacteria bacterium yellowstone b-prime]
  misc_feature (89)..(303): NCBI GI: 119485458 NCBI Desc: peptidase s16, lon [lyngbya sp. pcc 8106]
  misc_feature (89)..(301): NCBI GI: 75907508 NCBI Desc: peptidase s16, lon [anabaena variabilis atcc 29413]
MALRTLHLPSKLARPNSHSFSPSSSPPHQPKLPPGPGPQQQTRVATATKQQQQQLCKRSTPLLKVKCRANLHDCMDDEIVDTPKDQTTEIPIVAYPSVVFPGATLQLQAFEFRHRIMMHTLLQQGLRFGVLCSAGKTGTGRMADVGCVVHVVECERLTDDRFFLTCVGKDRFRVIDIVRTKPYVVARIQVLLSDRHHSVPLPQGDLGSLMQQVEQQVKNVAMLSEKLNRKPLPYRQGDQLHRLHTAASLSFLVARLFIDDRLEQQTLLQMDDTGQRLVREGMYLERRSKYLAAIAAIKDAFQHLSCNEM

SEQ ID NO: 6577 - DNA, 2373 bp, Sorghum bicolor
  misc_feature: Ceres ANNOT ID no. 6067565
  misc_feature: Encodes the peptide sequence at SEQ ID NO 6578
atggctgctcctcaaccaaagaagaggactattgtggaaagtggagatggaggtctcggtttgggccttgctacatttattgcaaatggtgaggatttgggtcccatcattcgtcactcgtttgattctgggaaacctgaggcgctcatgcagaaccttagaagcattgtgaagaagaaggaggttgagattgaagagctatgcagacttcactatgaggatttcatcgttgctgtcgacgaactacgtggtgtgttagtcgatgccgatgagttaaagggcatgctatctggtgagaattcacacctgcaagaggcttctactgaccaactgctgaagcttgacgaacttcttgagctatattctgtcaagaaaaacataggggaggctataacaacgctgaagatatgtgtcaaggtcttcagcttgtgcatgacatgcaacaattatattgccgaagctaagtttcatcctgcacttaagacactggacctgattcagaaaggctacctgcgaaatattcctttgaagcttcttaagaaggtggtggcgagacagataccattgataaagctgcacatagagaagaaagtctgcagtgagttcaatgattggcttgttcatattagaaggatggccaagcagattggccaggcctccataagccaggcatcattagctcgccaaaaggatgaggaaatgcgtgcacgacagagggaagctgaagggcatagccatgctggacccgatgagcatctgtataccttggacctggagaacacagaagaggaatcagcactacattttgatctgacaccagtttatcgggcgcatcacatgcacacatgtcttggtattggggagaagttcagagactattactataagaacaggctcatgcaacttaacttggacatgcaaatttccacctcacagcccttcttggagtcccatcaaccgttccttgcacaggtagctggattttttatagttgaagaacgtgttcttcgaactgcagatggattgttgttggagagtcaagtggaaacaacatgggagacagccattggcaagataacatctatactggaggaacagttctctcgcatgcgtacagccagccacttccttctcataaaagattatgtcactcttctaggcgcagctgtgaacaagtacggttatcgaatcacacagttgattgaagttcttgagaaaactagggacaaataccaccagttgcttcttcttgaatgtcggaagcaggtagacgacatccttactaatgactcatatgagcagatggttataaagaaggaatatgagtataacatgaatgtgacagcatttcatctggaacatgatgatgcaatccctgatttcccatatgtgacatcattctcctcttctgttccagatgtttgtcgcattgtccggtccttcatcgaggattctgttagctacttgtcatacggtggtgtcatgaacatctttgatgtggtgaaagcattcctagacaggttgctgattgaggtactgaatgacagtcttttgaacatgatatatgctcgttcgctgggcatgtcacagatgatgcaacttgctggaaatatatcagttcttgagcaagcatgtggtatgtttctgttgcactctgctcaactgtgcggcattccaaagcgtgttgctgagaggtcccattctggtttgactgctcgagcagtcctgaaagcctcacaaaatgcagtgtataatgcactaataaacctgaccaatttcaaggttgatgagttcatggtgctcctggaagaggtcaactggatagcagaagaagccccagacaattcaaatgaatacgtgaatgaggttctgatctatcttgaaacattagtatcgacagcacagcagattctacctttggaagctctatacaaggtggtttctggtgcaatgagccacatctcagactctataatgaccacacttctaaatgatggtgtgaaaagattcactgtcaatgcagttttaggaattgatattgacttgaagatgctggaagcatttgcagatgagaaatttgacagcacggggctgtcagatttggggaaggaaacaactttcagagattgtttagttgaaattaggcagctcgtaaatctcctgctcagtagccagcctgagaattttatgaatccagtgatcaggcagagaaactacggatcactggactacaagaagctgtccatcatttgtgacaagtacaaggatactgcagacagtctgtttggaagcctttcaaaccgtaatacccagcagagcgcccgtaagaaatctatggacgttttgaagagaaggcttaaggattttagctaa

SEQ ID NO: 6578 - protein, 790 aa, Sorghum bicolor
  misc_feature: Ceres ANNOT ID no. 6067565
  misc_feature (442)..(791): Pfam Id: Sec15 Pfam Desc: Exocyst complex subunit Sec15-like
  misc_feature (23)..(790): NCBI GI: 21104839 NCBI Desc: sec15 (s. cerevisiae)-like protein [oryza sativa (japonica cultivar-group)]
  misc_feature (324)..(790): NCBI GI: 7268995 NCBI Desc: at4g02350 [arabidopsis thaliana]
  misc_feature (33)..(787): NCBI GI: 24418668 NCBI Desc: exocyst complex component sec15a
  misc_feature (50)..(787): NCBI GI: 119570470 NCBI Desc: exocyst complex component 6, isoform cra_d [homo sapiens]
  misc_feature (50)..(787): NCBI GI: 20071540 NCBI Desc: sec15 homolog [mus musculus]
MAAPQPKKRTIVESGDGGLGLGLATFIANGEDLGPIIRHSFDSGKPEALMQNLRSIVKKKEVEIEELCRLHYEDFIVAVDELRGVLVDADELKGMLSGENSHLQEASTDQLLKLDELLELYSVKKNIGEAITTLKICVKVFSLCMTCNNYIAEAKFHPALKTLDLIQKGYLRNIPLKLLKKVVARQIPLIKLHIEKKVCSEFNDWLVHIRRMAKQIGQASISQASLARQKDEEMRARQREAEGHSHAGPDEHLYTLDLENTEEESALHFDLTPVYRAHHMHTCLGIGEKFRDYYYKNRLMQLNLDMQISTSQPFLESHQPFLAQVAGFFIVEERVLRTADGLLLESQVETTWETAIGKITSILEEQFSRMRTASHFLLIKDYVTLLGAAVNKYGYRITQLIEVLEKTRDKYHQLLLLECRKQVDDILTNDSYEQMVIKKEYEYNMNVTAFHLEHDDAIPDFPYVTSFSSSVPDVCRIVRSFIEDSVSYLSYGGVMNIFDVVKAFLDRLLIEVLNDSLLNMIYARSLGMSQMMQLAGNISVLEQACGMFLLHSAQLCGIPKRVAERSHSGLTARAVLKASQNAVYNALINLTNFKVDEFMVLLEEVNWIAEEAPDNSNEYVNEVLIYLETLVSTAQQILPLEALYKVVSGAMSHISDSIMTTLLNDGVKRFTVNAVLGIDIDLKMLEAFADEKFDSTGLSDLGKETTFRDCLVEIRQLVNLLLSSQPENFMNPVIRQRNYGSLDYKKLSIICDKYKDTADSLFGSLSNRNTQQSARKKSMDVLKRRLKDFS

SEQ ID NO: 6579 - DNA, 948 bp, Sorghum bicolor
  misc_feature: Ceres ANNOT ID no. 6067572
  misc_feature: Encodes the peptide sequence at SEQ ID NO 6580
atgcttctgcgagaaatggatggtgatccattccatcccatgcccaactatgatttcctgtctgggaatggctattcattaaagcagttagttcgtagcaactctgatatagactcttcatcatccaaatctgagcagtctcggcaagacttatctgacagtagtctcaatggacaacgcacaccaacacaatctggtttgttctccctctcagataacaacgatatttgtggaaagcgggaccagggcatggtgaagtctttgttgtcctttggtagcccggaagctgccttttcccctcacaagtttgactacagccagtctttcgcttgtgcttcttatactgctgatccatatcacggtggggtgttggcaggatacacttcaaatggaagtgttcatccccaaattaatggtgcagcaaacactagggtaccattgcctgttgggcctgcagcagaggaacccatatttgtcaatgcaaagcaatacaatgctatcctccggaggaggcaaatacgcgcaaaattggaggctcaaaataaactggtgaaaggtcggaagccatatctccatgaatctcggcatcgtcatgcaatgaagcgagtccgcggaccaggaggccgtttcctcaacaaaaaggagctccaggagcagcagcagcagcagcagaaggctctgccttcacttcagactccaacaggcagagtcagcatcagcaaaatggccttcggcagggacctgtgcactgaaagcagcacatctcactcgccttcgacaagctctgggatctcaagtgtttcaaacgggagtggcatgctggctcatcaagagcacatcagctttgcatctgctaacttcctccccagcatgaacttccgcgtggagaacggaggtgaaaagatggctgtcaatggcgtccgccaccacacccctgtcgtgaggtga

SEQ ID NO: 6580 - protein, 315 aa, Sorghum bicolor
  misc_feature: Ceres ANNOT ID no. 6067572
  misc_feature (154)..(210): Pfam Id: CBFB_NFYA Pfam Desc: CCAAT-binding transcription factor (CBF-B/NF-YA) subunitB
  misc_feature (1)..(315): NCBI GI: 115473283 NCBI Desc: os07g0608200 [oryza sativa (japonica cultivar-group)]
  misc_feature (23)..(218): NCBI GI: 45861201 NCBI Desc: ccaat-box transcription factor complex whap3 [triticum aestivum]
  misc_feature (23)..(218): NCBI GI: 45861211 NCBI Desc: ccaat-box transcription factor complex whap8 [triticum aestivum]
  misc_feature (23)..(218): NCBI GI: 45861203 NCBI Desc: ccaat-box transcription factor complex whap4 [triticum aestivum]
  misc_feature (23)..(218): NCBI GI: 45861207 NCBI Desc: ccaat-box transcription factor complex whap6 [triticum aestivum]
  misc_feature: The sequence is a functional homolog of SEQ ID NO 1263 in the 10/374,780US patent application
  misc_feature: The sequence is a functional homolog of SEQ ID NO 1338 in the 11/479,226US patent application
  misc_feature: The sequence is a functional homolog of SEQ ID NO 2460 in the 10/374,780US patent application
  misc_feature: The sequence is a functional homolog of SEQ ID NO 622 in the 10/412,699US patent application
  misc_feature: The sequence is a functional homolog of SEQ ID NO 626 in the 10/412,699US patent application
  misc_feature: The sequence is a functional homolog of SEQ ID NO 952 in the 10/225,066US patent application
  misc_feature: Useful for making plants with modulated growth and phenotype characteristics
  misc_feature: The sequence is a functional homolog of SEQ ID NO 622 in the 20040045049 US patent application
  misc_feature: The sequence is a functional homolog of SEQ ID NO 626 in the 20040045049 US patent application
  misc_feature: The sequence is a functional homolog of SEQ ID NO 1263 in the 20060162006 US patent application
  misc_feature: The sequence is a functional homolog of SEQ ID NO 2852 in the 10/374,780 US patent application
  misc_feature: The sequence is a functional homolog of SEQ ID NO 696 in the 10/225,066 US patent application
MLLREMDGDPFHPMPNYDFLSGNGYSLKQLVRSNSDIDSSSSKSEQSRQDLSDSSLNGQRTPTQSGLFSLSDNNDICGKRDQGMVKSLLSFGSPEAAFSPHKFDYSQSFACASYTADPYHGGVLAGYTSNGSVHPQINGAANTRVPLPVGPAAEEPIFVNAKQYNAILRRRQIRAKLEAQNKLVKGRKPYLHESRHRHAMKRVRGPGGRFLNKKELQEQQQQQQKALPSLQTPTGRVSISKMAFGRDLCTESSTSHSPSTSSGISSVSNGSGMLAHQEHISFASANFLPSMNFRVENGGEKMAVNGVRHHTPVVR

SEQ ID NO: 6581 - DNA, 2532 bp, Sorghum bicolor
  misc_feature: Ceres ANNOT ID no. 6067573
  misc_feature: Encodes the peptide sequence at SEQ ID NO 6582
atggattccacagctcttcaatatgaaaaccaaaagttggtgcaacaactggaggcacagaagtctgaaatgtatgcattggagcgcaagttcaaggagctgagagatgagcaatgttcttatgacaagactctgatttctttgaataaactgtggaatcagctgattgatgatttggttctgcttggagtacgggctggtggggatttggataatttgcaagcacttgaccatgaagagttatcagaagaatctttggaatcatgtccttcggaggagatatttctcttaaggctcttgaagtcaagcaacatcagagataatagtgacactagcttgttggaatttgttgaagaagctcttgcttttcggtgttcagcaactattactctgatgaagtccctgcaagagactatttcttcacagcaagctaaaagtgaacttttgtctttagctttgaatgcacagaagtcaaatgaagatgttattgttgcccttcaaaatcataatgattgcttgaaagaggttgctgagaatgcgagtcaagctatctctattatcaacgagaagcacaaaaggtatcttgatgagattgaggcttttaaaagcaaccattcaagtgagctacaggaaatcaagcgtatttcaggtgagctagaggaaagcactgcagagcttgaggaaagtcgaaggaagttggttgtgctccagttgcagaggcatggttctgtaatggatgcatctggggcaaatgctgtgaatggtggtatttctactcataaatcttcagataaaagtatgagctggcaagacctcaaagatgctgttgatgcagctaagaccctcgcaggaaaccgtctattggaacttcatcagactcaagaggataatctgatactatccaaggagctgggagatcttgaggggcaattgagagatgagaagtatgtcttggtatccaaaccgtacatgattcttaatgataaactacagcatttgaatgctgagatagatcgttatagagggttggttgaagttttacagaatgacaaggaccagctcatgcaaagggagaaagaaatttgtgcaaaatcagaatcagtcgatggtattaaacaaacaattaccacatatgagaccaaaattgaagaactggaaactcaaattcagatactcttttctgaaaagaatgatcttgaaaccaaggttgaggagactttgcaagattcaggtaagaaagacttcaaggatgagattcatgttatggccgcagcactctccaatgaactgggtatgatggagaatcagttgagtcgatcaaaggatgcagcttctgaagcacttgcattgcgtgagcaagcagaatcattaagatcattggtagctaaaaagattgaggaacacaagaagatatccgataaatacaactcacaagtaattgagatcaagtccctcaaggcattggtcgaggagttggagcaggaaaagcaggagctggagtttattgcagatatgtacgctaaagaaagttccttgtcaaggacacttgctgatattgaagaatcagaaacccgagctcgcaatcaagctgaatatttgaggagcaatctagaggagcatagtcttgagcttcgggttaaagcagcaaatgaagctgaagctgcatgccagcaaaggctttcctttgctgaagtggaactagaagagttaaggaccaaagtagatgcatcggaaagagatgttgtggaacttaaggaggcaataagaataaaagaggctgaaggagatgcctatatttccgatattgagacaattggtcaagcatatgaagacatgcaaacacaaaatcagcatcttcttcaacagcttactgatagagatgactttaacataaagctagtatcagatagtgtgaagatgaaacaagcttgtagttcccttctctctgacaagcttatgctagagaagcaactccagcaagttaacacttcactggagtcatctaaactgaaaattgcccgtggtgaagagcagatgaacacttgtgtagcacaagctataaaaacttcagctgaaaacaggcatcttactattagcctggaaaggattgcggtggaggtatctaacacagataaggaactcaagtggcttcggtcctctgttggatcctctgagaaagaatatgagcaaactcagcaaaagatatctgagctgagagcgttgctggagcatgagaggaatgagaggcggcggcttgaagaacaatatgaagaggtgaaaaatgaagttatggagctgacctctgagactgaagagattactatccagaaacttcaggatgaaataaaagaatgcaaggctattctcaagtgtggtgtctgctttgaccggcctaaagaggttgtgatcaccaaatgtttccacctattctgctcgccatgcattcagaggaaccttgagattcgccaccggaaatgtcctggctgtggaaccccattcggacaaaatgacgttagggaggtgaagatatga

SEQ ID NO: 6582 - protein, 843 aa, Sorghum bicolor
  misc_feature: Ceres ANNOT ID no. 6067573
  misc_feature (791)..(829): Pfam Id: zf-C3HC4 Pfam Desc: Zinc finger, C3HC4 type (RING finger)
  misc_feature (464)..(843): NCBI GI: 18405292 NCBI Desc: zinc finger (c3hc4-type ring finger) family protein [arabidopsis thaliana]
  misc_feature (308)..(841): NCBI GI: 144923791 NCBI Desc: zinc finger, dksa/trar c4-type; zinc finger, ring-type; protein kinase pkn/prk1, effector [medicago truncatula]
  misc_feature (1)..(843): NCBI GI: 119579359 NCBI Desc: ring finger protein 20, isoform cra_a [homo sapiens]
  misc_feature (1)..(464): NCBI GI: 115459778 NCBI Desc: os04g0550400 [oryza sativa (japonica cultivar-group)]
  misc_feature (459)..(843): NCBI GI: 119572583 NCBI Desc: ring finger protein 40, isoform cra_b [homo sapiens]
MDSTALQYENQKLVQQLEAQKSEMYALERKFKELRDEQCSYDKTLISLNKLWNQLIDDLVLLGVRAGGDLDNLQALDHEELSEESLESCPSEEIFLLRLLKSSNIRDNSDTSLLEFVEEALAFRCSATITLMKSLQETISSQQAKSELLSLALNAQKSNEDVIVALQNHNDCLKEVAENASQAISIINEKHKRYLDEIEAFKSNHSSELQEIKRISGELEESTAELEESRRKLVVLQLQRHGSVMDASGANAVNGGISTHKSSDKSMSWQDLKDAVDAAKTLAGNRLLELHQTQEDNLILSKELGDLEGQLRDEKYVLVSKPYMILNDKLQHLNAEIDRYRGLVEVLQNDKDQLMQREKEICAKSESVDGIKQTITTYETKIEELETQIQILFSEKNDLETKVEETLQDSGKKDFKDEIHVMAAALSNELGMMENQLSRSKDAASEALALREQAESLRSLVAKKIEEHKKISDKYNSQVIEIKSLKALVEELEQEKQELEFIADMYAKESSLSRTLADIEESETRARNQAEYLRSNLEEHSLELRVKAANEAEAACQQRLSFAEVELEELRTKVDASERDVVELKEAIRIKEAEGDAYISDIETIGQAYEDMQTQNQHLLQQLTDRDDFNIKLVSDSVKMKQACSSLLSDKLMLEKQLQQVNTSLESSKLKIARGEEQMNTCVAQAIKTSAENRHLTISLERIAVEVSNTDKELKWLRSSVGSSEKEYEQTQQKISELRALLEHERNERRRLEEQYEEVKNEVMELTSETEEITIQKLQDEIKECKAILKCGVCFDRPKEVVITKCFHLFCSPCIQRNLEIRHRKCPGCGTPFGQNDVREVKI

SEQ ID NO: 6583 - DNA, 1665 bp, Sorghum bicolor
  misc_feature: Ceres ANNOT ID no. 6067587
  misc_feature: Encodes the peptide sequence at SEQ ID NO 6584
atgggatgccgagtgatcgcccagggatacaaggttctggacgaggaacgtcacgccgtggactaccggcctagtgtctggggtgattacttcattaagaaccctacactaccacatacttatgagaagtcggtggaatggatgaaagagagacgtgatgtgctaatcaacgaagcaaagaacaccttgaccggcaagcacgatgatggtcccttggctgaaatgaagctagtcgatgcagttcagcgtctcggaattgcttaccatttccaggacgagatccatgcgtcgctgcaaaagctcaagtccatggagttccgcaatgaaagcttccatgaaatatccctccaattctggttattaagacaagaccggtactacgtgtcttgtgatgtattccaaagtttcatggacaaccaacagaacctaaatgtcagcttgcaaagtgatgtgcgagcattgcttgcactctatgaggcagcacatctaggcactccaaatgaacaatttctcattgaagctcaaaggcaaactactagtcttctaagatccatggttgaccatcttgaaaaaccactagcagataaagtacgacatgctcttcaaacaccgtcttttcgaaggatgaagagattggaggcaagactatatatccctctatatgaagaggataaagaggattgtgatgaattgatacttgaattggcaaaattagatttttatttgctccagcaaattcaccgtgaggaagtcaaggaaatatgcgagtggtaccatggtttggactccccacggaaattattctacgcaagacataggccagcagaagcctatttttgggcattaggagtatactatgaaccacaatatgccaaggctagaaagttactagcgaagtttatagcaacaattacaccatatgatgacacttttgacaattatggcatgtgggaagagctacagccattcgctgatgtgatgcagaggtgggacatgaaggaagccgagggactcaatgaatgctacagtgactttgctcgctttatgttcggtactatgattgaaatcgagaatgcacttccaaaggacataggaagaaggaatgtcaactttatccgagatattatcaatgaagtatgcaaaggctatgtgactgaaattggctggagagacagcaagtacattcctcttttagaggagcatctgaaggtcacactcattacatgcttctactgggcgattaattgcacagcttttgttgtctttgaagagaatgttacagaagaaattctgaagtggatgtcaaaatttccacaaattgtcaaggattcatgtattatatctcggctcatggatgacattgttgcccatgagtttgaaacagagagaaacaatgttgctacagctgtaacttgctacatgaatgagtataagacaacaaaggaagaagcaagtgatgtgctgtggaactcagtagagcatgcatggaagagtatgaatcatgagtacctcacctggacttcattgccatcatcgttgcttattcgtgtaatcaaccttgcacgaatgatggagacaatgtacaaggagatagacggatacacggattcaaagttactgaaagagtggatatccaaactgcttgatgaaccgattcccttctag

SEQ ID NO: 6584 - protein, 554 aa, Sorghum bicolor
  misc_feature: Ceres ANNOT ID no. 6067587
  misc_feature (231)..(500): Pfam Id: Terpene_synth_C Pfam Desc: Terpene synthase family, metal binding domain
  misc_feature (27)..(225): Pfam Id: Terpene_synth Pfam Desc: Terpene synthase, N-terminal domain
  misc_feature (17)..(554): NCBI GI: 4733937 NCBI Desc: sesquiterpene synthase [elaeis oleifera]
  misc_feature (17)..(553): NCBI GI: 45478053 NCBI Desc: terpene synthase [vitis vinifera]
  misc_feature (17)..(553): NCBI GI: 41058926 NCBI Desc: (-)-germacrene d synthase [populus balsamifera subsp. trichocarpa x populus deltoides]
  misc_feature (17)..(554): NCBI GI: 33316389 NCBI Desc: valencene synthase [citrus sinensis]
  misc_feature (14)..(552): NCBI GI: 2879841 NCBI Desc: (+)-delta-cadinene synthase [gossypium arboreum]
MGCRVIAQGYKVLDEERHAVDYRPSVWGDYFIKNPTLPHTYEKSVEWMKERRDVLINEAKNTLTGKHDDGPLAEMKLVDAVQRLGIAYHFQDEIHASLQKLKSMEFRNESFHEISLQFWLLRQDRYYVSCDVFQSFMDNQQNLNVSLQSDVRALLALYEAAHLGTPNEQFLIEAQRQTTSLLRSMVDHLEKPLADKVRHALQTPSFRRMKRLEARLYIPLYEEDKEDCDELILELAKLDFYLLQQIHREEVKEICEWYHGLDSPRKLFYARHRPAEAYFWALGVYYEPQYAKARKLLAKFIATITPYDDTFDNYGMWEELQPFADVMQRWDMKEAEGLNECYSDFARFMFGTMIEIENALPKDIGRRNVNFIRDIINEVCKGYVTEIGWRDSKYIPLLEEHLKVTLITCFYWAINCTAFVVFEENVTEEILKWMSKFPQIVKDSCIISRLMDDIVAHEFETERNNVATAVTCYMNEYKTTKEEASDVLWNSVEHAWKSMNHEYLTWTSLPSSLLIRVINLARMMETMYKEIDGYTDSKLLKEWISKLLDEPIPF

SEQ ID NO: 6585 - DNA, 1632 bp, Sorghum bicolor
  misc_feature: Ceres ANNOT ID no. 6067603
  misc_feature: Encodes the peptide sequence at SEQ ID NO 6586
atgcttcgtggggcggggcacgggggcggcgatgcgcggaggcgggcactgcgctcgtcgcggcggcggcttccggggtggatctggtggcttctcgggatcttcctcctcgtcgggctcatgctcttcgtcctgcaccacaaccagaaggagcagttccggccgcccgtcgtggataatggttcagagatcgaggaagtccctcatgagagagtgaatttctcagaagagcttttgagcagcacatcatttgctcgccaattagcggatcagatgactctagcaaaggcatatgtcatccttgcaaaagagcatggtaatcttcagcttgcatgggagcttagttcgcagataaggaattgtcaaagattgctatctgaaggagcagttagtgggagagcaatcactaaagatcaggcccatcctataataagccggctagcacggttaatatacaaggctcaggattctcactatgatatcagcacaacaatagtgacattgaagaaccatgccctggcactagaggagcgtgcaaaggcagcaattgttcaaagtgctgagtttggccagttagcagcagaatcctttcccaaaaatctgcactgtctaactgtgaaactgacagaggagtggcttcggaacccgaagcataggagtcgctcagaggagaaccggaattccacacgattggtggataataatctgtatcatttctgtatattctctgataatgtgctggccacttcagttgttgtcaattctacagtctccaatgcaaatcatcctcaacagcttgtgtttcatgtggtcactgacagaatccattttggcgcaatgtcaacttggttcctcttaaatgacttcaaaggttgtactgttgaagtccgctgcatagatgagttctcgtggttgaattcttcttcatctcctcttgtcaggcagctctctgaggtggaaacccagggttactattactcagctggttccaagaatcctgaaagagagataaaattccataatccaaagtttgtttctctattgaaccatttacggttctacattcctcagatacttcccaacttggagaaggtggtgtttcttgatgatgatgttgtggtgcaaaaggatctgactcagctgttctccatagagttgcatggcaatgtcattggagcagtggaaacttgtttagagtcgtttcatcggtatcacaagtatctaaatttttcgcacccaaccatcagctccaagattgatccacatacttgtggatgggcttttggaatgaacatttttgacttgatagcttggaggaaggaaaacgccacgtcattgtatcattattggcaagagcaaaattctgacctattgctctggagaacaggaactcttcctgcaggtcttttgacattttatggcctgatggagcccctagaccgcagatggcatgtcttgggtcttgggtatgatgtagacatagatgatcgtttgattgagagtgctgctgttgtgcactataatgggaacatgaaaccctggctgaagctggcaattcgccgttacaagtatatatgggagcggtatgtgaatatctcacacccgtatgttagagagtgtatgttgcattag

SEQ ID NO: 6586 - protein, 543 aa, Sorghum bicolor
  misc_feature: Ceres ANNOT ID no. 6067603
  misc_feature (203)..(518): Pfam Id: Glyco_transf_8 Pfam Desc: Glycosyl transferase family 8
  misc_feature (56)..(543): NCBI GI: 90265187 NCBI Desc: h0410g08.13 [oryza sativa (indica cultivar-group)]
  misc_feature (56)..(543): NCBI GI: 38344810 NCBI Desc: osjnba0043l09.30 [oryza sativa (japonica cultivar-group)]
  misc_feature (86)..(542): NCBI GI: 7271113 NCBI Desc: 68 kda protein [cicer arietinum]
  misc_feature (80)..(542): NCBI GI: 52077221 NCBI Desc: glycosyl transferase family 8 protein-like [oryza sativa (japonica cultivar-group)]
  misc_feature (86)..(543): NCBI GI: 86439693 NCBI Desc: glycosyl transferase-like protein [triticum aestivum]
  misc_feature: Useful for making plants with altered cell wall content and/or composition
  misc_feature: GREAT-hit functional homolog of the protein sequence encoded by LOCUS at1g18580
  misc_feature: Useful for making plants with altered carbohydrate content
  misc_feature: Functional homolog of the protein sequence given in SEQ ID NO 13960
  misc_feature: Useful for making plants with altered cell wall content and/or composition
  misc_feature: Functional homolog of the protein sequence given in SEQ ID NO 13961
MLRGAGHGGGDARRRALRSSRRRLPGWIWWLLGIFLLVGLMLFVLHHNQKEQFRPPVVDNGSEIEEVPHERVNFSEELLSSTSFARQLADQMTLAKAYVILAKEHGNLQLAWELSSQIRNCQRLLSEGAVSGRAITKDQAHPIISRLARLIYKAQDSHYDISTTIVTLKNHALALEERAKAAIVQSAEFGQLAAESFPKNLHCLTVKLTEEWLRNPKHRSRSEENRNSTRLVDNNLYHFCIFSDNVLATSVVVNSTVSNANHPQQLVFHVVTDRIHFGAMSTWFLLNDFKGCTVEVRCIDEFSWLNSSSSPLVRQLSEVETQGYYYSAGSKNPEREIKFHNPKFVSLLNHLRFYIPQILPNLEKVVFLDDDVVVQKDLTQLFSIELHGNVIGAVETCLESFHRYHKYLNFSHPTISSKIDPHTCGWAFGMNIFDLIAWRKENATSLYHYWQEQNSDLLLWRTGTLPAGLLTFYGLMEPLDRRWHVLGLGYDVDIDDRLIESAAVVHYNGNMKPWLKLAIRRYKYIWERYVNISHPYVRECMLH

SEQ ID NO: 6587 - DNA, 828 bp, Sorghum bicolor
  misc_feature: Ceres ANNOT ID no. 6067607
  misc_feature: Encodes the peptide sequence at SEQ ID NO 6588
atgggttatgatcagtcgaagtcgattgatggcgatgtgacggccccgatgatgctacacgggcgcgtggccattgtcaccggtggagccggcggcatcggccccgccgtgtcgaagcacctggcgtccctgggtgcgcgcgtagccgtggcgtacatcggcgacccagcgcctgctctggagctggtgagcaccatcaacaagaactcatcgtcgtcggccggcggcggcggggatcagccgcgcgctgttgcggtggcggcggacgtgtcggacgcagcgcaggtgaaggctctcttcgacgcggcggaggcggcgttcggcggcggcggggaggtccacatcctggtgacggcggcggcggtgctggacttctcgtacccggcgctggcggagacgagcgaggcgtcgtacgacgccacgttcggcaccaacgcgcggggcaccttcctgtgctgccgcgaggccgcggcgcgccttgcccgcggcggccgcgggcggatcatcaccttctcctcgtcgggggtcgggtcgctgcgccctggctacgcggcgagcaaggcggcggtggaggtgatgaccaggatcctgacgcgcgagctgcgcggcaccgggatcaccgccaacgcggtggcgccggggtccacgggcacgcccatgttctacaacggcaagacggaggaggaggcggagcggtacatcgccgaggcgccgctgggaaggctcggcatgcccgaggatatcgcgccgctggttggcttcctcgccagcgacgctggccactgggtgaacgcccaggttctgcgctgcaacggtggcaccatctag

SEQ ID NO: 6588 - protein, 275 aa, Sorghum bicolor
  misc_feature: Ceres ANNOT ID no. 6067607
  misc_feature (22)..(202): Pfam Id: adh_short Pfam Desc: short chain dehydrogenase
  misc_feature (23)..(219): Pfam Id: KR Pfam Desc: KR domain
  misc_feature (24)..(265): Pfam Id: Epimerase Pfam Desc: NAD dependent epimerase/dehydratase family
  misc_feature (19)..(275): NCBI GI: 115466800 NCBI Desc: os06g0185100 [oryza sativa (japonica cultivar-group)]
  misc_feature (19)..(275): NCBI GI: 77403673 NCBI Desc: short chain dehydrogenase [solanum tuberosum]
  misc_feature (19)..(273): NCBI GI: 115472775 NCBI Desc: os07g0561500 [oryza sativa (japonica cultivar-group)]
  misc_feature (14)..(275): NCBI GI: 21594913 NCBI Desc: short-chain alcohol dehydrogenase like protein [arabidopsis thaliana]
  misc_feature (16)..(275): NCBI GI: 395223 NCBI Desc: short-chain alcohol dehydrogenase [picea abies]
MGYDQSKSIDGDVTAPMMLHGRVAIVTGGAGGIGPAVSKHLASLGARVAVAYIGDPAPALELVSTINKNSSSSAGGGGDQPRAVAVAADVSDAAQVKALFDAAEAAFGGGGEVHILVTAAAVLDFSYPALAETSEASYDATFGTNARGTFLCCREAAARLARGGRGRIITFSSSGVGSLRPGYAASKAAVEVMTRILTRELRGTGITANAVAPGSTGTPMFYNGKTEEEAERYIAEAPLGRLGMPEDIAPLVGFLASDAGHWVNAQVLRCNGGTI

SEQ ID NO: 6589 - DNA, 834 bp, Sorghum bicolor
  misc_feature: Ceres ANNOT ID no. 6067623
  misc_feature: Encodes the peptide sequence at SEQ ID NO 6590
atggagagtgaaatcatggccccctatgaaaccaagcagaactgcgaaataagggtattcgagagttcagacgagatggcaacagatctggcagagtttatttcacaagcttcagaaatttcagttaaggaaagaggatactttgctattgctctttctggaggaccccttgtcagacatatgcggaagctctgtgaagcaccatacaacaagacccttgattggtctaaatggtacatcttctgggctgaagaacgtgcagtagcaaagaaccatgcagagagtaactacaaattagcaaaggaagaatttatctccaaggtgcctattcctaatggtcatgtctactccatcaacgacaatgcaacggtggaagaggcagcaactgactatgaatttgtcatccggcagctggtcaaggttcagagagttggagtctcaaagatcaacgactgccccaaatttgaccttattcttctgaacattggtcctgacgggcatgtagcctcattgttccccgaccatccagcgcttgaggtgaaaaatgactgggtcacctacatcactgactctccagagcctccacctgagaggattaccttcacccttcctgtgataaactcggcatcaaacatcgccatagttgccaccggagaagacagggcaaacgctgtctctttttccatttctgactgtcaagaaggcccagatgctaaaacaataccggctggaatggttcaaccaactgatgggaagttggtatggtttctggacgaggccgctgcttcatctcttgaagctgcaaatggtgcttacgagcatcaagggtactga

SEQ ID NO: 6590 - protein, 277 aa, Sorghum bicolor
  misc_feature: Ceres ANNOT ID no. 6067623
  misc_feature (69)..(277): NCBI GI: 115473239 NCBI Desc: os07g0604000 [oryza sativa (japonica cultivar-group)]
  misc_feature (12)..(266): NCBI GI: 108937162 NCBI Desc: 6-phosphogluconolactonase [mangifera indica]
  misc_feature (10)..(265): NCBI GI: 21554291 NCBI Desc: 6-phosphogluconolactonase-like protein [arabidopsis thaliana]
  misc_feature (10)..(265): NCBI GI: 10177901 NCBI Desc: 6-phosphogluconolactonase-like protein [arabidopsis thaliana]
  misc_feature (18)..(265): NCBI GI: 21536675 NCBI Desc: 6-phosphogluconolactonase-like protein [arabidopsis thaliana]
MESEIMAPYETKQNCEIRVFESSDEMATDLAEFISQASEISVKERGYFAIALSGGPLVRHMRKLCEAPYNKTLDWSKWYIFWAEERAVAKNHAESNYKLAKEEFISKVPIPNGHVYSINDNATVEEAATDYEFVIRQLVKVQRVGVSKINDCPKFDLILLNIGPDGHVASLFPDHPALEVKNDWVTYITDSPEPPPERITFTLPVINSASNIAIVATGEDRANAVSFSISDCQEGPDAKTIPAGMVQPTDGKLVWFLDEAAASSLEAANGAYEHQGY

SEQ ID NO: 6591 - DNA, 2127 bp, Sorghum bicolor
  misc_feature: Ceres ANNOT ID no. 6067627
  misc_feature: Encodes the peptide sequence at SEQ ID NO 6592
atggcggccgtccctgctgcggagaccctcgacgggcacaaggacaggttcgatctcggggtcttcgtaggcgacctcgcgctcgacgaggaagtcaccagtgtgcgctgcttcatcgttgccagtgacgacgagtccctggaggggctgcagcaggagcttgacaactgcaagaatgaccaggaagtcgcaaacattctggccaatggcatcaaactgcgtgagtacacaaaaggcgtcgagaataacatacgccaaattgagctggattctatacaggattacattaaggaaagtgaaaatctagtttctctgcatgatcaaattcgcgattgtgacaatattttgtcacaaatggaaacggttctgactggattccagacagaaattggttccataagttcggagataaaggtccttcaggagaaatctatggacatgggattaaagctgaaaaatcgtaaggctgcagagtctaaactgtcaaaatttgttgaggacataatagtacctccaagaatgattgacataattgttgatggagaggtcaatgatgagtatatgaaaacacttgaaactctaagcaaaaaaatcaaattcattgatgctgatcccatggttaaatcgtccaaggctctaaaagacgttcagcctgaggtcgagagactacgacagaaagctgtctcaaagattttcgagtttgtcatccaaaaattctatgctttgagaaaaccaaagactaatattcagattctacagcagagtgttcttcttaaatacaagtacacgataattttccttaaggaacatgctaaggagatatatgcagaagttcgtgcggcgtatattgataccatgaataaggtgctaagtgcacattttcgggcttacatacaagcgttggagaaactacagatggacatagcaacttccaccgacttgcttggtgttgaaaccagaagtacaggcttcattttctccattggaaaagaacctctgaaaacccgtccttcagtgtttgctctgggtgaacgaataaacattctaaaggaaatcgatcagccagcattgatacctcatatagctgaagcgaagtcacagaaatactcatatgaagttcttttcagaagcttgcagaaacttcttattgacactgccacttcagaatacctgtttaccgatgatttttttggcgaagaatccatattccatgatatatttgcaggaccgattcaagttgtagatgaacacttcaatgctgtactcctgaactgttatgatgcaattggcataatgcttatgatcagaataattcatcagcaccagctcatcatgtttaagcggcgaatcccatgtttggactcttacctagacaaggttaatatgtcactctggcctcgcttcaagatggtgttcgacttgcatttgaacagcttgcgaaatgcaaatattaagactctttgggaggatgatgtccatccacactatgttacaaggagatatgctgaatttacagcttctctagctcatctcaatgttgaacatggggatggtcagcttgatttaaatttggagcgattgcggatggctattgaggacttgcttgttaagttggccaagatgtttgctaaaccgaagttgcaaactatttttctgataaacaactatgatttaacaatttccattttgaaggaagctggaactgagggtggcaaggcacaacaacactttgaggaggtccttaagagcaacatcgcaatatatgtggaagagttgctcctggagcagttcagtagtttgatcaaattcgtcaaatctcgtccagcggatgaaacggctacaagttcggagaaggccagcattgccgaagttgaaccactagtaaaggatttcgcgagccggtacaaggccgcgatcgagctgatgcactatgacgtgatcacatctttcagcaacttcctgtgcgggatggagatcttgagagcgacgctcgcgcagctcctgctatactacaccaggctcaccgagtgtgtcaagaggatcaacggcggctctgccctcaacaaggacctggtgtccatatcctccatcctgttcgaaatcaagaagtattccaggacgttttag

SEQ ID NO: 6592 - protein, 708 aa, Sorghum bicolor
  misc_feature: Ceres ANNOT ID no. 6067627
  misc_feature (87)..(589): Pfam Id: Vps52 Pfam Desc: Vps52 / Sac2 family
  misc_feature (17)..(708): NCBI GI: 28416481 NCBI Desc: at1g71270/f3i17_8 [arabidopsis thaliana]
  misc_feature (94)..(708): NCBI GI: 12323838 NCBI Desc: are1-like protein; 78992-73047 [arabidopsis thaliana]
  misc_feature (17)..(708): NCBI GI: 51243241 NCBI Desc: tpa: are1-like protein [arabidopsis thaliana]
  misc_feature (14)..(708): NCBI GI: 51243243 NCBI Desc: tpa: are1-like protein p2 [arabidopsis thaliana]
  misc_feature (14)..(708): NCBI GI: 12323833 NCBI Desc: are1-like protein; 68800-64545 [arabidopsis thaliana]
MAAVPAAETLDGHKDRFDLGVFVGDLALDEEVTSVRCFIVASDDESLEGLQQELDNCKNDQEVANILANGIKLREYTKGVENNIRQIELDSIQDYIKESENLVSLHDQIRDCDNILSQMETVLTGFQTEIGSISSEIKVLQEKSMDMGLKLKNRKAAESKLSKFVEDIIVPPRMIDIIVDGEVNDEYMKTLETLSKKIKFIDADPMVKSSKALKDVQPEVERLRQKAVSKIFEFVIQKFYALRKPKTNIQILQQSVLLKYKYTIIFLKEHAKEIYAEVRAAYIDTMNKVLSAHFRAYIQALEKLQMDIATSTDLLGVETRSTGFIFSIGKEPLKTRPSVFALGERINILKEIDQPALIPHIAEAKSQKYSYEVLFRSLQKLLIDTATSEYLFTDDFFGEESIFHDIFAGPIQVVDEHFNAVLLNCYDAIGIMLMIRIIHQHQLIMFKRRIPCLDSYLDKVNMSLWPRFKMVFDLHLNSLRNANIKTLWEDDVHPHYVTRRYAEFTASLAHLNVEHGDGQLDLNLERLRMAIEDLLVKLAKMFAKPKLQTIFLINNYDLTISILKEAGTEGGKAQQHFEEVLKSNIAIYVEELLLEQFSSLIKFVKSRPADETATSSEKASIAEVEPLVKDFASRYKAAIELMHYDVITSFSNFLCGMEILRATLAQLLLYYTRLTECVKRINGGSALNKDLVSISSILFEIKKYSRTF

SEQ ID NO: 6593 - DNA, 2556 bp, Sorghum bicolor
  misc_feature: Ceres ANNOT ID no. 6067634
  misc_feature: Encodes the peptide sequence at SEQ ID NO 6594
atggggaagaggagcggcagcaagaggaaggacaagaacaaggtcattctcccgccggagctgccgccggaaatcgacgacgatgaggtggatctcagcgacgaggacatcgcgttctatggtaccgacagcagcaacgtagctcacttccgccacttcgacaagaagtccatcgacaggtatgtcgggagggtcgcaggacgcgacgagggcgaggtcgagcgcctctacgaggagcgccagaagaggaaggccacagagtcctcggggagaccccgcgaggatgatgacgagttggaggtcgaccccgtcgacgcactccccaccaagacgctgcaaggggagctcgtctacaatagagcaaagaaagcaaggtctgaagacaataccggcagtgttaagactaaagctcaagagaatggtgcagatgccaagaaaattattaagaaagatgaaccaaagggaaaatctaaaaacaaaaagggagatgataataaagtgaaaaatattcaatctcaaactgaagttccaaagggacaactacactcaaatgtcctggaggaagtgaaggaggaactttcagctgaggaattattcgaaaaaaagaaggctcaacttgctgagttggggatggctatgcttgaagatcctgagtcaaacattagatctctgaatgatatgctaagtataagcaatgacaaagaccaaaaggttgttaaacttggtctgatgtccttgcttgctgtgtttaaggacattattccaagttatcggattaggcagctgacagaaaaggagctagcagtagaagtttcaaaagaagtgaagaagacaagatattatgagtacacacttattcgctgctacaaggcatacctacagaaactggtatcgttggagaagcagccccagttttatactgtggctgttcgttgcatgtgtgctttattagatactgccccacattttaacttccgtgaaaacctattggctagtgtggtaaaaaatttaagctcctcagacgatgtagcaaggaaaatgtgttgtgaagcaataagatcattatttataaatgaaggaaaacatcgtggtgaggcaacaatagaagcagttaggttgattgcagatcatgtgaagctcaatgattgccagctccatcctgatagcattgatgtcttcctgtctttgagatttgatgaagatattggaaaagatgagactgaggaggaaaaggtgaaaccaaagaagaataaacgttggcaaaaaagtcaggaggttccgaagcaattgccagttaatgataagaagaaaaccagacaggaattgatctcaaaagctagagaggaggttgatgcagatcttagagcagtttccttcagtcttgatccgaaagagagaaaaaggatacaaaaagaaacactttctgctctgtttgaaacttattttcgcattctgaaacatagtgtgaccacttcaaattcaaggaccaaggtgaataatgtctcccctagtggcttgcacccactgctcactccatgcttggcgggcttaggaaaattttcacatttaattgatgtagatttcatgggtgaacttatatcttgcctcaagaagctttctgggtatagcgaccgacaagatgaaattcccaatgataatgcactgtctgtctcagaacgtctgcagtgctgcatagttgcgtttaaagtctggaggagcaaccttgaggcattgaatgtggatctacaggatttcttcgtgcagctttataacctcatactggagtatcggcctgacagggatcacggcgaggtattggctgatgctctgaagacacttctttgggaaggcaaacagcaggatatgctaagagctgctgctttcattaaacgtttggccacgtttgccctctcatttggctctgcagaagcgatagcagcattggtcacactgaagcatctcctccaaaaaaatagcaagtgtcgcaatatgctggaaaatgattctggtggcggttctctgtcttgcttagttgcgaaatacaaccccgaagctacagatccatatctgagtggtgcactcgcttcagtcctttgggagctcagcctcttagagaagcattatgatatctctgtatcctcaatggcttcgaatatcttgagtatggcaaatttgaatcccacgcagaaccccgttccaatcttgaatgtgaaccctcttgaagcatacagagacctgtcaatggaaagggaactattaaaaccagctagcaaatcattgccactaaatctcaaaaagaaacgacgtggcaaggagtttgttgcgctaagcccagatgtacttaagaaggcagattgctcagtggataaacatgagctcgaagagaagttgcagagccatttcgctgtgctaagaagcatctcggagaatgagaggttgaggggcgagctgaaccacacattgtcatccataaacatgtacaaggagtacaagaagcagcagaaaaagaaaaacatgaaatttaagaccgggaggaaaaaggtagcaaaggtttag

SEQ ID NO: 6594 - protein, 851 aa, Sorghum bicolor
  misc_feature: Ceres ANNOT ID no. 6067634
  misc_feature (199)..(292): Pfam Id: NOC3p Pfam Desc: Nucleolar complex-associated protein
  misc_feature (563)..(717): Pfam Id: CBF Pfam Desc: CBF/Mak21 family
  misc_feature (8)..(848): NCBI GI: 145337741 NCBI Desc: binding [arabidopsis thaliana]
  misc_feature (529)..(848): NCBI GI: 44917517 NCBI Desc: at1g79140 [arabidopsis thaliana]
  misc_feature (82)..(607): NCBI GI: 119482287 NCBI Desc: nuclear export protein noc3 [neosartorya fischeri nrrl 181]
  misc_feature (82)..(607): NCBI GI: 28394454 NCBI Desc: noc3p [aspergillus fumigatus]
  misc_feature (120)..(590): NCBI GI: 119404145 NCBI Desc: nuclear export protein noc3 [aspergillus clavatus nrrl 1]
MGKRSGSKRKDKNKVILPPELPPEIDDDEVDLSDEDIAFYGTDSSNVAHFRHFDKKSIDRYVGRVAGRDEGEVERLYEERQKRKATESSGRPREDDDELEVDPVDALPTKTLQGELVYNRAKKARSEDNTGSVKTKAQENGADAKKIIKKDEPKGKSKNKKGDDNKVKNIQSQTEVPKGQLHSNVLEEVKEELSAEELFEKKKAQLAELGMAMLEDPESNIRSLNDMLSISNDKDQKVVKLGLMSLLAVFKDIIPSYRIRQLTEKELAVEVSKEVKKTRYYEYTLIRCYKAYLQKLVSLEKQPQFYTVAVRCMCALLDTAPHFNFRENLLASVVKNLSSSDDVARKMCCEAIRSLFINEGKHRGEATIEAVRLIADHVKLNDCQLHPDSIDVFLSLRFDEDIGKDETEEEKVKPKKNKRWQKSQEVPKQLPVNDKKKTRQELISKAREEVDADLRAVSFSLDPKERKRIQKETLSALFETYFRILKHSVTTSNSRTKVNNVSPSGLHPLLTPCLAGLGKFSHLIDVDFMGELISCLKKLSGYSDRQDEIPNDNALSVSERLQCCIVAFKVWRSNLEALNVDLQDFFVQLYNLILEYRPDRDHGEVLADALKTLLWEGKQQDMLRAAAFIKRLATFALSFGSAEAIAALVTLKHLLQKNSKCRNMLENDSGGGSLSCLVAKYNPEATDPYLSGALASVLWELSLLEKHYDISVSSMASNILSMANLNPTQNPVPILNVNPLEAYRDLSMERELLKPASKSLPLNLKKKRRGKEFVALSPDVLKKADCSVDKHELEEKLQSHFAVLRSISENERLRGELNHTLSSINMYKEYKKQQKKKNMKFKTGRKKVAKV

SEQ ID NO: 6595 - DNA, 1581 bp, Sorghum bicolor
  misc_feature: Ceres ANNOT ID no. 6067636
  misc_feature: Encodes the peptide sequence at SEQ ID NO 6596
atggccaaccagaatccggcgccgttcgtctacctcgacgttgccacggcggccgacgcgcggcgccgcggcatggatcctcaggacctggagcggagcgcgcagggcgtcctcaagttcctctacatgtgccttcccgacacgcccgtgtacgccggcgccgctctgtccgcactccccgccgcctcccacgacgacgccgaggaccgcatcagcgcgctccctttctcgctcctccgcaacatcgtctcccgcctccccgccaaggacgccgcgcgcaccgccgcgctctcccgccgctggcgccccgtctggcgctgcacgccgctcgccttcgccgacgcgcacctcctcccgggggtcctcgagggccaccgcgaccccacgcgcgccgacacgccggcgatcgccgacaccttctcccgcgccatcgccgctcaccccggccccttccgcgccgtccacctcgtctgcggctactacgcggacgccgcgcgccagcggcagctcgcgcgctgggtccagacgttcgtcgccaagggcgtccaggagctcatcctcgtcaaccgcccgtggccgctcgacgtgcctctccccgccacggtcctcggcatcgacacgctcacccgcctctacctgggcctctggaaattcccagacacctccgctctcggacagagtcagagtggcgctggcccggtgttcccgcacctccgcgagctcgtcctctgctcggtggtggtggagagccgcgacattaacttcctcctcgctgggagccctgtcctggagaagtttggcatagtgggaagcagggagaagatgatgcgtctccgcctcgtcggccagcatctccggtgcgcgcagatcctcatttcagctgtggacagtgtcgccgtggtggacaccccgaacctcgagcggctcatcctgtgggaatccctggacttcaacagctcttgcattaggctaaagattggcaaagcccccaagctgcatatacttggatacttgagtcctggaattcacatgctggagatccggaacactgtcatcaatgccgggataaaggcgaccccaagcaccatggttccaggcattaagatcttgggattaaatgtgcgcttcggagtccgtaatgattccaagatgttaccgactttcctcagatgctttcccaatgttgagacactacatattgtgtctagaaaaactgacgaagtcgctggcaagatcaacctcaagttctggcaggaggccggtcccattgaaagcatccagtcctccatcaagatgatgactttccgtgaattccgaatggagcgaagtgagattgcctttctcaagttcttcttccaaagtgccaacgtgctgaagaatgccgtaattgtggggtccaacggaagtttcacatccattcctgaggtgattaacaaagtgaagactctgattcctgaaaatgggcctagtaattcctgcaatgtgctggtctatgaaagttcagatccagatgggggtgcagtctttagtttgcaaaaaggatttgatttttctgctagtgatcctctcaattatcagtga

SEQ ID NO: 6596 - protein, 526 aa, Sorghum bicolor
  misc_feature: Ceres ANNOT ID no. 6067636
  misc_feature (416)..(465): Pfam Id: FBD Pfam Desc: FBD
  misc_feature (69)..(116): Pfam Id: F-box Pfam Desc: F-box domain
  misc_feature (7)..(525): NCBI GI: 38346008 NCBI Desc: osjnba0035o13.10 [oryza sativa (japonica cultivar-group)]
  misc_feature (8)..(522): NCBI GI: 115457296 NCBI Desc: os04g0208500 [oryza sativa (japonica cultivar-group)]
  misc_feature (17)..(522): NCBI GI: 38346009 NCBI Desc: osjnba0035o13.11 [oryza sativa (japonica cultivar-group)]
  misc_feature (12)..(522): NCBI GI: 115457298 NCBI Desc: os04g0208600 [oryza sativa (japonica cultivar-group)]
  misc_feature (24)..(524): NCBI GI: 53793451 NCBI Desc: ribosomal rna apurinic site specific lyase-like [oryza sativa (japonica cultivar-group)]
MANQNPAPFVYLDVATAADARRRGMDPQDLERSAQGVLKFLYMCLPDTPVYAGAALSALPAASHDDAEDRISALPFSLLRNIVSRLPAKDAARTAALSRRWRPVWRCTPLAFADAHLLPGVLEGHRDPTRADTPAIADTFSRAIAAHPGPFRAVHLVCGYYADAARQRQLARWVQTFVAKGVQELILVNRPWPLDVPLPATVLGIDTLTRLYLGLWKFPDTSALGQSQSGAGPVFPHLRELVLCSVVVESRDINFLLAGSPVLEKFGIVGSREKMMRLRLVGQHLRCAQILISAVDSVAVVDTPNLERLILWESLDFNSSCIRLKIGKAPKLHILGYLSPGIHMLEIRNTVINAGIKATPSTMVPGIKILGLNVRFGVRNDSKMLPTFLRCFPNVETLHIVSRKTDEVAGKINLKFWQEAGPIESIQSSIKMMTFREFRMERSEIAFLKFFFQSANVLKNAVIVGSNGSFTSIPEVINKVKTLIPENGPSNSCNVLVYESSDPDGGAVFSLQKGFDFSASDPLNYQ

SEQ ID NO: 6597 - DNA, 1098 bp, Sorghum bicolor
  misc_feature: Ceres ANNOT ID no. 6067637
  misc_feature: Encodes the peptide sequence at SEQ ID NO 6598
atgtctgacgtcacctctgccgactcggcgccgaaccgccgctcgccgccgccgccgtcgccgtcgccgtcgatgccgcgcttccagcagcagccgagcgggcgccagccgcccccgcccggcgccgaccccttcgccttcggcgtcgtcgccttcatcggcatctgcttcgtgctgatttcactctcagccccatcaagtgttttacatcaagttcctgaaggacatgttggggtatactggagaggaggtgctcttctgaagacaatcactcctccagggtttcatctgaagctccctttgatcacccagtatgagccaatacaggtcagagatattccttgtggaacaaaaggtggtgttatgatcagctttgacaagatagaggttgtgaaccgcctccgcaaagagtttgtgcatgaaaccctactcaactatggtgtgcactatgacaagacatggatatatgataaaattcatcatgagattaaccagttctgcagtgctcacagtttgcaacaagtttacattgacatgtttgatcagattgatgaaacaatgaaagaagctattcaaagagactgtacacgctatgctcctggaattgaaatcatcagtgttcgtgttacgaagccgaacatacctggtagtatcagaagaaattttgaacttatggaggaggagcgtaccaaggcactgatcgccattgagaagcaaaaggtagcagagaaggaggcagaaacacagaagaagattgcactgtctgaagcagagaagaacgcacaggtgagcaagatcctgatggagcaaaagctgatggagaaggacagttccaagagacaggagcaaattgataatgaaatgtaccttgcacgtgagaaagcactagcagatgcaaactactacaggatcttgaaggaagcagaggctaataggctcaaactgacacctgagtatcttgagctgaggttcattgaatcaatcgccaataactcaaagattttcttcggtgaaaagattcctagtatgatcatggatcaaaggttgctcaagaattaccttgatgctgttcctaggaaggaccattatgaaatgtag

SEQ ID NO: 6598 - protein, 365 aa, Sorghum bicolor
  misc_feature: Ceres ANNOT ID no. 6067637
  misc_feature (70)..(246): Pfam Id: Band_7 Pfam Desc: SPFH domain / Band 7 family
  misc_feature (65)..(355): NCBI GI: 29028866 NCBI Desc: at2g03510 [arabidopsis thaliana]
  misc_feature (111)..(365): NCBI GI: 115453565 NCBI Desc: os03g0421400 [oryza sativa (japonica cultivar-group)]
  misc_feature (48)..(346): NCBI GI: 62859669 NCBI Desc: loc549473 [xenopus tropicalis]
  misc_feature (48)..(346): NCBI GI: 49522162 NCBI Desc: mgc84282 protein [xenopus laevis]
  misc_feature (48)..(346): NCBI GI: 117938801 NCBI Desc: spfh2 protein [homo sapiens]
MSDVTSADSAPNRRSPPPPSPSPSMPRFQQQPSGRQPPPPGADPFAFGVVAFIGICFVLISLSAPSSVLHQVPEGHVGVYWRGGALLKTITPPGFHLKLPLITQYEPIQVRDIPCGTKGGVMISFDKIEVVNRLRKEFVHETLLNYGVHYDKTWIYDKIHHEINQFCSAHSLQQVYIDMFDQIDETMKEAIQRDCTRYAPGIEIISVRVTKPNIPGSIRRNFELMEEERTKALIAIEKQKVAEKEAETQKKIALSEAEKNAQVSKILMEQKLMEKDSSKRQEQIDNEMYLAREKALADANYYRILKEAEANRLKLTPEYLELRFIESIANNSKIFFGEKIPSMIMDQRLLKNYLDAVPRKDHYEM

SEQ ID NO: 6599 - DNA, 594 bp, Sorghum bicolor
  misc_feature: Ceres ANNOT ID no. 6067640
  misc_feature: Encodes the peptide sequence at SEQ ID NO 6600
atggaggcgtcgtcgtcgtcgttgccgctcgtggccgccgtgctcctcctctcctccacgctcgctgcctcagatttctgcgtgtgccgttcggaccagccgacggcggtgctgcagaaggcgatcgacttcgcgtgcggtccgcagggcggcgccgactgcacgtccatcctgcagggcggcggctgctacaacccaaacaccgtcgccgcgcactgctcctgggccgccaacacctactaccagaacaacaaggccaggggcgccacctgcgacttcggcggcgccgccaccgtctccaccaccgaccccagtttctccgggtgcacattcgcttccagtgccaccagcgctggtgctgggaccgggacggcgggcaccaccaccgcgggcggcgcgacgacgggcacgggcacgggcaccttcagccccggcgtgggcaccagcggcttcaacggcaccgggatgggcggcagcaccctgggacccacgggcaacaccctcgacgccgccgcgccaggcctgctccccggcgccgcctccctcgccgccgccaccgtcctctccttcctggccctgcagctgcaccattga

SEQ ID NO: 6600 - protein, 197 aa, Sorghum bicolor
  misc_feature: Ceres ANNOT ID no. 6067640
  misc_feature (25)..(111): Pfam Id: X8 Pfam Desc: X8 domain
  misc_feature (10)..(193): NCBI GI: 115473199 NCBI Desc: os07g0600700 [oryza sativa (japonica cultivar-group)]
  misc_feature (10)..(193): NCBI GI: 23495810 NCBI Desc: glycosyl hydrolase family 17-like protein [oryza sativa (japonica cultivar-group)]
  misc_feature (10)..(165): NCBI GI: 57899559 NCBI Desc: glycosyl hydrolase family protein 17-like [oryza sativa (japonica cultivar-group)]
  misc_feature (20)..(195): NCBI GI: 33146901 NCBI Desc: beta-1,3-glucanase-like protein [oryza sativa (japonica cultivar-group)]
  misc_feature (10)..(159): NCBI GI: 38603944 NCBI Desc: at2g03505 [arabidopsis thaliana]
MEASSSSLPLVAAVLLLSSTLAASDFCVCRSDQPTAVLQKAIDFACGPQGGADCTSILQGGGCYNPNTVAAHCSWAANTYYQNNKARGATCDFGGAATVSTTDPSFSGCTFASSATSAGAGTGTAGTTTAGGATTGTGTGTFSPGVGTSGFNGTGMGGSTLGPTGNTLDAAAPGLLPGAASLAAATVLSFLALQLHH

SEQ ID NO: 6601 - DNA, 1236 bp, Sorghum bicolor
  misc_feature: Ceres ANNOT ID no. 6067646
  misc_feature: Encodes the peptide sequence at SEQ ID NO 6602
atggcggcggcgcctgctagtgtgcacgcacttcgtgcatgctcgtcatccagctgcagcagaggcgccgtggcagggagatggagcgctgccgcctcatcagccacctcggcgccggtcgacagcagcagcggcggcgtcgccggcggtggggagatgatggtggagtggccggcggcgccgcgggagcaggtggaggccatccggtcgctcaacgggtgggtggcggagaacatgctcccgctgctgacgcccgtggactccgcctggcagccgcacgactacctgccgcgctccacggcggcggcggcggccggcggcggggaggccaacgacaacgacagggcgttcgcggaggagctggccgagctgcgggccgccgcggcgtgcgttcccgacgacgtgctcgtgtgcctggtgggcaacatggtgacggaggaggcgctgcccacgtaccagagcatgttcaaccgcaccgacggcgtcggcgacgacacgggcgccagcgccgtcccctgggcgcgctggattcgcggctggaccgccgaggagaaccgccacggcgacctcctcaaccgctacctctacctcaccggccgcgtcgacatgcgccaggtggagatcaccatccaccacctcctcagcaacggcatggaaatgctgatgcccaagagcccgtaccacagcctcatctacgcgtcgttccaggagcgcgccaccttcatctcgcacggccacacggcgaggctggcggtgaagcacggcgaccgcacgctgtccaagatctgcggcgtggtcgccgccgacgagaggcggcacgaggcggcgtacaccagggccagcgccgagctgttcgacgtggacccggacggcatggtgcgcgcgctggcctacgtcatgctcgggaaggtcaccatgccggggctgctcatgtcggacggcctcggcggcggcggcgacagcctgttcgcgcggttctccgcggtggcgcagcgcgccggcgtgtacacggcgagcgactacggcgacatggtggagcacttcgtgcggcggtggcgggtggcggacctcggggcgggcttgtccggcgagggccgccgcgcgcaggagtacgtgtgcgggctggcgcccaagatccggcggatggaggagctagcgcaccggagggcggcccgtggggagccaggcctggcccggttcagctggatcttcaacagggccgtcgtggtgggctga

SEQ ID NO: 6602 - protein, 411 aa, Sorghum bicolor
  misc_feature: Ceres ANNOT ID no. 6067646
  misc_feature (61)..(408): Pfam Id: FA_desaturase_2 Pfam Desc: Fatty acid desaturase
  misc_feature (62)..(408): NCBI GI: 79387246 NCBI Desc: acyl-[acyl-carrier protein] desaturase [arabidopsis thaliana]
  misc_feature (28)..(410): NCBI GI: 533084 NCBI Desc: delta-9 stearoyl-acyl carrier protein desaturase precursor
  misc_feature (62)..(408): NCBI GI: 34222062 NCBI Desc: at3g02610 [arabidopsis thaliana]
  misc_feature (20)..(408): NCBI GI: 2290400 NCBI Desc: stearoyl-acp desaturase [helianthus annuus]
  misc_feature (61)..(408): NCBI GI: 5726639 NCBI Desc: steroyl-acp desaturase [arachis hypogaea]
  misc_feature (27)..(408): SWISSPROT Homolog: EC 1.14.19.2 Acyl-[acyl-carrier-protein] desaturase, chloroplast precursor
  misc_feature: The sequence is a functional homolog of SEQ ID NO. 338 in the 11/188,298 US application
MAAAPASVHALRACSSSSCSRGAVAGRWSAAASSATSAPVDSSSGGVAGGGEMMVEWPAAPREQVEAIRSLNGWVAENMLPLLTPVDSAWQPHDYLPRSTAAAAAGGGEANDNDRAFAEELAELRAAAACVPDDVLVCLVGNMVTEEALPTYQSMFNRTDGVGDDTGASAVPWARWIRGWTAEENRHGDLLNRYLYLTGRVDMRQVEITIHHLLSNGMEMLMPKSPYHSLIYASFQERATFISHGHTARLAVKHGDRTLSKICGVVAADERRHEAAYTRASAELFDVDPDGMVRALAYVMLGKVTMPGLLMSDGLGGGGDSLFARFSAVAQRAGVYTASDYGDMVEHFVRRWRVADLGAGLSGEGRRAQEYVCGLAPKIRRMEELAHRRAARGEPGLARFSWIFNRAVVVG

SEQ ID NO: 6603 - DNA, 438 bp, Sorghum bicolor
  misc_feature: Ceres ANNOT ID no. 6067653
  misc_feature: Encodes the peptide sequence at SEQ ID NO 6604
atggcggcttccacggcgaggacggtgaaggatgtcaacccccacgagttcgtcaaggcctactccgcccacctcaagcgctccggcaagatggagctacctgagtgggttgacattgtgaagactgcgaggttcaaggagctccctccttatgaccctgactggtactacaccagggctgcatctattgcaaggaagatctacctgaggcaaggcattggtgtgggtggcttccagaagatttatggtggccgccagaggaatggctcccgtccaccacacttctgcaagagcagtggtgccctctcacgcaacatcctgcaacagctgcagaagatgggcatcattgatgtcgatcccaagggtggaaggctcatcacatcccagggaaggcgtgatctggaccaagtggctggaagggttgctgttgaagcttga

SEQ ID NO: 6604 - protein, 145 aa, Sorghum bicolor
  misc_feature: Ceres ANNOT ID no. 6067653
  misc_feature (7)..(146): Pfam Id: Ribosomal_S19e Pfam Desc: Ribosomal protein S19e
  misc_feature (1)..(143): NCBI GI: 730456 NCBI Desc: 40s ribosomal protein s19
  misc_feature (4)..(143): NCBI GI: 92887164 NCBI Desc: ribosomal protein s19e [medicago truncatula]
  misc_feature (7)..(141): NCBI GI: 82623403 NCBI Desc: 40s ribosomal protein s19-like [solanum tuberosum]
  misc_feature (4)..(142): NCBI GI: 34365671 NCBI Desc: at5g61170 [arabidopsis thaliana]
  misc_feature (4)..(145): NCBI GI: 21554401 NCBI Desc: 40s ribosomal protein s19-like [arabidopsis thaliana]
MAASTARTVKDVNPHEFVKAYSAHLKRSGKMELPEWVDIVKTARFKELPPYDPDWYYTRAASIARKIYLRQGIGVGGFQKIYGGRQRNGSRPPHFCKSSGALSRNILQQLQKMGIIDVDPKGGRLITSQGRRDLDQVAGRVAVEA

SEQ ID NO: 6605 - DNA, 2952 bp, Sorghum bicolor
  misc_feature: Ceres ANNOT ID no. 6067662
  misc_feature: Encodes the peptide sequence at SEQ ID NO 6606
  misc_feature: Up-regulated in root tissues in response to salicylic acid treatment
atggccgccgcgccgcctctgtctctgtccgccgacgtactctccttccttccctccgcctccgcctccgcccccgccgcggccgcgccgacgccggtcgtagccgcggcgtggggcgcggcgagggcgggtgctgtgaggggtaaggcggcgctgaggacgacgacgagaggtggaaggggcgggttgctggctcccgtggttggggggaagccccgccggacgccgctttccgtgcgctgcaacgccaccagccgcgacggcaggattacgcaacaagagttcactgacatggcgtggcaagcaattgtctcatcccctgaggtggcaaaggagagtaaacaccagattgtggagacagaacatctgatgaaatccctgctggagcaacggaatggccttgcccgccgcatcttttctaaggcgggagttgacaatacaaggcttctcgatgccgcagagaagttcatccagaggcagccaaaggtattaggtgaagaacctggatccatgctggggcgtgacttggaagctctgatacaaagagcaagggactttaagaaagagtatggcgattcatatgtctcagttgaacatctagtcctgggctttgctgaagataagcggtttggaaaacagctgttcaaggattttcaggttactgtgaagaccttgaaatcagccattgaatcgatcagagggaagcaaaatgtaatggatcaagatcctgagggcaagtacgaagctttggagaagtatggaaaggatctgacagctatggcacgtcaagggaagcttgatccagttattggaagagatgatgagattcgaagatgtatacagattttgtcacgaagaacaaagaacaatccagtgctgattggtgaacctggtgtaggaaaaacggctatagctgaagggctagctcagaggattgttcaaggagatgtcccacaggctctgacaaaccgtcgactaattgcacttgatatgggtgcattgattgctggtgcaaaatatcgtggagagttcgaggatagactcaaggctgttctcaaagaagttacggattctgatgggcagaccattcttttcattgatgagattcacacagtcgttggagcaggtgccactaatggtgcaatggatgctggtaatcttctcaaaccaatgcttgggagaggagagctacggtgtattggtgcaacaacccttgatgaataccgcaaatatattgagaaagatccagcactagagcgacgcttccaacaagtttatgttgatcagccttcggttgaagatacaatttcaatactccgaggactaagagagagatatgagttgcaccatggtgtaagaatatctgacagtgcccttgtggctgcagctgttctttcagatcgttatatcagtggacgattcttgcctgacaaagcaattgatctggttgatgaatcagctgccaagttaaaaatggagataacatcaaaacctactgctctggatgagattgatcgtgctgtcctgaagcttgaaatggagcgtctctcacttacaaatgatacagataaagcatcaaaggacagattatcccgtcttgaagcagaattatcactcttgaaggataaacaacgtcaattgactgagcggtgggagcatgagaaatcagtgatgactaaaattcaatctatcaaagaagagattgacagggtaaatgtggagatacagcaggcagaacgtgagtacgatcttaatcgcgctgctgaactgaaatatggcagtctgaatgccttgcagcgccagcttcaaatgacagagaaggagcttgatgaatatcagagttctgggaaatccatgctaagggaagaggtgacccaagatgatattgcagaaatagtgagcaggtggacaggcattccagtttccaaactaaagcaatctgacagggagaagttgctgtttctggaggaagagctgcacaagcgagttgtcggtcaggatcctgctgtgaaagcagttgcagaggccattcagagatccagagctggattatctgacccaaaccgtcctattgccagtttcatgttcatgggacctacaggagttggcaaaacagagttagcgaaagcccttgctgcttttatgttcaacactgaggaagctgttgtcaggattgacatgagcgagtacatggagaagcattcagtctcaagattgattggtgctccaccaggttatgttgggtatgaagagggtggtcaactaacagaggctgttcgccgtaggccatattctgttgtcttgtttgatgagattgagaaagctcattcagatgtctttaatgtcttccttcaaatattggatgatggtagggttactgactctcaaggccgaaaagtgagcttcaccaacaccataattatcatgacgtccaacgttgggtcacagtatatactaaacatggatgaagaagttggatcatctgattcagcctatgagaacataaagaagagggtgatggatgctgcaagatctgtattccgtccagagttcatgaatcgtgtagatgagtatattgttttcaagcctctcgagagagaacagatcaacagcattgtcaaattacagcttgcaagagtacagaagaggatcgcagaccgcaaaatcaagctcgaagtctcacctggcgccattgaattcttgggaagcctggggtatgacccgaactatggtgcgaggccggtgaagagagtgattcaacagtacgtggagaacgaactcgcaaagggcatccttagaggtgatttcaaggacgaggacagcatctttgtggacacccaggttacggtgccctccaatggtcagcttccgcagcaaaagctagttttccggaaagtgggtgagcaatcgaaggccgctgctgaagacgagaagttcttgccggctgtgtga

SEQ ID NO: 6606 - protein, 983 aa, Sorghum bicolor
  misc_feature: Ceres ANNOT ID no. 6067662
  misc_feature (689)..(858): Pfam Id: AAA_2 Pfam Desc: ATPase family associated with various cellular activities(AAA)
  misc_feature (106)..(158): Pfam Id: Clp_N Pfam Desc: Clp amino terminal domain
  misc_feature (183)..(234): Pfam Id: Clp_N Pfam Desc: Clp amino terminal domain
  misc_feature (290)..(484): Pfam Id: AAA Pfam Desc: ATPase family associated with various cellular activities(AAA)
  misc_feature (290)..(430): Pfam Id: AAA_5 Pfam Desc: ATPase family associated with various cellular activities(AAA)
  misc_feature (693)..(837): Pfam Id: AAA_5 Pfam Desc: ATPase family associated with various cellular activities(AAA)
  misc_feature (77)..(978): NCBI GI: 68989120 NCBI Desc: heat shock protein [lycopersicon esculentum]
  misc_feature (57)..(967): NCBI GI: 115444633 NCBI Desc: os02g0181900 [oryza sativa (japonica cultivar-group)]
  misc_feature (78)..(966): NCBI GI: 9651530 NCBI Desc: clpb [phaseolus lunatus]
  misc_feature (94)..(945): NCBI GI: 54035850 NCBI Desc: chaperone clpb 1
  misc_feature (94)..(945): NCBI GI: 22298932 NCBI Desc: clpb protein [thermosynechococcus elongatus bp-1]
  misc_feature: Up-regulated in root tissues in response to salicylic acid treatment
MAAAPPLSLSADVLSFLPSASASAPAAAAPTPVVAAAWGAARAGAVRGKAALRTTTRGGRGGLLAPVVGGKPRRTPLSVRCNATSRDGRITQQEFTDMAWQAIVSSPEVAKESKHQIVETEHLMKSLLEQRNGLARRIFSKAGVDNTRLLDAAEKFIQRQPKVLGEEPGSMLGRDLEALIQRARDFKKEYGDSYVSVEHLVLGFAEDKRFGKQLFKDFQVTVKTLKSAIESIRGKQNVMDQDPEGKYEALEKYGKDLTAMARQGKLDPVIGRDDEIRRCIQILSRRTKNNPVLIGEPGVGKTAIAEGLAQRIVQGDVPQALTNRRLIALDMGALIAGAKYRGEFEDRLKAVLKEVTDSDGQTILFIDEIHTVVGAGATNGAMDAGNLLKPMLGRGELRCIGATTLDEYRKYIEKDPALERRFQQVYVDQPSVEDTISILRGLRERYELHHGVRISDSALVAAAVLSDRYISGRFLPDKAIDLVDESAAKLKMEITSKPTALDEIDRAVLKLEMERLSLTNDTDKASKDRLSRLEAELSLLKDKQRQLTERWEHEKSVMTKIQSIKEEIDRVNVEIQQAEREYDLNRAAELKYGSLNALQRQLQMTEKELDEYQSSGKSMLREEVTQDDIAEIVSRWTGIPVSKLKQSDREKLLFLEEELHKRVVGQDPAVKAVAEAIQRSRAGLSDPNRPIASFMFMGPTGVGKTELAKALAAFMFNTEEAVVRIDMSEYMEKHSVSRLIGAPPGYVGYEEGGQLTEAVRRRPYSVVLFDEIEKAHSDVFNVFLQILDDGRVTDSQGRKVSFTNTIIIMTSNVGSQYILNMDEEVGSSDSAYENIKKRVMDAARSVFRPEFMNRVDEYIVFKPLEREQINSIVKLQLARVQKRIADRKIKLEVSPGAIEFLGSLGYDPNYGARPVKRVIQQYVENELAKGILRGDFKDEDSIFVDTQVTVPSNGQLPQQKLVFRKVGEQSKAAAEDEKFLPAV

SEQ ID NO: 6607 - DNA, 804 bp, Sorghum bicolor
  misc_feature: Ceres ANNOT ID no. 6067672
  misc_feature: Encodes the peptide sequence at SEQ ID NO 6608
atgtggggttttgcatcaaatgcttgggcatctgggctggggaagaggagtcccccaaactgcacttcttcaagtgctgctggttctgatgatgaagcatcctcatgcacaagcagggaagaaggcctggaatgcccaatttgttgggaatctttcaacatagtggaaaatgtgccttatgtgctgtggtgcggccacaccatgtgcaagaactgcatcctaggactccaatgggctgtcatcaaagttccaactgtgccgatccagctaccattcttcatttgctgtccctggtgcaacctcttgtcacttcgcatactttacaaagggaacctcacattcccacgaaagaactatttcctcctttggatggttgaggggatgaatggcgagcgggccaggtcacgcccagctattcatagtgagcaacagactccatggctctcaagcagcagcagatcaaatggaaatgcaggctattcaaatcccactaggcggcaccttccaccaccggttgacatgtcgcccaccaatgccaatcatagcaaccatggggtccctctgctgaatgcagagagggtacaagcttcgctgcgcaagtcattgtcgttcctggttcacttgactgccaagtttccccttgtgttcatcttcctcctcatagtgctctatgcgatccctgccagcgcagcagtcttgttattgtatgtccttatcactgtgttgtttgcgcttccctcgttcctaatattgtattttgcgtacccgagcctagactggctagttagggaaatctttgcctga

SEQ ID NO: 6608 - protein, 267 aa, Sorghum bicolor
  misc_feature: Ceres ANNOT ID no. 6067672
  misc_feature (1)..(265): NCBI GI: 11994767 NCBI Desc: ring zinc finger protein-like [arabidopsis thaliana]
  misc_feature (28)..(113): NCBI GI: 83754838 NCBI Desc: chain a, solution structure of the ring domain of the tripartite motif protein 32
  misc_feature (41)..(113): NCBI GI: 123225989 NCBI Desc: tripartite motif protein 32 [mus musculus]
  misc_feature: The plant produces a reduced number of seeds.
  misc_feature: Useful for biocontainment applications
  misc_feature: Useful for making plants with altered alkaloid content
  misc_feature: Useful for making plants with altered protein content
  misc_feature: Useful for making plants with modulated biomass
  misc_feature: Useful for making plants with modulated heat sensitivity
  misc_feature: Functional homolog of the protein sequence given in SEQ ID NO 12877
  misc_feature: GREAT-hit functional homolog of the protein sequence given in SEQ ID NO 13434
  misc_feature: GREAT-hit functional homolog of the protein sequence given in SEQ ID NO 13460
  misc_feature: Useful for making plants with altered protein content
  misc_feature: Functional homolog of the protein sequence given in SEQ ID NO 13460
  misc_feature: Useful for biocontainment applications
  misc_feature: Useful for making plants with altered alkaloid content
  misc_feature: Functional homolog of the protein sequence given in SEQ ID NO 12877
  misc_feature: The sequence is a functional homolog of SEQ ID NO. 497 in the 11/188,298 US application
MWGFASNAWASGLGKRSPPNCTSSSAAGSDDEASSCTSREEGLECPICWESFNIVENVPYVLWCGHTMCKNCILGLQWAVIKVPTVPIQLPFFICCPWCNLLSLRILYKGNLTFPRKNYFLLWMVEGMNGERARSRPAIHSEQQTPWLSSSSRSNGNAGYSNPTRRHLPPPVDMSPTNANHSNHGVPLLNAERVQASLRKSLSFLVHLTAKFPLVFIFLLIVLYAIPASAAVLLLYVLITVLFALPSFLILYFAYPSLDWLVREIFA

SEQ ID NO: 6609 - DNA, 3093 bp, Sorghum bicolor
  misc_feature: Ceres ANNOT ID no. 6067673
  misc_feature: Encodes the peptide sequence at SEQ ID NO 6610
  misc_feature: Down-regulated in shoot tissues in response to salicylic acid treatment
atggcgtccccatcgccggcttccacgcgtccacagcgctcgcctgacgaggtggaggacatcatcctccgcaagatcctcctcgtctccctcacgccgccggccaaccccagcccggccgtcgcctacctcgagctcaccgccgccgagctgctctccgagtcgcgccctctcctcgccctgcgcgacgccgccgagcgcctcctcatcgaccgcctctcgctcccggacccgcccgccgggtccccgacccccttcgccttcctcgtctccgccttccgccgcgccgccgacgaggcgcgtaagatctccaccatccgcgacgccgctctccgggcgcgcctcgcggcctccatcgcgcacctccgggccctcatcctctcctactcgcgcatcgtcgccgggaaccccgacaccttccccaccccgcccggcgcgcaacaccccgccgccgacctcctcgtattcctcctcgccgaggcagccgacccgctcgaccccaccccggcccccggggcgccgccaccgccgggcttcattgatgagttcttcggcggcgcggactatgactccatcgagccagccatgggggagctgtacgagctacttaggcagagcgtcgataaagtttcggcccttggtgacttccagcgcccattgcgggtgctcaggcggcttgtggggatccccaattgcgccaaggccctggtgaaccatcccaagtggataccaaagaatcagatcatgctcattggggaagggagagtcatggagctctacagtgtacttggagccttcttccatgttagcgctatccgagaccgtgagtttgccagcaagcctgatgtcgggcaacaatgtttctcagaggcatcttcacgtcggccagctgacttgttgtcatctttctcaacaatcaagactgttatgaacggcttgtatgatggccttaaggatgtccttctaatcctcctaaaaaatttggatactcgagaaaaggttcttgagtatatagcagaagtgataaataaaaatgcatccagatctggcatgcaggtagacccattaaaatgcgcgagttcaggtatgtttgtgaatcttagcgctgtgatgctccgtctatgcgagccttttctggacaacatggaatcaaagaaggataagattgatgtcaagtacctcttttgtaacaatagaatcgatttcaaggatttgacagctataaatgcatcttcagaagaagtctcgtcttggatagagactataaacaatgagcatgctcaaaataatgccagtggagaggctcgatttgtggaatcacaggaagccacaagctctggcaaaaatagcacagcctcactacttaggtgcacaaagaaggataatttctcatttatttgtgaatgtttcttcatgacctcaagggtacttaatctcgggttgatgaaagctatatcagactacaaacatatttctcagcaacttgcaaggtttgaagatgatttggaatcaaacagagcagtgagagatcaaggagggggctcaccacagcttgagcaagatataactcgcttggagaagattgtcgagattttatcacaggacaaattctgttatgaagctcagatactacgagatggcgcattccttcaacgagcattatctttctacagattaatgatactgtggtcagttaacctagttggcggatttaagatgcctttgccatcacagtgccccaaggagtttgcttgcattccagaacattttcttgacgatgcaatggatttacttgttctaacctctagaattccaaaggctttggaaagctttgtattggatgactttctcagcttcatcattatgttcatgggaagcacatcttacattaagaatccttacctaagagcaaagatggttgaagttttgaattgctggatgccgcaaagaagtggcttgaattctacagcatcgttgtttgaggggcaccaactgtgtcttgactatcttgttagaaatcttctaaagctttatgtggatattgaattcactggctcccatacacaattttttgacaagtttaacattcgacataatattgctgagcttctggagtatttatgggatgttcctagtcaccgaaatgcatggagacaaatagcgaaagaggaggagaagggtgtatacttaaattttcttaactttctcatcaatgatagcatctatcttcttgatgagagcttgaacaaaattcttgaactgaaagaaatagaggctgaaatggctaacaccgttgagtgggagcgcagacctgctcaagaaagagaggagcgactgcgtgtatttcatcagtgggaaaatattgttcgatttgacatgaggctagccaatgaggatgttgggatgcttgcattcacctcagaacaaattccagcacctttccttctccctgaaatggtggaaagggtcgcaagcatgcttaattacttcctcttgcaacttgctggtccccagaggaaatctttgactgtaaaggatccggagaagtatgagttcaagccgaagcagctattgaaacagattgccaccatctatgtccatatctcaaggggcgacaaggaatctgtcttcccagctgcaatctcgaaagatggcagagcatataatgatcagttgtttgctagtgcagctaatattctgtggaagattgggggtgatcctaaaatcatacaggagttcatgcaacttgctggtagggcaaaatttgctgcttctgaagctatggatgctgaggcaatccttggggacataccagatgaattcctcgatccaattcagtatactctaatgaaagatcctgtgacactgccatcatcgaaggtcacagtagatcggcccgtaatcatcaggcatctgctgagtgattctacagatccatttaaccgctcccacctcactcaagacatgctgataccaaacacggagctcaagctgcagatcgaggaatttgtccggtcccaacagtcgagaaagcgatctgctgcggtgtcagagattggcgaagcggacggtgctgatgatatggccgaatga

SEQ ID NO: 6610 - protein, 1030 aa, Sorghum bicolor
  misc_feature: Ceres ANNOT ID no. 6067673
  misc_feature (936)..(1010): Pfam Id: U-box Pfam Desc: U-box domain
  misc_feature (7)..(1014): NCBI GI: 9755795 NCBI Desc: ubiquitin-fusion degradation protein-like [arabidopsis thaliana]
  misc_feature (464)..(1010): NCBI GI: 2827469 NCBI Desc: nosa [dictyostelium discoideum]
  misc_feature (464)..(1029): NCBI GI: 90303409 NCBI Desc: ubiquitin conjugation factor e4 [coccidioides immitis rs]
  misc_feature (417)..(1010): NCBI GI: 12038926 NCBI Desc: ufd2 [schizosaccharomyces pombe]
  misc_feature (417)..(1010): NCBI GI: 19114542 NCBI Desc: ubiquitin fusion degradation protein-2. [schizosaccharomyces pombe]
  misc_feature: Down-regulated in shoot tissues in response to salicylic acid treatment
  misc_feature: The sequence is a functional homolog of SEQ ID NO. 308 in the 11/188,298 US application
  misc_feature: The sequence is a functional homolog of SEQ ID NO. 309 in the 11/188,298 US application
MASPSPASTRPQRSPDEVEDIILRKILLVSLTPPANPSPAVAYLELTAAELLSESRPLLALRDAAERLLIDRLSLPDPPAGSPTPFAFLVSAFRRAADEARKISTIRDAALRARLAASIAHLRALILSYSRIVAGNPDTFPTPPGAQHPAADLLVFLLAEAADPLDPTPAPGAPPPPGFIDEFFGGADYDSIEPAMGELYELLRQSVDKVSALGDFQRPLRVLRRLVGIPNCAKALVNHPKWIPKNQIMLIGEGRVMELYSVLGAFFHVSAIRDREFASKPDVGQQCFSEASSRRPADLLSSFSTIKTVMNGLYDGLKDVLLILLKNLDTREKVLEYIAEVINKNASRSGMQVDPLKCASSGMFVNLSAVMLRLCEPFLDNMESKKDKIDVKYLFCNNRIDFKDLTAINASSEEVSSWIETINNEHAQNNASGEARFVESQEATSSGKNSTASLLRCTKKDNFSFICECFFMTSRVLNLGLMKAISDYKHISQQLARFEDDLESNRAVRDQGGGSPQLEQDITRLEKIVEILSQDKFCYEAQILRDGAFLQRALSFYRLMILWSVNLVGGFKMPLPSQCPKEFACIPEHFLDDAMDLLVLTSRIPKALESFVLDDFLSFIIMFMGSTSYIKNPYLRAKMVEVLNCWMPQRSGLNSTASLFEGHQLCLDYLVRNLLKLYVDIEFTGSHTQFFDKFNIRHNIAELLEYLWDVPSHRNAWRQIAKEEEKGVYLNFLNFLINDSIYLLDESLNKILELKEIEAEMANTVEWERRPAQEREERLRVFHQWENIVRFDMRLANEDVGMLAFTSEQIPAPFLLPEMVERVASMLNYFLLQLAGPQRKSLTVKDPEKYEFKPKQLLKQIATIYVHISRGDKESVFPAAISKDGRAYNDQLFASAANILWKIGGDPKIIQEFMQLAGRAKFAASEAMDAEAILGDIPDEFLDPIQYTLMKDPVTLPSSKVTVDRPVIIRHLLSDSTDPFNRSHLTQDMLIPNTELKLQIEEFVRSQQSRKRSAAVSEIGEADGADDMAE

SEQ ID NO: 6611 - DNA, 354 bp, Sorghum bicolor
  misc_feature: Ceres ANNOT ID no. 6067689
  misc_feature: Encodes the peptide sequence at SEQ ID NO 6612
atggcagcaagacgcaatgttcggtactcacctcttccttcagaggatgggggcgacagcaattttactaaagaagatgttgacctccgatacacttacactccaaaatcctacagaaggatcccgtggaagtcaattgccctggcattgttcctcctcctcctaggaacttcacttctctttctttcttacttcatattcacaggtcacatggagggtgatagttctcaggcatatggtctcttgttcctgggtttcctttcgtttcttcctggtttctacgagactcgagttgcttactattcatggcggggagcaccagggtacacttttgcatccataccagattattag

SEQ ID NO: 6612 - protein, 117 aa, Sorghum bicolor
  misc_feature: Ceres ANNOT ID no. 6067689
  misc_feature (64)..(117): NCBI GI: 115484003 NCBI Desc: os11g0132400 [oryza sativa (japonica cultivar-group)]
  misc_feature (7)..(117): NCBI GI: 49256223 NCBI Desc: mgc84021 protein [xenopus laevis]
  misc_feature (7)..(117): NCBI GI: 56204074 NCBI Desc: gd:c20orf30 [homo sapiens]
  misc_feature (7)..(117): NCBI GI: 58331124 NCBI Desc: chromosome 20 open reading frame 30 isoform 2 [homo sapiens]
  misc_feature (1)..(117): NCBI GI: 49904255 NCBI Desc: mgc89669 protein [xenopus tropicalis]
  misc_feature: Useful for making plants with altered protein content
  misc_feature: Useful for making plants with modulated biomass
  misc_feature: Useful for making plants with modulated heat sensitivity
  misc_feature: GREAT-hit functional homolog of the protein sequence given in SEQ ID NO 13434
  misc_feature: GREAT-hit functional homolog of the protein sequence given in SEQ ID NO 13449
MAARRNVRYSPLPSEDGGDSNFTKEDVDLRYTYTPKSYRRIPWKSIALALFLLLLGTSLLFLSYFIFTGHMEGDSSQAYGLLFLGFLSFLPGFYETRVAYYSWRGAPGYTFASIPDY

SEQ ID NO: 6613 - DNA, 1506 bp, Sorghum bicolor
  misc_feature: Ceres ANNOT ID no. 6067707
  misc_feature: Encodes the peptide sequence at SEQ ID NO 6614
atggatgcgcttgctgcatactcatggttcggtcagctctctgtagtgatcagcgtcctggccgtgtgctggaccatggtctggcagaacctggagcacatccggctgcagcagttcttcgcgcgcaacttcaaccgtcgcgcgcggcggatcgccgccatggtcgacccctacctgtccatcaccttcgaggagtacgagggcgggcgcatcaagagcagcgacgccttcaacgaggtcaagtcgtacctcaccacggcgagcacgcgcgacgtgcgccacctcccggccgagagcggcggcggcggcggccggagcgacggcaccgacaaggacacgctcgtcctcagcatggccaaggccaagggcgaggaggttcccgacgtcttccgcggcgccaccgtgtggtggtcggccgactccgtgccgccgccgcgcgacgccgtgccgtggacgcgctccgcgcgcgccgagcgccgctacttccgcctcgacttccacgagacccaccgggacctggtgatcagccactacgtcccgcacgtgcgccgccggggccgcgccgtcatggtccagaaccgccagcgcaggctctacaccaacatccaccgcgaaggctacgacgacgggtggtacgaggacgtgtggacgcacgtgccgttccaccaccccaagaccttcgacaagctcgccatggacccggcgaggaagaaggaggtgatggacgacctggacatgttcaggaacggcagggagtaccacgaccgcgtcgggaagccgtggaagcgcgggtacctcctgtacggcccgccgggcaccggcaagtccaccatggtcgccgccatggccaactacctcgactacgacgtctacgacttcgagctcacgtccgtgaagaccaacaccgagctccggaagctgctcatcgagaccaagagcaagtcaatcatggtgttcgaggacatcgaccgctcgctcgacgtcaccggcaagcgcaagagcaaggaggaggaggaggaggaggaggccgacaaggacgacgaggcggacggcgacccgcgccggcagagcaagaaggacgccaagagcaaggtcacgctgtccggcttgctcaacttcatcgacgggctctggtcggcgtgcggcgaggagcggctcatcgtgttcaccaccaaccacgacggggcgcggatggacaagaggatcgagatgtcctactgcgacttggagtccttcaggttcctggccaggatgcacctggacgaggacgtcgaaggccacgagctcttcggcgtcgttcgagagttgctccaggaggtgaacatggtgcctgtcgacgtcggcgagcatcttacgcccaagactctccacgacgacgccgggtcgtgcctcgcgaggctggtgacggcgttagaaaaggcgaaagcggaggatgcggcaaaggcaggggcacagcgggccgctcaagaagacgggaaggcgatcgtcgtcgaggacgacaattag

SEQ ID NO: 6614 - protein, 501 aa, Sorghum bicolor
  misc_feature: Ceres ANNOT ID no. 6067707
  misc_feature (264)..(446): Pfam Id: AAA Pfam Desc: ATPase family associated with various cellular activities(AAA)
  misc_feature (5)..(491): NCBI GI: 50510113 NCBI Desc: aaa-type atpase-like [oryza sativa (japonica cultivar-group)]
  misc_feature (1)..(495): NCBI GI: 115456003 NCBI Desc: os03g0802600 [oryza sativa (japonica cultivar-group)]
  misc_feature (11)..(481): NCBI GI: 50510118 NCBI Desc: aaa-type atpase-like [oryza sativa (japonica cultivar-group)]
  misc_feature (11)..(481): NCBI GI: 115471007 NCBI Desc: os07g0192800 [oryza sativa (japonica cultivar-group)]
  misc_feature (9)..(493): NCBI GI: 55276711 NCBI Desc: atpase 2 [hordeum vulgare subsp. vulgare]
  misc_feature: The sequence is a functional homolog of SEQ ID NO. 462 in the 11/188,298 US application
MDALAAYSWFGQLSVVISVLAVCWTMVWQNLEHIRLQQFFARNFNRRARRIAAMVDPYLSITFEEYEGGRIKSSDAFNEVKSYLTTASTRDVRHLPAESGGGGGRSDGTDKDTLVLSMAKAKGEEVPDVFRGATVWWSADSVPPPRDAVPWTRSARAERRYFRLDFHETHRDLVISHYVPHVRRRGRAVMVQNRQRRLYTNIHREGYDDGWYEDVWTHVPFHHPKTFDKLAMDPARKKEVMDDLDMFRNGREYHDRVGKPWKRGYLLYGPPGTGKSTMVAAMANYLDYDVYDFELTSVKTNTELRKLLIETKSKSIMVFEDIDRSLDVTGKRKSKEEEEEEEADKDDEADGDPRRQSKKDAKSKVTLSGLLNFIDGLWSACGEERLIVFTTNHDGARMDKRIEMSYCDLESFRFLARMHLDEDVEGHELFGVVRELLQEVNMVPVDVGEHLTPKTLHDDAGSCLARLVTALEKAKAEDAAKAGAQRAAQEDGKAIVVEDDN

SEQ ID NO: 6615 - DNA, 624 bp, Sorghum bicolor
  misc_feature: Ceres ANNOT ID no. 6067739
  misc_feature: Encodes the peptide sequence at SEQ ID NO 6616
atggccatcacccacgacgactacgtctccctttgcctcatggcgctcgcggccgcgggaggcggaggccaagctgcaggtttaacgacgcagtacgctctgacgaacacggctgcctgctggacggcgacggcgcaagagtccgagctccgcttccggtgctccgtctgtggcaaggccttcgcgtcgcaccaggcgctgggcgggcacaaggccagccaccggaaaccgacgcctgtactacaggcacaagcgtcgtcgtcgtcagccggaggtgcggcggcgtcgtcgtcggggataacgacctcggccggcggcagcagcgggcaggggaggcacaggtgcacggtgtgccatcggagcttcgcgacggggcaggcgctcggcgggcacaagaggtgccattactgggacgggctctcggtgtcgctcaccgcgtcgtctgcgccatcgggttccgggtcgaccgtgaagggatttgatctgaatttggtgccggcgccggcggcgacggcggccaacgcggcgacaaggtggagagaggaggaagaggtgcagagccccttgccggtcaagaagaggcggctgtccggtccgtccctggaccttagtttaacgatctag

SEQ ID NO: 6616 - protein, 207 aa, Sorghum bicolor
  misc_feature: Ceres ANNOT ID no. 6067739
  misc_feature (52)..(74): Pfam Id: zf-C2H2 Pfam Desc: Zinc finger, C2H2 type
  misc_feature (2)..(197): NCBI GI: 31580711 NCBI Desc: c2h2-type zinc finger protein zfp36 [oryza sativa (japonica cultivar-group)]
  misc_feature (7)..(198): NCBI GI: 115473107 NCBI Desc: os07g0590100 [oryza sativa (japonica cultivar-group)]
  misc_feature (49)..(199): NCBI GI: 6693033 NCBI Desc: t22c5.18 [arabidopsis thaliana]
  misc_feature (4)..(199): NCBI GI: 33331578 NCBI Desc: zinc finger protein [capsicum annuum]
  misc_feature (4)..(199): NCBI GI: 71979887 NCBI Desc: cys2-his2 type zinc finger protein [nicotiana tabacum]
  misc_feature: The sequence is a functional homolog of SEQ ID NO 10 in the 10/412,699US patent application
  misc_feature: The sequence is a functional homolog of SEQ ID NO 1092 in the 10/412,699US patent application
  misc_feature: The sequence is a functional homolog of SEQ ID NO 1093 in the 10/412,699US patent application
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1212 in the 10/412,699US patent application
  misc_feature: The sequence is a functional homolog of SEQ ID NO 1213 in the 10/412,699US patent application
  misc_feature: The sequence is a functional homolog of SEQ ID NO 1214 in the 10/412,699US patent application
  misc_feature: The sequence is a functional homolog of SEQ ID NO 1215 in the 10/412,699US patent application
  misc_feature: The sequence is a functional homolog of SEQ ID NO 124 in the 11/479,226US patent application
  misc_feature: The sequence is a functional homolog of SEQ ID NO 1288 in the 10/666,642US patent application
  misc_feature: The sequence is a functional homolog of SEQ ID NO 1289 in the 10/666,642US patent application
  misc_feature: The sequence is a functional homolog of SEQ ID NO 1291 in the 10/666,642US patent application
  misc_feature: The sequence is a functional homolog of SEQ ID NO 1292 in the 10/666,642US patent application
  misc_feature: The sequence is a functional homolog of SEQ ID NO 1762 in the 10/412,699US patent application
  misc_feature: The sequence is a functional homolog of SEQ ID NO 1988 in the 10/374,780US patent application
  misc_feature: The sequence is a functional homolog of SEQ ID NO 2 in the 10/374,780US patent application
  misc_feature: The sequence is a functional homolog of SEQ ID NO 32 in the 10/286,264US patent application
  misc_feature: The sequence is a functional homolog of SEQ ID NO 464 in the 11/435,388US patent application
  misc_feature: The sequence is a functional homolog of SEQ ID NO 592 in the 11/435,388US patent application
  misc_feature: The sequence is a functional homolog of SEQ ID NO 622 in the 10/374,780US patent application
  misc_feature: The sequence is a functional homolog of SEQ ID NO 623 in the 10/374,780US patent application
  misc_feature: The sequence is a functional homolog of SEQ ID NO 625 in the 10/374,780US patent application
  misc_feature: The sequence is a functional homolog of SEQ ID NO 626 in the 10/374,780US patent application
  misc_feature: The sequence is a functional homolog of SEQ ID NO 637 in the 10/374,780US patent application
  misc_feature: The sequence is a functional homolog of SEQ ID NO 638 in the 10/374,780US patent application
  misc_feature: The sequence is a functional homolog of SEQ ID NO 761 in the 10/666,642US patent application
  misc_feature: The sequence is a functional homolog of SEQ ID NO 762 in the 10/666,642US patent application
  misc_feature: The sequence is a functional homolog of SEQ ID NO 830 in the 10/666,642US patent application
  misc_feature: The sequence is a functional homolog of SEQ ID NO 831 in the 10/666,642US patent application
  misc_feature: The sequence is a functional homolog of SEQ ID NO 832 in the 10/666,642US patent application
  misc_feature: The sequence is a functional homolog of SEQ ID NO 903 in the 10/374,780US patent application
  misc_feature: The sequence is a functional homolog of SEQ ID NO 904 in the 10/374,780US patent application
  misc_feature: The sequence is a functional homolog of SEQ ID NO 905 in the 10/374,780US patent application
  misc_feature: The sequence is a functional homolog of SEQ ID NO 906 in the 10/374,780US patent application
  misc_feature: The sequence is a functional homolog of SEQ ID NO 907 in the 10/374,780US patent application
  misc_feature: Useful for making plants with altered protein content
  misc_feature: Useful for making plants with modulated growth and phenotype characteristics
  misc_feature: Functional homolog of the protein sequence given in SEQ ID NO 13461
  misc_feature: The sequence is a functional homolog of SEQ ID NO 32 in the 20030093837 US patent application
  misc_feature: The sequence is a functional homolog of SEQ ID NO 10 in the 20040045049 US patent application
  misc_feature: The sequence is a functional homolog of SEQ ID NO 1092 in the 20040045049 US patent application
  misc_feature: The sequence is a functional homolog of SEQ ID NO 1093 in the 20040045049 US patent application
  misc_feature: The sequence is a functional homolog of SEQ ID NO 12 in the 20040045049 US patent application
  misc_feature: The sequence is a functional homolog of SEQ ID NO 1212 in the 20040045049 US patent application
  misc_feature: The sequence is a functional homolog of SEQ ID NO 1213 in the 20040045049 US patent application
  misc_feature: The sequence is a functional homolog of SEQ ID NO 1214 in the 20040045049 US patent application
  misc_feature: The sequence is a functional homolog of SEQ ID NO 1215 in the 20040045049 US patent application
  misc_feature: The sequence is a functional homolog of SEQ ID NO 622 in the 20060162006 US patent application
  misc_feature: The sequence is a functional homolog of SEQ ID NO 623 in the 20060162006 US patent application
  misc_feature: The sequence is a functional homolog of SEQ ID NO 625 in the 20060162006 US patent application
  misc_feature: The sequence is a functional homolog of SEQ ID NO 626 in the 20060162006 US patent application
  misc_feature: The sequence is a functional homolog of SEQ ID NO 907 in the 20060162006 US patent application
  misc_feature: The sequence is a functional homolog of SEQ ID NO 830 in the 20070033671 US patent application
  misc_feature: The sequence is a functional homolog of SEQ ID NO 831 in the 20070033671 US patent application
  misc_feature: The sequence is a functional homolog of SEQ ID NO 832 in the 20070033671 US patent application
  misc_feature: The sequence is a functional homolog of SEQ ID NO. 457 in the 11/188,298 US application
  misc_feature: The sequence is a functional homolog of SEQ ID NO. 351 in the 11/188,298 US application
MAITHDDYVSLCLMALAAAGGGGQAAGLTTQYALTNTAACWTATAQESELRFRCSVCGKAFASHQALGGHKASHRKPTPVLQAQASSSSAGGAAASSSGITTSAGGSSGQGRHRCTVCHRSFATGQALGGHKRCHYWDGLSVSLTASSAPSGSGSTVKGFDLNLVPAPAATAANAATRWREEEEVQSPLPVKKRRLSGPSLDLSLTI

SEQ ID NO: 6617 - DNA, 711 bp, Sorghum bicolor
  misc_feature: Ceres ANNOT ID no. 6067741
  misc_feature: Encodes the peptide sequence at SEQ ID NO 6618
atggtggaacatctcgttattgacccgaccgcgctctcccttgcgctcccggcggcaccggcaccggcaccggcaccggcgctcagcaaggaggactacctcgccatctgcctcgccgcgctcgccggcacccgcaagtttgggctcggccgcgaccgggagcagcagcagccgaccaacaagtggtgcccaacgacgctcgcacccgcgcagccgcaggagctccggttccggtgcgccgtctgcgggaaggccttcgcgtcctaccaggcgctcggcggccacaagtccagccaccgcaagccgcccacgccggagcagtacgccgccgccgccgcggcacaggcggcggcgactggggctgactccgacgagacggcgtcgacgggatcggcggacagcggtggtgggccgcaccggtgcaccatctgccggagaggcttcgcgacgggccaggctctcggcgggcacaagcgctgccattactgggacggcatgtccgtgtcggtctccgtgtccgccgcgtctgcgaccgtctcggcgtccgccgggacgacggggtcgtcgtcgggcgtcaccgtcaggaactttgacctcaacctgacgccactgccggagattagcaacgccgggatgacgatgaggaggtgggccgaggaagaggaggtgcagagtccattgccgatcaagaagcgcaggatgtcggagtga

SEQ ID NO: 6618 - protein, 236 aa, Sorghum bicolor
  misc_feature: Ceres ANNOT ID no. 6067741
  misc_feature (6)..(235): NCBI GI: 31580711 NCBI Desc: c2h2-type zinc finger protein zfp36 [oryza sativa (japonica cultivar-group)]
  misc_feature (29)..(234): NCBI GI: 12698882 NCBI Desc: zinc finger transcription factor zf1 [oryza sativa]
  misc_feature (29)..(234): NCBI GI: 485816 NCBI Desc: zinc-finger protein wzf1 [triticum aestivum]
  misc_feature (29)..(235): NCBI GI: 71979887 NCBI Desc: cys2-his2 type zinc finger protein [nicotiana tabacum]
  misc_feature (29)..(235): NCBI GI: 33771374 NCBI Desc: zinc finger protein pif1 [nicotiana benthamiana]
  misc_feature: The plant is abnormally small.
  misc_feature: The sequence is a functional homolog of SEQ ID NO 1013 in the 10/666,642US patent application
  misc_feature: The sequence is a functional homolog of SEQ ID NO 1092 in the 10/666,642US patent application
  misc_feature: The sequence is a functional homolog of SEQ ID NO 1093 in the 10/666,642US patent application
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1212 in the 10/412,699US patent application
  misc_feature: The sequence is a functional homolog of SEQ ID NO 1213 in the 10/412,699US patent application
  misc_feature: The sequence is a functional homolog of SEQ ID NO 1214 in the 10/412,699US patent application
  misc_feature: The sequence is a functional homolog of SEQ ID NO 1215 in the 10/412,699US patent application
  misc_feature: The sequence is a functional homolog of SEQ ID NO 1288 in the 10/666,642US patent application
  misc_feature: The sequence is a functional homolog of SEQ ID NO 1289 in the 10/666,642US patent application
  misc_feature: The sequence is a functional homolog of SEQ ID NO 1290 in the 10/666,642US patent application
  misc_feature: The sequence is a functional homolog of SEQ ID NO 1291 in the 10/666,642US patent application
  misc_feature: The sequence is a functional homolog of SEQ ID NO 1292 in the 10/666,642US patent application
  misc_feature: The sequence is a functional homolog of SEQ ID NO 1762 in the 10/412,699US patent application
  misc_feature: The sequence is a functional homolog of SEQ ID NO 1988 in the 10/374,780US patent application
  misc_feature: The sequence is a functional homolog of SEQ ID NO 2 in the 10/374,780US patent application
  misc_feature: The sequence is a functional homolog of SEQ ID NO 32 in the 10/286,264US patent application
  misc_feature: The sequence is a functional homolog of SEQ ID NO 464 in the 11/435,388US patent application
  misc_feature: The sequence is a functional homolog of SEQ ID NO 592 in the 11/435,388US patent application
  misc_feature: The sequence is a functional homolog of SEQ ID NO 622 in the 10/374,780US patent application
  misc_feature: The sequence is a functional homolog of SEQ ID NO 623 in the 10/374,780US patent application
  misc_feature: The sequence is a functional homolog of SEQ ID NO 624 in the 10/374,780US patent application
  misc_feature: The sequence is a functional homolog of SEQ ID NO 625 in the 10/374,780US patent application
  misc_feature: The sequence is a functional homolog of SEQ ID NO 626 in the 10/374,780US patent application
  misc_feature: The sequence is a functional homolog of SEQ ID NO 830 in the 10/666,642US patent application
  misc_feature: The sequence is a functional homolog of SEQ ID NO 831 in the 10/666,642US patent application
  misc_feature: The sequence is a functional homolog of SEQ ID NO 832 in the 10/666,642US patent application
  misc_feature: The sequence is a functional homolog of SEQ ID NO 903 in the 10/374,780US patent application
  misc_feature: The sequence is a functional homolog of SEQ ID NO 904 in the 10/374,780US patent application
  misc_feature: The sequence is a functional homolog of SEQ ID NO 905 in the 10/374,780US patent application
  misc_feature: The sequence is a functional homolog of SEQ ID NO 906 in the 10/374,780US patent application
  misc_feature: The sequence is a functional homolog of SEQ ID NO 907 in the 10/374,780US patent application
  misc_feature: Useful for making plants with modulated biomass
  misc_feature: Useful for making plants with modulated growth and phenotype characteristics
  misc_feature: The sequence is a functional homolog of SEQ ID NO 32 in the 20030093837 US patent application
  misc_feature: The sequence is a functional homolog of SEQ ID NO 12 in the 20040045049 US patent application
  misc_feature: The sequence is a functional homolog of SEQ ID NO 12 in the 20040045049 US patent application
  misc_feature: The sequence is a functional homolog of SEQ ID NO 1212 in the 20040045049 US patent application
  misc_feature: The sequence is a functional homolog of SEQ ID NO 1213 in the 20040045049 US patent application
  misc_feature: The sequence is a functional homolog of SEQ ID NO 1214 in the 20040045049 US patent application
  misc_feature: The sequence is a functional homolog of SEQ ID NO 1215 in the 20040045049 US patent application
  misc_feature: The sequence is a functional homolog of SEQ ID NO 622 in the 20060162006 US patent application
  misc_feature: The sequence is a functional homolog of SEQ ID NO 623 in the 20060162006 US patent application
  misc_feature: The sequence is a functional homolog of SEQ ID NO 624 in the 20060162006 US patent application
  misc_feature: The sequence is a functional homolog of SEQ ID NO 625 in the 20060162006 US patent application
  misc_feature: The sequence is a functional homolog of SEQ ID NO 626 in the 20060162006 US patent application
  misc_feature: The sequence is a functional homolog of SEQ ID NO 907 in the 20060162006 US patent application
  misc_feature: The sequence is a functional homolog of SEQ ID NO 1013 in the 20070033671 US patent application
  misc_feature: The sequence is a functional homolog of SEQ ID NO 1092 in the 20070033671 US patent application
  misc_feature: The sequence is a functional homolog of SEQ ID NO 1093 in the 20070033671 US patent application
  misc_feature: The sequence is a functional homolog of SEQ ID NO 830 in the 20070033671 US patent application
  misc_feature: The sequence is a functional homolog of SEQ ID NO 831 in the 20070033671 US patent application
  misc_feature: The sequence is a functional homolog of SEQ ID NO 832 in the 20070033671 US patent application
  misc_feature: Functional homolog of the protein sequence given in SEQ ID NO 13580
  misc_feature: The sequence is a functional homolog of SEQ ID NO 1215 in the 10/412,699 US patent application
  misc_feature: The sequence is a functional homolog of SEQ ID NO 906 in the 10/374,780 US patent application
  misc_feature: The sequence is a functional homolog of SEQ ID NO. 457 in the 11/188,298 US application
  misc_feature: The sequence is a functional homolog of SEQ ID NO. 351 in the 11/188,298 US application
MVEHLVIDPTALSLALPAAPAPAPAPALSKEDYLAICLAALAGTRKFGLGRDREQQQPTNKWCPTTLAPAQPQELRFRCAVCGKAFASYQALGGHKSSHRKPPTPEQYAAAAAAQAAATGADSDETASTGSADSGGGPHRCTICRRGFATGQALGGHKRCHYWDGMSVSVSVSAASATVSASAGTTGSSSGVTVRNFDLNLTPLPEISNAGMTMRRWAEEEEVQSPLPIKKRRMSE

SEQ ID NO: 6619 - DNA, 771 bp, Sorghum bicolor
  misc_feature: Ceres ANNOT ID no. 6067742
  misc_feature: Encodes the peptide sequence at SEQ ID NO 6620
atggccgccggttccgaagctcttcttgacgccaccgcgctctccctctccctcgcgctgccgacgacgacgccggcgcccggcctggtggcggggctcaagatcaacaaggaggactacctcgccatctgcctcgccgcgctcgccggtacccgaggaaccggcctcagcaacaaggcggtcgtcgctgggttcggcctcccgcagcaccagggacagggacacggcaataataataataagcagcagcagtggtgcccaccgccggcggcgctggcgcacgaggagcagctccggttccggtgcgcggtgtgcgggaaggccttcgcgtcgtaccaggcgctcggcggccacaagtccagccaccgcaagccgcccacgccggagcagtacgccgccgccgcggcggcgcagcagcaggaggcggtttccgcgcccgactccgaggagacgacgacgacgacgacgtcgtcgtcgggagggacgacttctaccggtgggccgcaccggtgcaccatctgccggaaggggttcgccacgggccaggcgctcggcggccacaagcgctgccactactgggacggcacgtcgtcggtgtccgtctccatgtcggcgtcggcgtccgctacggggtcgtcgtcggccgtcaccgtcaggaactttgacctcaacctgatgcctgtgccggagaacgccggcatgaagagatgggtcgaggaggaggaggtgcagagtccactgcccatcaagaagcgcaggatcttggattag

SEQ ID NO: 6620 - protein, 256 aa, Sorghum bicolor
  misc_feature: Ceres ANNOT ID no. 6067742
  misc_feature (16)..(254): NCBI GI: 31580711 NCBI Desc: c2h2-type zinc finger protein zfp36 [oryza sativa (japonica cultivar-group)]
  misc_feature (80)..(254): NCBI GI: 71979887 NCBI Desc: cys2-his2 type zinc finger protein [nicotiana tabacum]
  misc_feature (80)..(254): NCBI GI: 33771374 NCBI Desc: zinc finger protein pif1 [nicotiana benthamiana]
  misc_feature (87)..(255): NCBI GI: 12698882 NCBI Desc: zinc finger transcription factor zf1 [oryza sativa]
  misc_feature (77)..(255): NCBI GI: 485816 NCBI Desc: zinc-finger protein wzf1 [triticum aestivum]
  misc_feature: The sequence is a functional homolog of SEQ ID NO 1013 in the 10/666,642US patent application
  misc_feature: The sequence is a functional homolog of SEQ ID NO 104 in the 10/374,780US patent application
  misc_feature: The sequence is a functional homolog of SEQ ID NO 1092 in the 10/666,642US patent application
  misc_feature: The sequence is a functional homolog of SEQ ID NO 1093 in the 10/666,642US patent application
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1212 in the 10/412,699US patent application
  misc_feature: The sequence is a functional homolog of SEQ ID NO 1213 in the 10/412,699US patent application
  misc_feature: The sequence is a functional homolog of SEQ ID NO 1214 in the 10/412,699US patent application
  misc_feature: The sequence is a functional homolog of SEQ ID NO 1215 in the 10/412,699US patent application
  misc_feature: The sequence is a functional homolog of SEQ ID NO 1288 in the 10/666,642US patent application
  misc_feature: The sequence is a functional homolog of SEQ ID NO 1289 in the 10/666,642US patent application
  misc_feature: The sequence is a functional homolog of SEQ ID NO 1290 in the 10/666,642US patent application
  misc_feature: The sequence is a functional homolog of SEQ ID NO 1291 in the 10/666,642US patent application
  misc_feature: The sequence is a functional homolog of SEQ ID NO 1292 in the 10/666,642US patent application
  misc_feature: The sequence is a functional homolog of SEQ ID NO 155 in the 11/479,226US patent application
  misc_feature: The sequence is a functional homolog of SEQ ID NO 2 in the 10/374,780US patent application
  misc_feature: The sequence is a functional homolog of SEQ ID NO 2216 in the 10/374,780US patent application
  misc_feature: The sequence is a functional homolog of SEQ ID NO 34 in the 10/412,699US patent application
  misc_feature: The sequence is a functional homolog of SEQ ID NO 346 in the 10/412,699US patent application
  misc_feature: The sequence is a functional homolog of SEQ ID NO 426 in the 11/435,388US patent application
  misc_feature: The sequence is a functional homolog of SEQ ID NO 464 in the 11/435,388US patent application
  misc_feature: The sequence is a functional homolog of SEQ ID NO 52 in the 10/903,236US patent application
  misc_feature: The sequence is a functional homolog of SEQ ID NO 58 in the 10/225,068US patent application
  misc_feature: The sequence is a functional homolog of SEQ ID NO 622 in the 10/374,780US patent application
  misc_feature: The sequence is a functional homolog of SEQ ID NO 623 in the 10/374,780US patent application
  misc_feature: The sequence is a functional homolog of SEQ ID NO 624 in the 10/374,780US patent application
  misc_feature: The sequence is a functional homolog of SEQ ID NO 625 in the 10/374,780US patent application
  misc_feature: The sequence is a functional homolog of SEQ ID NO 626 in the 10/374,780US patent application
  misc_feature: The sequence is a functional homolog of SEQ ID NO 780 in the 10/225,066US patent application
  misc_feature: The sequence is a functional homolog of SEQ ID NO 813 in the 11/479,226US patent application
  misc_feature: The sequence is a functional homolog of SEQ ID NO 830 in the 10/666,642US patent application
  misc_feature: The sequence is a functional homolog of SEQ ID NO 831 in the 10/666,642US patent application
  misc_feature: The sequence is a functional homolog of SEQ ID NO 832 in the 10/666,642US patent application
  misc_feature: The sequence is a functional homolog of SEQ ID NO 903 in the 10/374,780US patent application
  misc_feature: The sequence is a functional homolog of SEQ ID NO 904 in the 10/374,780US patent application
  misc_feature: The sequence is a functional homolog of SEQ ID NO 905 in the 10/374,780US patent application
  misc_feature: The sequence is a functional homolog of SEQ ID NO 906 in the 10/374,780US patent application
  misc_feature: The sequence is a functional homolog of SEQ ID NO 907 in the 10/374,780US patent application
  misc_feature: Useful for making plants with modulated growth and phenotype characteristics
  misc_feature: The sequence is a functional homolog of SEQ ID NO 12 in the 20040045049 US patent application
  misc_feature: The sequence is a functional homolog of SEQ ID NO 1212 in the 20040045049 US patent application
  misc_feature: The sequence is a functional homolog of SEQ ID NO 1213 in the 20040045049 US patent application
  misc_feature: The sequence is a functional homolog of SEQ ID NO 1214 in the 20040045049 US patent application
  misc_feature: The sequence is a functional homolog of SEQ ID NO 1215 in the 20040045049 US patent application
  misc_feature: The sequence is a functional homolog of SEQ ID NO 34 in the 20040045049 US patent application
  misc_feature: The sequence is a functional homolog of SEQ ID NO 346 in the 20040045049 US patent application
  misc_feature: The sequence is a functional homolog of SEQ ID NO 622 in the 20060162006 US patent application
  misc_feature: The sequence is a functional homolog of SEQ ID NO 623 in the 20060162006 US patent application
  misc_feature: The sequence is a functional homolog of SEQ ID NO 624 in the 20060162006 US patent application
  misc_feature: The sequence is a functional homolog of SEQ ID NO 625 in the 20060162006 US patent application
  misc_feature: The sequence is a functional homolog of SEQ ID NO 626 in the 20060162006 US patent application
  misc_feature: The sequence is a functional homolog of SEQ ID NO 907 in the 20060162006 US patent application
  misc_feature: The sequence is a functional homolog of SEQ ID NO 1013 in the 20070033671 US patent application
  misc_feature: The sequence is a functional homolog of SEQ ID NO 1092 in the 20070033671 US patent application
  misc_feature: The sequence is a functional homolog of SEQ ID NO 1093 in the 20070033671 US patent application
  misc_feature: The sequence is a functional homolog of SEQ ID NO 830 in the 20070033671 US patent application
  misc_feature: The sequence is a functional homolog of SEQ ID NO 831 in the 20070033671 US patent application
  misc_feature: The sequence is a functional homolog of SEQ ID NO 832 in the 20070033671 US patent application
  misc_feature: The sequence is a functional homolog of SEQ ID NO 1215 in the 10/412,699 US patent application
  misc_feature: The sequence is a functional homolog of SEQ ID NO 906 in the 10/374,780 US patent application
  misc_feature: The sequence is a functional homolog of SEQ ID NO. 457 in the 11/188,298 US application
  misc_feature: The sequence is a functional homolog of SEQ ID NO. 351 in the 11/188,298 US application
MAAGSEALLDATALSLSLALPTTTPAPGLVAGLKINKEDYLAICLAALAGTRGTGLSNKAVVAGFGLPQHQGQGHGNNNNKQQQWCPPPAALAHEEQLRFRCAVCGKAFASYQALGGHKSSHRKPPTPEQYAAAAAAQQQEAVSAPDSEETTTTTTSSSGGTTSTGGPHRCTICRKGFATGQALGGHKRCHYWDGTSSVSVSMSASASATGSSSAVTVRNFDLNLMPVPENAGMKRWVEEEEVQSPLPIKKRRILD

SEQ ID NO: 6621 - DNA, 816 bp, Sorghum bicolor
  misc_feature: Ceres ANNOT ID no. 6067743
  misc_feature: Encodes the peptide sequence at SEQ ID NO 6622
atggggatcgtggaggaggcgcacaacctgcgcgtggtgggcgagggcaagcgcggggtcatcgtgctggcgcacggcttcggcaccgaccagtccgtctggaagcacctggtcccgcacctcgtcgccgactaccgcgtcgtgctcttcgacaccatgggcgccgggcccaccaacccggactacttcgacttcgcccgctacgccacgctcgagggctacgcgctcgacctcctcgccatcctccaggagctcggcgtccagtcctgcatctacgtcggccactccgtctccgccgtcatcggcgcgctcgcctccatctcaaggcccgacctcttcacaaagctcgtcctactctccgcgtccccaaggtacctcaatgatgtggactactatggcgggtttgaacaagatgagcttgatgagctgtttgaggcgatgcgatcaaactacaaggcctggtgctcaggttttgcacccctgtgtgttggaggagatatggaatcagtggcagttcaggagtttagcaggacactcttcaatatacgcccagacattgcacttagtgttgcccagacgatcttccagagcgacgtgcgcagcctcctcccgcttgttagtgtcccatgccacataattcagagcaccaaggatcttgcggtgccagttgtggtgtctgagtacctgcacaagcacctcggtggcgactccattgtagaggtgatgccctctgaaggccatctcccccagctgagctctccagacattgtaatccctgtcttactccggcacattcagcatgatattgcagtctag

SEQ ID NO: 6622 - protein, 271 aa, Sorghum bicolor
  misc_feature: Ceres ANNOT ID no. 6067743
  misc_feature (45)..(263): Pfam Id: Abhydrolase_1 Pfam Desc: alpha/beta hydrolase fold
  misc_feature (1)..(270): NCBI GI: 92883690 NCBI Desc: alpha/beta hydrolase fold [medicago truncatula]
  misc_feature (1)..(269): NCBI GI: 92880621 NCBI Desc: alpha/beta hydrolase fold [medicago truncatula]
  misc_feature (1)..(271): NCBI GI: 90811669 NCBI Desc: catalytic hydrolase [striga asiatica]
  misc_feature (6)..(226): NCBI GI: 94442920 NCBI Desc: hydrolase [platanus x acerifolia]
  misc_feature (8)..(258): NCBI GI: 45656451 NCBI Desc: hydrolase [leptospira interrogans serovar copenhageni str. fiocruz l1-130]
MGIVEEAHNLRVVGEGKRGVIVLAHGFGTDQSVWKHLVPHLVADYRVVLFDTMGAGPTNPDYFDFARYATLEGYALDLLAILQELGVQSCIYVGHSVSAVIGALASISRPDLFTKLVLLSASPRYLNDVDYYGGFEQDELDELFEAMRSNYKAWCSGFAPLCVGGDMESVAVQEFSRTLFNIRPDIALSVAQTIFQSDVRSLLPLVSVPCHIIQSTKDLAVPVVVSEYLHKHLGGDSIVEVMPSEGHLPQLSSPDIVIPVLLRHIQHDIAV

SEQ ID NO: 6623 - DNA, 1344 bp, Sorghum bicolor
  misc_feature: Ceres ANNOT ID no. 6067759
  misc_feature: Encodes the peptide sequence at SEQ ID NO 6624
atggatgaggagtacgacgtgatcgtgttggggacggggctcaaggagtgcatcatcagcggcctcctctccgtcgatggcctcaaggttcttcacatggataggaatgattactatggaggagaatcatcatccctgaatcttattaagctctggaagagattcaaaggcaatgacagccctcctgagcatctgggcatcagcaaagaatacaatgttgacatggtacccaagtttatgatggcaaatggtgcgctggttcgtgttctgatccacacaagtgtgacaaagtatctaaacttcaaggccgttgatggaagttttgtgtacaacaacgggaagattcacaaagtccctgcaaccgatgttgaagctttgaaatctaacctgatgggtctgtttgagaagcgtcgtgctcgcaagttcttcatatatgtgcaggattacgaggaggatgacccaaaatctcacgagggcctggatttgaccaaggtcaccaccaaagaagtcatctccaaatatggattggaggatgatacagttgactttatcgggcatgcattagcgcttcatcgggatgatagctacctggatgagcctgcaattgacactgtcaagagaatgaagctttatgcagaatcacttgcacgctttcaaggagggtccccttacatctaccctctatatggtttgggagaacttcctcaggcttttgcccgtttgagcgctgtttatggtggcacgtacatgctgaacaagccagaatgcaaggttgagtttgatgagagtggaaaagcatacggagtcacttctgaaggggagactgcaaagtgcaagaagattgtttgtgatccttcatatttgcctgaaaaggtgaagaaggttggaagggtggcccgtgcgatatgtattatgaagcatccaatccccgacaccaaggattcacactccgtgcagatcatcctcccaaagaagcaattaaagcgcaaatcagacatgtacgtgttttgctgctcttacgctcacaatgttgcaccaaaaggcaagttcattgctttcgtttcgactgaagctgagaccgacaagcccgagattgagttgaagcctgggatcgatctgcttggccctgtagaggagacgttctttgacatctatgacagatatgaacccattaacaatcctgaggaggatagttgtttcttgacaaatagctacgactcaaccactcattttgagacaacggtaaaggatgtactcgccttgtacaacaagatcactggaaaggagcttgatctttcagtcgatttgaatgctgctagtgctgctgagcaagaagctgcttga

SEQ ID NO: 6624 - protein, 447 aa, Sorghum bicolor
  misc_feature: Ceres ANNOT ID no. 6067759
  misc_feature (1)..(438): Pfam Id: GDI Pfam Desc: GDP dissociation inhibitor
  misc_feature (1)..(444): NCBI GI: 2501850 NCBI Desc: gdp dissociation inhibitor [nicotiana tabacum]
  misc_feature (1)..(445): NCBI GI: 92896173 NCBI Desc: rab gdi protein [medicago truncatula]
  misc_feature (1)..(444): NCBI GI: 3175990 NCBI Desc: gdp dissociation inhibitor [cicer arietinum]
  misc_feature (1)..(444): NCBI GI: 82623395 NCBI Desc: gdp dissociation inhibitor 1-like [solanum tuberosum]
  misc_feature (1)..(444): NCBI GI: 7671434 NCBI Desc: gdp dissociation inhibitor [arabidopsis thaliana]
MDEEYDVIVLGTGLKECIISGLLSVDGLKVLHMDRNDYYGGESSSLNLIKLWKRFKGNDSPPEHLGISKEYNVDMVPKFMMANGALVRVLIHTSVTKYLNFKAVDGSFVYNNGKIHKVPATDVEALKSNLMGLFEKRRARKFFIYVQDYEEDDPKSHEGLDLTKVTTKEVISKYGLEDDTVDFIGHALALHRDDSYLDEPAIDTVKRMKLYAESLARFQGGSPYIYPLYGLGELPQAFARLSAVYGGTYMLNKPECKVEFDESGKAYGVTSEGETAKCKKIVCDPSYLPEKVKKVGRVARAICIMKHPIPDTKDSHSVQIILPKKQLKRKSDMYVFCCSYAHNVAPKGKFIAFVSTEAETDKPEIELKPGIDLLGPVEETFFDIYDRYEPINNPEEDSCFLTNSYDSTTHFETTVKDVLALYNKITGKELDLSVDLNAASAAEQEAA

SEQ ID NO: 6625 - DNA, 1287 bp, Sorghum bicolor
  misc_feature: Ceres ANNOT ID no. 6067777
  misc_feature: Encodes the peptide sequence at SEQ ID NO 6626
atgggcaagagtaagaggaacaagggcggtcgaagtggcggtggtgccgatgaccagcttgacggtggcagcgatgccgatagcgtgacctctatgtcgactgcgctgtctgaccttcagctcgcgcaggccaccgagcatgttagctcgcaggaattcgttcttgacaactacattgacgctctctacgagaagaggggatccacaagagagaaagcactgggcgctcttatcgatgcttttgaaagttttgtgcttcttggtttagtggaaaacaaatatgtcaccctattgagccagttcaccaattcaattaaaaaaggatctacaaaggaggtgtgtctggcttgtcgctgcattggtgcgggaagtagttcgcacgaaataatggatgagtcacatcaacagcttttgagagttctccaaacttggcctgatgcaccaaaaatgatctctgcacttgattgcttagcagttgtcacatttgttggtgcaactgatctttctgaaacccagctatctctgaaagccatctgggatgtgatccatccaaaatcaggatcaaatgttggcattgtcagaaaaccgaagcctcctttgttagcagccgccgtatctgcatgggcatttcttttaacaactgttggttcatctagaagaaatactgattcttggaaagaccttcttgaagcagaggatcgtgctgtgcggattgctgctggtgaagcattagctctgtgttttgagctaaaactgctggatgtttcctctagttatgaagctgatgttgacattgacactagagagaccagtggttctaaacatcaacttttcttgaatatgcaagcattgaaggccaaaatatctggtctagtctatagtctctccatggaggctgggggcagaggtgctgacaagaaaaatcttaatgatcagagagacttgttccaacgaatctcagattttattaagagtggtgagtgccctgaagaatcacttaggatttcaggcaagaatggcattttaagagttacaacatggcgtgaatcaatacagttgaactatatgaggcggtttcttgggcgaggattcctgaagcattcacaggataatgatttgctgcatgagatctttgacatcaaaattgatcgtactgaaaacatgtcaaccactaaaaagaaaatgtttagatccgaagaagagaaaggaagagctctgaagttgaataaagagcgtcgtctagctcaggagaggaaacagaatatcttgaacgagcaatatggatag

SEQ ID NO: 6626 - protein, 428 aa, Sorghum bicolor
  misc_feature: Ceres ANNOT ID no. 6067777
  misc_feature (24)..(324): Pfam Id: IFRD Pfam Desc: Interferon-related developmental regulator (IFRD)
  misc_feature (21)..(416): NCBI GI: 42571665 NCBI Desc: interferon-related developmental regulator family protein / ifrd protein family [arabidopsis thaliana]
  misc_feature (21)..(416): NCBI GI: 18700286 NCBI Desc: at1g27760/t22c5_5 [arabidopsis thaliana]
  misc_feature (21)..(416): NCBI GI: 42570214 NCBI Desc: interferon-related developmental regulator family protein / ifrd protein family [arabidopsis thaliana]
  misc_feature (21)..(378): NCBI GI: 6693024 NCBI Desc: t22c5.21 [arabidopsis thaliana]
  misc_feature (123)..(419): NCBI GI: 42408764 NCBI Desc: interferon-related protein-like [oryza sativa (japonica cultivar-group)]
MGKSKRNKGGRSGGGADDQLDGGSDADSVTSMSTALSDLQLAQATEHVSSQEFVLDNYIDALYEKRGSTREKALGALIDAFESFVLLGLVENKYVTLLSQFTNSIKKGSTKEVCLACRCIGAGSSSHEIMDESHQQLLRVLQTWPDAPKMISALDCLAVVTFVGATDLSETQLSLKAIWDVIHPKSGSNVGIVRKPKPPLLAAAVSAWAFLLTTVGSSRRNTDSWKDLLEAEDRAVRIAAGEALALCFELKLLDVSSSYEADVDIDTRETSGSKHQLFLNMQALKAKISGLVYSLSMEAGGRGADKKNLNDQRDLFQRISDFIKSGECPEESLRISGKNGILRVTTWRESIQLNYMRRFLGRGFLKHSQDNDLLHEIFDIKIDRTENMSTTKKKMFRSEEEKGRALKLNKERRLAQERKQNILNEQYG

SEQ ID NO: 6627 - DNA, 2715 bp, Sorghum bicolor
  misc_feature: Ceres ANNOT ID no. 6067813
  misc_feature: Encodes the peptide sequence at SEQ ID NO 6628
  misc_feature: Down-regulated in shoot tissues in response to aminocyclopropane carboxylic treatment
atggcgccggcggcgtcgactcgccgccgcaaggacgacgacggggccgcgccggagacgacgcagagggtcttccacttcggcaagggccggagcgacggcaacaaggcgatgaaagacttgcttggcgggaagggtgcgaacctggcggagatggcgagcatcgggctgtcggtgccgccggggttcaccgtgtccacggaggcgtgccggcagtaccagctgcaggagcttggcggcggcggcggcgggcggcggcgggccatgccggcggggctgtgggacgaggtcgtcgcggcgctgcggctcctggagcgcgccatggactcgggcctgggcgacccgcggcggccgctgctgctgtccgtgcgctccggcgccgccgtctccatgcccggcatgatggacaccgtgctcaacctcggcctcaacgaccaagtcgtcgccggcctcgcccaacgctgcggctgccgcttcgcctacgactcctatcgccgcttcctcgacatgttcggcaacgtggttatgggcatacctcatgcactatttgaagaaaaacttgaagccatgaaagttgacaaaggtttgcggaatgacactgagctggatgtcaaggatctggaagaacttgtagctcaatataagaatgtctatttggtggccaaaggtgaaaattgtccctcagatccaaagaagcagttgcatttggctatcttggctgtttttgattcatgggatagtgctagggcaaaaaagtacagaagcattaatcggattactggattgaagggcactgctgtaaatgttcagtgcatggtatttggcaacatgggtatcagatcaggcaccggtgttctctttactaggaaccctagtactggagagaaaaaactttatggagaattccttgtcaatgctcagggtgaggatgtggttgctggaattagaactccacaagagcttgatgcgatgaaggagtgcatgccagagccttatgcggaacttgttgcgaactgcaaaatcttggaaagccattataaagagatgatggacattgagttcactgttcaagaaaacagactttggatgcttcagtgcagaacagggaaacgtactggcaaaggtgcagtgaagattgctgtagacatggtcaatgagggcctgattgaccatcactcagcaattaagatggtggaaccacgacacttggaccagcttcttcatccgcagtttgaggacacattgtcatatgaagataaagtcatcgctacaggcttacctgcatcaccaggcgctgctgtgggtcagattgtcttcacagccgttgatgctgaaacatggcattcacaaggaaaatctgtcgttttggtgaggactgagaccagcccggaggatgttggtggcatgcatgcagctgctggaattctcacagccagaggtggtatgacttctcatgcagcagttgtagcccgtggctggggaaaatgttgtgtggcaggatgctcaagtatccatgtcaatgatgcagagaaggtggtagtggttggagaccaggtgctttgtgaaggtgactggttgtcactgaatggatcaaccggagatgttattttgggcaagctacctctctccccaccatcacttagtgctgatctagagatattcttgtcttgggtggatgaagttaaacagataaaggtcatggtcaatgcagacactcctgcggatgcactgactggaagaaaaaatggtgctcaagggattggattgtgcagaactgaacacatgttcttctcttctgatgagaggattaaggccatgaggcagatgataatggcggatactgctgaacagaggcagaaagcattagaccttctcttgccatatcagagggtagactttgaagggatttttcgtgcaatggatggtcttccagtaactatccggctcttggatcctccactccatgagtttcttccagagggcaacattgaggacattgttcacatgttatcttgtcacaccgattctactcatgaggaaatccttgcaagaatagaaaaaatttctgaagtgaatcctatgcttggtttccgtgggtgtaggcttggtatatcgtacccagaactaacagcaatgcaagcccgtgctatctttgaagctgctattgctgtgaatgatcaaggtttccaagtttttccagagataatggtgcctcttgttggtacacctcaggaacttgagcagcaaatgagtgtgattcatcaggtcgctcacaaggtttttgccaattcagaagcaactattagatacaaaattgggtccatgattgaggttcctagggcggccctcatagctgatgagatagcagaactggcagagttcttctcatttgggacaaatgacctcacacagatgacatttggttacagcagggatgacgttagcaagtttctcccaacctacatatcccagggtattctccagcacgacccattcgaggtgtttgaccagaagggagttggggagctggttaagattgcaactgcgaggggccgaaggtcaaggcctgatttggaggtgggcatttgtggggaacatggtggagagccgtcttcagtagcattttttgctaaggctggactggactatgtttcttgttcgcctttcagggtcccaattgcaaggttagctgcagcacaggcagcccttgaatga

SEQ ID NO: 6628 - protein, 904 aa, Sorghum bicolor
  misc_feature: Ceres ANNOT ID no. 6067813
  misc_feature (545)..(903): Pfam Id: PEP-utilizers_C Pfam Desc: PEP-utilising enzyme, TIM barrel domain
  misc_feature (23)..(392): Pfam Id: PPDK_N Pfam Desc: Pyruvate phosphate dikinase, PEP/pyruvate binding domain
  misc_feature (443)..(533): Pfam Id: PEP-utilizers Pfam Desc: PEP-utilising enzyme, mobile domain
  misc_feature (1)..(903): NCBI GI: 3550549 NCBI Desc: cytosolic pyruvate orthophosphate dikinase [oryza sativa (indica cultivar-group)]
  misc_feature (18)..(903): NCBI GI: 2443402 NCBI Desc: orthophosphate dikinase [oryza sativa (japonica cultivar-group)]
  misc_feature (16)..(900): NCBI GI: 168586 NCBI Desc: pyruvate,orthophosphate dikinase
  misc_feature (16)..(900): NCBI GI: 121582243 NCBI Desc: pyruvate orthophosphate dikinase [echinochloa frumentacea]
  misc_feature (20)..(900): NCBI GI: 62738112 NCBI Desc: chain a, pyruvate phosphate dikinase with bound mg-pep from maize
  misc_feature (16)..(900): SWISSPROT Homolog: EC 2.7.9.1 Pyruvate, phosphate dikinase, chloroplast precursor
  misc_feature: Down-regulated in shoot tissues in response to aminocyclopropane carboxylic treatment
MAPAASTRRRKDDDGAAPETTQRVFHFGKGRSDGNKAMKDLLGGKGANLAEMASIGLSVPPGFTVSTEACRQYQLQELGGGGGGRRRAMPAGLWDEVVAALRLLERAMDSGLGDPRRPLLLSVRSGAAVSMPGMMDTVLNLGLNDQVVAGLAQRCGCRFAYDSYRRFLDMFGNVVMGIPHALFEEKLEAMKVDKGLRNDTELDVKDLEELVAQYKNVYLVAKGENCPSDPKKQLHLAILAVFDSWDSARAKKYRSINRITGLKGTAVNVQCMVFGNMGIRSGTGVLFTRNPSTGEKKLYGEFLVNAQGEDVVAGIRTPQELDAMKECMPEPYAELVANCKILESHYKEMMDIEFTVQENRLWMLQCRTGKRTGKGAVKIAVDMVNEGLIDHHSAIKMVEPRHLDQLLHPQFEDTLSYEDKVIATGLPASPGAAVGQIVFTAVDAETWHSQGKSVVLVRTETSPEDVGGMHAAAGILTARGGMTSHAAVVARGWGKCCVAGCSSIHVNDAEKVVVVGDQVLCEGDWLSLNGSTGDVILGKLPLSPPSLSADLEIFLSWVDEVKQIKVMVNADTPADALTGRKNGAQGIGLCRTEHMFFSSDERIKAMRQMIMADTAEQRQKALDLLLPYQRVDFEGIFRAMDGLPVTIRLLDPPLHEFLPEGNIEDIVHMLSCHTDSTHEEILARIEKISEVNPMLGFRGCRLGISYPELTAMQARAIFEAAIAVNDQGFQVFPEIMVPLVGTPQELEQQMSVIHQVAHKVFANSEATIRYKIGSMIEVPRAALIADEIAELAEFFSFGTNDLTQMTFGYSRDDVSKFLPTYISQGILQHDPFEVFDQKGVGELVKIATARGRRSRPDLEVGICGEHGGEPSSVAFFAKAGLDYVSCSPFRVPIARLAAAQAALE

SEQ ID NO: 6629 - DNA, 942 bp, Sorghum bicolor
  misc_feature: Ceres ANNOT ID no. 6067817
  misc_feature: Encodes the peptide sequence at SEQ ID NO 6630
atggcggcgggctccaaggagaggaggaacccggcgacctgcctcaccgacgacctcatcgtggagatactctcacgactgcctgtcaagtcggtctgccgcttcaagtgcgtgtccaaacactggcttggcctcatctcccaccccgaccaccgcaagaagctgccccagaccctcgccggcatcttctaccacaccaccagcagcgagctcttccccgagttggtacgccacttcaccaatgtcacggggaagggcgcgcccctgatcagcccctccctgtccttcctcccgggccacgccgacatcaccctcttggactgctacaacggcctcctcctctgccgtagccggacgaccgcgggcgccaaccgctacgtcgtctgcaacccggcgaccgaggaatgggtagcgttgcctgagtccagtgaggctggtaacatctgtgatgcgcggctagggttcgatccggtcgtttgccccaacgtccatgtgtttgagttcgtggagaggcatgaacctgtatatggctactttccagcagaatatatcagtgggcttgagatctactcgtcggagaccgggcattgggctcacagggacagcggatggagtgacgatgtggactatgctagtgatgagtggatcttcaagcatagtgtcatgatttcgaatttattcaaaatgagccgttttgctcttgtgaagctcaataatctgatcacgattcatccagagtgccacttgatattctttgtttcggatttcgaccatacaataaggtgctatgatatggatagtagaaatgtgtgtgtgatttgcagcatggagtgtgaggtttactacaattcgagacgttgtttgtcctatgttcctcttttctcagagcattgtctgcctggaactagtaaccagagtgcaggttctcatctagcatactag

SEQ ID NO: 6630 - protein, 313 aa, Sorghum bicolor
  misc_feature: Ceres ANNOT ID no. 6067817
  misc_feature (10)..(57): Pfam Id: F-box Pfam Desc: F-box domain
  misc_feature (41)..(208): NCBI GI: 50508392 NCBI Desc: receptor-like kinase-like [oryza sativa (japonica cultivar-group)]
  misc_feature (11)..(208): NCBI GI: 115462391 NCBI Desc: os05g0177100 [oryza sativa (japonica cultivar-group)]
  misc_feature (11)..(215): NCBI GI: 115462393 NCBI Desc: os05g0177400 [oryza sativa (japonica cultivar-group)]
  misc_feature (15)..(204): NCBI GI: 115462373 NCBI Desc: os05g0175800 [oryza sativa (japonica cultivar-group)]
  misc_feature (10)..(169): NCBI GI: 117670145 NCBI Desc: f-box-like protein [hordeum vulgare]
  misc_feature: The sequence is a functional homolog of SEQ ID NO. 456 in the 11/188,298 US application
MAAGSKERRNPATCLTDDLIVEILSRLPVKSVCRFKCVSKHWLGLISHPDHRKKLPQTLAGIFYHTTSSELFPELVRHFTNVTGKGAPLISPSLSFLPGHADITLLDCYNGLLLCRSRTTAGANRYVVCNPATEEWVALPESSEAGNICDARLGFDPVVCPNVHVFEFVERHEPVYGYFPAEYISGLEIYSSETGHWAHRDSGWSDDVDYASDEWIFKHSVMISNLFKMSRFALVKLNNLITIHPECHLIFFVSDFDHTIRCYDMDSRNVCVICSMECEVYYNSRRCLSYVPLFSEHCLPGTSNQSAGSHLAY

SEQ ID NO: 6631 - DNA, 1818 bp, Sorghum bicolor
  misc_feature: Ceres ANNOT ID no. 6067831
  misc_feature: Encodes the peptide sequence at SEQ ID NO 6632
atggcggcgtccctcgccgccgcctccgcaggctcagcctccgcgcgcctcgccgccgccggcgaggtgccggggtcggcgcggccctgctgccccgggaggctcgcggcggcgagcttcccctgcgccggggccgggaggcgccggcgccccgccgtgggcgtgcggtgcggaggcggaggtgggggttcgcccgcgggggcggcggcggacgcggaggaagggggccgcttcgtcggctggatccgggaggcgtggccgtacatccggggccaccggggcagcaccttcgtcgtcgtcatctcgggggaggtcgtcgccggcccgcacctcgacggcattctgcaggatatatcccttcttcatggtcttgggatcaaatttgttcttgttcctggaacacatgtccagattgataagctcttggctgagagagggaagaaggctaagtatgctggtcgctaccgtattactgattcagattcattagatgctgcaatggaggcagctggccgaataaggctaactatagaagcgaagctgtctcctggaccaccaatgttaaatctccgtcggcatggtgttaatggtcgttggcacgaaatctctgataatgttgcaagtggaaatttccttggtgctaagaggcgaggggttgttggtggcattgattatggattcactggtgaagttaaaaaaatagatgtttcacggataagagaaaggcttgatagagatagtatagttgttgtgagcaatatggggtactccagtgcaggagaggtcttaaattgcaatacctatgaagttgctacagcatgtgctttatccattgaggcggacaagcttatttgcattgttgacggccaaatatttgatgagcatggtcgagtcaatcgttttatgtctattgaggaagcagatatgttgattagaacacgtgctaagcagagtgaaattgctgcaaattatgtgaaggttgttgatgaggaggacatcaatcatgtccgctacctcccaatgaaacatgatacagaacatagtttgaatggaagggacaatattaatgggtatactgcctcttttcggaatggtgtgggtttcaacaatggaaatggtctgtctggtgagcaagggtttgctattggtggggaggagcgtttgagcaggtcaaatggctacctttcagagttagcagcggcagcatacgtatgccatggtggtgtccaaagagtgcatattgtagatggtactgttggtggatcattgttgctagaactattcactagagatggtgttggaacgatgatagctagggatatgtatgaaggaacaagaatggccagagaggaagatctttctggtattagaaagatcattcgtcctctcgaagaatctggtgtcctggtgcgccgaactgataaagagcttcttgaagcattgccatcatttattgtcgtggaaagagatggctcaatcatagcgtgcgctgccctcttcccttttcttgaggataaatctggggaagttgctgctattgctgtatctgaagaatgtcgaggtcaaggtcaaggagacaaattacttgattacgttgagaagaaggctttatcccttggacttgagaaaatattcttgcttaccacacggacagcagattggtttgttcgtcgcggcttcaaggagtgctcgatcgagtccctgcccttggtgaggagaaaacgcatcgacctttcgcgcgggtcaaaatactacatgaagcggctccaggcagcagaggttgggcatatggctgtcaacggttttgccatgagatga

SEQ ID NO: 6632 - protein, 605 aa, Sorghum bicolor
  misc_feature: Ceres ANNOT ID no. 6067831
  misc_feature (485)..(561): Pfam Id: Acetyltransf_1 Pfam Desc: Acetyltransferase (GNAT) family
  misc_feature (95)..(329): Pfam Id: AA_kinase Pfam Desc: Amino acid kinase family
  misc_feature (2)..(605): NCBI GI: 115453651 NCBI Desc: os03g0431200 [oryza sativa (japonica cultivar-group)]
  misc_feature (7)..(590): NCBI GI: 115473053 NCBI Desc: os07g0585600 [oryza sativa (japonica cultivar-group)]
  misc_feature (7)..(529): NCBI GI: 24414029 NCBI Desc: amino acid acetyltransferase(n-acetylglutamate synthase)-like protein [oryza sativa (japonica cultivar-group)]
  misc_feature (68)..(589): NCBI GI: 42573209 NCBI Desc: gcn5-related n-acetyltransferase (gnat) family protein / amino acid kinase family protein [arabidopsis thaliana]
  misc_feature (68)..(529): NCBI GI: 18420097 NCBI Desc: gcn5-related n-acetyltransferase (gnat) family protein / amino acid kinase family protein [arabidopsis thaliana]
MAASLAAASAGSASARLAAAGEVPGSARPCCPGRLAAASFPCAGAGRRRRPAVGVRCGGGGGGSPAGAAADAEEGGRFVGWIREAWPYIRGHRGSTFVVVISGEVVAGPHLDGILQDISLLHGLGIKFVLVPGTHVQIDKLLAERGKKAKYAGRYRITDSDSLDAAMEAAGRIRLTIEAKLSPGPPMLNLRRHGVNGRWHEISDNVASGNFLGAKRRGVVGGIDYGFTGEVKKIDVSRIRERLDRDSIVVVSNMGYSSAGEVLNCNTYEVATACALSIEADKLICIVDGQIFDEHGRVNRFMSIEEADMLIRTRAKQSEIAANYVKVVDEEDINHVRYLPMKHDTEHSLNGRDNINGYTASFRNGVGFNNGNGLSGEQGFAIGGEERLSRSNGYLSELAAAAYVCHGGVQRVHIVDGTVGGSLLLELFTRDGVGTMIARDMYEGTRMAREEDLSGIRKIIRPLEESGVLVRRTDKELLEALPSFIVVERDGSIIACAALFPFLEDKSGEVAAIAVSEECRGQGQGDKLLDYVEKKALSLGLEKIFLLTTRTADWFVRRGFKECSIESLPLVRRKRIDLSRGSKYYMKRLQAAEVGHMAVNGFAMR

SEQ ID NO: 6633 - DNA, 363 bp, Sorghum bicolor
  misc_feature: Ceres ANNOT ID no. 6067833
  misc_feature: Encodes the peptide sequence at SEQ ID NO 6634
atggaggttgagaaggccaagtgcgagtgttgtgggttcacggaagagtgcacgccgacgtacatcgtggcggtgcacgccgagtacttgggccgttgggtctgcgggctctgcgccgaggcggtgggcgacgagatccggcgcgagggcaacgtcatcaccacggccaaggcgctcgaccgccacgtcgcgttcgcgcacgccgcgccgtcatacaggatggcgtccgccgccgaggacaacctcgtggcggctgtggcgcggctgctccgccgctgcctcgtcgactcgccgcccgcgtcagcgcctgcgagccggaaggtggccgcaggccccgggtgccatgatggagccgacgaatga

SEQ ID NO: 6634 - protein, 120 aa, Sorghum bicolor
  misc_feature: Ceres ANNOT ID no. 6067833
  misc_feature (1)..(98): NCBI GI: 144923428 NCBI Desc: 4fe-4s ferredoxin, iron-sulfur binding [medicago truncatula]
  misc_feature (1)..(45): NCBI GI: 7715593 NCBI Desc: f20b17.20 [arabidopsis thaliana]
  misc_feature (2)..(119): NCBI GI: 4587551 NCBI Desc: f15i1.18 [arabidopsis thaliana]
MEVEKAKCECCGFTEECTPTYIVAVHAEYLGRWVCGLCAEAVGDEIRREGNVITTAKALDRHVAFAHAAPSYRMASAAEDNLVAAVARLLRRCLVDSPPASAPASRKVAAGPGCHDGADE

SEQ ID NO: 6635 - DNA, 1563 bp, Sorghum bicolor
  misc_feature: Ceres ANNOT ID no. 6067839
  misc_feature: Encodes the peptide sequence at SEQ ID NO 6636
atggaagctctccgcaacgcgcttctcaacgagctcgccagcagagccatatccttcctggtgtccacgtgcgggagcaggctgatgccggcgccggcgagcgtccgggagcgggaggaggagaggctgatgctcatgcaccgtctgcggctcctgctcctgaggagcgccacgatcgtcgaggaagccgagggccggcgcgtcaccaaccgtggcgtgctccggcagctcagggtcctgcgcgacacgatggtgagaggccactacgtcctcgacactgtcaggtacgacgccggcggaggagaccggcgggaagaagaggacggcaaggaggtggtggttccagcgttcgcctcgtccctattcaacccagccaagcgtgcccggtgcgagccgtcgtcggagaccacgacggccagcagctctctccagctgcagcggatggtgcgcagcctggaggccgtcatcgccggcgccaaggagctggccgtgttcctgatggcctgcccacccgtgtcatgccgccagccttacagcgcccatttgttcctggacaagtgcatgttcggccgacacgcggagagggaccaggttcttgaattcttgctgcaagctgagccaccggagccggtgacgacgagtgctgcaaacccggggccggccgccggcgttcttccgatcgtcggccctgcgctcatcgggaagagcacccttgtggagcatgtctgcaacgacgagaggtgctggcctcggagtctcgaaaccatggccgccttgagggacagctgcgtgaccaagcatcagaacaacacgacgacggaggaggaagatgaaagatggttgcttgtcatcgagctttcaggggacgtggacgccgacgacgacgacgaggcatggccatggtggaacagcctcttgtaccactctcgtggaagatgcatgccgcgggggagcaaggtgatactcacgagccgttctgagaagatcgagaggttagggacgacgcgagctgtccggctgagatgcctcagcacggaagccatgtggtatttcttcaagctgagcgcgttcgggagcgctgacccggacgagaacccggagctggcgtcggtggccatggacatggcggccgaggcgcgcgggtccttcaccaccgccaacatcatggccgccatggtgagagccgatctcagcagccagcagctctggtgcaaggttctcgcgacggcgaggcactacatgcggaagaacctcgtgctgtttggtgagtacccggacgacctcaaggccaaggaccgtcctcgccgcacttggagcatgaataagctgctgaaacccaacgagtctttcgtcatctacgagacttaccagaagtgctccactcatcaacctcagcaggatgaggacctcccggacccagaggtaaccataatggacatgttgttcgaaagagtgcaaccacggggaaggtttgagatcttgttttggaaatctgtcctaccgccctactttagctatatatgtccatgcgagattcgtgatactgatacgtatgtccaatag

SEQ ID NO: 6636 - protein, 520 aa, Sorghum bicolor
  misc_feature: Ceres ANNOT ID no. 6067839
  misc_feature (173)..(449): Pfam Id: NB-ARC Pfam Desc: NB-ARC domain
  misc_feature (48)..(516): NCBI GI: 22831028 NCBI Desc: fusarium resistance protein i2c-5-like [oryza sativa (japonica cultivar-group)]
  misc_feature (46)..(510): NCBI GI: 18461224 NCBI Desc: p0690b02.9 [oryza sativa (japonica cultivar-group)]
  misc_feature (49)..(511): NCBI GI: 57899231 NCBI Desc: fusarium resistance protein i2c-5-like [oryza sativa (japonica cultivar-group)]
  misc_feature (48)..(460): NCBI GI: 115470327 NCBI Desc: os07g0117800 [oryza sativa (japonica cultivar-group)]
  misc_feature (48)..(474): NCBI GI: 22831034 NCBI Desc: fusarium resistance protein i2c-5-like [oryza sativa (japonica cultivar-group)]
MEALRNALLNELASRAISFLVSTCGSRLMPAPASVREREEERLMLMHRLRLLLLRSATIVEEAEGRRVTNRGVLRQLRVLRDTMVRGHYVLDTVRYDAGGGDRREEEDGKEVVVPAFASSLFNPAKRARCEPSSETTTASSSLQLQRMVRSLEAVIAGAKELAVFLMACPPVSCRQPYSAHLFLDKCMFGRHAERDQVLEFLLQAEPPEPVTTSAANPGPAAGVLPIVGPALIGKSTLVEHVCNDERCWPRSLETMAALRDSCVTKHQNNTTTEEEDERWLLVIELSGDVDADDDDEAWPWWNSLLYHSRGRCMPRGSKVILTSRSEKIERLGTTRAVRLRCLSTEAMWYFFKLSAFGSADPDENPELASVAMDMAAEARGSFTTANIMAAMVRADLSSQQLWCKVLATARHYMRKNLVLFGEYPDDLKAKDRPRRTWSMNKLLKPNESFVIYETYQKCSTHQPQQDEDLPDPEVTIMDMLFERVQPRGRFEILFWKSVLPPYFSYICPCEIRDTDTYVQ

SEQ ID NO: 6637 - DNA, 381 bp, Sorghum bicolor
  misc_feature: Ceres ANNOT ID no. 6067852
  misc_feature: Encodes the peptide sequence at SEQ ID NO 6638
atgaggaccctcatttccatgctcgtcgtcgccgccgccgcggtggtcggcctgtgctctgtggctcccgctgcatcagcgcgcggggagccgccggtgccgcaggccgtcggcgggtggaagccgattaatgtgaacgacccccacatccaagagctcggccgctgggcggtttcggagcacggcaagcaggccagcgaccggctggtcttcggcaaggtggtgagcggcgaggagcagatcgtcgccgggacgaaatacaagctggtcattcaggcgaccagggccggcgccggcgggaacagcgcgacgtacggggcggtggtgtacgagaaggtcgacaagacacggcagctactgtcgtttagtccggcgaactga

SEQ ID NO: 6638 - protein, 126 aa, Sorghum bicolor
  misc_feature: Ceres ANNOT ID no. 6067852
  misc_feature (38)..(126): Pfam Id: Cystatin Pfam Desc: Cystatin domain
  misc_feature (8)..(125): NCBI GI: 122246932 NCBI Desc: cysteine proteinase inhibitor 8 precursor (oryzacystatin-8) (oryzacystatin viii) (oc-viii)
  misc_feature (18)..(125): NCBI GI: 109238647 NCBI Desc: cystatin hv-cpi6 [hordeum vulgare subsp. vulgare]
  misc_feature (20)..(125): NCBI GI: 109238651 NCBI Desc: cystatin hv-cpi8 [hordeum vulgare subsp. vulgare]
  misc_feature (1)..(123): NCBI GI: 18029187 NCBI Desc: cystatin [triticum aestivum]
  misc_feature (39)..(122): NCBI GI: 122247388 NCBI Desc: cysteine proteinase inhibitor 6 precursor (oryzacystatin-6) (oryzacystatin vi) (oc-vi)
  misc_feature: Useful for making plants with modulated salt sensitivity
  misc_feature: Functional homolog of the protein sequence given in SEQ ID NO 13217
  misc_feature: The sequence is a functional homolog of SEQ ID NO. 303 in the 11/188,298 US application
MRTLISMLVVAAAAVVGLCSVAPAASARGEPPVPQAVGGWKPINVNDPHIQELGRWAVSEHGKQASDRLVFGKVVSGEEQIVAGTKYKLVIQATRAGAGGNSATYGAVVYEKVDKTRQLLSFSPAN

SEQ ID NO: 6639 - DNA, 375 bp, Sorghum bicolor
  misc_feature: Ceres ANNOT ID no. 6067853
  misc_feature: Encodes the peptide sequence at SEQ ID NO 6640
atgagggccctcatttccatgctcatcgtcgccgccgcagttgtggggctgtgctctgtcgctcccgctgcatcagcgcgcgaggcgcccctgccggagaacgtcggcaggtggacgccgatcacggacgtgaacgaccccgaaatccaagagatcggccgatgggcggtttcggagcacgacgcggcggccagcgatagtctggtcttcagcaaggtggtgcgcggcgaggagcaggtcgtcgccgggacgaactacaagctggtcattgaagcgaccaagggcgccggcgggaagatcgcgacgtacggggcggtggtgtacgagaaggttgacaatacgcggcagctactatcgtttgcgccggagaactga

SEQ ID NO: 6640 - protein, 124 aa, Sorghum bicolor
  misc_feature: Ceres ANNOT ID no. 6067853
  misc_feature (36)..(112): Pfam Id: Cystatin Pfam Desc: Cystatin domain
  misc_feature (3)..(122): NCBI GI: 122246932 NCBI Desc: cysteine proteinase inhibitor 8 precursor (oryzacystatin-8) (oryzacystatin viii) (oc-viii)
  misc_feature (9)..(122): NCBI GI: 109238647 NCBI Desc: cystatin hv-cpi6 [hordeum vulgare subsp. vulgare]
  misc_feature (2)..(122): NCBI GI: 109238651 NCBI Desc: cystatin hv-cpi8 [hordeum vulgare subsp. vulgare]
  misc_feature (23)..(120): NCBI GI: 122247388 NCBI Desc: cysteine proteinase inhibitor 6 precursor (oryzacystatin-6) (oryzacystatin vi) (oc-vi)
  misc_feature (8)..(124): NCBI GI: 109238657 NCBI Desc: cystatin hv-cpi11 [hordeum vulgare subsp. vulgare]
  misc_feature: Useful for making plants with modulated salt sensitivity
  misc_feature: Functional homolog of the protein sequence given in SEQ ID NO 13217
  misc_feature: The sequence is a functional homolog of SEQ ID NO. 303 in the 11/188,298 US application
MRALISMLIVAAAVVGLCSVAPAASAREAPLPENVGRWTPITDVNDPEIQEIGRWAVSEHDAAASDSLVFSKVVRGEEQVVAGTNYKLVIEATKGAGGKIATYGAVVYEKVDNTRQLLSFAPEN

SEQ ID NO: 6641 - DNA, 837 bp, Sorghum bicolor
  misc_feature: Ceres ANNOT ID no. 6067854
  misc_feature: Encodes the peptide sequence at SEQ ID NO 6642
atgcgctcgctgctcgccgctgccgctgctgccgcctccgcccccaacgtactccgcgccagcgctttcccgtcgcggccgccgctcctctccctacctttccgccggggtcgtgctctagctgccaggaacatgcttggcgcggcgaggtctgtctctgcggcggtccagtcgcgtgccggcggcggtgcggctgtggaggcccgggctgctcagtccggcgagatccatgtcatcgtgggacccatgttcgccggcaagaccaccgcgctcctccgccgggtccaggccgaggccggcaacggaaggagcgtggcactaataaagtctgacaaggacaaccgctatggattggattctgttgtgactcatgatggtacaaagatggcatgctgggccttgtcagaactatcaagttttcatgagaaattaggaattgaggcctataatgaggtagatgttataggtattgatgaagcccagttctttgatgatctttatgatttctgctgcaaagctgcagatcgtgatggaaaaattgtagttgttgctgggctagatggtgactacaaaaggaaaaagttcggttcagttctggatattgttcccctggctgactcagtcaccaagctaacagcacgctgtgagctatgcggtcaccgagcgttcttcacattgaggaagacgcaggaaaccaagactgaactaattggaggagctgatgtgtatatgcctgtgtgcaggcagcactacatggatgggcagattgtcattgaggccacaaggattgtattggaccttgacaggtccaccacggcggcgaaagctttgaaatag

SEQ ID NO: 6642 - protein, 278 aa, Sorghum bicolor
  misc_feature: Ceres ANNOT ID no. 6067854
  misc_feature (74)..(251): Pfam Id: TK Pfam Desc: Thymidine kinase
  misc_feature (1)..(270): NCBI GI: 97536559 NCBI Desc: thymidine kinase
  misc_feature (66)..(270): NCBI GI: 3411152 NCBI Desc: thymidine kinase [oryza sativa]
  misc_feature (74)..(266): NCBI GI: 33325041 NCBI Desc: tk1-like deoxyribonucleoside kinase [lycopersicon esculentum]
  misc_feature (104)..(266): NCBI GI: 140064738 NCBI Desc: thymidine kinase; tetratricopeptide-like helical [medicago truncatula]
  misc_feature (74)..(252): NCBI GI: 335130 NCBI Desc: thymidine kinase
  misc_feature (1)..(270): SWISSPROT Homolog: EC 2.7.1.21 Thymidine kinase
  misc_feature: The plant is abnormally small.
  misc_feature: Useful for making plants with modulated biomass
  misc_feature: GREAT-hit functional homolog of the protein sequence given in SEQ ID NO 12977
  misc_feature: Useful for making plants with modulated biomass
  misc_feature: Functional homolog of the protein sequence given in SEQ ID NO 12977
MRSLLAAAAAAASAPNVLRASAFPSRPPLLSLPFRRGRALAARNMLGAARSVSAAVQSRAGGGAAVEARAAQSGEIHVIVGPMFAGKTTALLRRVQAEAGNGRSVALIKSDKDNRYGLDSVVTHDGTKMACWALSELSSFHEKLGIEAYNEVDVIGIDEAQFFDDLYDFCCKAADRDGKIVVVAGLDGDYKRKKFGSVLDIVPLADSVTKLTARCELCGHRAFFTLRKTQETKTELIGGADVYMPVCRQHYMDGQIVIEATRIVLDLDRSTTAAKALK

SEQ ID NO: 6643 - DNA, 1419 bp, Sorghum bicolor
  misc_feature: Ceres ANNOT ID no. 6067874
  misc_feature: Encodes the peptide sequence at SEQ ID NO 6644
atggccgagaccgtcgacgacaaggtcagctacttccaggccgtcaccggcatctccgacgcggacctctgcacggagatcctagccgcgcacaactgggacctgcagctcgcggtgtcctccatcaccgccaacccctcgccctccgcctcggcttccacctcctcacgcggggacccggccccttccgccccgctgtcggctgatgcggagttcgtcgcgcccccgcccccgccgccgatgcagctgccgctgccgccccagcagcagcagccggggatcgcgtggaggctggtgacgctccccttctacgtggtctcgggcggggtgggcctcgttgccggcaccttccgcctaggcgcctgggtcgccgggggcgtgctgtcccgctccctctccctcctcggcctcgcggggcaggccggcagcggcgaccgcctgctggagttgccgccgtcagctgccgaggcggccgacttcgtcgctgagttcgcgcgcgagttcggcgctggccgcggcccgagcttcgtggcagaggggttcgctgatgcgctgcagcgagcgcagcgggagttcaagcttctgttcgtgtacctccactcccctgatcacccggatacccctgccttctgcggtggctgcctctgtgctgagcccgtcgcggcctttatagatgagaacttcgttgcgtggggtggtagcatcagaaggactgaagggttcaagatgagcaacagcctgaatgcgtccaggttcccgttttgtgctgtggtcatggcttctaccaaccagagaatcatgctattgcagcaggttgaagggcccaaatcacctgaagagatgataacaattcttcaacgtgttgttgaagaatgcactacatcactcgttgctgccaggattgaagctgaagagagactaaacaaccaacgtttgcgtgaggaacaagatgctgcttacagagctgcacttgaagctgaccaggccagggaacgtgaaaggatagaggaactggaaagacgtgaaagagaggctgcagaggctgagagaaagcgcaaggaagatgaggaagctttagcaagggcagcccaagaagcagctgaaaaggaagccgctcttgcaaggaggaggcaagagaaggccatggctcttggagctgaacctgagaaaggaccaggtgttactcgggttctcataagattcccaactggagagcgcaaagagcggagattccacagttctacaaccgtcacttccctctatgactatgttgattctttagattgcttgaaagcagagaagtacagcctagtttcgaatttcccacgtgtcacatatggtccagagaagcactccctgacactggaggaagcaggcttgcatccgcaggcgagcctgtttatcgagatagaacaatga

SEQ ID NO: 6644 - protein, 472 aa, Sorghum bicolor
  misc_feature: Ceres ANNOT ID no. 6067874
  misc_feature (389)..(470): Pfam Id: UBX Pfam Desc: UBX domain
  misc_feature (5)..(470): NCBI GI: 58200405 NCBI Desc: fas-associated factor 1-like protein [capsicum annuum]
  misc_feature (1)..(470): NCBI GI: 3600032 NCBI Desc: contains similarity to tropomyosin (pfam: tropomyosin.hmm, score: 14.57) and atp synthase (pfam: atp-synt_b.hmm, score: 10.89) [arabidopsis thaliana]
  misc_feature (204)..(472): NCBI GI: 115482984 NCBI Desc: os10g0520600 [oryza sativa (japonica cultivar-group)]
  misc_feature (105)..(437): NCBI GI: 58201892 NCBI Desc: fas-associated factor-like protein [nicotiana tabacum]
  misc_feature (150)..(469): NCBI GI: 50725876 NCBI Desc: etea protein -like [oryza sativa (japonica cultivar-group)]
MAETVDDKVSYFQAVTGISDADLCTEILAAHNWDLQLAVSSITANPSPSASASTSSRGDPAPSAPLSADAEFVAPPPPPPMQLPLPPQQQQPGIAWRLVTLPFYVVSGGVGLVAGTFRLGAWVAGGVLSRSLSLLGLAGQAGSGDRLLELPPSAAEAADFVAEFAREFGAGRGPSFVAEGFADALQRAQREFKLLFVYLHSPDHPDTPAFCGGCLCAEPVAAFIDENFVAWGGSIRRTEGFKMSNSLNASRFPFCAVVMASTNQRIMLLQQVEGPKSPEEMITILQRVVEECTTSLVAARIEAEERLNNQRLREEQDAAYRAALEADQARERERIEELERREREAAEAERKRKEDEEALARAAQEAAEKEAALARRRQEKAMALGAEPEKGPGVTRVLIRFPTGERKERRFHSSTTVTSLYDYVDSLDCLKAEKYSLVSNFPRVTYGPEKHSLTLEEAGLHPQASLFIEIEQ

SEQ ID NO: 6645 - DNA, 1254 bp, Sorghum bicolor
  misc_feature: Ceres ANNOT ID no. 6067875
  misc_feature: Encodes the peptide sequence at SEQ ID NO 6646
atggagagggacgtcgtggtgtccgaccccgaggccgccgggtcctcgtccacccccgcctcctcgtcgcgctcctccttcgccgagaccagggtcatctgccgcgtgtgtcagaagcagttcgcgcagtacacttgcccccgctgcaacgcccggtactgctcgctctcgtgctacaaggggcatagtgttcaatgcactgaatccttcatgcgtgagaatgttatggatgagcttaagcagatgcaacctgaggatgaatcaaagaaaaagatgctagatattctcaagcggctccacttggaagaagagatggagtcagatggtgaagatgaaccaatgttatcagaagaacttattcaaaaagttatgtctggggaagagataaggcttgaagacctctctgattgtgaaatcaaacgatttcgtcaagctctggcctcaggtgagctcagtaagatgattgaaccgtggacaccttggtggaaaaaaccgtcagccagatcgatttcccttggcccagatggaagtcagcttatcagacaagtaaacgcagaagacactgctgtactatatccagatccaaagactgtccaagaggctagcatcaacgaaatccctgaagggccagaatctcctctcccgtcactgaaacagttaacaaggacagagccatctcctttgcttgctgtccacttggttgacattctgtacagttactgcttcacacttcggctctacaacggtgattggcactcggatcctttgggtgcttccactgtcgccctgtcaatgtcgaaagtcatgggccaggatgctaaacctgagactgtacctgaagcactcacggcctgcatcgaggagacatgctcaccagcttacaggcatactggtggtttcaggtttgcgattggactcgtggatgatatcatcaccattctctccttgggacagaatgcgcttatttgtgcactatgcgacttccatcgactcattgaagttggtaagagcatgctcaaggcggagaaagtgggcaagacggagagggcacagagctcttcgaagcttcgtagtgcagctaggaagctattcttcatgacttgctgggtccatgagcagccaaatgaggcgtggccatctttagctcgcgtcgtccaggtgcagaaagcatctctggaggagttggacaccgggaattggaaggcggatagaaagagcaaacgacagtccacggttcttattgaggagctgtag

SEQ ID NO: 6646 - protein, 417 aa, Sorghum bicolor
  misc_feature: Ceres ANNOT ID no. 6067875
  misc_feature (30)..(60): Pfam Id: zf-HIT Pfam Desc: HIT zinc finger
  misc_feature (71)..(417): NCBI GI: 42568744 NCBI Desc: zinc finger (hit type) family protein [arabidopsis thaliana]
  misc_feature (8)..(417): NCBI GI: 34861831 NCBI Desc: similar to protein c11orf5 homolog (protein fon) [rattus norvegicus]
  misc_feature (15)..(172): NCBI GI: 49257750 NCBI Desc: zinc finger, hit domain containing 2 [xenopus tropicalis]
  misc_feature (34)..(377): NCBI GI: 62898227 NCBI Desc: zinc finger, hit domain containing 2 variant [homo sapiens]
  misc_feature (34)..(377): NCBI GI: 119594758 NCBI Desc: zinc finger, hit type 2 [homo sapiens]
MERDVVVSDPEAAGSSSTPASSSRSSFAETRVICRVCQKQFAQYTCPRCNARYCSLSCYKGHSVQCTESFMRENVMDELKQMQPEDESKKKMLDILKRLHLEEEMESDGEDEPMLSEELIQKVMSGEEIRLEDLSDCEIKRFRQALASGELSKMIEPWTPWWKKPSARSISLGPDGSQLIRQVNAEDTAVLYPDPKTVQEASINEIPEGPESPLPSLKQLTRTEPSPLLAVHLVDILYSYCFTLRLYNGDWHSDPLGASTVALSMSKVMGQDAKPETVPEALTACIEETCSPAYRHTGGFRFAIGLVDDIITILSLGQNALICALCDFHRLIEVGKSMLKAEKVGKTERAQSSSKLRSAARKLFFMTCWVHEQPNEAWPSLARVVQVQKASLEELDTGNWKADRKSKRQSTVLIEEL

SEQ ID NO: 6647 - DNA, 3780 bp, Sorghum bicolor
  misc_feature: Ceres ANNOT ID no. 6067877
  misc_feature: Encodes the peptide sequence at SEQ ID NO 6648
  misc_feature: Up-regulated in root tissues in response to methyl jasmonate treatment
atgggcagcagcagcacggcggagaagttcaggttctgcattgacaggggcggcaccttcactgacatctatgccgaggtacctgggagaagagaaggctatgtcatgaagctcctctccgtcgacccgtcaaactacgacgacgcgcccatcgaagggatccggaggatcctggaggagttctccggagagaggatcccccggtcggccaagatccccaccggcaagatcgagtggatcaggatgggcaccacggtcgccaccaacgccctcctggagaggaagggcgaaaggattgcgctttgtgtgacgagggggtttagggatttgctccagattggcaaccaggctcgcccgaacatattcgacctcaaggtctcaaagccgtcgaatctttatgaggaggtggttgagatcgacgaacgagttgagctcgttcgggatggtgacagcgacagggatgggtcatctgttgaaggaatctctggggaactggtgagggtggcaaagcctgttgatgttgaagcattgaagcctctgttgaaaggtctgcttgacaaggggataagatgcttggcagtggtgttgatgcattcgtatacttatcctcatcatgaactcctggttgagaagttagctctggggatgggattcaagcatgtatcgttgtcttcatcactgacaccaatggtccgtgcagtgcctcggggcctgacggcaagtgtggacgcctatctcacaccagtcatcaaagagtacctatcgggattcatgtcgagatttgaagggggttctgaacaagtgaatgtgctatttatgcaatcagatggaggacttgcaccggagaggagattctctggccataaagcggtattgtcaggacctgcaggtggtgtggttggctactcgcagaccttgtttggacttgagacatcaaagccactgattgggtttgacatggggggtacatccacggatgtgagccgctatgatggaagctatgaacaagttctggagacacagattgctgggtcaattattcaggctccccagcttgacataaacactgtggctgctggtggtggatcaaagcttaagtttcaatttggggctttcaaggttgggccagaatctgttggggcacaccctggtccagtttgttaccgaaaaggtggtgagctagcaattaccgatgccaatttgatcctaggaactgttattcctgagtacttcccatcaatatttggtccaaatgaagatatgccccttgattatgaggctacaagaaaggcctttgaaaaacttgcagttgagatcaactctcaccgaaagagtcaggacccatcagcaaaggacatggcaattgaggagattgcacttgggtttgtcaatgtcgcaaatgagacaatgtgccggcctatacgccagctgaccgaaatgaaggggcatgatacaaagaaccatgccctcgcatgctttggtggtgctggcccacaacatgcatgcgctatggcaaggtccttgggtatgtctgaggtacttgttcaccgatattgtggaatattgagtgcatatgggatgggtcttgctgatgtcattgaagacttgcaagaaccatattctgctgtttataataccgagtcatctgcagaagcatctagaagagaagcccttttagtaaaacaggtgaaagaaaagctgatggagcagggttttggagaggagagcatcaggacagattcatacttgaatttgaggtatgagggaactgatacggccatcatggttaaacaagcagagcaaggatctggaaatgactatgccgatgagtttgaaaaattatttcagcaagagtatggcttcaaattgcaaaacaggaaaatactcatatgtgatgtgagagttcagggtgtcgctagtacaaacatcctccagcctcgtgaattgacgcagatatcaaccaaacctgtgaaagaaagttcatgcaggatttatttttcaagtgggtggcaagatactccactttacaagcttgagaatttaggttatggccatgtcttggagggtcctgcagttattatgaatgggaatagtactgtgatcatagaaaaagactgtaaggccatcattacaaagtatggtaacataaaaatagagattaatgcagctccaagcattgtatcaatatcagagaaagttgcagatgtggtccaactttctattttcaatcaccgattcatgggtatcgctgaacagatgggtcggacacttcaaagaacttcaatttccactaacataaaggaaaggctagacttctcttgtgctctctttggtccagatggtggccttgttgcaaatgcacctcatgtccctgtgcatttaggagccatgtctagtactgtgtgttggcagcttaatttttggggtgataacctccatgagggtgatgttcttgtaacaaaccatccatgttctggggggagccatcttccagacataacagttgtcacgccagtttttgatcatggaaagcttgttttttttgttgctagtcgaggtcatcatgctgagattggtggcatcacgccaggaagcatgcctcctttctcaaaatgtatctgggaggaaggtgctgccatcagagcatttaaacttgtcgaaaggggtgttttccaagaggaaggaatagtccagctgctgcagtcaccttgctctgatgaacttgctggctataagatcccaggaacacgtcggatccaagataatctttccgatctccatgctcaggttgcagcaaaccagagaggtatatcacttatcaaagaacttataaatcagtatggcttggtcactgttcaatcatatatgaaccatgttcaaaagaatgctgaggtagctgtcagagagatgctcaaaacagttgcgtctagagttgcaaaggagaatggatcatgtgttgttgaggatgaagattatatggatgatggctctgtccttcacttgaaactcacccttgatgctattaaaggtgaagctacaattgactttgagggtaccagtcctgaggtctatggcaactggaatgctcctgaagcagttacaacagctgctgtcatatactgcctacggtgcttggtggatgtcgatataccgctaaatcagggctgcctagcacctgtgaagatcctcattcctaaaggctctttcctctcaccaagtgacaaggctgctgttgttggtggcaatgtgctaacgtctcagagagtgactgatgttatcctaatggcatttcaagcttgtgcctgctctcagggctgcatgaacaatttgacctttggggacgacacctttggttactacgagaccattgggggtggatgtggagctgggccaacctgggacggcactagtggcgttcaatgtcacatgacaaacacaaggatgactgaccctgagatctttgagcagcggtaccctgttcttttgcacacatttagcatcagagagaacagtggaggttctggtttacacagaggtggtgatggccttgtgagggagattgaattccggcggcctattgttgtgagcattctatctgagagacgggtgcatgctcccaggggactaaaaggaggacgagatggagctcgtggtgcaaactatttagtcagaaaagatggtagaaagatttaccttggaggaaagaacactgtatcagttagtgctggtgacattcttcagattttcacgcccggtggtggtggctttggctctccttga

SEQ ID NO: 6648 - protein, 1259 aa, Sorghum bicolor
  misc_feature: Ceres ANNOT ID no. 6067877
  misc_feature (734)..(1257): Pfam Id: Hydantoinase_B Pfam Desc: Hydantoinase B/oxoprolinase
  misc_feature (236)..(536): Pfam Id: Hydantoinase_A Pfam Desc: Hydantoinase/oxoprolinase
  misc_feature (11)..(217): Pfam Id: Hydant_A_N Pfam Desc: Hydantoinase/oxoprolinase N-terminal region
  misc_feature (1)..(1259): NCBI GI: 21902071 NCBI Desc: similar to 5-oxoprolinase [oryza sativa (japonica cultivar-group)]
  misc_feature (9)..(1258): NCBI GI: 20856448 NCBI Desc: at5g37830/k22f20_70 [arabidopsis thaliana]
  misc_feature (1)..(1259): NCBI GI: 92896162 NCBI Desc: hydantoinase/oxoprolinase; hydantoinase b/oxoprolinase; hydantoinaseoxoprolinase, n-terminal [medicago truncatula]
  misc_feature (9)..(963): NCBI GI: 110737709 NCBI Desc: 5-oxoprolinase -like protein [arabidopsis thaliana]
  misc_feature (1)..(1259): NCBI GI: 23346557 NCBI Desc: 5-oxoprolinase (atp-hydrolysing) [mus musculus]
  misc_feature (1)..(1259): SWISSPROT Homolog: EC 3.5.2.9 5-oxoprolinase
  misc_feature: Up-regulated in root tissues in response to methyl jasmonate treatment
MGSSSTAEKFRFCIDRGGTFTDIYAEVPGRREGYVMKLLSVDPSNYDDAPIEGIRRILEEFSGERIPRSAKIPTGKIEWIRMGTTVATNALLERKGERIALCVTRGFRDLLQIGNQARPNIFDLKVSKPSNLYEEVVEIDERVELVRDGDSDRDGSSVEGISGELVRVAKPVDVEALKPLLKGLLDKGIRCLAVVLMHSYTYPHHELLVEKLALGMGFKHVSLSSSLTPMVRAVPRGLTASVDAYLTPVIKEYLSGFMSRFEGGSEQVNVLFMQSDGGLAPERRFSGHKAVLSGPAGGVVGYSQTLFGLETSKPLIGFDMGGTSTDVSRYDGSYEQVLETQIAGSIIQAPQLDINTVAAGGGSKLKFQFGAFKVGPESVGAHPGPVCYRKGGELAITDANLILGTVIPEYFPSIFGPNEDMPLDYEATRKAFEKLAVEINSHRKSQDPSAKDMAIEEIALGFVNVANETMCRPIRQLTEMKGHDTKNHALACFGGAGPQHACAMARSLGMSEVLVHRYCGILSAYGMGLADVIEDLQEPYSAVYNTESSAEASRREALLVKQVKEKLMEQGFGEESIRTDSYLNLRYEGTDTAIMVKQAEQGSGNDYADEFEKLFQQEYGFKLQNRKILICDVRVQGVASTNILQPRELTQISTKPVKESSCRIYFSSGWQDTPLYKLENLGYGHVLEGPAVIMNGNSTVIIEKDCKAIITKYGNIKIEINAAPSIVSISEKVADVVQLSIFNHRFMGIAEQMGRTLQRTSISTNIKERLDFSCALFGPDGGLVANAPHVPVHLGAMSSTVCWQLNFWGDNLHEGDVLVTNHPCSGGSHLPDITVVTPVFDHGKLVFFVASRGHHAEIGGITPGSMPPFSKCIWEEGAAIRAFKLVERGVFQEEGIVQLLQSPCSDELAGYKIPGTRRIQDNLSDLHAQVAANQRGISLIKELINQYGLVTVQSYMNHVQKNAEVAVREMLKTVASRVAKENGSCVVEDEDYMDDGSVLHLKLTLDAIKGEATIDFEGTSPEVYGNWNAPEAVTTAAVIYCLRCLVDVDIPLNQGCLAPVKILIPKGSFLSPSDKAAVVGGNVLTSQRVTDVILMAFQACACSQGCMNNLTFGDDTFGYYETIGGGCGAGPTWDGTSGVQCHMTNTRMTDPEIFEQRYPVLLHTFSIRENSGGSGLHRGGDGLVREIEFRRPIVVSILSERRVHAPRGLKGGRDGARGANYLVRKDGRKIYLGGKNTVSVSAGDILQIFTPGGGGFGSP

SEQ ID NO: 6649 - DNA, 1263 bp, Sorghum bicolor
  misc_feature: Ceres ANNOT ID no. 6067883
  misc_feature: Encodes the peptide sequence at SEQ ID NO 6650
atggcgttcgccgcaaggaggagcatcgccacccggctctctcaccacctcacccgccgcgtccatccctgcgtcccgcacgcgcttacctcccactcccacgacgagcaagcgagcccctcgccgccgctcccaccacttcacgccccgctccagcaacgttctcgagcggcccaaaccctaggcttcctccctttctcgctccacctcgcgggatcaacccgccgcagcttctcgtcctcgtcctcagcccccgcccccaacctcgaggacgcaccagccgccgaggtcgatgccgcgggcgtccttgcagatgcagcggaggcggcggcgtcagtgccggcgccgttcccgggagaggtagccgccgcggctgccgactcgttccccccggttgccgcacttcagcacattatcgacgccatccatacctttaccgggctcaactggtgggcgtgcatcgcactgacaacgcttattatccggagcgccacgatcccgttgcttgtgaaccagttgaaggccacgacgaagctaagagcaataaatccagagatggaagccattaaagaccagatgaatagtatggatccaaaatcagcgcaggagggacaagctaaaatgaaagcgctgttcaaaaaacatggtgttagtccttttactccaatgaaaggactcctgatccaagggccaatgttcatgagcttttactttgccatatcaaacatggttgagaaagtaccttcattcaaaggaggtggagcattgtggtttactgacctgacgactccagattctctttacgtgttgcctgtgttaacaggactgaccttcttggtcacagtggagcttaatttgcaagaaggaatggagggaaatcctatggccggtaaaatgaagacattttctagaggaatggcagttttgacagtcccatttacaatgaattttgctaaggcaattttctgttactggatcacatcaaacatattcaccctgttatatggtattgttatccggcggccagctgtgaggaagtggtttaatcttcctgctttggaagctcagccttcgctcacggcaaagccaatcttcaatatgtttggtggatctaaggcaataccagccgcagagtcaccggtagcaatcgcaggagcccagcaatctggtctgggccaacctgatgctgctgctcttggctataaggtaaaaaatcttgaaaagaaagtgaaatccaggggtaaatctcggaaacagaggtaa

SEQ ID NO: 6650 - protein, 420 aa, Sorghum bicolor
  misc_feature: Ceres ANNOT ID no. 6067883
  misc_feature (149)..(344): Pfam Id: 60KD_IMP Pfam Desc: 60Kd inner membrane protein
  misc_feature (1)..(420): NCBI GI: 30387505 NCBI Desc: at5g62050 [arabidopsis thaliana]
  misc_feature (23)..(417): NCBI GI: 115450311 NCBI Desc: os03g0116000 [oryza sativa (japonica cultivar-group)]
  misc_feature (99)..(355): NCBI GI: 145347471 NCBI Desc: oxa1 family transporter: 60 kd inner membrane protein oxaa-like protein [ostreococcus lucimarinus cce9901]
  misc_feature (65)..(351): NCBI GI: 119586653 NCBI Desc: oxidase (cytochrome c) assembly 1-like [homo sapiens]
  misc_feature (65)..(351): NCBI GI: 38372882 NCBI Desc: inner membrane protein oxa1l, mitochondrial precursor (oxidase assembly 1-like protein) (oxa1-like protein) (oxa1hs) (hsa)
MAFAARRSIATRLSHHLTRRVHPCVPHALTSHSHDEQASPSPPLPPLHAPLQQRSRAAQTLGFLPFSLHLAGSTRRSFSSSSSAPAPNLEDAPAAEVDAAGVLADAAEAAASVPAPFPGEVAAAAADSFPPVAALQHIIDAIHTFTGLNWWACIALTTLIIRSATIPLLVNQLKATTKLRAINPEMEAIKDQMNSMDPKSAQEGQAKMKALFKKHGVSPFTPMKGLLIQGPMFMSFYFAISNMVEKVPSFKGGGALWFTDLTTPDSLYVLPVLTGLTFLVTVELNLQEGMEGNPMAGKMKTFSRGMAVLTVPFTMNFAKAIFCYWITSNIFTLLYGIVIRRPAVRKWFNLPALEAQPSLTAKPIFNMFGGSKAIPAAESPVAIAGAQQSGLGQPDAAALGYKVKNLEKKVKSRGKSRKQR

SEQ ID NO: 6651 - DNA, 1098 bp, Sorghum bicolor
  misc_feature: Ceres ANNOT ID no. 6067884
  misc_feature: Encodes the peptide sequence at SEQ ID NO 6652
atggagcggctgctgtgggcgtcgacgcaagcgctcggctgcggcggcggcaagcgtgggaagggcgacgacgacgacgggctgctggtggacccgatgggcacggtggggcagctgggcgagtggctgtgccgggccgcgctgcagccgccgccgccgccgcgggtgtgcggctcccccggtggcccgcccgtgacggcgcgccgggtgcgcctccgcgacggccgccacctcgcctacgaggagtccggcgtgcccagggaggccgcgcgctacaggatcgtcttctcccacggcttctccggctcgcgcctcgacagcctccgcgcctcacaggaagtggcggaggagctgggcgtgtacatggtggcgttcgaccgggccgggtacggcgagagcgacccgaaccctgcccggtccgtgcggagcgcggcgctggacatggaggagctggcggacgcgctgggcctcggcgacaagttctacgccgtgggggtctccctgggctgccacgccgtgtggggcgcgctccggcacatcccgcaccggctggcgggcgccgccatgctggcgcccgtggtcaactactggtggccggggctccccgcggaggcctcggcggcggcgtacgcgcggcaggcgcggggggaccagtgggcgctgcgcgtgtcgcaccacgcgccggggctgctccactggtggatgcgtcaggggtggctgcccacctccaccgtcgtcgacaacaccacgcacctccccaacaggcgcgacgccgagacccgcgccgcgctcgccgccgacggcacgctgcggaggaagcgggacgccgccacgcagcagggcatccacgagtcctactacagggacatgacggtgatgttcggcaggtgggagttcgaccccatggcgctgccggagccgacgtgccccgtccacctgtggcagggcgacgaggacggcctcgtcccggtcgtcctgcagcgccacgtcgctggcagcctcccgtgggtgaactaccacgagctccccggcaccggacacttcctgtccgccgtccccggactcggggacaccgttctccggacactcttcggttag

SEQ ID NO: 6652 - protein, 365 aa, Sorghum bicolor
  misc_feature: Ceres ANNOT ID no. 6067884
  misc_feature (120)..(366): Pfam Id: Abhydrolase_1 Pfam Desc: alpha/beta hydrolase fold
  misc_feature (47)..(363): NCBI GI: 115487372 NCBI Desc: os12g0152100 [oryza sativa (japonica cultivar-group)]
  misc_feature (36)..(363): NCBI GI: 20161637 NCBI Desc: p0489b03.5 [oryza sativa (japonica cultivar-group)]
  misc_feature (43)..(363): NCBI GI: 115458272 NCBI Desc: os04g0412000 [oryza sativa (japonica cultivar-group)]
  misc_feature (43)..(363): NCBI GI: 116310144 NCBI Desc: h0717b12.6 [oryza sativa (indica cultivar-group)]
  misc_feature (39)..(363): NCBI GI: 15232465 NCBI Desc: hydrolase, alpha/beta fold family protein [arabidopsis thaliana]
MERLLWASTQALGCGGGKRGKGDDDDGLLVDPMGTVGQLGEWLCRAALQPPPPPRVCGSPGGPPVTARRVRLRDGRHLAYEESGVPREAARYRIVFSHGFSGSRLDSLRASQEVAEELGVYMVAFDRAGYGESDPNPARSVRSAALDMEELADALGLGDKFYAVGVSLGCHAVWGALRHIPHRLAGAAMLAPVVNYWWPGLPAEASAAAYARQARGDQWALRVSHHAPGLLHWWMRQGWLPTSTVVDNTTHLPNRRDAETRAALAADGTLRRKRDAATQQGIHESYYRDMTVMFGRWEFDPMALPEPTCPVHLWQGDEDGLVPVVLQRHVAGSLPWVNYHELPGTGHFLSAVPGLGDTVLRTLFG

SEQ ID NO: 6653 - DNA, 3162 bp, Sorghum bicolor
  misc_feature: Ceres ANNOT ID no. 6067914
  misc_feature: Encodes the peptide sequence at SEQ ID NO 6654
  misc_feature: Up-regulated in shoot tissues in response to salicylic acid treatment
atggagaacggcaacaacggcggccacccgccgccgcactacccgccgtaccaatacccgtacccgcagccgcaggctcaggcgcagctgtatccttacgggtaccagtacccgcctgcgccgccgccaccgtcgtctgccgcgccggccgcgccgtacctctctccgtctccatccttcccgagctatgcccccgccccgcccccgccgcagcagcagcagtaccactccggcccgctccaggcgtacccacccacgccgcagtaccacgcctacccgccgccgccgcatccatcgccttacggccacgggtacaacccttacccatccccgtactcatcctcctacccgagcaccaaccctagccccagccccagcccggggctttctcccagctccagcttccaccaccaacacgcctccgcggcgcccgaacccccgtcgcccgcgccctccgcgccgtcctaccccatcgaggatgtcctcgccaccatgcgcctctccgaccgtcacgactacgcgtcgtcgccctccgtctccgcgcccccgccctcgacccccttctcgggcgatggaagcagccacggcggcgggatgcaggtggtgccctatggcgcggccgccggaggctcgcagcacggaggcgggatgcagatggtgccctacggcgcggccgcgggagggtcgcagcacggcggcagcttcagggcatcactcaaggtggtgctgctccacggcagcctcgacatctgggtgcacgacgcccggcacttgcctaacaaggacatgttctccaagagtgtagctgagttcctcggcccgcgcatcaccagcgctgttggcagcaagatgtccagcgcgaacatgaccagcgacccctatgtcaccgtccaggtctcctatgccaccgtcgcgcggacctatgtcatccccaactgtgagaatccagtctggtcgcagaacttcttggtgccagttgggcatgaggctgccgaagtcgagtttgttgtcaaggacagtgatgtcttcggcgctcagatcattggtgtggtgtccattcccgctgagaagcttctgacaggggccaggattcagggtgtctaccccgttcttgagcccaatggcaagccatgtgctccaggagctgtactacatttgtcgatacagtacatccccgtcgctcagctcacaatgtaccaccatggcgtcgttgctggtccagacagtattggcgtacctcatacttacttcccgcttaggcgtggcatgagagtgaccctgtatcaagacgctcatgtgcctgatggttgtctcccagacatatggcttgacaatgggctgcgctaccagcacgggcagtgctggcgtgatatctatgatgccatatgtcaggcaaggaagttgatttacatcgtggggtggtctgttttccacacaatccacctcgtgagagatggcactcaagctccatcacttggggacctgttgaagatgaagtcacaagaaggggtgcgtgtgctgctgcttgtttgggatgatcctacatcaaggagcattcttggatataagttggatggtttcatgggcacacgagatgaggagacacgcagatttttcaagcattcttcagtccaagtgttgctgtgcccacgatccgctgggaaacgccacagctgggtgaaacagcaggaaacaggaaccatttttactcatcatcagaaaacagttattgtggatgctgatgctggcaactataggagaaagatagttgcttttgttggaggccttgatttatgtggcgggagatatgatacaccttggcatcctctgtttcggactcttcagaacgagcacaaggaggattattacaatccaaactttaatacagttgatgctcgtggtccaagggaaccttggcatgacttgcattctaagatcgatggtccagctgcttatgatgttctacaaaacttccaggagcgttggttaaaagcggccaaacgccatgggattaaaaagttggcaaaatcgtatgatgatgctctgctcagtattgaaagaataccagatattataaacataaatgatgcaatatattttagcgacaatgatccagagacatggcatgttcaggtgtttcggtctattgattcaaactctgccaagggatttccaaaggatccacgagcagcaaccatgaagaatcttgtctgtggaaagaatgtacttattgacatgagcatacatacggcttatgtccatgctatccgggcagcccaacattatatttatattgagaatcagtacttcattggttcttcatttaattgggattcaaacaaggatttaggggctaacaatttaattccaattgaaattgctctcaaaattgcaaacaagattaaggcaaatgaaaggttttctgcatacatagtggttcctatgtggcctgagggtaatccaactggtgctgcaacacaacgaattctttactggcagaacaaaaccatgcaaatgatgtacgagacaatatacagggccttgaaagaagtaggcctggatgatatgtatgagcctcaggattatttaaacttcttctgtcttggcaaccgtgaagttgatgacagcactagcaattcaaatgcttcaaatacagcaaataatcctcaggaacatgctaggaaaaataggagattcatggtctatgtacattcaaaaggcatgattgtggatgatgagtatgttatcgttggatcggctaatattaaccagagatccatggaaggaataagagacacagagattgcgatgggagcgtatcagccacaatatacatgggctaataagctttctgccccacgtggacagatttatggctacagaatgtccttatgggctgagcatattggaagcattgaggaagacttccactatccggagagcctggaatgcatgaggcgtgtacggcatcttggggaagagaactggaagcagtttgttgccgatgaggtgacagagatgagaggccacctcatgaagtatccagtaagcgttgaccgtaaaggcaaggtgaaaccactaccaggatgcacaacattcccagatttaggtgggaacatctgtggctcatttacagccatccaggagaacctcacaatataa

SEQ ID NO: 6654 - protein, 1053 aa, Sorghum bicolor
  misc_feature: Ceres ANNOT ID no. 6067914
  misc_feature (567)..(602): Pfam Id: PLDc Pfam Desc: Phospholipase D Active site motif
  misc_feature (899)..(926): Pfam Id: PLDc Pfam Desc: Phospholipase D Active site motif
  misc_feature (248)..(352): Pfam Id: C2 Pfam Desc: C2 domain
  misc_feature (217)..(1053): NCBI GI: 38153701 NCBI Desc: phospholipase d [oryza sativa]
  misc_feature (211)..(1053): NCBI GI: 18765900 NCBI Desc: phospholipase d beta 2 [oryza sativa]
  misc_feature (216)..(1053): NCBI GI: 115450353 NCBI Desc: os03g0119100 [oryza sativa (japonica cultivar-group)]
  misc_feature (9)..(1053): NCBI GI: 30688872 NCBI Desc: phospholipase d beta 1 / pld beta 1 (pldbeta1) [arabidopsis thaliana]
  misc_feature (236)..(1053): NCBI GI: 20198318 NCBI Desc: phospholipase d [arabidopsis thaliana]
  misc_feature (152)..(1053): SWISSPROT Homolog: EC 3.1.4.4 Phospholipase D beta 1
  misc_feature: Up-regulated in shoot tissues in response to salicylic acid treatment
MENGNNGGHPPPHYPPYQYPYPQPQAQAQLYPYGYQYPPAPPPPSSAAPAAPYLSPSPSFPSYAPAPPPPQQQQYHSGPLQAYPPTPQYHAYPPPPHPSPYGHGYNPYPSPYSSSYPSTNPSPSPSPGLSPSSSFHHQHASAAPEPPSPAPSAPSYPIEDVLATMRLSDRHDYASSPSVSAPPPSTPFSGDGSSHGGGMQVVPYGAAAGGSQHGGGMQMVPYGAAAGGSQHGGSFRASLKVVLLHGSLDIWVHDARHLPNKDMFSKSVAEFLGPRITSAVGSKMSSANMTSDPYVTVQVSYATVARTYVIPNCENPVWSQNFLVPVGHEAAEVEFVVKDSDVFGAQIIGVVSIPAEKLLTGARIQGVYPVLEPNGKPCAPGAVLHLSIQYIPVAQLTMYHHGVVAGPDSIGVPHTYFPLRRGMRVTLYQDAHVPDGCLPDIWLDNGLRYQHGQCWRDIYDAICQARKLIYIVGWSVFHTIHLVRDGTQAPSLGDLLKMKSQEGVRVLLLVWDDPTSRSILGYKLDGFMGTRDEETRRFFKHSSVQVLLCPRSAGKRHSWVKQQETGTIFTHHQKTVIVDADAGNYRRKIVAFVGGLDLCGGRYDTPWHPLFRTLQNEHKEDYYNPNFNTVDARGPREPWHDLHSKIDGPAAYDVLQNFQERWLKAAKRHGIKKLAKSYDDALLSIERIPDIININDAIYFSDNDPETWHVQVFRSIDSNSAKGFPKDPRAATMKNLVCGKNVLIDMSIHTAYVHAIRAAQHYIYIENQYFIGSSFNWDSNKDLGANNLIPIEIALKIANKIKANERFSAYIVVPMWPEGNPTGAATQRILYWQNKTMQMMYETIYRALKEVGLDDMYEPQDYLNFFCLGNREVDDSTSNSNASNTANNPQEHARKNRRFMVYVHSKGMIVDDEYVIVGSANINQRSMEGIRDTEIAMGAYQPQYTWANKLSAPRGQIYGYRMSLWAEHIGSIEEDFHYPESLECMRRVRHLGEENWKQFVADEVTEMRGHLMKYPVSVDRKGKVKPLPGCTTFPDLGGNICGSFTAIQENLTI

SEQ ID NO: 6655 - DNA, 2970 bp, Sorghum bicolor
  misc_feature: Ceres ANNOT ID no. 6067946
  misc_feature: Encodes the peptide sequence at SEQ ID NO 6656
atggccatccaccgcagcaatctctcttcctacttcaagatctcaaggatctggcaccaattgaagcaatatggcgccaaatccttcgcttcctcatctccaacgagtgagattgcgcacctgaaggtcctcaccgtgctcctgcgcgacacatgttcgctgaaatgcctcagagagatccacgcgcgtctcgccgtcgcgggtgcgatccaggacagattcgtcgtcacaggcctcgttgaaagatatgtttcttttgggaagccggcgtctgcggcgttgctgtttgccgaagcctaccgcggccgccccgctgtgtactcactgaatcttgtggtccggtgcttctcggaccatggtttccaccgagagcttcttgatctttaccgggggctatgtggctttggctcggataacttcaccttccctccggtcatcagggcgtgcacggctgcctcttgccttcagctggggaggcaggtgcactgcagggttctgcgtacagggcatgggagtaatgttggtgtgcagactgcgctccttgacatgtatgctaaggctggccagattgatgtgtcaaggagagtctttgactgcatggtgctgagggacttgatttcttggaatgctatggtctcagggtactcagtcaatggatgcttccgagaagctgttgagacgttgcaggagatgcagcagtgtggcatgagtccgaatgcaagcactcttgttggcatagttggcatgtgtggaagtgctggagacagggttgctggtgattcgctgcatgcatttgcactgaaaggtggaacgattgatgatgaatcccttacatctgcattaatctcaatgtatgctgcatttgatgatctttcttcatctcgactggtgtttgatctgcaacctgtgaaagatttggtatctttcaattccatgatatcagcatacatgcagcacagcaattggaaggaagcttttgaggtcttcagattgatgcattgtgcaggcgtagggcctaacctgatcacattggtgtctgtccttccttcttgcagtgacttattatttggtataaaccatggggagtctgtgcatggcatgataatcaagcttggccttgcagagcaggtttctgttgtcagtgctcttgtttccatgtattcgaagcttgggaaattagactcatcgtcgctccttttctgttgttttaccgagaaaaacaatatcttgtggaactctatgatttctggatacctcgtgaataatgagtggaacatggctcttgatgcgttctgcaagatgcaaattgcgggtgttgctccagatgcaacaactgtcattaatgtaatatctggatgtagatacacaaaagatttgcacgtggcaaagtcaatacatgcatatgctgttagaaacagatttgaatcatatcagagcgttatgaatgcactcctagctatgtacgccgactgcggagatatatcaacttcctatacattattccagaaaatggaagtgcggatgttgatatcttggaacactatgatatctggttttgctgaaattggagattcagagacttctctaacattattctgccagatgttccatgaagaagtgtggtttgatctagttactctgattggtcttatcagcagcctttcagtgtctgaggatgccatagttggagaatcagttcattctttggcaattaaaagtggatgtatttcagatgtatctcttactaatgccctcattaccatgtacgccaactgtggtattgttgaagcaggtcagcaactttttaacagtttctgttctaggaatacaatcacttacaatgctctgatgagtggatatcgcaaaaacaatgtatctgagaagatattgcctttatttacccaaatggtcaagaatgacgagaaaccgaatcttgtaaccttactaaatttattacctgtttgtcagagccagttgcaggggaagtgtatacacagctatgcagtacgaaatttcaccaggctggaaacacccctcttcacatcagccatgggaatgtatagtaggttcaacaatatagaatactgcagaacaattttcagtttggtcagtgcaagaaaccttatagtatggaatgccttcttatctgcatgtgttcaatgcaagcaggctgatatggtagttgattactttaagcatatgctcttccttaatgtcagacctgatgaagtaaccatgctggcactcatctcagcatgttcacagcttggaaatgcagattttgctgcatgtattatggctgtcatacttcagaagggctttagcatgaacattttggttctcaatgctcttattgacacacattcgaggtgcggaagcatatcatttgcaagggagctctttgatagctcagtggagaaagattcagtcacttggggtgcaatgatcaacgcatacagtatgcatgggaatggtgaggctgcccttgatcttttctcaatgatgatagattcaggagtggatccagatgatataacttttgttagtatattatcggcctgcagtcataatggtctcgtagagcaaggaagaacattgttcaaatcgctacaggcagaccatggcattacaccacgaatggagcattatgcatgtatggtggatctattgggccgaactggccacttggatgaagcatatgatattgttaggtcaatgccattcacgccatcagataacttgcttgaatcattgcttggagcatgcagattccatggtaactataaaattggtgagtctgtaggaaaattactcatcaaatctgagtatggcaagtcaagatcttatgttatgctctcaaacatatatgcttctgctggcaaatggagtgattgtgagcagctgagattggacatggaagcaaaaggattgagaaaaaatgtgggggttagctttattgggatgacatag

SEQ ID NO: 6656 - protein, 989 aa, Sorghum bicolor
  misc_feature: Ceres ANNOT ID no. 6067946
  misc_feature (206)..(240): Pfam Id: PPR Pfam Desc: PPR repeat
  misc_feature (307)..(341): Pfam Id: PPR Pfam Desc: PPR repeat
  misc_feature (409)..(443): Pfam Id: PPR Pfam Desc: PPR repeat
  misc_feature (510)..(544): Pfam Id: PPR Pfam Desc: PPR repeat
  misc_feature (611)..(645): Pfam Id: PPR Pfam Desc: PPR repeat
  misc_feature (709)..(743): Pfam Id: PPR Pfam Desc: PPR repeat
  misc_feature (810)..(844): Pfam Id: PPR Pfam Desc: PPR repeat
  misc_feature (46)..(986): NCBI GI: 78183583 NCBI Desc: ppr1106-17 [physcomitrella patens]
  misc_feature (237)..(989): NCBI GI: 38423978 NCBI Desc: ppr-repeat protein-like [oryza sativa (japonica cultivar-group)]
  misc_feature (118)..(986): NCBI GI: 42566761 NCBI Desc: pentatricopeptide (ppr) repeat-containing protein [arabidopsis thaliana]
  misc_feature (268)..(986): NCBI GI: 32482936 NCBI Desc: osjnbb0072m01.1 [oryza sativa (japonica cultivar-group)]
  misc_feature (199)..(986): NCBI GI: 54695180 NCBI Desc: ppr986-12 [physcomitrella patens]
MAIHRSNLSSYFKISRIWHQLKQYGAKSFASSSPTSEIAHLKVLTVLLRDTCSLKCLREIHARLAVAGAIQDRFVVTGLVERYVSFGKPASAALLFAEAYRGRPAVYSLNLVVRCFSDHGFHRELLDLYRGLCGFGSDNFTFPPVIRACTAASCLQLGRQVHCRVLRTGHGSNVGVQTALLDMYAKAGQIDVSRRVFDCMVLRDLISWNAMVSGYSVNGCFREAVETLQEMQQCGMSPNASTLVGIVGMCGSAGDRVAGDSLHAFALKGGTIDDESLTSALISMYAAFDDLSSSRLVFDLQPVKDLVSFNSMISAYMQHSNWKEAFEVFRLMHCAGVGPNLITLVSVLPSCSDLLFGINHGESVHGMIIKLGLAEQVSVVSALVSMYSKLGKLDSSSLLFCCFTEKNNILWNSMISGYLVNNEWNMALDAFCKMQIAGVAPDATTVINVISGCRYTKDLHVAKSIHAYAVRNRFESYQSVMNALLAMYADCGDISTSYTLFQKMEVRMLISWNTMISGFAEIGDSETSLTLFCQMFHEEVWFDLVTLIGLISSLSVSEDAIVGESVHSLAIKSGCISDVSLTNALITMYANCGIVEAGQQLFNSFCSRNTITYNALMSGYRKNNVSEKILPLFTQMVKNDEKPNLVTLLNLLPVCQSQLQGKCIHSYAVRNFTRLETPLFTSAMGMYSRFNNIEYCRTIFSLVSARNLIVWNAFLSACVQCKQADMVVDYFKHMLFLNVRPDEVTMLALISACSQLGNADFAACIMAVILQKGFSMNILVLNALIDTHSRCGSISFARELFDSSVEKDSVTWGAMINAYSMHGNGEAALDLFSMMIDSGVDPDDITFVSILSACSHNGLVEQGRTLFKSLQADHGITPRMEHYACMVDLLGRTGHLDEAYDIVRSMPFTPSDNLLESLLGACRFHGNYKIGESVGKLLIKSEYGKSRSYVMLSNIYASAGKWSDCEQLRLDMEAKGLRKNVGVSFIGMT

SEQ ID NO: 6657 - DNA, 975 bp, Sorghum bicolor
  misc_feature: Ceres ANNOT ID no. 6067965
  misc_feature: Encodes the peptide sequence at SEQ ID NO 6658
atgtgtggtggtgcgatcctcgccgagctcatcccgagcacgccggctcgccgcggtggcggtggcggtggcgcggcgtggcccggcggcaagggcagccagaggaaggccgacgacttcgaggccgcgttccgggagttccacgaggactctgacgaggacgaggagatgacggaggtggtggagagcaagcccgccttcatcttcagcgccccgtcgtccccagcgacgaagcccagggcggcgcgccaggagcagccgatccggcgccggaaggccgcgcagcagtacaggggcgtccggcgccgcccgtggggcaagtgggccgccgagatccgcgaccccgtcaagggcgtccgcgtctggctcggcaccttcccctccgccgaggccgccgcgctcgcctacgaccacgccgcgctcgacgtccgcggacccagggccaagctcaacttcccctcctcctccgccgccgccgctggggccccagccagccgcaagcgcgcccgcgcctccgacgccgccttcatcgacctcgtcgaccaagaggaacaagagcagctcacggcggcggcgacgacggccttgaagcacgaggccgccgaagaagcagccggcgagagctccggtgcactcccggacttctcgtggcagggcgtgctgtcggcgtacgacgagtcccccgccgtcgacgtggaggccggccagagcggcgataagaagcggccgaggaccgagccggagagcaccgaagacgaggcgtcgccacgggcctcctccggctccgagccggacgcgctgttcgacgcgctcctcttcggcgaccagttcgccttcttcgacgccggcgcgtacgagtcactggacagcctgttcagcgcggacgccgtgcagagcaacgcggcggcggaccagggcatgccgctgtggagcttcgatgacggctgcctcgtcgaggacaacctgtcgttttga

SEQ ID NO: 6658 - protein, 324 aa, Sorghum bicolor
  misc_feature: Ceres ANNOT ID no. 6067965
  misc_feature (95)..(146): Pfam Id: AP2 Pfam Desc: AP2 domain
  misc_feature (1)..(324): NCBI GI: 56567587 NCBI Desc: bth-induced erf transcriptional factor 4 [oryza sativa (indica cultivar-group)]
  misc_feature (34)..(321): NCBI GI: 60100224 NCBI Desc: ethylene-responsive element binding protein 2 [triticum aestivum]
  misc_feature (1)..(160): NCBI GI: 62526569 NCBI Desc: ethylene response factor [manihot esculenta]
  misc_feature (46)..(160): NCBI GI: 140067127 NCBI Desc: pathogenesis-related transcriptional factor and erf [medicago truncatula]
  misc_feature (38)..(172): NCBI GI: 30961941 NCBI Desc: callus-expressing factor [nicotiana tabacum]
  misc_feature: The sequence is a functional homolog of SEQ ID NO 503 in the 10/374,780US patent application
  misc_feature: Useful for making plants with altered Lignin content
  misc_feature: Useful for making plants with altered alkaloid content
  misc_feature: Useful for making plants with modulated growth and phenotype characteristics
  misc_feature: Functional homolog of the protein sequence given in SEQ ID NO 12955
  misc_feature: Functional homolog of the protein sequence given in SEQ ID NO 12996
  misc_feature: The sequence is a functional homolog of SEQ ID NO 503 in the 20060162006 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO. 274 in the 11/188,298 US application
MCGGAILAELIPSTPARRGGGGGGAAWPGGKGSQRKADDFEAAFREFHEDSDEDEEMTEVVESKPAFIFSAPSSPATKPRAARQEQPIRRRKAAQQYRGVRRRPWGKWAAEIRDPVKGVRVWLGTFPSAEAAALAYDHAALDVRGPRAKLNFPSSSAAAAGAPASRKRARASDAAFIDLVDQEEQEQLTAAATTALKHEAAEEAAGESSGALPDFSWQGVLSAYDESPAVDVEAGQSGDKKRPRTEPESTEDEASPRASSGSEPDALFDALLFGDQFAFFDAGAYESLDSLFSADAVQSNAAADQGMPLWSFDDGCLVEDNLSF

SEQ ID NO: 6659 - DNA, 924 bp, Sorghum bicolor
  misc_feature: Ceres ANNOT ID no. 6067970
  misc_feature: Encodes the peptide sequence at SEQ ID NO 6660
atgtgcgggggagccatccttgccgaactcatccccgcgcgggtgcaccgcccgctgacggcctccacgctctggccagcggccggcctgcgcgggaccatcaccggcggcaagcggaaggccgatgatgacttcgatgacttcgaggacttcgagaccgagttccagcttttcgacgacaaggagttcgacttcgacgacgaccaggagccgtctcccccagcttcgcctaaggccggcggctgcgcccgcaagccgaaggctgccattgctcctcctcctgctgctgctggtgcctccacttccacgaatccgacgaccccacgcaacaagaagtacaggggcgtccggcgccgccagtcaggcaggtgggccgccgagatcaggaacccgcagctggggcgtcgcgcctggctcggcacgtaccacacccccgaggaggccgcccaggcgtacgaccgcgaggcccgccggatccgcgggaagagggcgcggctcaacttccccctcatcccgcaccagggtcccgcgcccgcccccgcccccgcgcccgctcccgcccccgcgcccacgccgacgccgacgccgacgccggtggccatcgatctcaacttgccgcccgcctccgacgacctcgacgacccggcttcggctggtgacggcgacggcaagacgggtgctgacggagatgcagagatggccggcgagagcacgctagtgcgggtccaggaactgatcgcgcagggacctcgcgacgagcggctggtggcgaggatcgtgcctgagctgatgaggcacggcagcaggggcgaggctacagcggccgacttcagccgtcagatggaggagatcgctgccttgcggagggacctggagacacgcgagaggcagcttgttgagctggtttcccaagtgcttcgttga

SEQ ID NO: 6660 - protein, 307 aa, Sorghum bicolor
  misc_feature: Ceres ANNOT ID no. 6067970
  misc_feature (111)..(162): Pfam Id: AP2 Pfam Desc: AP2 domain
  misc_feature (1)..(307): NCBI GI: 18369751 NCBI Desc: ethylene responsive protein [oryza sativa]
  misc_feature (1)..(204): NCBI GI: 87201358 NCBI Desc: ethylene-responsive element binding protein erf2 [gossypium hirsutum]
  misc_feature (1)..(199): NCBI GI: 145325427 NCBI Desc: rap2.12 [arabidopsis thaliana]
  misc_feature (1)..(206): NCBI GI: 62526569 NCBI Desc: ethylene response factor [manihot esculenta]
  misc_feature (1)..(199): NCBI GI: 79319902 NCBI Desc: rap2.12; dna binding / transcription factor [arabidopsis thaliana]
  misc_feature: Useful for making plants with altered terpenoid content
  misc_feature: Functional homolog of the protein sequence given in SEQ ID NO 13188
  misc_feature: The sequence is a functional homolog of SEQ ID NO. 274 in the 11/188,298 US application
MCGGAILAELIPARVHRPLTASTLWPAAGLRGTITGGKRKADDDFDDFEDFETEFQLFDDKEFDFDDDQEPSPPASPKAGGCARKPKAAIAPPPAAAGASTSTNPTTPRNKKYRGVRRRQSGRWAAEIRNPQLGRRAWLGTYHTPEEAAQAYDREARRIRGKRARLNFPLIPHQGPAPAPAPAPAPAPAPTPTPTPTPVAIDLNLPPASDDLDDPASAGDGDGKTGADGDAEMAGESTLVRVQELIAQGPRDERLVARIVPELMRHGSRGEATAADFSRQMEEIAALRRDLETRERQLVELVSQVLR

SEQ ID NO: 6661 - DNA, 2325 bp, Sorghum bicolor
  misc_feature: Ceres ANNOT ID no. 6067975
  misc_feature: Encodes the peptide sequence at SEQ ID NO 6662
  misc_feature: Up-regulated in root tissues in response to methyl jasmonate treatment
atggaggctatgacgggtggcaaattccttgaaaagtttcggctctacgaaaccagatcgaaattttatcttattggaagagacaagagcagaatacactggagggtgctaaaaattgatcggttggagtccactgagctgggtgtcgaggaggatccaactatttacacggaggatgaatgccaagaactgctttgccggattcatgtggggaacatgttgactggtggactgaaatttgtcacaaaatgttacggaatagttggttttgtaaagtttcttggtccttattacatggttataataaccaggagaaggaaaattggcacaatatgtggccatgaaatttactccgttggcaagagcgaaatgatcgcaattccaagtgttatagtctggcccaacgtggcttattctagggatgagaacaggtataagcgcctgctttgttcagttgatctttcgaaggatttcttcttcagctactcttacaacatcatgcgcagccttcagaagaacatatccgagaagaatactgggcaggttgtttatgaaacaatgtgtgtatggaatgaatttctgacgagagcaattcggaatcatctcaagaatacctgttggactgttgccttagtccatggattttttaaacagtcgaagctctctgtatctggcaaggatttttggttgacccttatagctaggcgctcgcgacattttgctggaaccagattcttgaaacgtggagttaatgaaaagggcagggtagccaatgatgttgagactgaacagattgtttttgaagacacatctgatggaatcccaactcagatagcttctgttgtacaacatagaggatcgatacctcttgtctggtttcaggagacttcaaggcttaatattagaccagatattatattaaaacctgatgtggactacaaggcgactcgccttcattttgagaaccttgcacttagatatgggaatccaataatcatcttgaacttaataaagacccgcgagaagaagccccgtgaatctctgctccgtgcagaatttgcaaaggctatccattacattaacaagagcctacctgatgacaagcgtctaaaatttttacacatggatctgagtaagctttctcgaaggaaaggaaccaatgtgcttgcactgttgaacaaggtggcatcagatgtgttggatctaactgaattcctccactgcgaaataagtacatcaacaaaacctgatgacacctcaagaccacttgatgacagaagtagcagagatcaaactgaatgtgcagctaagttggcacctcttttattacagaagggtgtcctcaggacaaattgcatagactgcttggatcgcacaaatgttgcacaatttgcatatggtttagttgctttagggcgtcaacttcatgtattggggcttattgaagcacagaaaattgaattgcatgatcctctggctgatgatctgatggatttctatgaacggatgggtgatacattagctattcagtatggtggttctgctgctcacaacaagatcttctgtgagcaaaggggccaatggaaggcagcaacccaatctcaggagttccttcgaacccttcaacgctactacaataatgcctacactgatcacgagaagcaggatgctataaacatgttcttaggtcatttccaacctcagcaagggaaacctgcattgtggaagctggactcagatcagcattacaacattgggaggcaaggaactttaaaagaagagattggaagatcattcataaagaggtcgctatcagatggtaacatattgttggagaacagcttgcctataactaactgtaacaatgaaacaaacagcacagaattgctcccaatgcaacagctggatgatattagagaaccttctgattctgcgccagagatctccatatgcgaacctaacccgtgctccagtatgaactatggcacagtgcctggaagacactccatgtcagaagagcggcagagttatttgaaaagattaggttaccctgaattgcattcttcaaatttccttgaccttgatttgttgtcatcttcagggaattcgtgtgatgaggaagtttttgagaggtcatcactgatcaattcacctatggatgtgatcagtgttgaatcatctacgtcatacagtgaacaaggacacatagatgagggcagggatgacacagatctttcccgttctagcagccagctctcagacgttcgggactattctgatcgctttgcgcactgggtcgcaaatggaggcatgctttgctactag

SEQ ID NO: 6662 - protein, 774 aa, Sorghum bicolor
  misc_feature: Ceres ANNOT ID no. 6067975
  misc_feature (84)..(389): Pfam Id: Syja_N Pfam Desc: SacI homology domain
  misc_feature (2)..(435): NCBI GI: 31415721 NCBI Desc: sac domain protein 2 [arabidopsis thaliana]
  misc_feature (2)..(430): NCBI GI: 31415723 NCBI Desc: sac domain protein 3 [arabidopsis thaliana]
  misc_feature (10)..(415): NCBI GI: 31415725 NCBI Desc: sac domain protein 4 [arabidopsis thaliana]
  misc_feature (145)..(417): NCBI GI: 140067122 NCBI Desc: synaptojanin, n-terminal [medicago truncatula]
  misc_feature (2)..(430): NCBI GI: 20453210 NCBI Desc: at3g43220/f7k15_70 [arabidopsis thaliana]
  misc_feature: Up-regulated in root tissues in response to methyl jasmonate treatment
MEAMTGGKFLEKFRLYETRSKFYLIGRDKSRIHWRVLKIDRLESTELGVEEDPTIYTEDECQELLCRIHVGNMLTGGLKFVTKCYGIVGFVKFLGPYYMVIITRRRKIGTICGHEIYSVGKSEMIAIPSVIVWPNVAYSRDENRYKRLLCSVDLSKDFFFSYSYNIMRSLQKNISEKNTGQVVYETMCVWNEFLTRAIRNHLKNTCWTVALVHGFFKQSKLSVSGKDFWLTLIARRSRHFAGTRFLKRGVNEKGRVANDVETEQIVFEDTSDGIPTQIASVVQHRGSIPLVWFQETSRLNIRPDIILKPDVDYKATRLHFENLALRYGNPIIILNLIKTREKKPRESLLRAEFAKAIHYINKSLPDDKRLKFLHMDLSKLSRRKGTNVLALLNKVASDVLDLTEFLHCEISTSTKPDDTSRPLDDRSSRDQTECAAKLAPLLLQKGVLRTNCIDCLDRTNVAQFAYGLVALGRQLHVLGLIEAQKIELHDPLADDLMDFYERMGDTLAIQYGGSAAHNKIFCEQRGQWKAATQSQEFLRTLQRYYNNAYTDHEKQDAINMFLGHFQPQQGKPALWKLDSDQHYNIGRQGTLKEEIGRSFIKRSLSDGNILLENSLPITNCNNETNSTELLPMQQLDDIREPSDSAPEISICEPNPCSSMNYGTVPGRHSMSEERQSYLKRLGYPELHSSNFLDLDLLSSSGNSCDEEVFERSSLINSPMDVISVESSTSYSEQGHIDEGRDDTDLSRSSSQLSDVRDYSDRFAHWVANGGMLCY

SEQ ID NO: 6663 - DNA, 2625 bp, Sorghum bicolor
  misc_feature: Ceres ANNOT ID no. 6067994
  misc_feature: Encodes the peptide sequence at SEQ ID NO 6664
atgtcacccgcggcagcctctgcatcacccgacgaccgcatccgaaactacgaagacttcgtgcgggtgcacgcgtacctgctggccgcggccggcatcccgccgtcgctgcaccagaggctgtaccgcaagctcgcggacgaggtgttcgacggcggggaggtctttgccgtcgagccgtgcgaggacgggaggcagcggcgcctcgtgctctccgccgatgagtctctgcgaaaggagtccgatgtcttcctcgtcgaccacgcgtggtccttccgccttcctgatgcgctcaagcagttgcgggaagtgccaggactggctgaaaggatggcagcattgatgtgtgtggatttggaccgcaggatagaaactgaagaggcagatgagaaggatggtcacgagagtgggagcttggagcatgtattgcaggtagtcgagaaagagaaggctagagttcaggagaggggaagggattctgcggcatggctggaacttgaagaactcggaattgatgatgacatgctagtagccttggatctatctgcaaaatttccgaatctggtagctctgaacctatggggaaacaagctgcaggatctagagaaagttatgcaagaaatcaggaagtgtgcaaagctaaaggcactgtggttgaacgagaatcctgttcttggcaaaagtattgacaaagctattctagatggtctctctggattggaaatatacaattcacattttacgagtaaagctggagagtgggcattaggtttttgtgcagacattgttggagcagataatccctgttcttctgtggaaagcacactgttagggagtattgagattattgacctttctgatagatgcattcacaagctaccagaggtattatctcctagtaatttcccatctctgtcaaaattgaacatccgtggtaatcctctggatcaaatttctggcgatgatctcttaaagctatttggtggattcacaaagttacaagagttggaggtcgacattcctggccctctgggaaacagcgcaatctccattcttgagtctctccctaatttatctttgctaaatggtgtggattcctcaagtataatagagagtgggaagcatatagttgactctgcacttgaaccacggcttccagaatggtcacctgaagaaccccttgctgaaagagttattggtgcaatgtggttgtatcttatgacataccggcttgctgatgaggaaaagattgatgaaacacctgtttggtatgtcatggacgagttgggctcagccatgcgccacagtgattatgcaaacttcagaatagctccattcttgttcatgccagaagggaaactagacactgctataagttacacaattctgtggcccactcatgatgttcatactggagaagaatgtacccgtgatttcttgtttggtattggcgaggacaaacagcgttcggctaggcttacagcttggttccgcacacctgagaactactttattcaggaattcaggaggtaccaggaacaacttcaatcaaatagcatttgttcttcgacaaaaatagaagagacgccctctaccaaaagtatacgtccaagtgatggtcgtgcacttcgagtatatactgacatacctcatgtagaggagtttttaacgcggccagagtttgttctcacaactgatccaaaggaggctgacattatctgggtaagcatgcaagtggattcagaagtaaagaaagctgtagggctcacagaccaacaatacacaaatcaatttccttttgaagcttgccttgtcatgaagcaccatcttgcggagaccatccacaaggcttggggttcacctgaatggcttcaacctacatataacctagagacccatttgtctccacttattggtgattattttgtgaggaaacgagatggcatggacaatttatggatcatgaagccttggaacatggcgagaacaatcgataccacagttactggtgatttgtctgctattatcagacttatggagacaggccccaagatatgccaaaaatatattgaacgccctgcacttttccaaggaaggaagtttgatcttcggtacattgttttggtccgtagtatccgccctttggaaatatttctatctgatgttttctgggttaggttagcaaacaatcagtacactttggagaagactagcttttttgagtatgagacccatttcactgtgatgaattatattggaaggatgaaacatatgaatacaccagagtttgtcaaggagtttgagaaggagcaccaagttaaatggctggacatccatgaaagtatacggtctacgatacgttgtgtctttgagtcagccgcagctgttcatcctgagatgcagaacccattctccagggccatgtatggtgtagatgttatgcttgataacagattcgaaccaaagattctagaggtgacatactgtccggactgcgggagggcgtgcaaatatgacacgcaagctctggtagggagccagggtacaatcagaggccgtgattttttcaacgccgtgtttggctgcctctttcttgacgagcaaacaaatgtatcgcccttgtaa

SEQ ID NO: 6664 - protein, 874 aa, Sorghum bicolor
  misc_feature: Ceres ANNOT ID no. 6067994
  misc_feature (581)..(871): Pfam Id: TTL Pfam Desc: Tubulin-tyrosine ligase family
  misc_feature (187)..(868): NCBI GI: 89301973 NCBI Desc: tubulin-tyrosine ligase family protein [tetrahymena thermophila sb210]
  misc_feature (130)..(838): NCBI GI: 89288254 NCBI Desc: tubulin-tyrosine ligase family protein [tetrahymena thermophila sb210]
  misc_feature (390)..(868): NCBI GI: 116128387 NCBI Desc: ensangp00000013381 [anopheles gambiae str. pest]
  misc_feature (396)..(872): NCBI GI: 24586383 NCBI Desc: cg1550-pa [drosophila melanogaster]
  misc_feature (392)..(870): NCBI GI: 125807249 NCBI Desc: ga13769-pa [drosophila pseudoobscura]
MSPAAASASPDDRIRNYEDFVRVHAYLLAAAGIPPSLHQRLYRKLADEVFDGGEVFAVEPCEDGRQRRLVLSADESLRKESDVFLVDHAWSFRLPDALKQLREVPGLAERMAALMCVDLDRRIETEEADEKDGHESGSLEHVLQVVEKEKARVQERGRDSAAWLELEELGIDDDMLVALDLSAKFPNLVALNLWGNKLQDLEKVMQEIRKCAKLKALWLNENPVLGKSIDKAILDGLSGLEIYNSHFTSKAGEWALGFCADIVGADNPCSSVESTLLGSIEIIDLSDRCIHKLPEVLSPSNFPSLSKLNIRGNPLDQISGDDLLKLFGGFTKLQELEVDIPGPLGNSAISILESLPNLSLLNGVDSSSIIESGKHIVDSALEPRLPEWSPEEPLAERVIGAMWLYLMTYRLADEEKIDETPVWYVMDELGSAMRHSDYANFRIAPFLFMPEGKLDTAISYTILWPTHDVHTGEECTRDFLFGIGEDKQRSARLTAWFRTPENYFIQEFRRYQEQLQSNSICSSTKIEETPSTKSIRPSDGRALRVYTDIPHVEEFLTRPEFVLTTDPKEADIIWVSMQVDSEVKKAVGLTDQQYTNQFPFEACLVMKHHLAETIHKAWGSPEWLQPTYNLETHLSPLIGDYFVRKRDGMDNLWIMKPWNMARTIDTTVTGDLSAIIRLMETGPKICQKYIERPALFQGRKFDLRYIVLVRSIRPLEIFLSDVFWVRLANNQYTLEKTSFFEYETHFTVMNYIGRMKHMNTPEFVKEFEKEHQVKWLDIHESIRSTIRCVFESAAAVHPEMQNPFSRAMYGVDVMLDNRFEPKILEVTYCPDCGRACKYDTQALVGSQGTIRGRDFFNAVFGCLFLDEQTNVSPL

SEQ ID NO: 6665 - DNA, 1173 bp, Sorghum bicolor
  misc_feature: Ceres ANNOT ID no. 6068000
  misc_feature: Encodes the peptide sequence at SEQ ID NO 6666
atgtctgtgcttacctgtgtgattgaaagcatgggttcatcctgtagcagatcccattccttggacgagactgaagcagctgaaaatgcaaagtctgcagacatcgaccggaggattttgcaagaaacaaaggccgagcaacacatccacaagctcttacttcttggtgctggagaatcagggaagtctacaatatttaaacaaataaagctccttttccaaactggctttgatgaggcagagcttaagagctacacgtcagtcatccatgcgaacgtgtatcagacaattaaaatattatatgagggagctaaagagctagcccaagtggaaccagattcctcaaaatatgttttatctccagatagtcaggagattggagaaaaactatcagaaattggtgtcaggttggattacccatcgctaaacaaagaatgtgtacaggatgtaagaaaactatggcaagatccagccattcaggaaacttactcacgaggaagtattctccaagtcccagactgtgcacagtacttcatggaaaatttggacagattatctgaagtagattatgtaccaacaaaggaggacgtgcttcatgcaagagtacggacaaatggtgtggtagaaactcagtttagccctctaggagagagcaaaagaggcggagaggtctataggctatacgatgtaggaggccagagaaacgagagaaggaaatggatccatctttttgaaggtgttaatgctgtaatattctgtgctgccattagcgagtatgatcagatgttatgcgaggatgagacgaagaacagaatgatggagactaaagaactctttgattgggtgctaaagcaaagatgtttcgagaaaacctcattcatgttatttctcaacaaatttgacatatttgagagaaaaatacaaaaggttcctttaagtgcgtgcgagtggtttaaagattaccagcctatcgcacctggcaaacaggaggtggaacatgcctatgagttcgtgaaaaagaagtttgaggaactctacttccagagcagcaagcctgaccgtgtcgaccgagtgttcaagatctacagaacaacagccctggatcagaaacttgtaaagaagacattcaagctgatcgacgagagcatgaggcgttccagagaaggaacttga

SEQ ID NO: 6666 - protein, 390 aa, Sorghum bicolor
  misc_feature: Ceres ANNOT ID no. 6068000
  misc_feature (23)..(391): Pfam Id: G-alpha Pfam Desc: G-protein alpha subunit
  misc_feature (1)..(390): NCBI GI: 115463253 NCBI Desc: os05g0333200 [oryza sativa (japonica cultivar-group)]
  misc_feature (11)..(390): NCBI GI: 55167970 NCBI Desc: 'gtp-binding protein alpha-1 subunit, dwarf one gene' [oryza sativa (japonica cultivar-group)]
  misc_feature (11)..(390): NCBI GI: 1346104 NCBI Desc: guanine nucleotide-binding protein alpha-1 subunit (gp-alpha-1)
  misc_feature (11)..(390): NCBI GI: 862310 NCBI Desc: g protein alpha-subunit
  misc_feature (11)..(390): NCBI GI: 11245655 NCBI Desc: g protein alpha subunit [hordeum vulgare]
  misc_feature: The sequence is a functional homolog of SEQ ID NO. 522 in the 11/188,298 US application
MSVLTCVIESMGSSCSRSHSLDETEAAENAKSADIDRRILQETKAEQHIHKLLLLGAGESGKSTIFKQIKLLFQTGFDEAELKSYTSVIHANVYQTIKILYEGAKELAQVEPDSSKYVLSPDSQEIGEKLSEIGVRLDYPSLNKECVQDVRKLWQDPAIQETYSRGSILQVPDCAQYFMENLDRLSEVDYVPTKEDVLHARVRTNGVVETQFSPLGESKRGGEVYRLYDVGGQRNERRKWIHLFEGVNAVIFCAAISEYDQMLCEDETKNRMMETKELFDWVLKQRCFEKTSFMLFLNKFDIFERKIQKVPLSACEWFKDYQPIAPGKQEVEHAYEFVKKKFEELYFQSSKPDRVDRVFKIYRTTALDQKLVKKTFKLIDESMRRSREGT

SEQ ID NO: 6667 - DNA, 723 bp, Sorghum bicolor
  misc_feature: Ceres ANNOT ID no. 6068001
  misc_feature: Encodes the peptide sequence at SEQ ID NO 6668
atggcctcccccaacgccgacccggctcagcagcaccacgcctcgacgccgccactcctcctcgccgtacgccacctgccgtcccccggcgtccaccggacacgcacgctccccggccccgacgtcctcacccctctcgcccgccgcctcgaggagctcgcgtccgcggcggccgcccacccgctcctgaagccgctcttcgccgcccactcccacctctcttccttctcccagggcaggaggcggctggtggcggcgcggcgtgcgacgatgctgctgtccggggagcactgcttcgcggcggtgctcggggactcggtggccgggatggtggtgtccaacggcatcaacaacttcctcaacctttacaacacggtgctcgtcgtcaggctcgtgctcacctggttcccaaacacgccgcccgccatcgtcgcgcctctcagcacgatatgtgacccgtacctgaacatcttccggggcatcatcccgccgctcgggggaacgctggacctgtcgcctatcctggctttcctcgtcctcaacgccttcaccagcacggccgccgcgcttccggcagagctccccagctcggcagctgcacagcatcaccagaggaccgctgctctgtccagctcggcgccgctcgaggcgacgtccaaccagaggaaatggatgcggagaatgcggtcacagaagtcacagggagaaggtggtgatcactag

SEQ ID NO: 6668 - protein, 240 aa, Sorghum bicolor
  misc_feature: Ceres ANNOT ID no. 6068001
  misc_feature (109)..(190): Pfam Id: YGGT Pfam Desc: YGGT family
  misc_feature (107)..(185): NCBI GI: 84518087 NCBI Desc: uncharacterized yggt family protein conserved membrane protein [prochlorococcus marinus str. mit 9211]
  misc_feature (120)..(190): NCBI GI: 72382137 NCBI Desc: uncharacterized yggt family conserved membrane protein [prochlorococcus marinus str. natl2a]
  misc_feature (111)..(190): NCBI GI: 33240375 NCBI Desc: uncharacterized yggt family conserved membrane protein [prochlorococcus marinus subsp. marinus str. ccmp1375]
  misc_feature (116)..(185): NCBI GI: 89101247 NCBI Desc: integral membrane protein [bacillus sp. nrrl b-14911]
  misc_feature (120)..(190): NCBI GI: 30263900 NCBI Desc: ylmg protein [bacillus anthracis str. ames]
MASPNADPAQQHHASTPPLLLAVRHLPSPGVHRTRTLPGPDVLTPLARRLEELASAAAAHPLLKPLFAAHSHLSSFSQGRRRLVAARRATMLLSGEHCFAAVLGDSVAGMVVSNGINNFLNLYNTVLVVRLVLTWFPNTPPAIVAPLSTICDPYLNIFRGIIPPLGGTLDLSPILAFLVLNAFTSTAAALPAELPSSAAAQHHQRTAALSSSAPLEATSNQRKWMRRMRSQKSQGEGGDH

SEQ ID NO: 6669 - DNA, 2649 bp, Sorghum bicolor
  misc_feature: Ceres ANNOT ID no. 6068002
  misc_feature: Encodes the peptide sequence at SEQ ID NO 6670
atggccaccgctgccaccatctccctcctacagcacgtccgacctccggcttcgggcggtactagtcttctccccctccagtgcctccgccctgttcactgccgacgctcggcgccagcctcccaccactccctccagcgccgtctccgtctccgcctccccacgcgcggcgcacccgcggcccggccccgcgccacggccgacccgtcgtccgcgctcgatgcagcggccggggagggcaccgacgccaccaccgcgctgctcgacgtgagcggcatgatgtgcggcggctgcgcggcgcgggtgcgggccatcctggcggcggacccgcgggttgagacggcggcggtcaacctcctcgccgagtccgccgcggtgcggctgcgggcaccggcgccgccgggcgcgggggaggagctcgcggccaggctcacggagtgcggcttccccaccacggcgcgccgaggcggggcggccgcgggcgccggggagagcgcgcgcaagtggagggagatggccgccaggaaggaggagctcctggcgcggagccggggccgagtcgcgttcgcgtggacgctcgtcgcgctctgctgcggctcgcacgcgtcccacatcctgcactcgctcggcatccatatcggccatggaacgtttttggatttgttgcataattcttatgtgaaatgtggcattgccacagctgctctgcttgggcctggaagagatatactgtttgatggtttcagagctttcaagcaaggttcccccaacatgaactctctagtaggatttggctctgcagctgcatttgctatcagtgcagtcatgcttcttggatttgtacttcttggacgatctcttgaagaaagtgcaaggctcaaggcatccagtgatatgaatgagctcatttcactgttatcacctcagtcgagattaattgttacttcctcaagtgatgacccttctgcggacactagtttgaattctgatgcaatcactgtcgaggttcctgttgatgatgtccgtgttggagactcaatattggtcctgccaggagaaactataccagtagatgggaatgttattggaggatcaagttttgttgacgaatcaatgcttactggagagtccttgcctgtagccaaggagattggtcttcctgtattttcaggaactgtgaactgggatggcccgctaaagatcagagcaacatgtactggaccgtcatcaacaatagctaagatagtccgcatggttgaggatgcccaggcacgtgaagctcctgttcaaaggcttgcagattccattgcaggaccatttgtgtatactgttatgacattggctgcagcaaccttttccttctggtattatattggcacacacgtatttccggaggttcttttcaatgatattgctggcccagatggagattcattacttttgagtataaagcttgctgtggatgtactagttgtttcctgtccttgtgcacttggattagctacacctacagctatcttaataggaacttccctaggtgctaaaagagggttacttattagaggaggtgatgttttagagcgtttggctggaatagatgctcttgtgcttgataaaacagggacacttacagaaggaaaaccagtagttacttctattgcttctctggcatatgaagatacagagattcttcgtcttgctgctgcagtggagaaaacagcattgcatccaattgcaaatgctataatgaacaaggctgaactactcaagctagatattccgatcacaagtggtcagcttacagagcctggatttggctgtttggcggaagtagatgggagtttagttgcagtaggcactttggattgggtgcatgatcgttttgaaactaaagcatcacctactgaactgagagaccttagaaaccggctggagtctatgttgtcaagtgaagcatcatcatcaaatcagtcaaagtcaattgcttatgttggtcgtgaaggagaaggaattataggtgctattgctatatcagatattttacgagaagatgcaaacttaactgtggagaggttgcagcaggaaagcattacaacgtttctactgtcaggggatagggaagaagcagtgacaagcatcgggaggactattggaatcagggatgaaaacataaagtcttccctaactccgcaagacaaagcaagcattatatcaactttgcaagggaagggacacagagttgcaatggttggtgatggaataaatgatgcgccgtctttggcagctgcagatgttggaatagccatgcgaactcactcaaaagagaacgctgcctctgatgcagcttcagttgttctattaggcaacagactttctcaggtggtagatgcactatccctgtcgaaggcaacgatggcaaaagttcaccaaaatttagcctgggcagtggcatataacatagtagccattccaattgccgctggagtgttactgccacaatatgatttcgccatgacaccatctctctcagggggattgatggcccttagctccatctttgtcgtcagcaattctttgcttctgcagctgcatgggtcgtttcagaacacagaaaaacggcagggtgatttgagctcaagattaaactga

SEQ ID NO: 6670 - protein, 882 aa, Sorghum bicolor
  misc_feature: Ceres ANNOT ID no. 6068002
  misc_feature (276)..(528): Pfam Id: E1-E2_ATPase Pfam Desc: E1-E2 ATPase
  misc_feature (532)..(773): Pfam Id: Hydrolase Pfam Desc: haloacid dehalogenase-like hydrolase
  misc_feature (113)..(866): NCBI GI: 29294054 NCBI Desc: atpase, e1-e2 type family [arabidopsis thaliana]
  misc_feature (113)..(866): NCBI GI: 42570031 NCBI Desc: atpase e1-e2 type family protein / haloacid dehalogenase-like hydrolase family protein / heavy-metal-associated domain-containing protein [arabidopsis
  misc_feature (113)..(866): NCBI GI: 42570031 (continued) thaliana]
  misc_feature (113)..(866): NCBI GI: 31616607 NCBI Desc: paa2 p-type atpase [arabidopsis thaliana]
  misc_feature (66)..(869): NCBI GI: 3549654 NCBI Desc: metal-transporting p-type atpase (fragment) [arabidopsis thaliana]
  misc_feature (85)..(619): NCBI GI: 119486994 NCBI Desc: copper-translocating p-type atpase [lyngbya sp. pcc 8106]
MATAATISLLQHVRPPASGGTSLLPLQCLRPVHCRRSAPASHHSLQRRLRLRLPTRGAPAARPRATADPSSALDAAAGEGTDATTALLDVSGMMCGGCAARVRAILAADPRVETAAVNLLAESAAVRLRAPAPPGAGEELAARLTECGFPTTARRGGAAAGAGESARKWREMAARKEELLARSRGRVAFAWTLVALCCGSHASHILHSLGIHIGHGTFLDLLHNSYVKCGIATAALLGPGRDILFDGFRAFKQGSPNMNSLVGFGSAAAFAISAVMLLGFVLLGRSLEESARLKASSDMNELISLLSPQSRLIVTSSSDDPSADTSLNSDAITVEVPVDDVRVGDSILVLPGETIPVDGNVIGGSSFVDESMLTGESLPVAKEIGLPVFSGTVNWDGPLKIRATCTGPSSTIAKIVRMVEDAQAREAPVQRLADSIAGPFVYTVMTLAAATFSFWYYIGTHVFPEVLFNDIAGPDGDSLLLSIKLAVDVLVVSCPCALGLATPTAILIGTSLGAKRGLLIRGGDVLERLAGIDALVLDKTGTLTEGKPVVTSIASLAYEDTEILRLAAAVEKTALHPIANAIMNKAELLKLDIPITSGQLTEPGFGCLAEVDGSLVAVGTLDWVHDRFETKASPTELRDLRNRLESMLSSEASSSNQSKSIAYVGREGEGIIGAIAISDILREDANLTVERLQQESITTFLLSGDREEAVTSIGRTIGIRDENIKSSLTPQDKASIISTLQGKGHRVAMVGDGINDAPSLAAADVGIAMRTHSKENAASDAASVVLLGNRLSQVVDALSLSKATMAKVHQNLAWAVAYNIVAIPIAAGVLLPQYDFAMTPSLSGGLMALSSIFVVSNSLLLQLHGSFQNTEKRQGDLSSRLN

SEQ ID NO: 6671 - DNA, 1125 bp, Sorghum bicolor
  misc_feature: Ceres ANNOT ID no. 6068006
  misc_feature: Encodes the peptide sequence at SEQ ID NO 6672
atgtcggcgcgtgaccgcgagacggccgaggcgctggtgcgcctcgccgcctcgctggacggggcggtgctcgggctcggcacggcggccgtcgccgtcgcgtcgtgggtcaagtacctcgccgtctcgggccagctgcgcctcgtcgcctccgcggcgacggcctccatcggtgacgcccgctccctcctccggggcgacggcaacgagccgcggatcgccgcggtgcggggctacgtgcggacccagggctcgttcctccgggccccgttctcaagcgaggcgggcgtcgtcgtcaagcacacccagatgtgtttgttcacagaatggagaggcatctttggatggacctttgatctgcatgctcttcttttcagatcatggaaagagcaaattgtgacatcttttagagcggttccgtttgttctggctagtactgagttaggaaattctacaggagtggtgcatataaatgtggatgaggtggattatcaaccgttgcctcttactacagtgtttcataaacttatcccacttgagacaactccgtacacattgtttcaaactattattggcaacggctatccgattgcattgttggatgaagaaaaaatactaccgattggtaagaaaattacagcaataggactatgccgagcaaagaatgcagaaagtgtcgagatcacatcgtgcccagagatcccctttttcttatctgaactaaccaaggatgagatgcaagctcagctggcttcacgtgctaggatactcttttggggtagtattgttttgggaaccttgtcggtttgcttagtgggccatgccatttacaggggctggaagagaatcaaactacggagagaggctaggcaggcacaacagatgtttgaggatgctgaagatgctattcgggaagataactctagtgatgatgatgatgatgatgtaggagacggccaactatgtgttgtgtgcttaaggaagagaaggaaagcagcttttattccatgtgggcatcttgtctgctgttgcaaatgcgcattaagaatggagcgtgaggttgaaccgttgtgccctatgtgccgtcaagacatcagatacatgataaggatttatgactcttga

SEQ ID NO: 6672 - protein, 374 aa, Sorghum bicolor
  misc_feature: Ceres ANNOT ID no. 6068006
  misc_feature (1)..(374): NCBI GI: 66947626 NCBI Desc: c3hc4 zinc finger containing protein [medicago truncatula]
  misc_feature (1)..(374): NCBI GI: 23505911 NCBI Desc: at1g54150/f15i1_32 [arabidopsis thaliana]
  misc_feature (71)..(372): NCBI GI: 8778741 NCBI Desc: t30e16.12 [arabidopsis thaliana]
  misc_feature (148)..(372): NCBI GI: 6520214 NCBI Desc: zcf61 [arabidopsis thaliana]
  misc_feature (203)..(372): NCBI GI: 144924893 NCBI Desc: zinc finger, ring-type [medicago truncatula]
  misc_feature: Useful for making plants with altered alkaloid content
  misc_feature: GREAT-hit functional homolog of the protein sequence given in SEQ ID NO 13319
  misc_feature: GREAT-hit functional homolog of the protein sequence given in SEQ ID NO 13320
MSARDRETAEALVRLAASLDGAVLGLGTAAVAVASWVKYLAVSGQLRLVASAATASIGDARSLLRGDGNEPRIAAVRGYVRTQGSFLRAPFSSEAGVVVKHTQMCLFTEWRGIFGWTFDLHALLFRSWKEQIVTSFRAVPFVLASTELGNSTGVVHINVDEVDYQPLPLTTVFHKLIPLETTPYTLFQTIIGNGYPIALLDEEKILPIGKKITAIGLCRAKNAESVEITSCPEIPFFLSELTKDEMQAQLASRARILFWGSIVLGTLSVCLVGHAIYRGWKRIKLRREARQAQQMFEDAEDAIREDNSSDDDDDDVGDGQLCVVCLRKRRKAAFIPCGHLVCCCKCALRMEREVEPLCPMCRQDIRYMIRIYDS

SEQ ID NO: 6673 - DNA, 921 bp, Sorghum bicolor
  misc_feature: Ceres ANNOT ID no. 6068007
  misc_feature: Encodes the peptide sequence at SEQ ID NO 6674
atggccacaggcgccatcacgccgccgccggtggccggcgcgcggcgcgtcccccgtggacggggattcctccaccggcgcctcgccgcatcgcctatgaaagatgaatccatgatgatttccacagatggtagaaatgaggagacagacactgacagcctcaatgttgccagaggattgtctcaccctgggctttcctcaagtttatccaataaggcatcagtggccccaacccctttgcttccttctggaccatctgatctccggttcaatcgtcttcgaccctcaattgatgaaagtgattgcaaatacaaaagattatttggctgctatgttgctcgtgaggctgtaattgatgaggaatattggattgctgcatggttgagagcggaagatcactatgaaaatgagtcaggcaatcgctatgttgaaagctttaaaagaaagtttgcatcaaaggaattccatgcattaaagaagagatgcagcaaacagcacggagaaaagtatatctgttttgtcgcagtaaagaatgatgacctcaggcgaaccgtcctgaatagtgttgttggtaccttagatgtatgtgtaagacatcctctacatggtgagaaatttcctgaggagcctggaaagtcgtcacttcactgtcgaatttatcagcctgatcagccaaaatttgggtacgtaacaaatgtatgtgttgctaaatatgcgaggcgtcaagggattgccagcaacatgctgttattggccatagatgctgcaagactcaacggtgctgaaaatatttacattcatgtgcataaagacaacttaccagcatggaggctctatgatcagataggattcaagatggttgaccaggatggcggctcttgtcgttcatcagatctgtgcttactctccttcagttcatag

SEQ ID NO: 6674 - protein, 306 aa, Sorghum bicolor
  misc_feature: Ceres ANNOT ID no. 6068007
  misc_feature (181)..(285): Pfam Id: Acetyltransf_1 Pfam Desc: Acetyltransferase (GNAT) family
  misc_feature (208)..(287): NCBI GI: 106886905 NCBI Desc: ribosomal-protein-alanine acetyltransferase [clostridium phytofermentans isdg]
  misc_feature (111)..(285): NCBI GI: 22137098 NCBI Desc: at4g28030/t13j8_140 [arabidopsis thaliana]
  misc_feature (211)..(304): NCBI GI: 94499409 NCBI Desc: spermidine n1-acetyltransferase [oceanobacter sp. red65]
  misc_feature (155)..(292): NCBI GI: 119490862 NCBI Desc: gcn5-related n-acetyltransferase [lyngbya sp. pcc 8106]
  misc_feature (228)..(287): NCBI GI: 121997484 NCBI Desc: ribosomal-protein-alanine acetyltransferase [halorhodospira halophila sl1]
MATGAITPPPVAGARRVPRGRGFLHRRLAASPMKDESMMISTDGRNEETDTDSLNVARGLSHPGLSSSLSNKASVAPTPLLPSGPSDLRFNRLRPSIDESDCKYKRLFGCYVAREAVIDEEYWIAAWLRAEDHYENESGNRYVESFKRKFASKEFHALKKRCSKQHGEKYICFVAVKNDDLRRTVLNSVVGTLDVCVRHPLHGEKFPEEPGKSSLHCRIYQPDQPKFGYVTNVCVAKYARRQGIASNMLLLAIDAARLNGAENIYIHVHKDNLPAWRLYDQIGFKMVDQDGGSCRSSDLCLLSFSS

SEQ ID NO: 6675 - DNA, 1575 bp, Sorghum bicolor
  misc_feature: Ceres ANNOT ID no. 6068014
  misc_feature: Encodes the peptide sequence at SEQ ID NO 6676
atggacatgaacaacggctggctcggcttctccttgtctccttccgcagggaggggcggctatggcgacggcggagcgagcgcgagcggggatggaggagacggctcttgctcctcgcctgccgcggcggcttcgcctgtccctctcgtcgccatgccgctccagcccgatggctctctgcactatacctctgcgccagattggaggcacggcgcagcagaagccaacggccccaagcttgaggacttcatgagcgtcacttgcagcagcaacaacaagaggagcagcagcagcagcagcttctacgacaggtgcagccacgccgagcaggctaacaagtaccacgaggtccacgacctccaacccctctcgtgcggctcgtactaccacggcagcagcggcggcggcggcaacggcattgccctggggatcaacatgaacgcgccgccctgcagcggcggcggcttcccggaccaccaccaccaccaccagttcgtgtcatcccaccacggccagtacttcctgggcgcccctctcaacgcgagcccgcctggcgcagtgccaatgtacagcgccggcggcggcggcgtcggcgggtccatgtccatctccggcatcaagtcctggctccgggaggccatgtacgtgccgccagagcgcccggtggcggcggcggcggcgctgtcgctcgccgtgacggacgatgtgggggctgagccgccgcagctgttgccggcggcgccaatgccgccggtgcaccgcaagcccgcgcagacgttcgggcagcggacctcgcagttccgcggcgtcaccagacacagatggaccgggaggtacgaggctcacctgtgggacaacacatgcaggaaggaaggccagactaggaaaggaaggcaaggcgggtatgacagggaggagaaggctgcgagggcttatgaccttgctgctctcaagtattggggcccttcaactcacataaatttcccactgagccactacgagaaggagctggaggagatgaaacacatgtcaaggcaggagttcattgcacacttgagaaggcatcaccagcacgggagatggcaagccaggattgggagggtcgctggcaacaaggacttgtatcttggcacgttcagcacgcaggaggaggcggcggaggcgtacgacatcgcggcgatcaagttccgtggcctcaacgcggtgaccaacttcgacatcagcaagtacgacgtgaagcgcatctgcgccagcacccacctcatcggcggcggcgacgcgtgcaggcgctccccgacgcagccgccggacgcgccggcgctcgccatcgacgctgctggcgccgaccggtcgtcggacgcgccgggcggcggcgaccaggccgtgtccgacaactcggacacctccgccggacaccgcggcgcgcacctgctgcacggcctccagtacggccaccccatgaagctggaggccggcgagggcagcagctggatggcggcggcgacggcggcggcggcgcggccggtggcaggcgtgcaccagctaccggtgttcgcgctgtggaatgactgttga

SEQ ID NO: 6676 - protein, 524 aa, Sorghum bicolor
  misc_feature: Ceres ANNOT ID no. 6068014
  misc_feature (265)..(322): Pfam Id: AP2 Pfam Desc: AP2 domain
  misc_feature (347)..(399): Pfam Id: AP2 Pfam Desc: AP2 domain
  misc_feature (251)..(354): NCBI GI: 92894900 NCBI Desc: pathogenesis-related transcriptional factor and erf [medicago truncatula]
  misc_feature (30)..(448): NCBI GI: 115455605 NCBI Desc: os03g0770700 [oryza sativa (japonica cultivar-group)]
  misc_feature (49)..(354): NCBI GI: 38492172 NCBI Desc: ant-like protein [nicotiana tabacum]
  misc_feature (252)..(355): NCBI GI: 91806073 NCBI Desc: ovule development protein [arabidopsis thaliana]
  misc_feature (178)..(354): NCBI GI: 46395275 NCBI Desc: aintegumenta-like protein [pinus thunbergii]
  misc_feature: The sequence is a functional homolog of SEQ ID NO 400 in the 10/374,780US patent application
  misc_feature: The sequence is a functional homolog of SEQ ID NO 592 in the 10/225,066US patent application
  misc_feature: Useful for making plants with modulated growth and phenotype characteristics
  misc_feature: The sequence is a functional homolog of SEQ ID NO 592 in the 20050160493 US patent application
  misc_feature: Useful for making plants with altered lignin content
  misc_feature: Useful for making plants with modulated biomass
  misc_feature: Functional homolog of the protein sequence given in SEQ ID NO 13511
  misc_feature: Useful for making plants with modulated asexual embryo production
  misc_feature: Functional homolog of the protein sequence given in SEQ ID NO 13420
  misc_feature: The sequence is a functional homolog of SEQ ID NO. 274 in the 11/188,298 US application
MDMNNGWLGFSLSPSAGRGGYGDGGASASGDGGDGSCSSPAAAASPVPLVAMPLQPDGSLHYTSAPDWRHGAAEANGPKLEDFMSVTCSSNNKRSSSSSSFYDRCSHAEQANKYHEVHDLQPLSCGSYYHGSSGGGGNGIALGINMNAPPCSGGGFPDHHHHHQFVSSHHGQYFLGAPLNASPPGAVPMYSAGGGGVGGSMSISGIKSWLREAMYVPPERPVAAAAALSLAVTDDVGAEPPQLLPAAPMPPVHRKPAQTFGQRTSQFRGVTRHRWTGRYEAHLWDNTCRKEGQTRKGRQGGYDREEKAARAYDLAALKYWGPSTHINFPLSHYEKELEEMKHMSRQEFIAHLRRHHQHGRWQARIGRVAGNKDLYLGTFSTQEEAAEAYDIAAIKFRGLNAVTNFDISKYDVKRICASTHLIGGGDACRRSPTQPPDAPALAIDAAGADRSSDAPGGGDQAVSDNSDTSAGHRGAHLLHGLQYGHPMKLEAGEGSSWMAAATAAAARPVAGVHQLPVFALWNDC

SEQ ID NO: 6677 - DNA, 732 bp, Sorghum bicolor
  misc_feature: Ceres ANNOT ID no. 6068027
  misc_feature: Encodes the peptide sequence at SEQ ID NO 6678
atgagacagaatggcacggtaatgattcaatttggtcatcaaatgcctgattacgactccccagctacccaatcaaccagtgagagccatcaagaagtgtctggaatgagcgaaggaagcctcaacgagcataatgaccattcaggtaatcttgatggttactcaaagagtgacgaaaacaagatgatgtcagctttatccctgggcaatccagaaacagcttatgcacatccaaagcctgaccgtactcagtcctttgctatatcatacccatatgctgatccatactatggtggtgcagtggcagcttatggctctcatgctattatgcaccctcagctggtgggcatggtttcatcctctcgagtgccattaccaattgagccggccgctgaagagcccatttatgtcaacgcgaagcaataccacgcgattctccgaaggagacagctccgtgcaaagctagaggctgaaaacaagcttgtgaaaagtcgcaagccgtacctgcacgagtctcggcatctgcacgcgatgaagagagctcggggaacaggcgggcggttcctgaacacaaagcagcagccagagtcccccggcagcggaagcggcggcggctcctcggacgcgcaacgcatgcccatgaacggtggtggcctgttcacgaagcacgagcacagcttgcctcccggcgatcgccaccactatcacgcgagaggagggggcggcgcgtag

SEQ ID NO: 6678 - protein, 243 aa, Sorghum bicolor
  misc_feature: Ceres ANNOT ID no. 6068027
  misc_feature (132)..(188): Pfam Id: CBFB_NFYA Pfam Desc: CCAAT-binding transcription factor (CBF-B/NF-YA) subunitB
  misc_feature (1)..(240): NCBI GI: 45861205 NCBI Desc: ccaat-box transcription factor complex whap5 [triticum aestivum]
  misc_feature (1)..(240): NCBI GI: 45861203 NCBI Desc: ccaat-box transcription factor complex whap4 [triticum aestivum]
  misc_feature (1)..(240): NCBI GI: 45861201 NCBI Desc: ccaat-box transcription factor complex whap3 [triticum aestivum]
  misc_feature (1)..(240): NCBI GI: 38640734 NCBI Desc: ccaat-box transcription factor complex whap2 [triticum aestivum]
  misc_feature (1)..(239): NCBI GI: 2826786 NCBI Desc: rapb protein [oryza sativa (indica cultivar-group)]
  misc_feature: The sequence is a functional homolog of SEQ ID NO 1263 in the 10/374,780US patent application
  misc_feature: The sequence is a functional homolog of SEQ ID NO 1518 in the 10/666,642US patent application
  misc_feature: The sequence is a functional homolog of SEQ ID NO 1733 in the 11/479,226US patent application
  misc_feature: The sequence is a functional homolog of SEQ ID NO 2132 in the 10/374,780US patent application
  misc_feature: The sequence is a functional homolog of SEQ ID NO 230 in the 10/225,068US patent application
  misc_feature: The sequence is a functional homolog of SEQ ID NO 268 in the 10/374,780US patent application
  misc_feature: The sequence is a functional homolog of SEQ ID NO 290 in the 10/374,780US patent application
  misc_feature: The sequence is a functional homolog of SEQ ID NO 472 in the 10/666,642US patent application
  misc_feature: The sequence is a functional homolog of SEQ ID NO 6 in the 10/225,066US patent application
  misc_feature: The sequence is a functional homolog of SEQ ID NO 668 in the 10/225,066US patent application
  misc_feature: Useful for making plants with modulated growth and phenotype characteristics
  misc_feature: The sequence is a functional homolog of SEQ ID NO 230 in the 20050120408 US patent application
  misc_feature: The sequence is a functional homolog of SEQ ID NO 6 in the 20050160493 US patent application
  misc_feature: The sequence is a functional homolog of SEQ ID NO 668 in the 20050160493 US patent application
  misc_feature: The sequence is a functional homolog of SEQ ID NO 1263 in the 20060162006 US patent application
  misc_feature: The sequence is a functional homolog of SEQ ID NO 1518 in the 20070033671 US patent application
  misc_feature: The sequence is a functional homolog of SEQ ID NO 1342 in the 11/479,226 US patent application
  misc_feature: The sequence is a functional homolog of SEQ ID NO 624 in the 10/412,699 US patent application
MRQNGTVMIQFGHQMPDYDSPATQSTSESHQEVSGMSEGSLNEHNDHSGNLDGYSKSDENKMMSALSLGNPETAYAHPKPDRTQSFAISYPYADPYYGGAVAAYGSHAIMHPQLVGMVSSSRVPLPIEPAAEEPIYVNAKQYHAILRRRQLRAKLEAENKLVKSRKPYLHESRHLHAMKRARGTGGRFLNTKQQPESPGSGSGGGSSDAQRMPMNGGGLFTKHEHSLPPGDRHHYHARGGGGA

SEQ ID NO: 6679 - DNA, 1098 bp, Sorghum bicolor
  misc_feature: Ceres ANNOT ID no. 6068050
  misc_feature: Encodes the peptide sequence at SEQ ID NO 6680
atgacgggatgcctgtggccgtgcgtgggagcggcggtggccgaggatggggccggccaccgggggctgttccgctccaagcccaggacccccgcggaggtggtgcagcacgtcaggtacctggtcacctacgtcctcaacaacaaggacggctgtgccggcggcaggcgcgacgccaagcttgagcacaggatgttagaactaagcaaagggatcaaagagatgaaaggcattctctatggcaatggtgaagacgatccttgtgaagaagcttgcaagcaattgactaaggagttcttcaagaagaacacagacaccttccgtcaatttattgtttgccttcaatacgtgaacttggatacacaaaaggatgtcactcaagtgattgcaaatttgcaaaggcaaaaggttgattcaagattggttgcctctgattacttggaagctaacttggatcttttggaaattttgatgtctgggtacgaaaacttggacatcgcaatacattatagtactctattgagagactgcatacgccaccaagttgctgcaaggtacgtattggaatgtccacacttgaggacattctttgatcatatacagtttccagacttcaatatacaatccgatgtgtttaaaacttttaaggagctcatgacacgacataaatcaactgttgctgagttcttttccaagaattatgattgggcaaaattcaactcgaagctgatattatctgcttccaactacttcatccgaaggcaagctgttcaactcttgcgagacattcttttggaaaggtcaaacagtgcagtgatgatgcgctatgttagttcgaaagagcacctcatgattcatatgaaccttctaagggatgacagcatagctattcaggtagaggctttccatgtcttcaagctgttcgtcgctaacaaggagcagccacctgagatcaccagcatactgcgcaccaacagaagcaagctcctgaggttcttgaaagacttcaccaccgtggagaaagacgataagaagttcgaggccgataaagctacggtcatctcgaagatcctagcgctagctggcgctgaaaattag

SEQ ID NO: 6680 - protein, 365 aa, Sorghum bicolor
  misc_feature: Ceres ANNOT ID no. 6068050
  misc_feature (20)..(362): Pfam Id: Mo25 Pfam Desc: Mo25-like
  misc_feature (21)..(360): NCBI GI: 115473049 NCBI Desc: os07g0585100 [oryza sativa (japonica cultivar-group)]
  misc_feature (21)..(360): NCBI GI: 15238126 NCBI Desc: mo25 family protein [arabidopsis thaliana]
  misc_feature (21)..(360): NCBI GI: 89257483 NCBI Desc: mo25 protein -related [brassica oleracea]
  misc_feature (21)..(360): NCBI GI: 140064512 NCBI Desc: calcium-binding protein 39-like , related [medicago truncatula]
  misc_feature (21)..(331): NCBI GI: 89257511 NCBI Desc: mo25 family protein [brassica oleracea]
MTGCLWPCVGAAVAEDGAGHRGLFRSKPRTPAEVVQHVRYLVTYVLNNKDGCAGGRRDAKLEHRMLELSKGIKEMKGILYGNGEDDPCEEACKQLTKEFFKKNTDTFRQFIVCLQYVNLDTQKDVTQVIANLQRQKVDSRLVASDYLEANLDLLEILMSGYENLDIAIHYSTLLRDCIRHQVAARYVLECPHLRTFFDHIQFPDFNIQSDVFKTFKELMTRHKSTVAEFFSKNYDWAKFNSKLILSASNYFIRRQAVQLLRDILLERSNSAVMMRYVSSKEHLMIHMNLLRDDSIAIQVEAFHVFKLFVANKEQPPEITSILRTNRSKLLRFLKDFTTVEKDDKKFEADKATVISKILALAGAEN

SEQ ID NO: 6681 - DNA, 3024 bp, Sorghum bicolor
  misc_feature: Ceres ANNOT ID no. 6068052
  misc_feature: Encodes the peptide sequence at SEQ ID NO 6682
atggcagctagaactgtattccccgtgctgcgctcctctgagtacttcacaaggccatcaattgatgagctggtagagagggaggtggctaatcctggatactgcagcagggttccaaacttcatcatagggagggctggatatgggcaggttaggttcttgggcgacaccgatgtgaggggcattgacctgaatgaaattgtcaggtttgaaaaacactatgtggtggtttatgaggatgagacttgtaagccacctgtagggcatggtcttaacaaagcagcagaagtgtccttgctgctgagtttgaaggatcttccggagcccagtatccttgttgaggtgctaaggtgtcgtgcaagaaagcaaggttctaggtttctttcattcaatccagtgaatggaaaatggaaatttgaggttgatcattttagtagatttgggcttgtggatgaggaggaagaggatgctgtgatggacgaggcagctgttcggcagccaattactgaagtaagagaaagagacccaccttcaaatggtcatgaaattgagctttcccattcattgcctgctcatctcgggcttgaccctgcaaagatgcaagaaatgaggatggtgatgttttccaatgaggaagaagatgaatatatggaggatgatgggttcccttctgacgagaggtacgttagcagagaaaggatgaatgtggattcacctacctcaagcggtaaaggtttgaggttaaggtctctctctcccttgcacatgtcttctcagaagtctggcaggagatctggtatgccggttcggaaagaacctcaggcacttttggaatacagtatgaattcttcagagcttggtccatcgactcagggtattcttatgtctgggcaaaacagaggatttccagtgagtatgaccaaggtggatggttttaagctgccggctgaccaagaaactcctgttgctggaaacatgtatactaattgtgtagtggatgctgctttattcatgggtagatcatttcgtgttggttggggaccaaatggtttacttgtacattcaggtagtctggtcaataatcctggaacaggcttatcttctgttattcacatagagaaagttgcaagtgacaaacttgtgcgtgatgataagagcaagattaaggatgacctaacagaactatgtttttctgatccaatgggcctccataagagtcttgatcatgagattctggagacggagtctgactcgttcagattaaagcttcagaaagtcatggcaaatcgtttggttttgcctgacatctgcaggtcatatattgacatcattgaaaagcagcttgaagtcagtgatttatctatgtctacgcgtgtgctgttgatgcaccaagtaacagtgtgggagttaatcagggtcttgttctcagaaagagcaactggtaaccagttggagcctgttggagatgatgatcaggaaggcatggttttagacaaaaaagaaggctatgtcgacatagatcctgaagcacttcctttgtttaggagagcagactttagcaattggttacaggacagtgtttgccatcgggtgcaaggtgaggtgggctccttaaatgatgccaggtacttggaacatatccttcttcttttgactggtcgacaattggacacagccacagaaattgctgtctcaaggggtgatgttcggttggcaatcttgctaagtcaggcaggtgggtcaatgtcaaatcgatctgaccttgctcagacactggatcagtggaaaatgaatggtctagattttgattatattgaggaagactggttaaaggtatataggttgcttgctggtaacgtacaggctgcttttctagattcaccaattgactggaaaaggtaccttggtttgattatgtggtatcaattatcacctgaaacaccacttgatattatcattcgttcttatgatcaactccttggtgagggcaaagttccctatcctgttcctgtatatatagatgaaggacctcttgatgaagcgcctcagtggtccccaggtgaccattttgatatctccttctacctaatgcttcttcatgccaatcaaggcgagaagtttgggctgctaaaaactatgttcagtgcattctcatcttcattcgaccccttggattatcatatgatatggcatcagcgttcgattttggaagctgttggtgctttcagttcaaatgatcttcacctgctagatttaagttttgtttatcaattactttgtcttgggaagtgccattgggctatctatgtcattctacacatgccgtatcttgacgatgccccatacattcatgaaaaattaatcagggaagttttatcacagtattgtgagtcatggagtagagatgatgctcaaaggcaatatattgtggaacttggtataccagaagaatggatgcatgaagctctggctctttatcacgaatactatggagataagcagggtgcactggagaattttattcagtgtggcaactggaagaaagctcatactattttcatgacttctgttgctcattctatgtttctgtcatctaaccatcaggaggtctggaagatcacaagttccttggagaaccataagtctgaaattgctgactgggaccttggtgccggcatatacatagacttctacgttctaaagaactcaatgcaagaaagaaatgccatggatgattcggattcactcgaggagataagtgaatcatgcagaaatttctttggccgattaaatgattcattgttagtctggggaagcaaattacctgttgagtcaagggcatgctactcgaagatggcagaggagctatgcgcgcttctcgtggacaccccaagcgagacactgaatctacccatgggatgtcttcagacaatgctcaacgctccagttcctgatgaaatcaggtcgtcgtacctgcaggatgcactctccgtcttcaccgaaattctttgcagcgattcatag

SEQ ID NO: 6682 - protein, 1007 aa, Sorghum bicolor
  misc_feature: Ceres ANNOT ID no. 6068052
  misc_feature (2)..(150): Pfam Id: Nucleoporin2 Pfam Desc: Nucleoporin autopeptidase
  misc_feature (222)..(1003): NCBI GI: 92876937 NCBI Desc: peptidase s59, nucleoporin [medicago truncatula]
  misc_feature (8)..(643): NCBI GI: 6503280 NCBI Desc: identical to gi1297187 nucleoprotein 98 homolog from arabidopsis thaliana cosmid gbu53501. est gbw43800 comes from this gene
  misc_feature (146)..(960): NCBI GI: 21264365 NCBI Desc: nucleoporin 98kd isoform 1 [homo sapiens]
  misc_feature (146)..(960): NCBI GI: 18032249 NCBI Desc: nup196 nucleoporin [homo sapiens]
  misc_feature (146)..(922): NCBI GI: 33860189 NCBI Desc: nuclear pore complex protein nup98-nup96 precursor [contains: nuclear pore complex protein nup98 (nucleoporin nup98) (98 kda nucleoporin); nuclear pore complex protein nup96
  misc_feature (146)..(922): NCBI GI: 33860189 (continued) (nucleoporin nup96) (96 kda nucleoporin)]
  misc_feature: Useful for making plants with modulated flowering time
  misc_feature: Functional homolog of the protein sequence given in SEQ ID NO 13962
MAARTVFPVLRSSEYFTRPSIDELVEREVANPGYCSRVPNFIIGRAGYGQVRFLGDTDVRGIDLNEIVRFEKHYVVVYEDETCKPPVGHGLNKAAEVSLLLSLKDLPEPSILVEVLRCRARKQGSRFLSFNPVNGKWKFEVDHFSRFGLVDEEEEDAVMDEAAVRQPITEVRERDPPSNGHEIELSHSLPAHLGLDPAKMQEMRMVMFSNEEEDEYMEDDGFPSDERYVSRERMNVDSPTSSGKGLRLRSLSPLHMSSQKSGRRSGMPVRKEPQALLEYSMNSSELGPSTQGILMSGQNRGFPVSMTKVDGFKLPADQETPVAGNMYTNCVVDAALFMGRSFRVGWGPNGLLVHSGSLVNNPGTGLSSVIHIEKVASDKLVRDDKSKIKDDLTELCFSDPMGLHKSLDHEILETESDSFRLKLQKVMANRLVLPDICRSYIDIIEKQLEVSDLSMSTRVLLMHQVTVWELIRVLFSERATGNQLEPVGDDDQEGMVLDKKEGYVDIDPEALPLFRRADFSNWLQDSVCHRVQGEVGSLNDARYLEHILLLLTGRQLDTATEIAVSRGDVRLAILLSQAGGSMSNRSDLAQTLDQWKMNGLDFDYIEEDWLKVYRLLAGNVQAAFLDSPIDWKRYLGLIMWYQLSPETPLDIIIRSYDQLLGEGKVPYPVPVYIDEGPLDEAPQWSPGDHFDISFYLMLLHANQGEKFGLLKTMFSAFSSSFDPLDYHMIWHQRSILEAVGAFSSNDLHLLDLSFVYQLLCLGKCHWAIYVILHMPYLDDAPYIHEKLIREVLSQYCESWSRDDAQRQYIVELGIPEEWMHEALALYHEYYGDKQGALENFIQCGNWKKAHTIFMTSVAHSMFLSSNHQEVWKITSSLENHKSEIADWDLGAGIYIDFYVLKNSMQERNAMDDSDSLEEISESCRNFFGRLNDSLLVWGSKLPVESRACYSKMAEELCALLVDTPSETLNLPMGCLQTMLNAPVPDEIRSSYLQDALSVFTEILCSDS

SEQ ID NO: 6683 - DNA, 1440 bp, Sorghum bicolor
  misc_feature: Ceres ANNOT ID no. 6068054
  misc_feature: Encodes the peptide sequence at SEQ ID NO 6684
  misc_feature: Up-regulated in root tissues in response to salicylic acid treatment
atggccgcgtcgctgcttcgccgtggcgctgtcgccagccgccggcgatgcccggaggggatgctgcggcggctggtctcgtctgaggcggcgcccgagcgggcaccgtcgtcgcggccgccgccggagatgccgtcgtttgaccaccagccccgcccgtacgccgggatgggtggcgccgagatcttccagaagaggaaggcggtgctcggaccgtcgctcttccactattaccagaagccgctcaacatcgtggaggggaagatgcagtacctgtatgacgagaatgggaagagatacctcgattgctttgggggcattgtaacagtgtcgtgtggccattgccatccggatattgtgaatgctgtggtggagcagaccaagttgctccagcacacaaccaccatttacttgcatcatgccattgtagagtttgcagaggccctcacctccaaaatgcctggcaatctcaaggttgcgtatttcgtgaattctgggactgaagcgaatgaattagcaatgttgatggcccggctgtatagtgggaatctcagtatggttgcacttagaaatgcatatcatggtggaagtgccggtacgattggattgactggtttgcagacgtggaagtaccccattcctcagggtgaaatacatcatgtcatgaaccctgatccttatcgagggacttttgggtctgatgctgcagcttatgccaaggaagtcgaagaacacataacttacggaagttcaggaagggttgcaggcttcattgcagaaacattccagggtgtcggaggtgctgttgaactagctcctggatacctaaagttagcttatgacattgtgcgcaaggctggtggtgtttgtattgctgatgaagtccagagtggttttggtcgtactggcagtcattattggggattccagacacagggtgttattcctgacatagtcaccatggcaaagggaattggcaatggcctgccactgggggcagttgtaacaactcctgagattgcaagtgtgttagctcaaaaaatccaatttaacacatttggtggaaatccagtttgttctgctggtggattagctgtgcttaaggttcttgacaaggagaaacgccaggcacattgtgctgatgttggagctcacttggtggaacgtctaaaatcgcttcaggagaagcacgaaatcataggtgatgttagaggaaggggcctgatgcttggggtggaactcgttacggacagaaaggagaagacccctgccaaggcagaaaccactgaactgtttgagaagctcaaagatctcggagtactagttggaaagggcggtctgcatggtaacgtcttcagaataaaaccaccaatgtgcttttcgaaggacgatgcagacttcttggtggactgcatggactacgcaatgtcagggctctga

SEQ ID NO: 6684 - protein, 479 aa, Sorghum bicolor
  misc_feature: Ceres ANNOT ID no. 6068054
  misc_feature (83)..(416): Pfam Id: Aminotran_3 Pfam Desc: Aminotransferase class-III
  misc_feature (1)..(479): NCBI GI: 92899037 NCBI Desc: peptidase s1 and s6, chymotrypsin/hap; aminotransferase class-iii [medicago truncatula]
  misc_feature (35)..(479): NCBI GI: 5731259 NCBI Desc: alanine:glyoxylate aminotransferase 2 homolog [arabidopsis thaliana]
  misc_feature (230)..(477): NCBI GI: 28574759 NCBI Desc: cg11241-pa [drosophila melanogaster]
  misc_feature (230)..(477): NCBI GI: 16198011 NCBI Desc: ld24726p [drosophila melanogaster]
  misc_feature (237)..(477): NCBI GI: 54641146 NCBI Desc: ga10859-pa [drosophila pseudoobscura]
  misc_feature (35)..(479): SWISSPROT Homolog: EC 2.6.1.44 Alanine--glyoxylate aminotransferase 2 homolog 1, mitochondrial precursor
  misc_feature: Up-regulated in root tissues in response to salicylic acid treatment
MAASLLRRGAVASRRRCPEGMLRRLVSSEAAPERAPSSRPPPEMPSFDHQPRPYAGMGGAEIFQKRKAVLGPSLFHYYQKPLNIVEGKMQYLYDENGKRYLDCFGGIVTVSCGHCHPDIVNAVVEQTKLLQHTTTIYLHHAIVEFAEALTSKMPGNLKVAYFVNSGTEANELAMLMARLYSGNLSMVALRNAYHGGSAGTIGLTGLQTWKYPIPQGEIHHVMNPDPYRGTFGSDAAAYAKEVEEHITYGSSGRVAGFIAETFQGVGGAVELAPGYLKLAYDIVRKAGGVCIADEVQSGFGRTGSHYWGFQTQGVIPDIVTMAKGIGNGLPLGAVVTTPEIASVLAQKIQFNTFGGNPVCSAGGLAVLKVLDKEKRQAHCADVGAHLVERLKSLQEKHEIIGDVRGRGLMLGVELVTDRKEKTPAKAETTELFEKLKDLGVLVGKGGLHGNVFRIKPPMCFSKDDADFLVDCMDYAMSGL

SEQ ID NO: 6685 - DNA, 1440 bp, Sorghum bicolor; identical to SEQ ID NO: 6683
  misc_feature: Ceres ANNOT ID no. 6068056
  misc_feature: Encodes the peptide sequence at SEQ ID NO 6686
  misc_feature: Up-regulated in root tissues in response to salicylic acid treatment

SEQ ID NO: 6686 - protein, 479 aa, Sorghum bicolor; identical to SEQ ID NO: 6684
  misc_feature: Ceres ANNOT ID no. 6068056
  misc_feature (83)..(416): Pfam Id: Aminotran_3 Pfam Desc: Aminotransferase class-III
  misc_feature (1)..(479): NCBI GI: 92899037 NCBI Desc: peptidase s1 and s6, chymotrypsin/hap; aminotransferase class-iii [medicago truncatula]
  misc_feature (35)..(479): NCBI GI: 5731259 NCBI Desc: alanine:glyoxylate aminotransferase 2 homolog [arabidopsis thaliana]
  misc_feature (230)..(477): NCBI GI: 28574759 NCBI Desc: cg11241-pa [drosophila melanogaster]
  misc_feature (230)..(477): NCBI GI: 16198011 NCBI Desc: ld24726p [drosophila melanogaster]
  misc_feature (237)..(477): NCBI GI: 54641146 NCBI Desc: ga10859-pa [drosophila pseudoobscura]
  misc_feature (35)..(479): SWISSPROT Homolog: EC 2.6.1.44 Alanine--glyoxylate aminotransferase 2 homolog 1, mitochondrial precursor
  misc_feature: Up-regulated in root tissues in response to salicylic acid treatment

SEQ ID NO: 6687 - DNA, 1287 bp, Sorghum bicolor
  misc_feature: Ceres ANNOT ID no. 6068062
  misc_feature: Encodes the peptide sequence at SEQ ID NO 6688
  misc_feature: Up-regulated in shoot tissues in response to salicylic acid treatment
atgatgctggaagggaagtcctaccttgtgtcgcgctccctgccgagctcctgcgagccagagacggagtgggcgtacctcgcccacgaggtcctcagcggcaagcgcccgacgccggaagacgtcgaggtcgaagacctcgacgaagctgacggcggcggcaagcgcagcaagccgccgtctccacagccgcacacgccggacatctgcgagggccacggctccagccgccatgcctccggttgcggagagcagcagggcactgggagcaaccccatgaattcaatcggtcgtgacctgaccatcaattgcctcctccggctatcccggtccgactacggctcggtcgcctcgctcagccgggacttccgcgccatggtccgcagtggggagatctaccgcctgcggcgccagagtggggtggccgagcactgggtatacttctcctgcaatgttcttgaatgggatgcctatgacccatatcgagagcgctggatccaagtgcccaagatgccgcctgatgaatgcttcatgtgctctgacaaggaatcacttgcagtgggcactcaactgcttgtgtttgcgatggcgcatattgtgttcagatacagcatcctaaccaattcatggaccatggctgatccaatgaactctccacggtgcctgtttgggtcaacaagtgttggggaaaaggccttcgttgctggaggcactgattctggtggcaacatactgagctctgcagagatgtatgactctgagacacatacctggacgcccctcccaagcatgaatagggcgaggaagatgtgttctggggttttcatggatggcaagttctatgtgataggtggtgtggccaacaacaacagagtgctgacttgtggggaggagtatgacttgaagaggcgttcttggaggataatcgagaacatgtctgaaggcctcaatggagtgactggtgctcctccccttattgcagttgtcaacaatgagctctatgccgctgattacagcgagaaggatctcaagaagtatgacaagaagaacaataggtggatcacccttggaaaactgcctgaacggtctgtatcaatgaatgggtggggccttgctttccgagcgtgcggtgaccgcttgattgtcatcggaggtccaaggacctatactggtggtactattgagctcaactcatggatcccagatgagcggccgcctgtgtggaatttgattgccaggcggccatctgggaacttcgtgtataactgtgccgtgatgggttgctga

SEQ ID NO: 6688 - protein, 428 aa, Sorghum bicolor
  misc_feature: Ceres ANNOT ID no. 6068062
  misc_feature (219)..(265): Pfam Id: Kelch_1 Pfam Desc: Kelch motif
  misc_feature (267)..(313): Pfam Id: Kelch_1 Pfam Desc: Kelch motif
  misc_feature (219)..(265): Pfam Id: Kelch_2 Pfam Desc: Kelch motif
  misc_feature (2)..(428): NCBI GI: 46390943 NCBI Desc: kelch repeat-containing f-box-like [oryza sativa (japonica cultivar-group)]
  misc_feature (96)..(428): NCBI GI: 92899179 NCBI Desc: cyclin-like f-box [medicago truncatula]
  misc_feature (14)..(428): NCBI GI: 4262182
  misc_feature (83)..(428): NCBI GI: 38344328 NCBI Desc: osjnba0058k23.10 [oryza sativa (japonica cultivar-group)]
  misc_feature (83)..(428): NCBI GI: 90399335 NCBI Desc: h0313f03.20 [oryza sativa (indica cultivar-group)]
  misc_feature: Up-regulated in shoot tissues in response to salicylic acid treatment
  misc_feature: The sequence is a functional homolog of SEQ ID NO. 315 in the 11/188,298 US application
  misc_feature: The sequence is a functional homolog of SEQ ID NO. 440 in the 11/188,298 US application
MMLEGKSYLVSRSLPSSCEPETEWAYLAHEVLSGKRPTPEDVEVEDLDEADGGGKRSKPPSPQPHTPDICEGHGSSRHASGCGEQQGTGSNPMNSIGRDLTINCLLRLSRSDYGSVASLSRDFRAMVRSGEIYRLRRQSGVAEHWVYFSCNVLEWDAYDPYRERWIQVPKMPPDECFMCSDKESLAVGTQLLVFAMAHIVFRYSILTNSWTMADPMNSPRCLFGSTSVGEKAFVAGGTDSGGNILSSAEMYDSETHTWTPLPSMNRARKMCSGVFMDGKFYVIGGVANNNRVLTCGEEYDLKRRSWRIIENMSEGLNGVTGAPPLIAVVNNELYAADYSEKDLKKYDKKNNRWITLGKLPERSVSMNGWGLAFRACGDRLIVIGGPRTYTGGTIELNSWIPDERPPVWNLIARRPSGNFVYNCAVMGC

SEQ ID NO: 6689 - DNA, 1560 bp, Sorghum bicolor
  misc_feature: Ceres ANNOT ID no. 6068066
  misc_feature: Encodes the peptide sequence at SEQ ID NO 6690
atggctcgcggcgacggcgagctggagctgtcggtgggggtccgcggcgccggcggcggggccgcggcggcggaccacgtggcgccgatcagcctcggcaggctcatcctcgccggcatggtcgccggcggcgtgcagtacggctgggcgctgcagctctccctcctgacgccctacgtgcagactctggggctttcacatgccctcacttcattcatgtggctatgcggtcctattgctggcttagtggttcaaccgttggttggcctgtacagtgataggtgtacagcaagatggggaagacggaggccattcattctgacaggatgtgtgctcatctgcattgctgtcattgttgttggcttttcgtcagacatcggagctgcgctaggggacacaaaggaacattgcagtctctatcatggtcctcgctggcatgctgcaattgtatatgttctggggttttggctccttgacttctccaacaatactgtgcaaggtccagcacgtgctatgatggctgatttgtgcggtcatcatgggcctagtgcagctaattcaatcttctgttcttggatggcgctgggaaacatcctaggttattcctctggttccacaaacaattggcacaagtggtttcccttcctcaaaacaaatgcctgttgtgaagcctgtgcaaacctgaaaggtgcatttctggtggctgtggtgttcctagtcatatgcttggctataaccctcgtcttcgccaaggaagtaccatacagaggaaacgagaacctcccaacaaaagcaaacggcgaggttgaagctgaacctaccgggccacttgctgtgctcaagggcttcaagaacttgccccgcgggatgccatccgttcttctcgtaactggcctcacctggctctcgtggttcccgttcatcctctacgacaccgactggatgggccgtgagatctaccacggcgacccaaagggcaccaatgctcagatctcggcattcaacgaaggtgtcagaataggcgcattcgggctgcttctcaactcgattgttctaggattcagctcgttcctgatcgagcccatgtgccggaaggtcgggccgagggttgtgtgggtgacgagcaacttcatggtgtgcatcgccatggcggccaccgcgctgatcagcttctggtcgctcaaggactaccacggatacgtgcagaacgccatcaccgccagcacgagcatcaaggccgtctgcctcgtcctcttcgccttcctgggtgtccctctcgccatcctgtacagcgtcccgttcgcggtgacggcgcagctagcggccagcatgggcggcgggcaggggctgtgcaccggcgtcctcaacatctccatcgttatcccccaggtgatcatcgcggtgggcgcaggcccgtgggacgcgctgttcggcaagggcaacatcccggcgttcggcgtggcgtcggggttcgccctcatcggcggcgtcgtgggcatgttcctgctgcccaggatctccaagcgccagttcagggccgtcagcgcgggcggccactga

SEQ ID NO: 6690 - protein, 519 aa, Sorghum bicolor
  misc_feature: Ceres ANNOT ID no. 6068066
  misc_feature (35)..(518): Pfam Id: Sugar_tr Pfam Desc: Sugar (and other) transporter
  misc_feature (38)..(504): Pfam Id: MFS_1 Pfam Desc: Major Facilitator Superfamily
  misc_feature (1)..(519): NCBI GI: 54873545 NCBI Desc: sucrose transporter [saccharum hybrid cultivar]
  misc_feature (1)..(519): NCBI GI: 5771354 NCBI Desc: sucrose transporter [zea mays]
  misc_feature (4)..(518): NCBI GI: 9624451 NCBI Desc: sucrose transporter [oryza sativa (indica cultivar-group)]
  misc_feature (4)..(518): NCBI GI: 2723471 NCBI Desc: sucrose transporter [oryza sativa (japonica cultivar-group)]
  misc_feature (1)..(519): NCBI GI: 7024415 NCBI Desc: sucrose transporter 1 [hordeum vulgare subsp. vulgare]
  misc_feature: Useful for making plants with modulated heat sensitivity
  misc_feature: Functional homolog of the protein sequence given in SEQ ID NO 13009
MARGDGELELSVGVRGAGGGAAAADHVAPISLGRLILAGMVAGGVQYGWALQLSLLTPYVQTLGLSHALTSFMWLCGPIAGLVVQPLVGLYSDRCTARWGRRRPFILTGCVLICIAVIVVGFSSDIGAALGDTKEHCSLYHGPRWHAAIVYVLGFWLLDFSNNTVQGPARAMMADLCGHHGPSAANSIFCSWMALGNILGYSSGSTNNWHKWFPFLKTNACCEACANLKGAFLVAVVFLVICLAITLVFAKEVPYRGNENLPTKANGEVEAEPTGPLAVLKGFKNLPRGMPSVLLVTGLTWLSWFPFILYDTDWMGREIYHGDPKGTNAQISAFNEGVRIGAFGLLLNSIVLGFSSFLIEPMCRKVGPRVVWVTSNFMVCIAMAATALISFWSLKDYHGYVQNAITASTSIKAVCLVLFAFLGVPLAILYSVPFAVTAQLAASMGGGQGLCTGVLNISIVIPQVIIAVGAGPWDALFGKGNIPAFGVASGFALIGGVVGMFLLPRISKRQFRAVSAGGH

SEQ ID NO: 6691 - DNA, 1011 bp, Sorghum bicolor
  misc_feature: Ceres ANNOT ID no. 6068067
  misc_feature: Encodes the peptide sequence at SEQ ID NO 6692
atggggtgcaccacctcaaggcaggcccgtcacgacctccggtactgcccgtcgccgctgggggcgctgccgcgcagccagtcgttcccggctcggtgccccagcgacgtcggagtccacgtggtgcggctcacgtcgtccacgctcggctccctggagctcgaaaaggccctgccgcgggcaccggagcccgcggcggcgcgcgcgaccacgaggcttgcgccacggacgcccaccatgacgccgcccaacgagcccgaggacatcgacgcgtgggcgctcatggccggcctcgaggaccactcaccgctgctggccgcgccgttcggccgccactccttctcgttcccggtcgccacggtgccgcaggacctcacggcgtctgccaaggtgacgccgctgccgatgcctcggcccgacgccgccctggtgaccggtggcgaggggaagccggcgccgccgccggtgccgccgcggagagcggtgctctacttcacgtcgctgcgcggcgtgcgcgccacgtacgaggactgctgcctggcgcgcgccatcctcaagggctacggcgtgcgcctcgacgagcgcgacgtgtccatgcaccgcggcttccgggacgagctccgcggccttctcgacctcggcggcggcccgctcgccaagtgccgggcgcccgccacgcccgccgcactcccgagcctgttcgtggacggggagctcgtgggcaacgccgaggagctgaagcggctgcacgagaccggggagctcgcggcgaggctggccgggtgcgaaagcgccgcggcgaccggcgcccatggcgaggccggcgcgtgcgaggcctgcggggacgtgcggttcgtgctctgcgaggtctgctcgggcagctgcaaggtgtacgtggacgacgaagacgagccggaggaggaaggcgacgaatgcggcggcggcgggttccggcggtgcacggagtgcaacgagaacggcatcgtgaggtgccccgtgtgctgctgctga

SEQ ID NO: 6692 - protein, 336 aa, Sorghum bicolor
  misc_feature: Ceres ANNOT ID no. 6068067
  misc_feature (162)..(240): Pfam Id: Glutaredoxin Pfam Desc: Glutaredoxin
  misc_feature (160)..(335): NCBI GI: 87240364 NCBI Desc: glutaredoxin [medicago truncatula]
  misc_feature (154)..(323): NCBI GI: 32490043 NCBI Desc: osjnba0063c18.3 [oryza sativa (japonica cultivar-group)]
  misc_feature (150)..(334): NCBI GI: 115467206 NCBI Desc: os06g0226100 [oryza sativa (japonica cultivar-group)]
  misc_feature (132)..(323): NCBI GI: 115448683 NCBI Desc: os02g0748800 [oryza sativa (japonica cultivar-group)]
  misc_feature (155)..(261): NCBI GI: 124359980 NCBI Desc: thioredoxin fold [medicago truncatula]
MGCTTSRQARHDLRYCPSPLGALPRSQSFPARCPSDVGVHVVRLTSSTLGSLELEKALPRAPEPAAARATTRLAPRTPTMTPPNEPEDIDAWALMAGLEDHSPLLAAPFGRHSFSFPVATVPQDLTASAKVTPLPMPRPDAALVTGGEGKPAPPPVPPRRAVLYFTSLRGVRATYEDCCLARAILKGYGVRLDERDVSMHRGFRDELRGLLDLGGGPLAKCRAPATPAALPSLFVDGELVGNAEELKRLHETGELAARLAGCESAAATGAHGEAGACEACGDVRFVLCEVCSGSCKVYVDDEDEPEEEGDECGGGGFRRCTECNENGIVRCPVCCC

SEQ ID NO: 6693 - DNA, 288 bp, Sorghum bicolor
  misc_feature: Ceres ANNOT ID no. 6068071
  misc_feature: Encodes the peptide sequence at SEQ ID NO 6694
atggctggagcagggagatgtttttgtttggtcactgacaattacttgcaacatatcacgagggcagaggtgcttctcctcttccggtccttcctccgcacggcaaagcagttctcagactacaacatctgcgagtacacagacacacgccgccgcgccgcggatgccttccgcgagaaccgtgttctcgcagacgctccaaccgctgccgcggcattagcgaagggaggaatgtacccgctctacgcccccaaggctaagagtgcgatggagttgaaggtgcagtga

SEQ ID NO: 6694 - protein, 95 aa, Sorghum bicolor
  misc_feature: Ceres ANNOT ID no. 6068071
  misc_feature (19)..(85): Pfam Id: Complex1_LYR Pfam Desc: Complex 1 protein (LYR family)
  misc_feature (20)..(65): NCBI GI: 16306961 NCBI Desc: chromosome 6 open reading frame 149 [homo sapiens]
  misc_feature (20)..(61): NCBI GI: 44982521 NCBI Desc: adl113cp [eremothecium gossypii]
  misc_feature (20)..(61): NCBI GI: 45187760 NCBI Desc: adl113cp [eremothecium gossypii]
  misc_feature (20)..(65): NCBI GI: 119575580 NCBI Desc: chromosome 6 open reading frame 149, isoform cra_a [homo sapiens]
  misc_feature (20)..(65): NCBI GI: 119575582 NCBI Desc: chromosome 6 open reading frame 149, isoform cra_c [homo sapiens]
MAGAGRCFCLVTDNYLQHITRAEVLLLFRSFLRTAKQFSDYNICEYTDTRRRAADAFRENRVLADAPTAAAALAKGGMYPLYAPKAKSAMELKVQ

SEQ ID NO: 6695 - DNA, 1209 bp, Sorghum bicolor
  misc_feature: Ceres ANNOT ID no. 6068078
  misc_feature: Encodes the peptide sequence at SEQ ID NO 6696
atggcagcatcctcctccctgggctctgccaaagccctagcgtgctcccacgcctccctcctcgcgccccaattccaaagaccagtggtcgcgccagctccgtcgcgccgcacttccgtcaggatgcgcgcttctgctactgctgccccggcggagccgaagaagaccgtctgggtgtggaccgagagccggcaggtgatgacggcggccgtggagaggggctggagcactttcctcttcggatccaaagatctcggcaaggactggtcatcaactgctcgcatcaatcctctattcattgatggcccggagattttcaatggggaaaaccaaaaggttgctgtaatttcacaagtctcttcgcccagtgaacttgaccgtgtacaacctgaaaatgccgaagccgagaacattgtcatagactttcgaggtgattggcaggttataccggcagaaaatatagttgctgctttccaaggatgcaaaggaactgtattggctgtttcaaccaactcaactgaggcacaagtttttcttgaggccttggagcaagggcttgatggagttgtacttaaagcagatgacatggatgatatcattaagctcaaggattattttgacagaaggaacgaggcaaagagtcaattaccattgacaaaggctactgtatcaaaggttgaggttgttggtatgggtgatcgtgtttgtgtcgatctttgcagtatcatgcgacctggtgaaggccttctggttggatcttatgcaagaggaatgtttcttgttcattctgaatgcttggagactaattacattgcaagcaggcctttcagagtcaatgcaggtcctgtgcatgcatatgtcaccgttcctggtggcaagacaagctacctctcagagttggggtcaggaaaggaagtcatcatcgtcgatcaaaatgggctatggcgtactgcaattgtgggtcgtgtgaaaattgaatcaaggcctctcatccttgtagaagcaaaggataactctggagatgacacgtatagcatttttctacaaaatgcagaaacagttgcacttatcatccctgacacgggatcaagtggaagaacagctattcctgtgacttccctgaaagtcggtgatgaagttttggtgaggaaacagggcggcgcccgtcacactgggatagagattcaggagtttattgttgagaaatga

SEQ ID NO: 6696 - protein, 402 aa, Sorghum bicolor
  misc_feature: Ceres ANNOT ID no. 6068078
  misc_feature (55)..(402): Pfam Id: DHQS Pfam Desc: 3-dehydroquinate synthase (EC 4.6.1.3)
  misc_feature (111)..(402): NCBI GI: 134046704 NCBI Desc: 3-dehydroquinate synthase [methanococcus maripaludis c5]
  misc_feature (107)..(402): NCBI GI: 145644135 NCBI Desc: 3-dehydroquinate synthase [methanococcus maripaludis c7]
  misc_feature (145)..(402): NCBI GI: 21227374 NCBI Desc: 3-dehydroquinate synthase [methanosarcina mazei go1]
  misc_feature (145)..(402): NCBI GI: 72395621 NCBI Desc: 3-dehydroquinate synthase [methanosarcina barkeri str. fusaro]
  misc_feature (145)..(402): NCBI GI: 116753852 NCBI Desc: 3-dehydroquinate synthase [methanosaeta thermophila pt]
MAASSSLGSAKALACSHASLLAPQFQRPVVAPAPSRRTSVRMRASATAAPAEPKKTVWVWTESRQVMTAAVERGWSTFLFGSKDLGKDWSSTARINPLFIDGPEIFNGENQKVAVISQVSSPSELDRVQPENAEAENIVIDFRGDWQVIPAENIVAAFQGCKGTVLAVSTNSTEAQVFLEALEQGLDGVVLKADDMDDIIKLKDYFDRRNEAKSQLPLTKATVSKVEVVGMGDRVCVDLCSIMRPGEGLLVGSYARGMFLVHSECLETNYIASRPFRVNAGPVHAYVTVPGGKTSYLSELGSGKEVIIVDQNGLWRTAIVGRVKIESRPLILVEAKDNSGDDTYSIFLQNAETVALIIPDTGSSGRTAIPVTSLKVGDEVLVRKQGGARHTGIEIQEFIVEK

SEQ ID NO: 6697 - DNA, 1302 bp, Sorghum bicolor
  misc_feature: Ceres ANNOT ID no. 6068081
  misc_feature: Encodes the peptide sequence at SEQ ID NO 6698
atgtggaggggcggcgccaccgccgcctccgccgcgagggctctccgctcgcgcctcctcctcgaccccatccaccacccggccacgtcgctcggtcctattgcttcgacgcgtacctcctcctcttccacctcgtccactgccgcggcgaacgccatcgttgaagaagcggcggcggcggcggcggctgtatccgtttcacagcataccggatccatctccgacgcgctgcggcactacgggaactgctactgggagctctcgaaagcccgcctcagtgctcttgtggtggcaacttcgggggctggctatgtgctcggtagtggcaacatcgtggacattgctggactttgttgcacatgtgctggtacaatgatggttgcagcatctgcaaataccctcaaccaggtgttcgagataaaaaatgacgctaaaatgaaaaggacaatgcgacggcccctgccatctggtcgcattagtcctgcacatgctgccatgtgggctacaagtgttggagttgcaggaacagctttgctggcctggaaggctaatggcttggcagctgggcttgcagcttctaatcttgttctgtacgcatttgtgtatacgccattgaagcaaatacaccctgttaatacatgggttggggcagtcgttggtgccattccaccacttctggggtgggcagcagcttcaactgaactgtcgctaaatgcgatgatactccctgccgcattgtactattggcaaatacctcattttatggctcttgcgtacttatgtcgcaatgattatcttgctggagggtatcgtatgttttcttttgctgaccctactggtaaaagaactgcgtgggtatcactaagaaattgtctgtacatgctacctttggggttatttgcatacaactggggcctcacatctgagtggttcggtcttgaagcttcactcctaacattaggccttaccattggagctctatcatttgtgctggaaccaagtccgaagactgcgaggagaatgttctatggcagcctgctgtatctccctgctttcatggctggacttcttttacatcgacttcctaatgaacaaaaggtgcacaacctagccgagaaaactgacctggctgagaaaagtgagctggatggagttctgtacggggctgatctgcaggacaaagaaagatcgcaacagaaacaccgagacaggaaaccttctcgtctgcaatcacgccctccagttgcctatgcttctgtggctccattccctttcctaccggtacccatatatgagtcatga

SEQ ID NO: 6698 - protein, 433 aa, Sorghum bicolor
  misc_feature: Ceres ANNOT ID no. 6068081
  misc_feature (93)..(360): Pfam Id: UbiA Pfam Desc: UbiA prenyltransferase family
  misc_feature (37)..(227): NCBI GI: 140057471 NCBI Desc: ubia prenyltransferase [medicago truncatula]
  misc_feature (23)..(399): NCBI GI: 108883176 NCBI Desc: protoheme ix farnesyltransferase [aedes aegypti]
  misc_feature (84)..(360): NCBI GI: 116117491 NCBI Desc: ensangp00000013941 [anopheles gambiae str. pest]
  misc_feature (84)..(360): NCBI GI: 126002112 NCBI Desc: ga18613-pa [drosophila pseudoobscura]
  misc_feature (84)..(360): NCBI GI: 19921064 NCBI Desc: cg5037-pa [drosophila melanogaster]
MWRGGATAASAARALRSRLLLDPIHHPATSLGPIASTRTSSSSTSSTAAANAIVEEAAAAAAAVSVSQHTGSISDALRHYGNCYWELSKARLSALVVATSGAGYVLGSGNIVDIAGLCCTCAGTMMVAASANTLNQVFEIKNDAKMKRTMRRPLPSGRISPAHAAMWATSVGVAGTALLAWKANGLAAGLAASNLVLYAFVYTPLKQIHPVNTWVGAVVGAIPPLLGWAAASTELSLNAMILPAALYYWQIPHFMALAYLCRNDYLAGGYRMFSFADPTGKRTAWVSLRNCLYMLPLGLFAYNWGLTSEWFGLEASLLTLGLTIGALSFVLEPSPKTARRMFYGSLLYLPAFMAGLLLHRLPNEQKVHNLAEKTDLAEKSELDGVLYGADLQDKERSQQKHRDRKPSRLQSRPPVAYASVAPFPFLPVPIYES

SEQ ID NO: 6699 - DNA, 567 bp, Sorghum bicolor
  misc_feature: Ceres ANNOT ID no. 6068082
  misc_feature: Encodes the peptide sequence at SEQ ID NO 6700
atggtgggtcggaagccgatgcgccgccgccgaagtgaccggcaaccgccgccgcaatccttcggcgccacggctcgcccgagttccccacgctcgctcgcctccactcctgcctccgctgccgcggtcgccgccgacctggacgagctgctgctgacggcgcccccgccgtccgcgtcggagccccggagcttctcgtacgcggtgaagcagcagtgctgggagaaggcggagcgggttcccggacgcgacccggagaggtggcgccgcgatgcgctcggcaacatcgtcttccgcaagctcgtggggtgccccggctgtctctgccacgactacgaccacatcgtcccctactccaagggcgggaagagcacattggagaattgccaggttttgcaggctacggtgaatcgatctaaaggcaacaagactgagatatccaaatctgagctcatacagaagagtgcatattgtagggtttcaggacgggacatggatcttgttgaactctctgcctatggaaatgtccggcgagggccagattcagggggctgcaaaatccaatga

SEQ ID NO: 6700 - protein, 188 aa, Sorghum bicolor
  misc_feature: Ceres ANNOT ID no. 6068082
  misc_feature (102)..(144): Pfam Id: HNH Pfam Desc: HNH endonuclease
  misc_feature (61)..(176): NCBI GI: 146181610 NCBI Desc: hnh endonuclease family protein [tetrahymena thermophila sb210]
  misc_feature (61)..(120): NCBI GI: 42572595 NCBI Desc: hnh endonuclease domain-containing protein [arabidopsis thaliana]
  misc_feature (52)..(185): NCBI GI: 38605769 NCBI Desc: osjnba0044k18.12 [oryza sativa (japonica cultivar-group)]
  misc_feature (71)..(144): NCBI GI: 115345574 NCBI Desc: osjnba0044k18.12 [roseobacter denitrificans och 114]
  misc_feature (76)..(145): NCBI GI: 91982954 NCBI Desc: gp48 [propionibacterium phage pa6]
MVGRKPMRRRRSDRQPPPQSFGATARPSSPRSLASTPASAAAVAADLDELLLTAPPPSASEPRSFSYAVKQQCWEKAERVPGRDPERWRRDALGNIVFRKLVGCPGCLCHDYDHIVPYSKGGKSTLENCQVLQATVNRSKGNKTEISKSELIQKSAYCRVSGRDMDLVELSAYGNVRRGPDSGGCKIQ

SEQ ID NO: 6701 - DNA, 1530 bp, Sorghum bicolor
  misc_feature: Ceres ANNOT ID no. 6068086
  misc_feature: Encodes the peptide sequence at SEQ ID NO 6702
atggagttggaggggctgtgggcacgggtgctgctcgacgcggcctccgccgcagcgccgggggaccgggcggcgtgggcagcggtgcgggcgcgcgcggtggcgccggtgctggaggccgcggtgtgggcgtgcctcgccatgtcggtcatgctcgtgctcgaggtgtgctacatgagcgtcgccagcttcgtcgccgtcaacctgctgcgccggaccccggagcggcggtaccgctgggagcccatgccctccgggaccgccggcggccagcaggacgatgaggaggccgcggtgggcagcggcggcggcgaggcgtacccgatggtgctcgtgcagatccccatgtacaacgagagggaggtctacaagctctctattggagcagcatgtgccctcacatggccgctcgaccgtattataatccaagtcttggatgattccaccgatccattcattaaggaacttgtggagcttgaatgcgaggattgggccagaaagaaaataaatataaaatatgaaactcgagaaagtaggaagggatacaaagcaggagccctcaagaagggcatggaacagggttatgcccaagaatgtgattttgtcgccatctttgatgcagattttcagcctgatcctgacttccttttaagaactataccatttcttgtgcataacccgaagattgctttggtacagacacgttgggagtttgtgaactacaatatttgcctactgacaaggatacagaagatgtcactagattatcatttcaaggtagagcaggaatcaggctcatctatgcatgccttctttggtttcaacggtactgctggtgtgtggcgggtatcagctattagggaagcaggaggatggaaggatcgcaccactgtagaagacatggacttggctgtgcgagcaagtctcaagggatggcaattcctgtatgttggtgatataaggggggtaactgtatggaagaagcttcatcttctgtacagcttcttctttgtccgaagggtcatcgctcccatcctgacattcctgttctactgcgtcgtgatcccactgtctgttatggtccctgaagtcagtatcccagtctggggaatgttctacattcccactgctatcacggtcatgaacgccatcaggaatccatggtctatccatctggtgccaatatggatcctgttcgagaacgtcatgtcaatgcaccgaatgcgcgcggcactgacggggttgctggagaccatgtacgtggatgagtgggtggtcaccgagaaggtgggcgaccatgtgaagggcaagctcgagatccctctccttacaccggtgaagccaaccgagtgcgtcgagaggatctacgtgcctgagctcctggtggcgttctacctgttgctatgcgcgtcatacgatgtcgtgctcggaaccgggcactgctacctgtacatcttcctccaggccttcgctttcctcgtgctgggatttggcttcgtcggcaccgcgacgccctgttcttgtccatag

SEQ ID NO: 6702 - protein, 509 aa, Sorghum bicolor
  misc_feature: Ceres ANNOT ID no. 6068086
  misc_feature (111)..(289): Pfam Id: Glycos_transf_2 Pfam Desc: Glycosyl transferase family 2
  misc_feature (3)..(276): NCBI GI: 34419208 NCBI Desc: tpa: cellulose synthase-like a4 [oryza sativa (japonica cultivar-group)]
  misc_feature (3)..(321): NCBI GI: 115450999 NCBI Desc: os03g0169500 [oryza sativa (japonica cultivar-group)]
  misc_feature (15)..(321): NCBI GI: 34419228 NCBI Desc: tpa: cellulose synthase-like a2 [oryza sativa (japonica cultivar-group)]
  misc_feature (26)..(321): NCBI GI: 109628383 NCBI Desc: cellulose synthase-like a1 [pinus taeda]
  misc_feature (14)..(320): NCBI GI: 16519223 NCBI Desc: cellulose synthase-like protein oscsla9 [oryza sativa]
  misc_feature: Useful for making plants with altered cell wall content and/or composition
  misc_feature: Functional homolog of the protein sequence encoded by LOCUS at4g13410
  misc_feature: Functional homolog of the protein sequence encoded by LOCUS at5g03760
  misc_feature: Useful for making plants with altered cell wall content and/or composition
  misc_feature: Functional homolog of the protein sequence given in SEQ ID NO 13963
  misc_feature: Useful for making plants with altered carbohydrate content
  misc_feature: Functional homolog of the protein sequence given in SEQ ID NO 13964
  misc_feature: The sequence is a functional homolog of SEQ ID NO. 403 in the 11/188,298 US application
MELEGLWARVLLDAASAAAPGDRAAWAAVRARAVAPVLEAAVWACLAMSVMLVLEVCYMSVASFVAVNLLRRTPERRYRWEPMPSGTAGGQQDDEEAAVGSGGGEAYPMVLVQIPMYNEREVYKLSIGAACALTWPLDRIIIQVLDDSTDPFIKELVELECEDWARKKINIKYETRESRKGYKAGALKKGMEQGYAQECDFVAIFDADFQPDPDFLLRTIPFLVHNPKIALVQTRWEFVNYNICLLTRIQKMSLDYHFKVEQESGSSMHAFFGFNGTAGVWRVSAIREAGGWKDRTTVEDMDLAVRASLKGWQFLYVGDIRGVTVWKKLHLLYSFFFVRRVIAPILTFLFYCVVIPLSVMVPEVSIPVWGMFYIPTAITVMNAIRNPWSIHLVPIWILFENVMSMHRMRAALTGLLETMYVDEWVVTEKVGDHVKGKLEIPLLTPVKPTECVERIYVPELLVAFYLLLCASYDVVLGTGHCYLYIFLQAFAFLVLGFGFVGTATPCSCP

SEQ ID NO: 6703 - DNA, 825 bp, Sorghum bicolor
  misc_feature: Ceres ANNOT ID no. 6068103
  misc_feature: Encodes the peptide sequence at SEQ ID NO 6704
atggcgacgccgtcgtcgtcgctttgctccagcttcgcctccctgcggaccgcctccatcggccaccgtcgtggcctcacctcctccacgcccaggaagggattccaagcgagggcatcagctcgtgttgacaagttctcaaagagtgacatcattgtgtccccttcgattctatctgcaaactttgccaagctcggcgatcaggtaaaagctgtggaggtggcaggatgcgactggattcatgttgatgtcatggacgggcgctttgtgccaaatatcacaattggacctttggttgttgatgctctgcgtccagtgactgatcttccgttggatgtacatctgatgattgtggaaccggagcagcgtgtccctgattttatcaaggcaggtgctgatattgttagtgtccactgcgaacaaacatctactatccatttgcaccgaacagtcaatcagattaaaagtctaggagcaaaggcaggagttgttttgaatccagcgactccactcgctgcaatcgattatgttcttgatgttgttgacctggtgttgattatgtctgtgaatcctgggtttggtggccagagctttatcgagagtcaagtaaagaaaattgcagaattgagaaggttatgtgcagagaagggagtgaacccctggattgaggttgatggtggtgttggtccgacaaatgcctacaaggttattgaagctggggcgaatgccatagttgctggttctgcagtttttggggctccagactatgctgaagctatcaaaggaatcaagaccagccaaagacctgtagctgtacccgcataa

SEQ ID NO: 6704 - protein, 274 aa, Sorghum bicolor
  misc_feature: Ceres ANNOT ID no. 6068103
  misc_feature (52)..(254): Pfam Id: Ribul_P_3_epim Pfam Desc: Ribulose-phosphate 3 epimerase family
  misc_feature (1)..(274): NCBI GI: 109940150 NCBI Desc: ribulose-phosphate 3-epimerase, chloroplast precursor (pentose-5-phosphate 3-epimerase) (ppe) (rpe) (r5p3e)
  misc_feature (1)..(274): NCBI GI: 4105561 NCBI Desc: ribulose-5-phosphate-3-epimerase [oryza sativa]
  misc_feature (1)..(272): NCBI GI: 20339362 NCBI Desc: ribulose-5-phosphate-3-epimerase [pisum sativum]
  misc_feature (15)..(272): NCBI GI: 902739 NCBI Desc: pentose-5-phosphate-3-epimerase [solanum tuberosum]
  misc_feature (41)..(269): NCBI GI: 4930132 NCBI Desc: chain c, d-ribulose-5-phosphate 3-epimerase from solanum tuberosum chloroplasts
  misc_feature (1)..(274): SWISSPROT Homolog: EC 5.1.3.1 Ribulose-phosphate 3-epimerase, chloroplast precursor
  misc_feature: The sequence is a functional homolog of SEQ ID NO. 534 in the 11/188,298 US application
MATPSSSLCSSFASLRTASIGHRRGLTSSTPRKGFQARASARVDKFSKSDIIVSPSILSANFAKLGDQVKAVEVAGCDWIHVDVMDGRFVPNITIGPLVVDALRPVTDLPLDVHLMIVEPEQRVPDFIKAGADIVSVHCEQTSTIHLHRTVNQIKSLGAKAGVVLNPATPLAAIDYVLDVVDLVLIMSVNPGFGGQSFIESQVKKIAELRRLCAEKGVNPWIEVDGGVGPTNAYKVIEAGANAIVAGSAVFGAPDYAEAIKGIKTSQRPVAVPA

SEQ ID NO: 6705 - DNA, 4518 bp, Sorghum bicolor
  misc_feature: Ceres ANNOT ID no. 6068105
  misc_feature: Encodes the peptide sequence at SEQ ID NO 6706
atggagacaacaccggactgggactgggaggaatgcctcattttcttcctacacggcgtgagcgccgcgtcccaccttatcctggcgctcgccgtcacggggcgcttgctccttcgccgcctctcagccggccgaaccaaggacggggaggtgggtggaggagatgctagccgcagtcttggccggtttccgtactgctacagggtctctgtctgcaccacgtgggctctggcggcgttcgaggtgctcctcgccgcctactcctggtacgcggacggcggcgccgggtggtcgggcgacgcggtcgctgaacgggtggacgcggccgcgcgcgcggtgtcgtggttgctgctcgccgcgtacctgcagttcgatgtcgggcggcgtcggcgccaggagcggttccccgcgccgctcaggatttggtgggcgcttttcacgctgctcaccgtcgtcgccgccggcgttcacgcggcgacgagtctggacgggtttcccgtgcccggtcggtcgtgggcgctcgacgcaatctctgttactgcagcggtggttctactctcagctgggttcctcggaaggaaggagggaaatggacgcggccatgcttccgaggagcaggagcctctgcttaacggcgcgcacggggcggccgatgacgacgacgagaacagcagcagcagcgccgccgacgcatccttgttcactggcgccggctttcttagcgtgctcaccttctcttggatggggcctctgctccgcgtgggccacaggaagaccctcgccctggaggatgtcccgggcctcgaaccaggcgacagcgttgctggcatcctcccgcccttcaaggccaaccttgaggcgctcacccgcgacgtcaacagcgacggcggcaggtccagcaagaaggtcgtcaccgcgttcacgctcaccaaggccctgctgcgcaccatatggtggcacgtcgcggtgaccgcgttctacacgctggtctactgcgtcgccgcctacgtcgggccgtacctcatagactccctggtgcagtacctgtatctcagcggcgacgagaggtacgcgggcaaggggcagcttctcgtgctcgccttcgtcgtggccaaggtgctcgagtgcctgtcgcagcggcacctgttcttccggctgcagcaggcggggatacgcgcgcggtcggcgctcgtcgccgtcgtgtaccagaagagcctcgcgctctccagccagtcgcggcggagccgcacgagcggagagatgatcaacatcgtcagcgttgacgccgaccgcgtcggcatcttctcatggtacctgcacgaggtctggcaagtaccgctgcaaacaggcatggcgatgttcatcctctactccaccctcgggctcgcctcgctcgccgcgctcgctgccaccgtggccatcagcctcgccaccgtgcccctgggaaggatgcaggagaggttccaggagaagctgatggacagcaaggacgcgaggatgaaggcgacgtcagagagccttcacagcatgaggatcctgaagctgcaggggtgggagatgagattcctgtccaaggtcatcgatctgaggaagacggaggcgaactggctaaagagatacctctacacgtcggccaccatgaccttcgtcttctggggcaccccgaccttcgtcgccgtggtgaccttcggagcctgcatgctcatggggatccccttggagacagggaagctgctgtctgcactggccacgttccgcgtgctgcaggaaccgatatacgaactccctggcaccatcgcgatggtgatcaagaccaaggtgtctcttgccaggatagcatcgttcctgtgcctcgacgagctgcccagtgacgctgtgcagaggcttccacgtggcagctctgaggactttgcgatcagcgtcagcaacgggtgcttctcatgggaagcctcacctgaatttccaacactgaaggacctcagcttccaagctaggccaggcatgcgcgttgcagtctgtgggacggttggctccggcaaatccagcttgctatcctgcattcttggtgagattccaaagttatcaggagaggtccggacctgtgggacaacagcgtatgtcagtcagtcggcatggatacaaagcggcaaaattcaggagaacatactgttcggcaaggagatggatacagagaagtacgacagggtcctcgagtcatgcgcgctgaagaaagacttggagatcttgccgtttggtgaccagacagtcattggcgagcgaggcatcaaccttagtggcggccagaagcagaggattcagatagcacgcgctctgtatcaggatgccgacatctatttgtttgatgacccgttcagtgcagtcgatgcgcataccggatcccacctgtttaaggaatgcttgcttgctgatttggcttcaaaaacagtggtttatgtcactcatcagattgaattcctacccgccgccgaactcattcttgtcatgaaagatgggagaatagcacaggcaggaaaatacgatgaaatactgggttcaggcgaagagctcatggagctagttggtgcccacaaggagtctctaacagcacttgatgtgatcgatggcatgaacgaagacaatgcatcctcctcctctcccagtggcagagagaagcagaatctgtccagatcactgtcattagctgagaagaaacatgaagccaacgatgatgaagggaatgatgctcagagtgggcagctagtgcaggaggaagaaagggagaaaggcagggtggggttctgggtctactggaagtacctcacgctagcttacaagggtgctcttgtacccttggtgttgctagcacagatgctttttcaagtaattcagattgcgagcaattactggatggcttgggctgctccggtgtcaaaggatgttgagcctccggtgagcatgccgacgctgctcagtgtctatgtgatgctggctcttggaagctcgttgtgcatcctcgtaagatcactgctccttgcaacagctgggtacaagacagcgactttgttgttcaacaagatgcatttctccatattcagagctcctatgtctttcttcgattccactccgagcgggcgcatcttgaatagggcttcaactgatcaaagtgaagtggacaccaacattgctgaccagatgggcactgttgcattttccatgattcagcttgttggaattattgtggtgatgtctcaggttgcatggcaggtctttgttgttttcatccctgtatttgctgcctgtgtctggtatcagcaatactacattgacacggctagggagctgcaaaggctagtaggagtttgttatgctcctatcatacaacactttgcagaatcaatagcagggtcaagtactattagaagcttcggcaaggaaaatcagtttgtgacaactaacagtcgtctaacagatgcctactctcggcccaaattctacaacgctggagcaagggagtggctatgctttcgtctggatgtgctgtcatctcttgtatttgccttctctttgatctttttgatcaatctaccaaccggtctcattgatccaggtattgctggtcttgctatcacatacgggcttagtctgaacacgttgcaagcacaggttgtctggagcatgtgcactttggagaacaagattatatcagtggagagaattctgcagtacataagcattcctacagaacccccgcttgtcatgtcagaaaataagttggctcataactggccttcaaatggagaaattcagcttcataatctccatgtgaaatatgcaccacagttgccctttgttctgaagggccttacagtcacttttccgggtggcatgaagaccggtatagttggaagaacaggaagtggcaaatcaaccctcattcagtccctcttccgtattgttgaccctactgtcggtcagatactaatcgatggcgtcgacatctgcacaattggactacatgatctgagatccagactgagcatcattccacaagagccgacgatgttcgaaggaactgtcagaagcaaccttgatcccctaggggagtactctgatgatcaaatctgggagctaggggacgaagttaggaagcaggagctgaagcttgactcaccagttatagagaatggcgagaactggagtgtgggccagcgtcagctcgtgtgtcttggtagggtaattctgaaacggagcaaggttcttgttctggacgaagctaccgcctcagtggatactgcaaccgacaacttgatccagagaacactgaggcagcagtttaaagagacgaccgtcatcacgatagcgcacaggatctcgtccgttcttgacagcgacatggtgctgcttcttgacaacggcgtggccgtggagcacgacaggcccaacaaattgctggaggataagtcatctctgttctcaaagctcgtagcagaatacaccatgcgggcggcgcatacataa

SEQ ID NO: 6706 - protein, 1505 aa, Sorghum bicolor
  misc_feature: Ceres ANNOT ID no. 6068105
  misc_feature (667)..(838): Pfam Id: ABC_tran Pfam Desc: ABC transporter
  misc_feature (1295)..(1472): Pfam Id: ABC_tran Pfam Desc: ABC transporter
  misc_feature (321)..(592): Pfam Id: ABC_membrane Pfam Desc: ABC transporter transmembrane region
  misc_feature (953)..(1218): Pfam Id: ABC_membrane Pfam Desc: ABC transporter transmembrane region
  misc_feature (69)..(1505): NCBI GI: 115434802 NCBI Desc: os01g0173900 [oryza sativa (japonica cultivar-group)]
  misc_feature (213)..(1505): NCBI GI: 33329359 NCBI Desc: multidrug resistance associated protein mrp2 [triticum aestivum]
  misc_feature (52)..(1503): NCBI GI: 10172595 NCBI Desc: multidrug resistance-associated protein (mrp); abc-transoprter [arabidopsis thaliana]
  misc_feature (72)..(1503): NCBI GI: 42733544 NCBI Desc: multidrug resistance-associated protein [thlaspi caerulescens]
  misc_feature (52)..(1503): NCBI GI: 2316016 NCBI Desc: mrp-like abc transporter [arabidopsis thaliana]
  misc_feature (52)..(1503): SWISSPROT Homolog: EC 3.6.3.44 Multidrug resistance-associated protein 3
METTPDWDWEECLIFFLHGVSAASHLILALAVTGRLLLRRLSAGRTKDGEVGGGDASRSLGRFPYCYRVSVCTTWALAAFEVLLAAYSWYADGGAGWSGDAVAERVDAAARAVSWLLLAAYLQFDVGRRRRQERFPAPLRIWWALFTLLTVVAAGVHAATSLDGFPVPGRSWALDAISVTAAVVLLSAGFLGRKEGNGRGHASEEQEPLLNGAHGAADDDDENSSSSAADASLFTGAGFLSVLTFSWMGPLLRVGHRKTLALEDVPGLEPGDSVAGILPPFKANLEALTRDVNSDGGRSSKKVVTAFTLTKALLRTIWWHVAVTAFYTLVYCVAAYVGPYLIDSLVQYLYLSGDERYAGKGQLLVLAFVVAKVLECLSQRHLFFRLQQAGIRARSALVAVVYQKSLALSSQSRRSRTSGEMINIVSVDADRVGIFSWYLHEVWQVPLQTGMAMFILYSTLGLASLAALAATVAISLATVPLGRMQERFQEKLMDSKDARMKATSESLHSMRILKLQGWEMRFLSKVIDLRKTEANWLKRYLYTSATMTFVFWGTPTFVAVVTFGACMLMGIPLETGKLLSALATFRVLQEPIYELPGTIAMVIKTKVSLARIASFLCLDELPSDAVQRLPRGSSEDFAISVSNGCFSWEASPEFPTLKDLSFQARPGMRVAVCGTVGSGKSSLLSCILGEIPKLSGEVRTCGTTAYVSQSAWIQSGKIQENILFGKEMDTEKYDRVLESCALKKDLEILPFGDQTVIGERGINLSGGQKQRIQIARALYQDADIYLFDDPFSAVDAHTGSHLFKECLLADLASKTVVYVTHQIEFLPAAELILVMKDGRIAQAGKYDEILGSGEELMELVGAHKESLTALDVIDGMNEDNASSSSPSGREKQNLSRSLSLAEKKHEANDDEGNDAQSGQLVQEEEREKGRVGFWVYWKYLTLAYKGALVPLVLLAQMLFQVIQIASNYWMAWAAPVSKDVEPPVSMPTLLSVYVMLALGSSLCILVRSLLLATAGYKTATLLFNKMHFSIFRAPMSFFDSTPSGRILNRASTDQSEVDTNIADQMGTVAFSMIQLVGIIVVMSQVAWQVFVVFIPVFAACVWYQQYYIDTARELQRLVGVCYAPIIQHFAESIAGSSTIRSFGKENQFVTTNSRLTDAYSRPKFYNAGAREWLCFRLDVLSSLVFAFSLIFLINLPTGLIDPGIAGLAITYGLSLNTLQAQVVWSMCTLENKIISVERILQYISIPTEPPLVMSENKLAHNWPSNGEIQLHNLHVKYAPQLPFVLKGLTVTFPGGMKTGIVGRTGSGKSTLIQSLFRIVDPTVGQILIDGVDICTIGLHDLRSRLSIIPQEPTMFEGTVRSNLDPLGEYSDDQIWELGDEVRKQELKLDSPVIENGENWSVGQRQLVCLGRVILKRSKVLVLDEATASVDTATDNLIQRTLRQQFKETTVITIAHRISSVLDSDMVLLLDNGVAVEHDRPNKLLEDKSSLFSKLVAEYTMRAAHT

SEQ ID NO: 6707 - DNA, 1317 bp, Sorghum bicolor
  misc_feature: Ceres ANNOT ID no. 6068118
  misc_feature: Encodes the peptide sequence at SEQ ID NO 6708
atgcgtgcagccgccggaggtgccccgcagcggcgtgcggggggtatccgcgtccgcgccccactggtagagtctgtctcctgctactgcagggtagatgggggtcttaaaacagttgtaagtgctaggaagtttgtccctggtgcaaagctgtgcatgcaacctgatatcataccaaccaagcgcaagtcaaggagctcacgcaaggagaggtctcaaactcagtcaccactgctgcctgggcttcctgatgaactggctatttcctgtctcatgcgggctgctcgggtcgagcacccaaatatgcggttagtctgtaaacgatggaaccgtcttttgtctggaaattattattactccttgcgtaagaaatttggcatggcagaagaatggatttacgtcttcaaaagggaccgtgatcagaagctatcttggtatgcctttgatcctgtgaaccagctctggaagtcattgcctccagttccaccagagtattctgaagctgttggatttggtagtgctgttctcaacggatgctatctgtacttatttggcggcaaagacccagtacatgggtctatgaggcgtgttgtattttacaatgctcggataaacaaatggcttcgagctccagatatgctgcaaaaacggcacttctttggttcttgtgtcataaacaactgtctttatgttgctggtggggagtgtgtagggatacagagatctctaaggtctgccgaggtatatgatccaaacaggaatagatggtctagcattgctgaaatgagcacaggaatggtgccctccattggagtagtacatgatggcaagtggttcctaaaaggtctcaattctcatcgccaggtcgtgagcgaggtctatcttccagcttctaaaatgtggtcaaccaccggtaatgaaatggtcacgggcttgcggaatccaagcatttccctcaacgggcgactttattctgctgattgtcgtgatggctgtaagcttcgagtttataatagagagctgggatcgtggacaaggttcattgacaccagacaccatatgggaagctcacggtctcttgaagccgcagcctttgtctcccttaatggaaagctatgcatcatccgtaacaatatgagtatcaccattattgatatgtcagacccaacaagagtaactgaggttgacagtgcgcgcatgtgggaggcttttgctcgaaaggggcagcacaggtctttcatggcaaacctatggtcagccatcacaggtcgtaatctgaagacagacattatgcattgtcaggtgctccaagtttga

SEQ ID NO: 6708 - protein, 438 aa, Sorghum bicolor
  misc_feature: Ceres ANNOT ID no. 6068118
  misc_feature (216)..(263): Pfam Id: Kelch_1 Pfam Desc: Kelch motif
  misc_feature (77)..(124): Pfam Id: F-box Pfam Desc: F-box domain
  misc_feature (49)..(421): NCBI GI: 86991186 NCBI Desc: kelch-motif containing protein [oryza sativa (japonica cultivar-group)]
  misc_feature (49)..(421): NCBI GI: 86991200 NCBI Desc: kelch-motif containing protein [oryza sativa (indica cultivar-group)]
  misc_feature (49)..(421): NCBI GI: 86991166 NCBI Desc: kelch-motif containing protein [oryza barthii]
  misc_feature (49)..(421): NCBI GI: 86991198 NCBI Desc: kelch-motif containing protein [oryza sativa (indica cultivar-group)]
  misc_feature (49)..(421): NCBI GI: 86991170 NCBI Desc: kelch-motif containing protein [oryza meridionalis]
  misc_feature: The sequence is a functional homolog of SEQ ID NO. 315 in the 11/188,298 US application
  misc_feature: The sequence is a functional homolog of SEQ ID NO. 440 in the 11/188,298 US application
MRAAAGGAPQRRAGGIRVRAPLVESVSCYCRVDGGLKTVVSARKFVPGAKLCMQPDIIPTKRKSRSSRKERSQTQSPLLPGLPDELAISCLMRAARVEHPNMRLVCKRWNRLLSGNYYYSLRKKFGMAEEWIYVFKRDRDQKLSWYAFDPVNQLWKSLPPVPPEYSEAVGFGSAVLNGCYLYLFGGKDPVHGSMRRVVFYNARINKWLRAPDMLQKRHFFGSCVINNCLYVAGGECVGIQRSLRSAEVYDPNRNRWSSIAEMSTGMVPSIGVVHDGKWFLKGLNSHRQVVSEVYLPASKMWSTTGNEMVTGLRNPSISLNGRLYSADCRDGCKLRVYNRELGSWTRFIDTRHHMGSSRSLEAAAFVSLNGKLCIIRNNMSITIIDMSDPTRVTEVDSARMWEAFARKGQHRSFMANLWSAITGRNLKTDIMHCQVLQV

SEQ ID NO: 6709 - DNA, 900 bp, Sorghum bicolor
  misc_feature: Ceres ANNOT ID no. 6068134
  misc_feature: Encodes the peptide sequence at SEQ ID NO 6710
atggatcggtaccatcgggtggagaagccgcggcccgaggccgccgccatcagcgagaacgagatccgcatcaccactcagggcctcatccgcaactacgtcacctacgctacctccctcgtccaggaaaaacgggtgaaagaaattgtgttgaaggctatgggacaggctataagcaagactgtggctattgctgagatcataaagaagaggattcctggtttgcatcaagatacaataataagttctgtcagtattactgatgtatgggagcccattgaggaaggccttgtaccattggagatgactcgtcatgtttcaatgatatcaatttccttgtcacctaaggagcttaacaagaattctcccgggtatcaagctcctctgcatttagatcttaagccacaaagataccagcaacctcagcaatatcaacagcaccagccaagacaaaatccaattcaaacagattcatatggacgcggccgaggtagaggcagggggcgaggaaggggctggggtagcaggggtggttatggtggaggctatggtggatatgaatatgataaccaaggaggttatggtgggtatggacaccaaggtgggtatggacatcaaggtggatatggaaaccagggaggatatggccacaaccaagatggttatggtggctatggttacaaccaaggtggatatggaggctatgaaaatggaggttggaactacaaccggaacagaggtggtggtggtggtggtggccgaggacgaggcaactggggctatggtggtcctggatatgaccggggtggcagaggcgcaggtggccctggcggcaggggctatgtgcgaggccgtggacgaatgggtggcggccgtgggcggggcaaccaaaactactag

SEQ ID NO: 6710 - protein, 299 aa, Sorghum bicolor
  misc_feature: Ceres ANNOT ID no. 6068134
  misc_feature (18)..(88): Pfam Id: Alba Pfam Desc: Alba
  misc_feature (1)..(255): NCBI GI: 92873121 NCBI Desc: alba, dna binding [medicago truncatula]
  misc_feature (1)..(240): NCBI GI: 32526671 NCBI Desc: chloroplast nucleoid dna-binding protein -like protein [oryza sativa (japonica cultivar-group)]
  misc_feature (57)..(295): NCBI GI: 8778814 NCBI Desc: t4o12.22 [arabidopsis thaliana]
  misc_feature (17)..(248): NCBI GI: 23485324 NCBI Desc: arabidopsis thaliana at1g20220/t20h2_3-related [plasmodium yoelii yoelii]
  misc_feature (150)..(299): NCBI GI: 3893085 NCBI Desc: glycine-rich protein 2 [cicer arietinum]
MDRYHRVEKPRPEAAAISENEIRITTQGLIRNYVTYATSLVQEKRVKEIVLKAMGQAISKTVAIAEIIKKRIPGLHQDTIISSVSITDVWEPIEEGLVPLEMTRHVSMISISLSPKELNKNSPGYQAPLHLDLKPQRYQQPQQYQQHQPRQNPIQTDSYGRGRGRGRGRGRGWGSRGGYGGGYGGYEYDNQGGYGGYGHQGGYGHQGGYGNQGGYGHNQDGYGGYGYNQGGYGGYENGGWNYNRNRGGGGGGGRGRGNWGYGGPGYDRGGRGAGGPGGRGYVRGRGRMGGGRGRGNQNY

SEQ ID NO: 6711 - DNA, 666 bp, Sorghum bicolor
  misc_feature: Ceres ANNOT ID no. 6068136
  misc_feature: Encodes the peptide sequence at SEQ ID NO 6712
atggggaagcaaagtacgttggtgtacagcttcgtggcgcgaggaaccgttgtgctagcagaccacgctgaggtctccggcaactttgcctccgtcgccgcacagtgcctgcagaagctccctaccaacaacaatcgcttcaactacaactgtgatgggcacacattcaactaccacattcatgatggattcacatattgcgttgttgctactgaatcagctggtcgacaacttccaattggatttattgagagagtgaaagaagattttttcaagaaatatggcggagggaaaggtaaaactgctaatgccaatggcctcaagcgagaatatgggcctaaacttaaagagcacatgaggtattgtgaccagcaccctgaggagattgacaaacttgcaaaagtgaaggctcaggtcacagaggtcaagggagtaatgatgcaaaacattgagaaggtactagatcgtggtgaaaaaattgaactactcgttgataaaacggaggatctccgatcacaggcacaagatttccggaaacagggaacaaagatacgacaaaagatgtggtgggagaatatgaagatgaagctcattgttttcggaatcgtggttgcactgatcctcctcattgtcttgacaatttgcaaggacttcaattgctggtga

SEQ ID NO: 6712 - protein, 221 aa, Sorghum bicolor
  misc_feature: Ceres ANNOT ID no. 6068136
  misc_feature (128)..(216): Pfam Id: Synaptobrevin Pfam Desc: Synaptobrevin
  misc_feature (1)..(220): NCBI GI: 60543737 NCBI Desc: synaptobrevin 1 [oryza sativa (japonica cultivar-group)]
  misc_feature (4)..(220): NCBI GI: 600710 NCBI Desc: formerly called hat24; synaptobrevin-related protein
  misc_feature (1)..(220): NCBI GI: 7211989 NCBI Desc: strong similarity to the synaptobrevin homolog f25i18.14 gi2924792 from a. thaliana on bac gbac002334. [arabidopsis thaliana]
  misc_feature (1)..(220): NCBI GI: 92899155 NCBI Desc: longin [medicago truncatula]
  misc_feature (4)..(220): NCBI GI: 79324082 NCBI Desc: sar1 (synaptobrevin-related protein 1) [arabidopsis thaliana]
MGKQSTLVYSFVARGTVVLADHAEVSGNFASVAAQCLQKLPTNNNRFNYNCDGHTFNYHIHDGFTYCVVATESAGRQLPIGFIERVKEDFFKKYGGGKGKTANANGLKREYGPKLKEHMRYCDQHPEEIDKLAKVKAQVTEVKGVMMQNIEKVLDRGEKIELLVDKTEDLRSQAQDFRKQGTKIRQKMWWENMKMKLIVFGIVVALILLIVLTICKDFNCW

SEQ ID NO: 6713 - DNA, 2529 bp, Sorghum bicolor
  misc_feature: Ceres ANNOT ID no. 6068140
  misc_feature: Encodes the peptide sequence at SEQ ID NO 6714
  misc_feature: Down-regulated in shoot tissues in response to salicylic acid treatment
atggggaggtggtggcaggctgccctgctgggctgcgcagtggcggtggctgttctggcggccgccgtggaatgcgcggtgacgtacgacaagaaggcggtgctgattgatgggcagaggcggattctcttctccggatccatacactaccccaggagcacccctgatatgtgggaagggctgattcagaaggctaaagatggaggcttggatgtgattcagacctatgtcttttggaatggacatgagcctacgcctggaaattactacttcgaagagaggtacgatttggtcaggttcataaagacggtccagaaggccgggctgtttgtacatctccgcatcggtccctacatttgcggcgagtggaacttcggtggcttcccagtttggttgaagtatgtaccaggcatcagcttcaggacagacaacgaacctttcaagacggcaatgcagggtttcactgagaaaattgtgggaatgatgaagagcgaaaaactctttgcatcccaaggtggccctattatcctctctcagattgagaatgagtatgggccagaaggcaaggagcttggtgccgcaggtcaggcatatatcaactgggcagcaaagatggccatcggattgggcactggtgtgccgtgggtgatgtgcaaagaggaggatgcacctgatccagtgatcaatgcatgtaatggtttctactgtgatgcattttctccaaacaaaccatacaagcccacaatgtggactgaagcttggagtggctggttcacagaatttggtgggaccatccgccaacgaccagttgaagatctcgcatttgctgttgctcgatttgtacaaaagggtggttcttttatcaattactacatgtatcatggaggaacaaatttcgggcgcactgctgggggtcccttcatcacaacaagctatgattatgatgctccaattgatgaatatggacttgttagagaaccaaagcacagtcatcttaaagaactccacagagctgttaagttatgtgagcaggctttggtttctgttgacccagcaattactacccttggaaccatgcaagaggcccatgtcttccgatctccatctggttgtgcagctttccttgcaaactacaattctaactcctatgcgaaagttgtgttcaacaatgagcaatacagcctcccaccttggtcaattagcatccttcctgattgcaagaatgtagtttttaacagtgccacagttggtgttcagacatctcaaatgcaaatgtggggagatggagcctcatcaatgatgtgggagaggtatgatgaggaggttgattctctggctgctgctccattgctcaccacaactggtttgcttgagcagcttaacgtcacgagagacagcagtgattatctgtggtacataaccagtgttgacatcagcccatctgaaaactttctacaaggtggtggcaagcctctgtctctcagtgtgctgtctgctggtcacgccttgcatgtctttgtcaacggagagcttcaaggttctgcttatggtaccagggaagatcgaagaattaaatataatggtaacgctaaccttcgagctggtactaacaaaatcgcactgctgagtgttgcttgtggattgccgaatgttggagtgcattatgagacatggaacactggtgttggtggtcctgttgggcttcatgggttgaatgaaggatcacgagatcttacttggcagacttggtcctatcaggttggcctgaaaggtgaacagatgaatctgaactccctagaaggctcaacctcagttgaatggatgcaagggtcgttgatagctcaaaaccaacagccattgtcctggtatagggcttacttcgaaactcccagcggagatgagccattggctctggatatgggtagcatgggcaagggccaaatctggataaatggacaaagcattggacgctactggacagcatatgcagatggggactgcaaagagtgcagttacactgggaccttccgggcacccaagtgtcaagcaggctgtggtcagcccacgcaacgttggtatcatgtgccaaggtcctggctacaacccaccagaaacctattggtagtttttgaggaacttggtggggattcatcaaagattgccctagtgaagaggtcagtctcaagtgtctgtgccgatgtatctgaggatcatccaaacatcaagaactggcagattgaaagctatggcgagcgtgagtaccacagggccaaggtgcatttaagatgctcacctgggcagtctatttctgcaatcaaatttgcaagctttgggacacctatgggaacatgtggaaatttccagcaaggagattgccactcagctaactcacacactgttctagagaagaaatgcattgggctccaaagatgtgccgtcgccatctcccccgagagctttggaggagatccctgcccgagggtgacgaagagggtggcggtcgaggcagtatgttctcccactgcttag

SEQ ID NO: 6714 - protein, 842 aa, Sorghum bicolor
  misc_feature: Ceres ANNOT ID no. 6068140
  misc_feature (33)..(339): Pfam Id: Glyco_hydro_35 Pfam Desc: Glycosyl hydrolases family 35
  misc_feature (761)..(838): Pfam Id: Gal_Lectin Pfam Desc: Galactose binding lectin domain
  misc_feature (1)..(842): NCBI GI: 21070357 NCBI Desc: beta-galactosidase [oryza sativa (japonica cultivar-group)]
  misc_feature (23)..(841): NCBI GI: 114217397 NCBI Desc: beta-d-galactosidase [persea americana]
  misc_feature (23)..(840): NCBI GI: 57232107 NCBI Desc: beta-galactosidase [prunus persica]
  misc_feature (7)..(840): NCBI GI: 61162201 NCBI Desc: beta-d-galactosidase [pyrus pyrifolia]
  misc_feature (23)..(840): NCBI GI: 4006924 NCBI Desc: beta-galactosidase like protein [arabidopsis thaliana]
  misc_feature (1)..(839): SWISSPROT Homolog: EC 3.2.1.23 Beta-galactosidase precursor
  misc_feature: Useful for making plants with altered cell wall content and/or composition
  misc_feature: Functional homolog of the protein sequence encoded by LOCUS at1g45130
  misc_feature: Functional homolog of the protein sequence encoded by LOCUS at3g13750
  misc_feature: GREAT-hit functional homolog of the protein sequence encoded by LOCUS at4g36360
  misc_feature: Useful for making plants with altered cell wall content and/or composition
  misc_feature: Functional homolog of the protein sequence given in SEQ ID NO 13587
  misc_feature: The sequence is a functional homolog of SEQ ID NO 2 in US patent 7084321
  misc_feature: Useful for making plants with altered carbohydrate content
  misc_feature: Functional homolog of the protein sequence given in SEQ ID NO 13588
  misc_feature: Down-regulated in shoot tissues in response to salicylic acid treatment
MGRWWQAALLGCAVAVAVLAAAVECAVTYDKKAVLIDGQRRILFSGSIHYPRSTPDMWEGLIQKAKDGGLDVIQTYVFWNGHEPTPGNYYFEERYDLVRFIKTVQKAGLFVHLRIGPYICGEWNFGGFPVWLKYVPGISFRTDNEPFKTAMQGFTEKIVGMMKSEKLFASQGGPIILSQIENEYGPEGKELGAAGQAYINWAAKMAIGLGTGVPWVMCKEEDAPDPVINACNGFYCDAFSPNKPYKPTMWTEAWSGWFTEFGGTIRQRPVEDLAFAVARFVQKGGSFINYYMYHGGTNFGRTAGGPFITTSYDYDAPIDEYGLVREPKHSHLKELHRAVKLCEQALVSVDPAITTLGTMQEAHVFRSPSGCAAFLANYNSNSYAKVVFNNEQYSLPPWSISILPDCKNVVFNSATVGVQTSQMQMWGDGASSMMWERYDEEVDSLAAAPLLTTTGLLEQLNVTRDSSDYLWYITSVDISPSENFLQGGGKPLSLSVLSAGHALHVFVNGELQGSAYGTREDRRIKYNGNANLRAGTNKIALLSVACGLPNVGVHYETWNTGVGGPVGLHGLNEGSRDLTWQTWSYQVGLKGEQMNLNSLEGSTSVEWMQGSLIAQNQQPLSWYRAYFETPSGDEPLALDMGSMGKGQIWINGQSIGRYWTAYADGDCKECSYTGTFRAPKCQAGCGQPTQRWYHVPRSWLQPTRNLLVVFEELGGDSSKIALVKRSVSSVCADVSEDHPNIKNWQIESYGEREYHRAKVHLRCSPGQSISAIKFASFGTPMGTCGNFQQGDCHSANSHTVLEKKCIGLQRCAVAISPESFGGDPCPRVTKRVAVEAVCSPTA

SEQ ID NO: 6715 - DNA, 1446 bp, Sorghum bicolor
  misc_feature: Ceres ANNOT ID no. 6068149
  misc_feature: Encodes the peptide sequence at SEQ ID NO 6716
atggcgcttcaaaccctaaacccgcaccggcacgcggcggccgtctccccgtcgccggcgccgtcgcccgtcccgcgccgcggccacccgccgccgcagcctctcctgcacctccctccccgccgccgcctcgcgggcggcgccgcccggccgcgcgccgtcgctgccgccgtctcgggggccgtcaacgaggccaggaggcgtggggcgccgcaggagggcggggaggacgggaggaaggacacggacctcgccacgctcgggaacctctgcgtcgacgtcgtgctcagcgtgccccagctcccgcccgcgccgcgggaggagcggaaggcctacatggagcgcctcgccgcctcaccgcccgatcagaaattttgggaggctggtggaaactgcaatttagcctttgctgcagctaggcttgggcttagctgttccactctgggtcatgtaggagaggaaatatatggaaattttcttcttgatgtgcttcaagcggagggcattagtgttgttgggatgcttgaaaataccaatgctgctgcgtgccgccaagcctatgaaacacttctatgttgggttcttgtagacccatttcagaaacatggtttttgcagccgtgcagacttcagtgaagagccagcattcagttggatacgtaaactcccagcagatatcaggacagctattcatcactccaaaatactgttttgcaatggctatgcttttgatgagttcttccctgatgtgatcgcatcctctatcgactgtgcaattgattcgggaacagcagtgtttttcgatcctggtccccgtgggaaatctctcttacatgggaccttggatgagcagagagcacttgagcatgcgctcaggttcagtgatgtcctcctcttgacatcagatgaggctgaatctctaaccaccatcagaaacccagttcaggctgggcaagagttgctaaagaaaggggtccgcacaaagcaggttgtcatcaaaatgggttccaagggttcgatcatgataactaagagcactgtttcctgcgcgcctgctttcaagatcaacgttgtggacacagttggatgtggagatagctttactgctgctatagcctttgggttcctccatgacttgccagcggttaacacattaaccctagcaaatgcagttggtgctgcaaccgccactggctgtggggctggcaggaatgttgctcgcctggataaagtactacagctcttgaaagaagccgatctcaatgaagaagacacatggactgagctgattgaaggaaattctctctgtattgaggtctcaattatgtctgggatggcaagaaatggttttggcgagcgcattgtgcatgttcctgttaccaaagtggtttccgacattttgcctatgttcgaagcagtgtcagagcgaagcgctgtccaggcttga

SEQ ID NO: 6716 - protein, 481 aa, Sorghum bicolor
  misc_feature: Ceres ANNOT ID no. 6068149
  misc_feature (81)..(407): Pfam Id: PfkB Pfam Desc: pfkB family carbohydrate kinase
  misc_feature (32)..(471): NCBI GI: 13605673 NCBI Desc: at1g06730/f4h5_22 [arabidopsis thaliana]
  misc_feature (129)..(400): NCBI GI: 117928421 NCBI Desc: pfkb domain protein [acidothermus cellulolyticus 11b]
  misc_feature (273)..(417): NCBI GI: 28210620 NCBI Desc: ribokinase [clostridium tetani e88]
  misc_feature (255)..(417): NCBI GI: 20806728 NCBI Desc: sugar kinases, ribokinase family [thermoanaerobacter tengcongensis]
  misc_feature (249)..(416): NCBI GI: 118047956 NCBI Desc: ribokinase [chloroflexus aggregans dsm 9485]
  misc_feature: The sequence is a functional homolog of SEQ ID NO. 302 in the 11/188,298 US application
  misc_feature: The sequence is a functional homolog of SEQ ID NO. 299 in the 11/188,298 US application
MALQTLNPHRHAAAVSPSPAPSPVPRRGHPPPQPLLHLPPRRRLAGGAARPRAVAAAVSGAVNEARRRGAPQEGGEDGRKDTDLATLGNLCVDVVLSVPQLPPAPREERKAYMERLAASPPDQKFWEAGGNCNLAFAAARLGLSCSTLGHVGEEIYGNFLLDVLQAEGISVVGMLENTNAAACRQAYETLLCWVLVDPFQKHGFCSRADFSEEPAFSWIRKLPADIRTAIHHSKILFCNGYAFDEFFPDVIASSIDCAIDSGTAVFFDPGPRGKSLLHGTLDEQRALEHALRFSDVLLLTSDEAESLTTIRNPVQAGQELLKKGVRTKQVVIKMGSKGSIMITKSTVSCAPAFKINVVDTVGCGDSFTAAIAFGFLHDLPAVNTLTLANAVGAATATGCGAGRNVARLDKVLQLLKEADLNEEDTWTELIEGNSLCIEVSIMSGMARNGFGERIVHVPVTKVVSDILPMFEAVSERSAVQA

SEQ ID NO: 6717 - DNA, 1755 bp, Sorghum bicolor
  misc_feature: Ceres ANNOT ID no. 6068159
  misc_feature: Encodes the peptide sequence at SEQ ID NO 6718
atggctatggtgcgaagtgattcatcacatcatggagttgtggacaatagccccaatggatgtgcccaggctaggtgtgatgaagctaggaaacttggtccatcgtggtatttcagtagaaaagaattagaggaaaattctccatccaggagggatggtattgattttaagaaagagtctaaccttcgaaagttgtattgcaagtttctacaagatttgggcatgttgcttaaaatgcctcaagtgacgattgccacagcgatggtattctgtcatcgtttttaccttcgtcaatcccttgcaaaaaatgatagacgaataatcgccacagtttgtttattcttggctggaaaagttgaagaaacacctaaacctctgagggatgtcatcttggtttcttatgggatgattcataagaatgatcctaagtctagtcagagaatcaagcagaaggaaatatatgataaacaaaaagaacttattttacttggggagcgagttgtacttgcaacacttgggtttgaccttaatattcaccatgcatataggcccttggttgaagcaataaggagattcaatattgataataaaagtccacttgctcaggttgcctggaattttgtaaatgatgggctgcgtacttcgctttgcctgcagttccagcctcatcatattgcagctggtgctatctgtttggctgctaaatttctcaaagtgaagctctcattagatggtgataagcattggtggcaggattttgatgtcacgtatcgacagcttgaagagattagcggtcagttgttggaaatgtatgagcaaaaccgtacaacgcaggcacaatcatcacagggaagtgaagccgaagggagctccgctggtgtgtgtaatcaacgttcatctgtaaagtctgaagcaaattccaaggaaccatctgctcatggttatcttcaggcatccagatcgcaaaatttgcagcattcgtcctcaacaagcgcttcaggtcaccatgacgatgggcactcaaattcagacaagcatatttctggccacaaaatgctgcaaaatgacaatgctaaccatggtggcagcaaagaaaagaacaaaagtggaatcaaaactgatactggtatggacagattgcaccatgacaaaaagttctcgcctggacatcgttatccagtggaagaacatcaaccacatcgatcggatgataattccaatgaaacaagagatggtgttggtggccttgaagctcctgttgtgtcaacctcgagaatggatgcaatgaataaaattgacaaggataaagtaaaagcagctctggagaagcgaaggaagtcgaaaggtggttttgcctcaaaggtaaatttgatggatgatgatgatctacttgagagagagctagaacaaggtgttgagttggctgttgaggttgagaagattaaacaggataagaagcagaacttgtccgatggtagcaagcatccaccagaccttcaaaacactgaccaagtaatggagaatggtcaccatgtcaagcagagtctaccaacaacagctgaagacatgggctgtctgatggacagtaaagaacaacatccttcaccatttattaagcaaaatgatgttcctgagcacaagtcacagcagcttgatgacacattgaagcaccaaaagggctatgaccatcctcaacttgtaggaggccctgagctggatggaaaggactgcaagagacctaagctcgacgggtag

SEQ ID NO: 6718 - protein, 584 aa, Sorghum bicolor
  misc_feature: Ceres ANNOT ID no. 6068159
  misc_feature (34)..(177): Pfam Id: Cyclin_N Pfam Desc: Cyclin, N-terminal domain
  misc_feature (9)..(563): NCBI GI: 30694715 NCBI Desc: cyclin family protein [arabidopsis thaliana]
  misc_feature (36)..(398): NCBI GI: 145340421 NCBI Desc: cyclin-dependent protein kinase [arabidopsis thaliana]
  misc_feature (35)..(362): NCBI GI: 46805809 NCBI Desc: cyclin k-like [oryza sativa (japonica cultivar-group)]
  misc_feature (108)..(271): NCBI GI: 115444041 NCBI Desc: os02g0133000 [oryza sativa (japonica cultivar-group)]
  misc_feature (37)..(271): NCBI GI: 37703718 NCBI Desc: cyclin t1 [medicago truncatula]
MAMVRSDSSHHGVVDNSPNGCAQARCDEARKLGPSWYFSRKELEENSPSRRDGIDFKKESNLRKLYCKFLQDLGMLLKMPQVTIATAMVFCHRFYLRQSLAKNDRRIIATVCLFLAGKVEETPKPLRDVILVSYGMIHKNDPKSSQRIKQKEIYDKQKELILLGERVVLATLGFDLNIHHAYRPLVEAIRRFNIDNKSPLAQVAWNFVNDGLRTSLCLQFQPHHIAAGAICLAAKFLKVKLSLDGDKHWWQDFDVTYRQLEEISGQLLEMYEQNRTTQAQSSQGSEAEGSSAGVCNQRSSVKSEANSKEPSAHGYLQASRSQNLQHSSSTSASGHHDDGHSNSDKHISGHKMLQNDNANHGGSKEKNKSGIKTDTGMDRLHHDKKFSPGHRYPVEEHQPHRSDDNSNETRDGVGGLEAPVVSTSRMDAMNKIDKDKVKAALEKRRKSKGGFASKVNLMDDDDLLERELEQGVELAVEVEKIKQDKKQNLSDGSKHPPDLQNTDQVMENGHHVKQSLPTTAEDMGCLMDSKEQHPSPFIKQNDVPEHKSQQLDDTLKHQKGYDHPQLVGGPELDGKDCKRPKLDG

SEQ ID NO: 6719 - DNA, 1308 bp, Sorghum bicolor
  misc_feature: Ceres ANNOT ID no. 6068185
  misc_feature: Encodes the peptide sequence at SEQ ID NO 6720
atgcaggggcaagttgctggtgacgacgcaggtggcggcagctctaggcggcgggagagcttggtgcgtggccccatcatcgtgggcgcggggccgtcggggctggccgtggcggcgacgctgagccagcacggggtgccgttcacggtgctggagcgctccgacggcatcgccgacctgtggacgaaccgcacgtacgaccggctccggctgcacctccccaaggtgttctgcgagctcccgcacgcgcgcttcccggcagacttccccacgtacccgaccaagcacgacttcctccgctacctccgctcctacgccgcgcgcttcggcgtgtccccgctgttcggccgcacggtgacccgggcgcgctacgacgccgacgcgtcgctctggcgggtcacggcggtgtcgtcgtcgtcgtcggccgcggacggcggcggcgtgacgacgacgacggagaccgagtacgcgtcgccgtggctggtggtggctagtggggagaacgcggaggtggtggtgccgacggtgaaggggagggagatgttcgccggggaggtcctgcactccagcgcgtacaggagcggggagaggttcaagggcatgagggtgctggtcgtggggtgtggcaactccggcatggagatgtgcttggacttgtgtgagcacggtgccatgcccttcatgtccgtcaggagcggggtgcacgttctaccgagagagatgtttggggcctcaacgttcggcatcgccatgaaactgcttagatggctgccgatcaagctggtggacaggctgctgctgctcatcgccaggatggtcctgggaaacacggagaggcacgggctgaagaggcccaagctgggcccgctggagatcaagaacatcaccggcaagagccctgttctcgacgtgggagcatggtcgttcatcaaatctggaaacatcaagatcgtgccagaagtggagtcattcaccggcggcaacggggtgaggttcgtggacggcaacaagatggccttcgacgccgtcatcttcgccaccggctacagaagcaacgtccctttctggctcaaggacgacggcgatctgttcacggaggacggcacggcaaagcaggctgctgggcagccgagcggcggcgactggtggaggggtcccaacgggctgtaccgcgtgggattctccgggcggggcctgctcggcgctggcgcggacgcgctgagggccgccgccgacatcgccgggaggtggcaggcggaggtggcggcagcgggtggagccaagatagtctcctcgtcctcggtgtag

SEQ ID NO: 6720 - protein, 435 aa, Sorghum bicolor
  misc_feature: Ceres ANNOT ID no. 6068185
  misc_feature (27)..(436): Pfam Id: FMO-like Pfam Desc: Flavin-binding monooxygenase-like
  misc_feature (22)..(418): NCBI GI: 92895305 NCBI Desc: pyridine nucleotide-disulphide oxidoreductase, class i; fad-dependent pyridine nucleotide-disulphide oxidoreductase [medicago truncatula]
  misc_feature (17)..(419): NCBI GI: 115439755 NCBI Desc: os01g0732700 [oryza sativa (japonica cultivar-group)]
  misc_feature (14)..(420): NCBI GI: 92875435 NCBI Desc: pyridine nucleotide-disulphide oxidoreductase, class i; fad-dependent pyridine nucleotide-disulphide oxidoreductase [medicago truncatula]
  misc_feature (21)..(433): NCBI GI: 4914451 NCBI Desc: dimethylaniline monooxygenase-like protein [arabidopsis thaliana]
  misc_feature (22)..(418): NCBI GI: 118624210 NCBI Desc: flavin monooxygenase-like protein [solanum lycopersicum]
MQGQVAGDDAGGGSSRRRESLVRGPIIVGAGPSGLAVAATLSQHGVPFTVLERSDGIADLWTNRTYDRLRLHLPKVFCELPHARFPADFPTYPTKHDFLRYLRSYAARFGVSPLFGRTVTRARYDADASLWRVTAVSSSSSAADGGGVTTTTETEYASPWLVVASGENAEVVVPTVKGREMFAGEVLHSSAYRSGERFKGMRVLVVGCGNSGMEMCLDLCEHGAMPFMSVRSGVHVLPREMFGASTFGIAMKLLRWLPIKLVDRLLLLIARMVLGNTERHGLKRPKLGPLEIKNITGKSPVLDVGAWSFIKSGNIKIVPEVESFTGGNGVRFVDGNKMAFDAVIFATGYRSNVPFWLKDDGDLFTEDGTAKQAAGQPSGGDWWRGPNGLYRVGFSGRGLLGAGADALRAAADIAGRWQAEVAAAGGAKIVSSSSV

SEQ ID NO: 6721 - DNA, 2220 bp, Sorghum bicolor
  misc_feature: Ceres ANNOT ID no. 6068206
  misc_feature: Encodes the peptide sequence at SEQ ID NO 6722
atgccgccgcctcgccgcgcgcttctcacctccctcctccgcctccgctccttctcctccattgcttatccccatccccacccacccgcgcccccgcggcgccaccagttcgtcgccgaccctaccacctccacaagccgtggcgtcatcgggggcatcggtggcgggagcgggaaccccttggacccaacgcagctcctccgtgacgacccggtggcaatcaccgcttccctttgggtatcctccttccgcgccgccgccgccgcctccggctccggctcttgtacctccgcaccgccgcaatcgctcacccccttcctctcgcgcctggagctgtgggtgctcgcctaccagaaggcatacgctgacgagaccggctcctacctgccgcgctcctccatcccggcctccacgctcacctccctcctcacgctccgcaacgccgtactcgacgcccgcttccgcttcggcaaccgcctcacccccttcctccagtccccgcgcgccgccaacgcgccggaccccgccaccctctccaagcgcaagctccgcgccctcctcacaacccccggcccaccgcccttccaggaccgcgtcgtgcaggagctgctcctactcctgctcgagcccgtctacgaagccaggttctcgccaaagtccttcgccttccgccccggtcgatccccgcatgccgcgatccgcaccatccgccgcagctttgcgccatacctctggtatatcaagggcgacctctccccactcctgcactcgcctgatcctgcgcttgtggtcggcgcgcttatccgtgatgtgcgtgataaaaaggtggtggatttgatccgttcggcgctgctcaccccggtggtgaccgcaagtgatgatgctgcagcgaagaagaagaagacgaagaggaagtaccagaagaagaaggtgctgccagagggggagccgaagcctgacccttactggctgcagacgttctttgggtttgcaccagaggaggcccagacacagcctgattggggccactgtggggtgttgagcccgttgcttgccaatgtgtgcctggatgagcttgataagtggatcgaagagaagattaaggagctttacaagccatccaagttggatgttgtgggaggggatgatggtattgagcagggtaacacatcatggccggagtttgttcccacgagtggccctgacaagacaaggaaggtggactacattcgatatggtggacatttcttaatcggtgtgagggggccaagagccgatgcggcggtgcttcggaagcagctagttgagttttgtgatcagcgattcaggatcaaacttgataatgagagcctccctattgagcacatcacaaaaggagtcatgttccttgaccatgtgttgtgccgtcgagttgtctacccaacgctgcgttacactgctacaggaggcaagatcattagtgagaagggagttggtacactgctctcggtgacagctagtctgaagcagtgtatcaaacagtttcggaagctcgagtttttgaaaggtgaccgtgaaccagatccacaaccatgcttccgtatgttccacgccacacaggctcacacaaattctcagatgaataagcttttactgacgatggcagagtggtatcgctatgctgataaccgcaagaaagttgtcaacttctgctcttacattataagggggtccctggcaaaattatatgctgccaagtacaagctgcggtcaagggcaaaggtctataagattgcgtcaagaaatcttagtcggccattgaaggataagaaagggcagtcgccagagtatcacaatttgctgagaatgggccttgtggattcgattgatggtcttcagtatacaaggatgtcgatggttcctgatcctgattacacgccgttaccaagtggatggcggccagaccatgagaggattttgctggagtatataaagctcacagatcaacagacattggaagagcagcgaaactgcattagagaggaggggctaataacaccacaggactatatttcgatgcttgtatggggctacaagaaaaatgctgttttacttccttcaaaagtgagtgatgcccaaggatccacagaggacctgggttcagatactgatgaattggatgaaaaagagctaggaaatgagggcaatcaaagtttcccaaagcttgctgaaatgtcatga

SEQ ID NO: 6722 - protein, 739 aa, Sorghum bicolor
  misc_feature: Ceres ANNOT ID no. 6068206
  misc_feature (492)..(626): Pfam Id: Intron_maturas2 Pfam Desc: Type II intron maturase
  misc_feature (132)..(723): NCBI GI: 115488292 NCBI Desc: os12g0407300 [oryza sativa (japonica cultivar-group)]
  misc_feature (461)..(738): NCBI GI: 27764956 NCBI Desc: at5g46920/mqd22_6 [arabidopsis thaliana]
  misc_feature (346)..(601): NCBI GI: 786218 NCBI Desc: coxii intron2 orf [marchantia polymorpha]
  misc_feature (339)..(653): NCBI GI: 23505442 NCBI Desc: orf786 [schizosaccharomyces octosporus]
  misc_feature (176)..(280): NCBI GI: 32140772 NCBI Desc: ltra [shuttle vector pleiitd+kr'']
MPPPRRALLTSLLRLRSFSSIAYPHPHPPAPPRRHQFVADPTTSTSRGVIGGIGGGSGNPLDPTQLLRDDPVAITASLWVSSFRAAAAASGSGSCTSAPPQSLTPFLSRLELWVLAYQKAYADETGSYLPRSSIPASTLTSLLTLRNAVLDARFRFGNRLTPFLQSPRAANAPDPATLSKRKLRALLTTPGPPPFQDRVVQELLLLLLEPVYEARFSPKSFAFRPGRSPHAAIRTIRRSFAPYLWYIKGDLSPLLHSPDPALVVGALIRDVRDKKVVDLIRSALLTPVVTASDDAAAKKKKTKRKYQKKKVLPEGEPKPDPYWLQTFFGFAPEEAQTQPDWGHCGVLSPLLANVCLDELDKWIEEKIKELYKPSKLDVVGGDDGIEQGNTSWPEFVPTSGPDKTRKVDYIRYGGHFLIGVRGPRADAAVLRKQLVEFCDQRFRIKLDNESLPIEHITKGVMFLDHVLCRRVVYPTLRYTATGGKIISEKGVGTLLSVTASLKQCIKQFRKLEFLKGDREPDPQPCFRMFHATQAHTNSQMNKLLLTMAEWYRYADNRKKVVNFCSYIIRGSLAKLYAAKYKLRSRAKVYKIASRNLSRPLKDKKGQSPEYHNLLRMGLVDSIDGLQYTRMSMVPDPDYTPLPSGWRPDHERILLEYIKLTDQQTLEEQRNCIREEGLITPQDYISMLVWGYKKNAVLLPSKVSDAQGSTEDLGSDTDELDEKELGNEGNQSFPKLAEMS

SEQ ID NO: 6723 - DNA, 1269 bp, Sorghum bicolor
  misc_feature: Ceres ANNOT ID no. 6068208
  misc_feature: Encodes the peptide sequence at SEQ ID NO 6724
atggggaaggcggggcgctggctccggagcttcctgtccggcaagaaggacaggccgccgcagcaggccgtggagccaccgaaggacaagcggtggagcttcaggcgccccccggcggcgcaggaagggagggccgccgaggcttcgtggcgcggtgtgccgcaggaggaccaggaccagcaccaggggccgcttggtttcccggcgccgggcgtcgagttcgaccagaacaagcatgccgtggcggtggccgtggcgaccgcggccgcggccgacgcggcggtggccgccgcgcacgcggccgccgccgtggcgcgcctgtcgtcccgtggtgcgtcgcgcatgccactgccgccgccgtgcctcgtcgaggacgccgccgccgtcaggatccaggccaccttcagaggctatctggcgcggacggctctgtgcgcgctgaggggcatcgtcaagctgcaagctctggtgcgggggcagctcgtgaggaagcaggccaacgccacgctccgctgcatgcaggcgctcctcgccgcgcagtcccacctgcgggcacagcgcatgctcgcgctccaccaccatgaccaccaccactacccgacgccgcccagaccacggcagtcgccgcagcacccgaggcaccgccgctcctacgagatggacaggtcgtgcgaggacaacgccaagatcgtggaggtggacgtcggggagcccgtgcggcggagccggagcgcgggcaaggacaggcaccccttcgccgaccaccaccactacgccggccggtgctcgccggcgccgtcggtggcgacggagctgatgagcccgcgggcgtacagcggccacttcgacgagttctcggtggccaacacggcgcagagcagcccgcggcatgaggcgtcggaggcgtgcccgggctacatggccaacacggagtcgtcccgcgccaaggcgcggtcccagagcgcgccccgccagcgcaccgacgcgctggagcggctgcctagccggaggaaagggacgccgcccagagccaccgccaagatgcagcgctcgtcgtcgctggccggcgccgcgccgcgcggggccggacactactcgtccccgtggtcgtcgggcgccaggctcgacgtctccacggcgtcgctgaaggacagtgagtgcggctccaccagctccgtgctcaccgccgccaccgtctacagccggacgcggtcgctcgtcggcttcgaggtgagtgacagtgataaaaataaaaggcgcgcgacatga

SEQ ID NO: 6724 - protein, 422 aa, Sorghum bicolor
  misc_feature: Ceres ANNOT ID no. 6068208
  misc_feature (125)..(145): Pfam Id: IQ Pfam Desc: IQ calmodulin-binding motif
  misc_feature (1)..(238): NCBI GI: 115482058 NCBI Desc: os10g0420200 [oryza sativa (japonica cultivar-group)]
  misc_feature (49)..(296): NCBI GI: 145348380 NCBI Desc: iqd25 (iq-domain 25); calmodulin binding [arabidopsis thaliana]
  misc_feature (123)..(402): NCBI GI: 30682982 NCBI Desc: calmodulin-binding family protein [arabidopsis thaliana]
  misc_feature (7)..(370): NCBI GI: 92881543 NCBI Desc: iq calmodulin-binding region [medicago truncatula]
  misc_feature (70)..(192): NCBI GI: 23308403 NCBI Desc: at3g49260/f2k15_120 [arabidopsis thaliana]
MGKAGRWLRSFLSGKKDRPPQQAVEPPKDKRWSFRRPPAAQEGRAAEASWRGVPQEDQDQHQGPLGFPAPGVEFDQNKHAVAVAVATAAAADAAVAAAHAAAAVARLSSRGASRMPLPPPCLVEDAAAVRIQATFRGYLARTALCALRGIVKLQALVRGQLVRKQANATLRCMQALLAAQSHLRAQRMLALHHHDHHHYPTPPRPRQSPQHPRHRRSYEMDRSCEDNAKIVEVDVGEPVRRSRSAGKDRHPFADHHHYAGRCSPAPSVATELMSPRAYSGHFDEFSVANTAQSSPRHEASEACPGYMANTESSRAKARSQSAPRQRTDALERLPSRRKGTPPRATAKMQRSSSLAGAAPRGAGHYSSPWSSGARLDVSTASLKDSECGSTSSVLTAATVYSRTRSLVGFEVSDSDKNKRRAT

SEQ ID NO: 6725 - DNA, 852 bp, Sorghum bicolor
  misc_feature: Ceres ANNOT ID no. 6068220
  misc_feature: Encodes the peptide sequence at SEQ ID NO 6726
atgagccagaggcagccgaggaggccgtccggccaccaggagacgacgagcggagagcagggcgccgtccgctacggcgacgtgttcccggcggtggccgggggcctcgcggagaagcccgtggcgccgcaggacgcggccacgatgcagtcggcggagaacctggtgttcggccagacgctcaggggagggccggcggcggccatgcagtccgcggccaccgccaacgagcgcatgggcgccgtcgggcacgaccaggccacggacgccaccgccgtgcagggcgtcaccgtctccgagacccgcgtcccgggcggccgcatcgtcaccgagttcgtcgcgggccaggccgtcggccagtacctcgcgcgggacgacgatgctggtggtggcggtggcggcgccggcgccggagcgagaggcgcctctgctggtggggtcggtaaggatatgacgaaggtgacgatcggcgaggcgctcgaggcgacggcgctcgcggcgggcgacgcgccggtggagcgcagcgacgcggccgcgatccaggcggcggaggcacgcgccacggggctggacgcgaacgtccccggcggcctggccgcacgggcacagtccgctgccgcggccaacgcgtgggcgtcgcgcgacgaggacaaggccacgctcggcgacgtcctcgcgaacgcggcgacgaggctggtggcggacaagccggtggagagcggcgacgcgctgggggtggctggcgcggagaaccgcaacagggacgacgggacggcgaggccaggaggcgtggcagcgtccatggctgcggccgcacggctcaaccgtgacgaggcggtctgggatcagtga

SEQ ID NO: 6726 - protein, 283 aa, Sorghum bicolor
  misc_feature: Ceres ANNOT ID no. 6068220
  misc_feature (22)..(81): Pfam Id: SMP Pfam Desc: Seed maturation protein
  misc_feature (153)..(214): Pfam Id: SMP Pfam Desc: Seed maturation protein
  misc_feature (218)..(280): Pfam Id: SMP Pfam Desc: Seed maturation protein
  misc_feature (1)..(282): NCBI GI: 22460 NCBI Desc: rab28 [zea mays]
  misc_feature (1)..(277): NCBI GI: 226556 NCBI Desc: lea d-34 gene
  misc_feature (1)..(277): NCBI GI: 18501 NCBI Desc: d-34 lea protein [gossypium hirsutum]
  misc_feature (20)..(277): NCBI GI: 77997745 NCBI Desc: seed maturation protein [medicago truncatula]
  misc_feature (1)..(277): NCBI GI: 57506542 NCBI Desc: ecp31 protein [daucus carota]
MSQRQPRRPSGHQETTSGEQGAVRYGDVFPAVAGGLAEKPVAPQDAATMQSAENLVFGQTLRGGPAAAMQSAATANERMGAVGHDQATDATAVQGVTVSETRVPGGRIVTEFVAGQAVGQYLARDDDAGGGGGGAGAGARGASAGGVGKDMTKVTIGEALEATALAAGDAPVERSDAAAIQAAEARATGLDANVPGGLAARAQSAAAANAWASRDEDKATLGDVLANAATRLVADKPVESGDALGVAGAENRNRDDGTARPGGVAASMAAAARLNRDEAVWDQ

SEQ ID NO: 6727 - DNA, 1416 bp, Sorghum bicolor
  misc_feature: Ceres ANNOT ID no. 6068224
  misc_feature: Encodes the peptide sequence at SEQ ID NO 6728
atgaagaaccctaaccctcctccttcgcggccctccgccgcaggcaagccccccgctggcatggcgccggcccgcaaatctcgctggggtccaccgccaccgggcgctgccggcgccgccccggctggggacaaggccgcgccatccacctccgcccgcaccccgacccccacccgcacagcggattccaggcgccatccgggggcccctcccgtgccagcaccacacgcccgcaaccccgcgtcgcccgcggccgccctccggtcgcaggctcagccgcacccggcggtggagactcctcccccgcagccgtacggcttccacaacctcgaccgccgcaccatgctcctcgccgacggcaccgtccgcacctacttcgccctgccccctgactaccccttcgagccggcgcccctgccacccctcccacgccacctcctcccccgcgccgccccagacctttggccgccacatcaggcgccgccgccgccgccgcagatgcccatgcccatgcctgtgcagatgccgccgcacgaggctaggcggaaacaccccgccgaccaggacgagggcttccctaggcaccacaagcagccgcggctcgacgggccgcatcaaccgccgccacatgccgcggtggaccggcacgcactcaggagggcgttcctcaagtacgccaagatgctcaacgagagctccgcgcagaggcggagctatctcgagggcggccgtgtcccgtgcctcgcctgtggcaggtcatctaaggactttgctgatgtccatggacttgtcatgcatgcttacaacccaccaaatgcagattcacttgttgatcatcttggtttgcacaaggcattgtgtgtccttatgggatgggattatacaaaagtccctgagaactctaagggctaccaatcattaccttctgaccttgtccaagcaagtagggaggacctcatcgtgtggccgcctactgttatcattcacaatacttcgactgggaggaagaaagatggtcgttttgagggtttagggaacaaagaaatggataagaaaatgacagaactaggtttttctggtgggaagtcaaagtccttgtatggaaaggaaggacatatgggtttgacacttatcaagtttgcaaacaacccatctggcttgaaggaggctgagcgtcttgctgagttccttgagaggcaagatcgtggacgtgtgggttggtcacgtgctcatgccagtcgttctgtagattctgatcagaaccctttgttggtcgagacggatatcaggacagctgagaaaaagaggatattttacgggtacctagcaattgcatctgatctggatgaactagactcagattctcgaaaaagggctttcctccagagcagaagagaatttgatccaaatgaatga

SEQ ID NO: 6728 - protein, 471 aa, Sorghum bicolor
  misc_feature: Ceres ANNOT ID no. 6068224
  misc_feature (316)..(424): Pfam Id: XS Pfam Desc: XS domain
  misc_feature (290)..(466): NCBI GI: 30686649 NCBI Desc: xs domain-containing protein [arabidopsis thaliana]
  misc_feature (342)..(466): NCBI GI: 18252269 NCBI Desc: at3g22430/mcb17_17 [arabidopsis thaliana]
  misc_feature (4)..(209): NCBI GI: 6523547 NCBI Desc: hydroxyproline-rich glycoprotein dz-hrgp [volvox carteri f. nagariensis]
  misc_feature (4)..(209): NCBI GI: 12018147 NCBI Desc: vegetative cell wall protein gp1 [chlamydomonas reinhardtii]
  misc_feature (4)..(212): NCBI GI: 117606933 NCBI Desc: vegetative cell wall protein [chlamydomonas incerta]
MKNPNPPPSRPSAAGKPPAGMAPARKSRWGPPPPGAAGAAPAGDKAAPSTSARTPTPTRTADSRRHPGAPPVPAPHARNPASPAAALRSQAQPHPAVETPPPQPYGFHNLDRRTMLLADGTVRTYFALPPDYPFEPAPLPPLPRHLLPRAAPDLWPPHQAPPPPPQMPMPMPVQMPPHEARRKHPADQDEGFPRHHKQPRLDGPHQPPPHAAVDRHALRRAFLKYAKMLNESSAQRRSYLEGGRVPCLACGRSSKDFADVHGLVMHAYNPPNADSLVDHLGLHKALCVLMGWDYTKVPENSKGYQSLPSDLVQASREDLIVWPPTVIIHNTSTGRKKDGRFEGLGNKEMDKKMTELGFSGGKSKSLYGKEGHMGLTLIKFANNPSGLKEAERLAEFLERQDRGRVGWSRAHASRSVDSDQNPLLVETDIRTAEKKRIFYGYLAIASDLDELDSDSRKRAFLQSRREFDPNE

SEQ ID NO: 6729 - DNA, 2136 bp, Sorghum bicolor
  misc_feature: Ceres ANNOT ID no. 6068230
  misc_feature: Encodes the peptide sequence at SEQ ID NO 6730
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
atggccgccgtcgcgccgcccccggctcccgcgcccgccgcgcctgcaccggctgctgctgctgctgctgctccggctccggctcctgccaccgtccctgtcgcggatcaaaccacggatctgctgcagaagctgtcgctggatccgcagcccaaggcggcggatgcaacagagcctactgctgctgccaagaagcagggcgctgtgacgagccagccgctaagtgtggccataccgccggagcggtccatcacaccggtgcttcaagactttatggatcccaacctattctatctaccagcgtattactatggaggctacgacagttccatgagcgagtgggatgattatccaagatatctaaattcagatggagtggagattgccccagcagtatatggagatatttatggatatgggtatgctccttatggggcatactctcctgccacttccccagctccaacggttgatggccagatgtttggtgcacagcattaccagtatccaactgcgtattttcagcctcctacaccagttccttctaccactcaaagtgacctccagtcttctaacaatactgaaaagccagcagctaaagcagatcctgccaagacaactgctaacggtgttccaaatggtactgctcatagtaacagtggaactgtaccccttgcgtcaagccaacaaaattcatcactgacgcctgatggaacttatagggcgccattgctaggtggagttccttctgctggttacctggacatgacatatgggtatgacagcacaggggcacactttgcatggtatgatggctctgcttatgcaaatggtcagcaaagaacaactacaactaatcattatccatcctcaacattcagtggtaatggttcctcagcaagaaatcagaacaagagctccaccacgccgcagatgggtatgcagaacagaagacctacaactacatcagcaactcctacttataccaataggatgtaccctagctcccgaccatacacccagtatgggaattcaataaaaactggtcttccctacgggagtaacggttacgattccaggatatatggtcgatggggcgttggtatggataacaggtacaggcctaggggccgtaatggatactatggttatggcaacgagagtcaggatggaacaattgagttaaacagaggtcctagatctggccgtttcaagaaccagaaattgtatggtcatactgtcactattgctgtgaaagggcagagccttccttctggtgaaagcaagaatgatagtgccgtgcccgatagagcacagttcaatagagacgacttccctgttcagtatgatgctgcaaagttcttcgtcatcaagtcgtacagcgaggatgacatccacaagagtgtaaaatacaatgtgtgggcaagcacaaccaatggaaacaagaagcttgatgctgcttatcaagaagctcagtcaaagggctctgcatgccctatattcttgtttttctcagtgaatacaagtggtcagtttgttggtgttgctgaaatgactggtgctgttgattttgagaaaactctggagtattggcagcaggacaagtggaatggttccttctctgttaagtggcatattgtcaaggacgtgcctaacaatattctcaagcacatcatcctagagaacaatgagaacaagcctgtcacgaatagccgtgacacccaggagatacaccttgaacaaggccttcagatgctcaagatcttcaaggatcatgtcagcaagacatccatcctggatgactttaccttctatgagagccgccagaaattgatgcaggataagaggtcgaaacagcagcaggtccaaaagcaggtctgggacagtaggacccccatttctgtcaccagcgagcaacagcaggaagctgctaatgggaagcccaatccgtctgatgtaccaaatggtgtcactgcagaggtgaaggcggtgaaggctcctgcagagaaacccgtcctcgccaatggagtcaccaacggagtaaccaccactcccgctgtttcctatgcagctaaggtggcccaaacagcaacagggaaacccatcctcgccaatggagtcgccaagaccggttag

SEQ ID NO: 6730 - protein, 711 aa, Sorghum bicolor
  misc_feature: Ceres ANNOT ID no. 6068230
  misc_feature (502)..(592): Pfam Id: YTH Pfam Desc: YT521-B-like family
  misc_feature (35)..(708): NCBI GI: 92884719 NCBI Desc: yt521-b-like protein [medicago truncatula]
  misc_feature (25)..(626): NCBI GI: 124365566 NCBI Desc: yt521-b-like protein [medicago truncatula]
  misc_feature (130)..(681): NCBI GI: 50509741 NCBI Desc: high-glucose-regulated protein 8-like [oryza sativa (japonica cultivar-group)]
  misc_feature (259)..(677): NCBI GI: 30697464 NCBI Desc: yt521-b-like family protein [arabidopsis thaliana]
  misc_feature (259)..(677): NCBI GI: 15912287 NCBI Desc: at5g61020/maf19_20 [arabidopsis thaliana]
  misc_feature: Up-regulated in shoot tissues in response to methyl jasmonate treatment
  misc_feature: Up-regulated in root tissues in response to methyl jasmonate treatment
  misc_feature: Up-regulated in shoot tissues in response to salicylic acid treatment
MAAVAPPPAPAPAAPAPAAAAAAAPAPAPATVPVADQTTDLLQKLSLDPQPKAADATEPTAAAKKQGAVTSQPLSVAIPPERSITPVLQDFMDPNLFYLPAYYYGGYDSSMSEWDDYPRYLNSDGVEIAPAVYGDIYGYGYAPYGAYSPATSPAPTVDGQMFGAQHYQYPTAYFQPPTPVPSTTQSDLQSSNNTEKPAAKADPAKTTANGVPNGTAHSNSGTVPLASSQQNSSLTPDGTYRAPLLGGVPSAGYLDMTYGYDSTGAHFAWYDGSAYANGQQRTTTTNHYPSSTFSGNGSSARNQNKSSTTPQMGMQNRRPTTTSATPTYTNRMYPSSRPYTQYGNSIKTGLPYGSNGYDSRIYGRWGVGMDNRYRPRGRNGYYGYGNESQDGTIELNRGPRSGRFKNQKLYGHTVTIAVKGQSLPSGESKNDSAVPDRAQFNRDDFPVQYDAAKFFVIKSYSEDDIHKSVKYNVWASTTNGNKKLDAAYQEAQSKGSACPIFLFFSVNTSGQFVGVAEMTGAVDFEKTLEYWQQDKWNGSFSVKWHIVKDVPNNILKHIILENNENKPVTNSRDTQEIHLEQGLQMLKIFKDHVSKTSILDDFTFYESRQKLMQDKRSKQQQVQKQVWDSRTPISVTSEQQQEAANGKPNPSDVPNGVTAEVKAVKAPAEKPVLANGVTNGVTTTPAVSYAAKVAQTATGKPILANGVAKTG

SEQ ID NO: 6731 - DNA, 1500 bp, Sorghum bicolor
  misc_feature: Ceres ANNOT ID no. 6068232
  misc_feature: Encodes the peptide sequence at SEQ ID NO 6732
atggccgacaaggcggcgtccccggagaagaagtcgtgggccgacctcgaggaggaggaggaggccaaggccaaggcggccgcggaagcggaagcggcgtcctcttcctcttcctcctccgccgtgccggcagtggacgagcaggccaagcagatcgaggcgctctccctcgccccggcggtggaggacgccgcaggcgaagagggtccgcccctcctcgatgactccgacgactcgcaaatccaagccgtgacttcgggtggcacggtgtacgagtccgccaccacgttcgaggatctgaagctgtcgcccgagctgctcaaggggctgcacgacgagatggggttcagccgcccgagcaagatccaggcgatcaccctgcccatgatcctcaccccgccctacaaggacctcgtcgcgcaggcgcacaacggctctggcaagaccacttgtttcgtcctcggcatgctcagccgcgtcgacccgcagcgcaggataccccaggctatctgcatttgccccactagggagctcgcacagcagaataaggcggttctcatgaggatgggcaagtttacaggcattacatgcgcttgtgcaatcccaccagctcaaaaggactatatgccgatctctaaaatggctccgattactgaccagatcgttattggcacatctggtacactcatcaaatggattacccataagaagctggccactagggatatcaagatacttgtgtttgatgaggcagatcatatgcttgctgaggatggatttaggagtgattctgaaaggatcatgagggatatacaaagaagcgctggtggttgtcaggtgcttctcttttcggcgactttcaatgagagagtgaaggattttgttacaaaggttattagggatggaaatcagatattcgtgaagaaggaagagcttactttggaaaaagtaaagcaatacaaagttcaaatccctgatgaatcggcaaaaatagaggttataagggacaagatatttgaatttggacagaaagtcggccaggttatcatatttgttagaacaaagcaaagtactaagaatgttcacaatgctttgacgagggaggactatgtgtgctcctcaattcaaggatcccttgaccaatcagagagggaaaagataatacaggaattcaaagatggctacaccaaggttcttatatcaactgatgttctagctcgaggttttgaccaagcacaggttaacctggtcatcaactacgacatgccaatcaaatttggtacaagagatgaacctgattatgaagtgtacttgcatagaattggcagagctgggcgctttggccggaaaggtgctgtgttcaacttgctgtgtggtcaaacagataatgttgtgatgaagaagattgaggactatttccagcacagtgtacctgaggttcggaattggcaacgtgaagaagatttcgaggctgctctcaaggatgcaggtttactttaa

SEQ ID NO: 6732 - protein, 499 aa, Sorghum bicolor
  misc_feature: Ceres ANNOT ID no. 6068232
  misc_feature (120)..(294): Pfam Id: DEAD Pfam Desc: DEAD/DEAH box helicase
  misc_feature (364)..(448): Pfam Id: Helicase_C Pfam Desc: Helicase conserved C-terminal domain
  misc_feature (16)..(499): NCBI GI: 15982881 NCBI Desc: at3g53110/t4d2_40 [arabidopsis thaliana]
  misc_feature (72)..(480): NCBI GI: 51261184 NCBI Desc: dead (asp-glu-ala-asp) box polypeptide 25 [rattus norvegicus]
  misc_feature (72)..(480): NCBI GI: 30749194 NCBI Desc: gonadotropin-regulated testicular rna helicase; grth [mus musculus]
  misc_feature (72)..(480): NCBI GI: 33186912 NCBI Desc: dead (asp-glu-ala-asp) box polypeptide 25 [rattus norvegicus]
  misc_feature (72)..(487): NCBI GI: 61222937 NCBI Desc: atp-dependent rna helicase ddx25 (dead-box protein 25) (gonadotropin-regulated testicular rna helicase)
  misc_feature: Useful for making plants with modulated cold sensitivity
  misc_feature: Useful for making plants with modulated heat sensitivity
  misc_feature: GREAT-hit functional homolog of the protein sequence given in SEQ ID NO 13410
  misc_feature: Useful for making plants with modulated cold sensitivity
  misc_feature: Useful for making plants with modulated heat sensitivity
  misc_feature: Functional homolog of the protein sequence given in SEQ ID NO 13410
MADKAASPEKKSWADLEEEEEAKAKAAAEAEAASSSSSSSAVPAVDEQAKQIEALSLAPAVEDAAGEEGPPLLDDSDDSQIQAVTSGGTVYESATTFEDLKLSPELLKGLHDEMGFSRPSKIQAITLPMILTPPYKDLVAQAHNGSGKTTCFVLGMLSRVDPQRRIPQAICICPTRELAQQNKAVLMRMGKFTGITCACAIPPAQKDYMPISKMAPITDQIVIGTSGTLIKWITHKKLATRDIKILVFDEADHMLAEDGFRSDSERIMRDIQRSAGGCQVLLFSATFNERVKDFVTKVIRDGNQIFVKKEELTLEKVKQYKVQIPDESAKIEVIRDKIFEFGQKVGQVIIFVRTKQSTKNVHNALTREDYVCSSIQGSLDQSEREKIIQEFKDGYTKVLISTDVLARGFDQAQVNLVINYDMPIKFGTRDEPDYEVYLHRIGRAGRFGRKGAVFNLLCGQTDNVVMKKIEDYFQHSVPEVRNWQREEDFEAALKDAGLL

SEQ ID NO: 6733 - DNA, 909 bp, Sorghum bicolor
  misc_feature: Ceres ANNOT ID no. 6068239
  misc_feature: Encodes the peptide sequence at SEQ ID NO 6734
atgcagtcgccggagccctcctcctcctccccggtcctcctcaatatagggggaaagaagtacgcaaccaccgtggagacactgacgcagcgggagcccgactccatgctcgccgccatgttcagcgggcggcacacgctcccgcagcacccaaccacggggaaggggatggtgttcgtggacagggacgggaagcacttccggcacgtgctcaattggctcagggacggtgctatccccgtgctgtcggagtccgattaccagcaactgctgcgagaggcagagtactaccagttgctcggtttagctgattacataaatgagaggcttggttggaagaaagccgacaattcagaggctgaattgacacgaaaggacgtgatcaagtgcatacaggcgcaaagagtcagatttcgtggcgtgaatttgtctggccttgatctgtctaaacttgacttatcagaggtggacttcagttatgcatgcattaagaacactgatttttcatgtgctaacctttacaaagcaaaatttggggtggaagctttgtcttcgtctttccaaaacgcaaatttgcgtgagtgtgagtttgttggagcgaatcttcaagaatctattctggatggagcaaaccttcgaagtgccaacttgcaagatgcatccttaacacgatgcagcttcattgaaacagatctccattctgcccatttacagactgctaaccttacacaagccaacttaagaggagctaatcttgaagcagccaatctcaagggtgctaagttgtctggtacaaacttgcaagacgcaaatcttcagagagcttacttgcgagaagttgatttgcgtgacactcaattgactggtgctaagctcggaggtgcaaatctacttggagctatcagatga

SEQ ID NO: 6734 - protein, 302 aa, Sorghum bicolor
  misc_feature: Ceres ANNOT ID no. 6068239
  misc_feature (131)..(170): Pfam Id: Pentapeptide Pfam Desc: Pentapeptide repeats (8 copies)
  misc_feature (185)..(224): Pfam Id: Pentapeptide Pfam Desc: Pentapeptide repeats (8 copies)
  misc_feature (225)..(264): Pfam Id: Pentapeptide Pfam Desc: Pentapeptide repeats (8 copies)
  misc_feature (265)..(303): Pfam Id: Pentapeptide Pfam Desc: Pentapeptide repeats (8 copies)
  misc_feature (12)..(105): Pfam Id: K_tetra Pfam Desc: K+ channel tetramerisation domain
  misc_feature (5)..(302): NCBI GI: 6503014 NCBI Desc: fh protein interacting protein fip2 [arabidopsis thaliana]
  misc_feature (5)..(284): NCBI GI: 30696554 NCBI Desc: potassium channel tetramerisation domain-containing protein / pentapeptide repeat-containing protein [arabidopsis thaliana]
  misc_feature (12)..(297): NCBI GI: 125777425 NCBI Desc: ga13145-pa [drosophila pseudoobscura]
  misc_feature (12)..(297): NCBI GI: 17862036 NCBI Desc: ld05823p [drosophila melanogaster]
  misc_feature (12)..(297): NCBI GI: 116008377 NCBI Desc: cg14647-pa [drosophila melanogaster]
MQSPEPSSSSPVLLNIGGKKYATTVETLTQREPDSMLAAMFSGRHTLPQHPTTGKGMVFVDRDGKHFRHVLNWLRDGAIPVLSESDYQQLLREAEYYQLLGLADYINERLGWKKADNSEAELTRKDVIKCIQAQRVRFRGVNLSGLDLSKLDLSEVDFSYACIKNTDFSCANLYKAKFGVEALSSSFQNANLRECEFVGANLQESILDGANLRSANLQDASLTRCSFIETDLHSAHLQTANLTQANLRGANLEAANLKGAKLSGTNLQDANLQRAYLREVDLRDTQLTGAKLGGANLLGAIR

SEQ ID NO: 6735 - DNA, 1263 bp, Sorghum bicolor
  misc_feature: Ceres ANNOT ID no. 6068241
  misc_feature: Encodes the peptide sequence at SEQ ID NO 6736
atggcgtcgtgggacaacctcggggagctctccaacatcgcgcagctcacgggtctggacgccgtgaagctcatctccctcatcgtcagggcggcgtccacggcgcgcctgcacaagcgcaactgccgccgcttcgcgcagcacctcaagctcatcggcggcctgctggagcagctccgggtgtcggagctcaggaagtacccggagacgcgggagccgctggagcagctcgaggacgcgctccgccggggatacctcctcgtcaactcctgccaggaccgatcctacctctacctcctcgccatgggctggaacatcgtctaccagttccgcaaggcgcagagcgagatcgacaattacctacgcctcgtcccgctcatcacgctcgtcgacaatgcccgcattcgggatcggcttgagtatattgagagggaccaatgtgaatattcttttgacgaggaagacaagaaagtgcaagatgctctgttaaatcctgacccttgcacgaatcctacaatagtgctcaagaagactctgtcatgttcctatccaaacttgcctttcaatgaggccctccgaaaggaaagtgagaagcttcaggttgagcttcaaagatcacaaagcaacatggatctgggttcgtgtgaggttattcagcacctgattggagtaaccaaaactgtggaatctacaattccagaggaagaaacaaatgctaaagcttcagaaaagaagggttcaaactacagtgaatccaaaggagataatgcaaaatcgtttgatgatgacgacgactatcctaagaagcaaaaggatacctgcagcacgcaacgattttcttcacaagttccatatggccatgatcttgtctcaagtagaggatcgtacagcgatgagtggcatgcagatttacttggctgctgttcagaaccagctttgtgtttcaagaccttgttcttcccctgtggaaccttctcgagaattgcttcagtcgccaaggacaggccaatgtcttctggagaagcttgcaatgatattatggcatactccctaatattgtcctgctgctgttatacatgctgtgtaaggagaaagcttcgccaaaagttggacattgcgggaggctgctgtgacgactttctttcacatctgctgtgttgttgctgtgcacttgttcaagaatggcgggaagttgagattcgtggggcatataccgaaaagacgaaggttaccccaccgccatgtcaatatatggagcattga

SEQ ID NO: 6736 - protein, 420 aa, Sorghum bicolor
  misc_feature: Ceres ANNOT ID no. 6068241
  misc_feature (300)..(398): Pfam Id: PLAC8 Pfam Desc: PLAC8 family
  misc_feature (2)..(419): NCBI GI: 140047308 NCBI Desc: uncharacterized cys-rich domain [medicago truncatula]
  misc_feature (3)..(404): NCBI GI: 22137178 NCBI Desc: at4g35920/f4b14_190 [arabidopsis thaliana]
  misc_feature (4)..(143): NCBI GI: 52076711 NCBI Desc: receptor protein kinase-like [oryza sativa (japonica cultivar-group)]
  misc_feature (1)..(158): NCBI GI: 115486569 NCBI Desc: os11g0670100 [oryza sativa (japonica cultivar-group)]
  misc_feature (4)..(143): NCBI GI: 115469634 NCBI Desc: os06g0690200 [oryza sativa (japonica cultivar-group)]
MASWDNLGELSNIAQLTGLDAVKLISLIVRAASTARLHKRNCRRFAQHLKLIGGLLEQLRVSELRKYPETREPLEQLEDALRRGYLLVNSCQDRSYLYLLAMGWNIVYQFRKAQSEIDNYLRLVPLITLVDNARIRDRLEYIERDQCEYSFDEEDKKVQDALLNPDPCTNPTIVLKKTLSCSYPNLPFNEALRKESEKLQVELQRSQSNMDLGSCEVIQHLIGVTKTVESTIPEEETNAKASEKKGSNYSESKGDNAKSFDDDDDYPKKQKDTCSTQRFSSQVPYGHDLVSSRGSYSDEWHADLLGCCSEPALCFKTLFFPCGTFSRIASVAKDRPMSSGEACNDIMAYSLILSCCCYTCCVRRKLRQKLDIAGGCCDDFLSHLLCCCCALVQEWREVEIRGAYTEKTKVTPPPCQYMEH

SEQ ID NO: 6737 - DNA, 471 bp, Sorghum bicolor
  misc_feature: Ceres ANNOT ID no. 6068244
  misc_feature: Encodes the peptide sequence at SEQ ID NO 6738
atgcttcgcgtcgacgacctcatcgccgaactctgccttctgccggccaaagtcctcggcaagaagaagcgcagggagttccagacggtggagctgttggtgcggatggactgcgaggggtgcgagcgcagggtgaggaaggcagtggaggacatgagaggcgtgagcagcgtggaggtggacccgaagcagaacaaggtgtcggtgtccgggtacgtggaggcgccggaggtggtggagcggctgcggcggcgcgccgggaaggaggccaagccgtggccctacgtgccgtacgaggtggtgccgcacccctacgccccgggcgcctacgacaagaaggcgccgcccgggtacgtccgcaacgtgctcgacgaccccgacgccgcgccgctcgtcagggccgcctccatggaggagaggtacaccaccgccttcagcgacgacaacccaaactcctgcgccgtcatgtga

SEQ ID NO: 6738 - protein, 156 aa, Sorghum bicolor
  misc_feature: Ceres ANNOT ID no. 6068244
  misc_feature (31)..(92): Pfam Id: HMA Pfam Desc: Heavy-metal-associated domain
  misc_feature (6)..(156): NCBI GI: 23304411 NCBI Desc: farnesylated protein 1 [hordeum vulgare subsp. vulgare]
  misc_feature (22)..(156): NCBI GI: 79547451 NCBI Desc: metal ion binding [arabidopsis thaliana]
  misc_feature (36)..(156): NCBI GI: 37202066 NCBI Desc: at5g66110 [arabidopsis thaliana]
  misc_feature (21)..(156): NCBI GI: 4097573 NCBI Desc: gmfp7 [glycine max]
  misc_feature (22)..(156): NCBI GI: 21536547 NCBI Desc: farnesylated protein (atfp6) [arabidopsis thaliana]
MLRVDDLIAELCLLPAKVLGKKKRREFQTVELLVRMDCEGCERRVRKAVEDMRGVSSVEVDPKQNKVSVSGYVEAPEVVERLRRRAGKEAKPWPYVPYEVVPHPYAPGAYDKKAPPGYVRNVLDDPDAAPLVRAASMEERYTTAFSDDNPNSCAVM

SEQ ID NO: 6739 - DNA, 1215 bp, Sorghum bicolor
  misc_feature: Ceres ANNOT ID no. 6068254
  misc_feature: Encodes the peptide sequence at SEQ ID NO 6740
atggaggaggccgtggaggacatcgtcattgccggcgcgggcctcgccggcctcgcgacggcgctcgggaaaggggtgcggtgcctggtgctggagtcgtcgccgacgctgcgcgcgtcagggttcgcgttcaacacgtggaccaacgccttccgcgccctcgatgccctcggcgttggggacaagatccgggagcaccatttgctctacgagaggatgattgccttctctgcagctacaggtgaagctgctgcagaagtaagcttaaagattcagggcaaaagcgggccacacgaaatccggtgcgtgaagcgggacttcctgctgcagacgctcgccaacgagctgcccgagggcaccatcaggtactcgtccaagcttgccgccatggaggaagacgacggcagcgtgaagaccctgcacttggcagatggttccatcataaaggccaaggtcgtgatagggtgcgacggcgtgaactcggtggtggccaagtggctgggcctcccgaagccgatcctctcgggccgctccgccaccaggggcctcgccgagtacccggcgggccacggcttcggcccggagatcctgcagttcatcggccatggcttccgctccggcgtgctcccctgctccgacacctccgtctactggaactacacctggtacccttccccggcggacggggacgccgaggagagcgtggccaagatgcggagccacgtggtcggcaagctgcggggcgccaagatcccggcggaggcgctggaggtgatcgagcggagcgagatgagcgacgtggcgtcgtcgccgctgcggttccggtccccgctggcgctggtccgcggaagcatcagccggggcggcgtgtgcgtggcgggcgacgcgctgcacccgatgacgccggagctcgggcagggcgggtgcgccgcgctcgaggacggcgtcgtcctggcccggtgccttggcgaggccttcagccacggccacggccacgacgagcaggatgaggggcggcggttcacggcggcgctggagaagtacgcggaggcgaggcggtggcgcagcatccagctgatcacggccgcctacgtcgtcggcttcatccagcagagcaacaacgccgtgatcaggttcctcagggacaagttcctgtctagactgctgtccaagacgctagtcgccatggcggactacgactgtggcacgctatga

SEQ ID NO: 6740 - protein, 404 aa, Sorghum bicolor
  misc_feature: Ceres ANNOT ID no. 6068254
  misc_feature (7)..(349): Pfam Id: FAD_binding_3 Pfam Desc: FAD binding domain
  misc_feature (2)..(404): NCBI GI: 115450797 NCBI Desc: os03g0153500 [oryza sativa (japonica cultivar-group)]
  misc_feature (1)..(390): NCBI GI: 21537119 NCBI Desc: monooxygenase [arabidopsis thaliana]
  misc_feature (50)..(404): NCBI GI: 24745927 NCBI Desc: monooxygenase [solanum tuberosum]
  misc_feature (6)..(404): NCBI GI: 4164576 NCBI Desc: ctf2a [arabidopsis thaliana]
  misc_feature (6)..(404): NCBI GI: 4164574 NCBI Desc: ctf2a [arabidopsis thaliana]
MEEAVEDIVIAGAGLAGLATALGKGVRCLVLESSPTLRASGFAFNTWTNAFRALDALGVGDKIREHHLLYERMIAFSAATGEAAAEVSLKIQGKSGPHEIRCVKRDFLLQTLANELPEGTIRYSSKLAAMEEDDGSVKTLHLADGSIIKAKVVIGCDGVNSVVAKWLGLPKPILSGRSATRGLAEYPAGHGFGPEILQFIGHGFRSGVLPCSDTSVYWNYTWYPSPADGDAEESVAKMRSHVVGKLRGAKIPAEALEVIERSEMSDVASSPLRFRSPLALVRGSISRGGVCVAGDALHPMTPELGQGGCAALEDGVVLARCLGEAFSHGHGHDEQDEGRRFTAALEKYAEARRWRSIQLITAAYVVGFIQQSNNAVIRFLRDKFLSRLLSKTLVAMADYDCGTL

SEQ ID NO: 6741 - DNA, 1179 bp, Sorghum bicolor
  misc_feature: Ceres ANNOT ID no. 6068266
  misc_feature: Encodes the peptide sequence at SEQ ID NO 6742
atggtctccggaacggcgcacaacccggacgggggcggcggcgcccagggcacccagcgccagccgccgccgccgccgcacacgcaggtgggggcccggacgcccctcgccacgccgccgccggtctcaggcggcgccgcgcactccgcgtctactagtgggggcagcgccggctcgccaccgtccagccgcagcgagcagcacgcccccgacggtgctggcaagggtcctgccctcggggctgcgcccgcggcggcggcggcggcgtccacgccggccagcgacagcacgttcctccgcttgaataatctcgacatcaacggcgacgacgcgccatcgtcgcaggctcctacgagcaagaagaaaagaagaggcacacgggcagtgggtcctgataaaggtaaccggggactgcgccagtttagtatgaaagtttgtgagaaagttgaaagtaaagggagaacaacatataatgaggtggcagatgaacttgttgctgagtttacagaccccaataacaatattgaggcaccagatcctgataaccctaatgcgcaacaatatgatgagaagaatatacgacgaagagtttatgatgctttaaatgttctgatggctatggacattatatctaaagataaaaaggagatccagtggaagggcttgccacggactagtataagtgatattgaagaactgaagaaggaggtcgtgggactgaaaggtaggattgagaagaaaagtgcttacttacaggagctacaagaccaatatgtaggtctgcaaaacctgattcaacgaaatgagcaattatatggttcaggaaacacgccttctggtggagtggatttgccatttatcctagtccagacccgacctcatgcaactgtggaggttgagatatctgaagatatgcagttggtgcattttgacttcaatagcaccccatttgagctgcatgatgactcatatgtcctaaaagaaatgcggttctgtggaaaagaacaacatgaaggtgctcaagagtcgacatcaaatggaggtgagagctcaagcatgtcaaatatttattggcaacaagtacatcatctggagcggccaaataatggcacagttaggctaccaagctcaccgccaattccagggatattgaaagggcgtgtgaagcatgagcactag

SEQ ID NO: 6742 - protein, 392 aa, Sorghum bicolor
  misc_feature: Ceres ANNOT ID no. 6068266
  misc_feature (228)..(391): Pfam Id: DP Pfam Desc: Transcription factor DP
  misc_feature (133)..(221): Pfam Id: E2F_TDP Pfam Desc: E2F/DP family winged-helix DNA-binding domain
  misc_feature (49)..(392): NCBI GI: 32187097 NCBI Desc: dp1 [populus tremula x populus tremuloides]
  misc_feature (143)..(381): NCBI GI: 7378623 NCBI Desc: transcription factor-like protein [arabidopsis thaliana]
  misc_feature (137)..(352): NCBI GI: 7413636 NCBI Desc: dp-2 transcription factor-like [arabidopsis thaliana]
  misc_feature (108)..(341): NCBI GI: 89741408 NCBI Desc: dp1 [chlamydomonas reinhardtii]
  misc_feature (109)..(329): NCBI GI: 37362300 NCBI Desc: transcription factor dp-2 [danio rerio]
  misc_feature: The sequence is a functional homolog of SEQ ID NO 1550 in the 10/666,642US patent application
  misc_feature: The sequence is a functional homolog of SEQ ID NO 1552 in the 10/666,642US patent application
  misc_feature: The sequence is a functional homolog of SEQ ID NO 610 in the 10/666,642US patent application
  misc_feature: The sequence is a functional homolog of SEQ ID NO 612 in the 10/666,642US patent application
  misc_feature: Useful for making plants with modulated growth and phenotype characteristics
  misc_feature: The sequence is a functional homolog of SEQ ID NO 1550 in the 20070033671 US patent application
  misc_feature: The sequence is a functional homolog of SEQ ID NO 1552 in the 20070033671 US patent application
  misc_feature: The sequence is a functional homolog of SEQ ID NO 1550 in the 10/666,642 US patent application
  misc_feature: The sequence is a functional homolog of SEQ ID NO 610 in the 10/666,642 US patent application
  misc_feature: The sequence is a functional homolog of SEQ ID NO 1552 in the 10/666,642 US patent application
  misc_feature: The sequence is a functional homolog of SEQ ID NO 612 in the 10/666,642 US patent application
  misc_feature: The sequence is a functional homolog of SEQ ID NO. 416 in the 11/188,298 US application
MVSGTAHNPDGGGGAQGTQRQPPPPPHTQVGARTPLATPPPVSGGAAHSASTSGGSAGSPPSSRSEQHAPDGAGKGPALGAAPAAAAAASTPASDSTFLRLNNLDINGDDAPSSQAPTSKKKRRGTRAVGPDKGNRGLRQFSMKVCEKVESKGRTTYNEVADELVAEFTDPNNNIEAPDPDNPNAQQYDEKNIRRRVYDALNVLMAMDIISKDKKEIQWKGLPRTSISDIEELKKEVVGLKGRIEKKSAYLQELQDQYVGLQNLIQRNEQLYGSGNTPSGGVDLPFILVQTRPHATVEVEISEDMQLVHFDFNSTPFELHDDSYVLKEMRFCGKEQHEGAQESTSNGGESSSMSNIYWQQVHHLERPNNGTVRLPSSPPIPGILKGRVKHEH

SEQ ID NO: 6743 - DNA, 1095 bp, Sorghum bicolor
  misc_feature: Ceres ANNOT ID no. 6068268
  misc_feature: Encodes the peptide sequence at SEQ ID NO 6744
atgggtgcgggaaaaggaggagacggcggcggcggtggcggcgaggcggccgcggcggcgcctgaggccgcgcagcccgtcgtgctgaagatggaactgcattgcgccggctgcgcgcacaaggtcaagaaggctattaagcgcgttcctggtgtcgagtcgatcgtgacggacgtcgcggcgaacagggtcgtcgtggcggggacggcagacgccggcgcgctcaaggcgcggctcgaggcgaagaccagcaagcccgtggaagtcgtctccgccggcggcgcccccaagaaacctgctgccgccgcggagcacgccggcgccggcgagaagaagggggacaagggcgtgagccccaaggaggaggagaaagagaaggacaaggagaagaagcaacaggcctcggaggagaagaaacccaagcaggagacggtgctgctcaagatccgcctccactgcgacggctgcgccgaccgcatcaggcgacgcatctacaagatcaaaggcgtgaaggatgtggtgctggacggcaatgccaaggacgaggtgaaggtcatgggcaccatggacatccccaacatgctctcctacctcaaggagaagctcaaccgcgacgtggaggccgtggcgccgcccgccaagaaagacggcggcggcgagggcaaggacgacaagaaggacagcggcagcggcggcgacaagaacaagggcgcagccgaggccggcggcgacgacaagaaagacaaaggcaaagggatcgacgtgtcggcgggcccgtccacggcggccgccgcggcgttcatggctgcgccggcgggggcgagcacgtaccacgtggcgccgccgtacgggtacgtggcgtaccagcaggcgccaccgccgccccccgccagctactacccctacccgtactacggcaatggcgacggcatgggccacgccaacccctcctactaccaccaacaaccgcagcagcagcccgacgtcaaccagcagccgcagatggcgtacccgccgtacccgtaccgtttcgacatggcgccgccgccgcagctcttcagcgacgagaaccccaacgcctgctccgtcatgtaa

SEQ ID NO: 6744 - protein, 364 aa, Sorghum bicolor
  misc_feature: Ceres ANNOT ID no. 6068268
  misc_feature (27)..(89): Pfam Id: HMA Pfam Desc: Heavy-metal-associated domain
  misc_feature (145)..(210): Pfam Id: HMA Pfam Desc: Heavy-metal-associated domain
  misc_feature (27)..(356): NCBI GI: 21591780 NCBI Desc: cadmium induced protein cdi19 [arabidopsis thaliana]
  misc_feature (29)..(356): NCBI GI: 79326820 NCBI Desc: metal ion binding [arabidopsis thaliana]
  misc_feature (21)..(139): NCBI GI: 4097547 NCBI Desc: atfp3 [arabidopsis thaliana]
  misc_feature (5)..(364): NCBI GI: 38344582 NCBI Desc: osjnba0053b21.14 [oryza sativa (japonica cultivar-group)]
  misc_feature (137)..(349): NCBI GI: 4097571 NCBI Desc: gmfp5 [glycine max]
MGAGKGGDGGGGGGEAAAAAPEAAQPVVLKMELHCAGCAHKVKKAIKRVPGVESIVTDVAANRVVVAGTADAGALKARLEAKTSKPVEVVSAGGAPKKPAAAAEHAGAGEKKGDKGVSPKEEEKEKDKEKKQQASEEKKPKQETVLLKIRLHCDGCADRIRRRIYKIKGVKDVVLDGNAKDEVKVMGTMDIPNMLSYLKEKLNRDVEAVAPPAKKDGGGEGKDDKKDSGSGGDKNKGAAEAGGDDKKDKGKGIDVSAGPSTAAAAAFMAAPAGASTYHVAPPYGYVAYQQAPPPPPASYYPYPYYGNGDGMGHANPSYYHQQPQQQPDVNQQPQMAYPPYPYRFDMAPPPQLFSDENPNACSVM

SEQ ID NO: 6745 - DNA, 2796 bp, Sorghum bicolor
  misc_feature: Ceres ANNOT ID no. 6068271
  misc_feature: Encodes the peptide sequence at SEQ ID NO 6746
atggtgaaggcttacctccgctacgagccggccctcaccttcggtgtgattgcgtcgccggagtccaacgtcgtctacgacccctccggccgccgcctcctcgccgccgccctcgaccgcctcgtcgcctgggacctcaagcgtggtctcccctctgtctccttcgcaccttcctcctcctccttctcgctcgccgtctcctgcatcgcttcctccccctccgccgccgtctcctcttcgattgcgagcgggcacgcggatgggagcatcaggctgtgggacgcggaaacaggtggctgcgaggcaaccctccacgggcaccgctccgctgcctccgccctccgcttcggcccctctggcgccgtcctcgcttctggcagcaaggactgcgatgtcatcctctgggacgtggttgcgcaggctgggctcttccgtttgcgtgggcaccgtgatcaggtcaccgatttggtgtttctcgattctggtaagaagctggtgagctgctccaaggacaagtttatcagggtttgggaccttgaaacacagcactgtctacaaatcgttggtggtcaccgcagtgagatttggtcaatggatgtggatcctagcgagaggtttttagtgtctgggtctgctgatccagagctgcaggtgtttagaatccgacaatcagtggaggagggtgaggattggagcaagtgggatgtgctcaagctatttggtgagattccacggcagagcaaggaacgagtggcaaatgttaggtttaatagggatggtagtcttgtggtatgccaggtggctgggaagacagcagatatttatagggttcttgatgaaacagaggctgcacgtaaggccaaaaggcgggtgaacagaaagaaggagaaagcatctgcgaaatccatgattgccgaagataatggcactatcattgatcctttaccagctaaaaacttacaaaatcccactgttatcgtcaccgatgtatttaagctatttcaagttttacgggcaagcaaaaaaatatgctcggttgcattctctccaagtaatcctccaagaggatgccttgccattttgtctctatcactcaacaataacatgcttgagacgtactcagtggatagcgagaaggtatcgaagatgtactcggttgagatgcatggacaccgttctgacatcaggagcatctcccttaattctgaggacaaccttctgatgtcgactagccacaatgctgtcaagatatggaatcctagtacaggggaatgccttcggaccattgactctggatatgggctgtgcagtactttcgttggaaatcggtttgctcttgttggtacacaaagtggtgctttggagattgtggatattgctagtgggagcttaactgaggccatagaagctcatgctggctccatacgatcaattgtacctattccagatgaggatggaactgttggtgcgcgaggctttgtcactggaagtgctgatcatgatgtcaagttctgggaataccaattggtgcagaagtctgataatctgactgtaactaatgtgaggaccttgaagatgaccgaagatgtccttgctgtctcgatcagtcccgaaggaaagcacattgctgttgctctcttggattgccatgtcaaggtctaccacatggacacactgaaaccttctctaaacctttatgggcacaaacttccagttctctgtatggacatatcatctgatggggctttgctagttactggctccgcggacaaaaatttgaagatttggggtatggatttcggggactgccacagatctatatttgctcattcagacagcgtgatggatgttaagtttgtgtatagaactcattatatgttcagtgtggggaaagatcgcactgtgaagtactgggatgctgataaatttgagttgttgttaacacttgaaggacatcatgctgaagtttggtgcctcacaatcagcagtcgtggtgattttattgtaacaggttcgcatgatcgctccattcggcgttgggatcgtactgaagaacaactgttcattgaggaagagaaggagaaaagattggaagaaacctttgaggctgatttagaaaatgatgagtatagatatgggcagaaagatgatgcccctgatgaaggttctgtgggtgttcctggtaggaaaacaaaagagacagtaacctctgctgacgcaatcatggatgcacttgacactgctgaggaggaactaaaacgcattaatcagcataaaatggaagagcaaattaatgcgaaggcagctaaatttcaacctaatgttataatgcaagggcattcaccttcagattatgttctgaatgtagtttcaaacatccgtccaaatgatttggagcaggccctcttggcattgccattctcggatgcactaaagctcatgtcctacttgaaggagtggtctctagttccttcaaaggttgagcttgtttgtagggtttgcttagtgctccttcagacacatcataatcaattaactgctaccccagctgcaagatccttgttgacagaacttaaggatattctttactgtagagtaaaggaatgcaaggatactataggcttcaaccttgccgcaatggatcatgaattgttggcgatgagatcagatgcacctttccgtgatgccaaggcgaaactcatggaaatcaagcaggaactgtcgaagcggtcaagtagggtcgatggggatgaaaaaaggaaaaagaagagaaagaaaacgtccgcagaaagctga

SEQ ID NO: 6746 - protein, 931 aa, Sorghum bicolor
  misc_feature: Ceres ANNOT ID no. 6068271
  misc_feature (98)..(136): Pfam Id: WD40 Pfam Desc: WD domain, G-beta repeat
  misc_feature (140)..(178): Pfam Id: WD40 Pfam Desc: WD domain, G-beta repeat
  misc_feature (182)..(220): Pfam Id: WD40 Pfam Desc: WD domain, G-beta repeat
  misc_feature (462)..(506): Pfam Id: WD40 Pfam Desc: WD domain, G-beta repeat
  misc_feature (559)..(597): Pfam Id: WD40 Pfam Desc: WD domain, G-beta repeat
  misc_feature (601)..(639): Pfam Id: WD40 Pfam Desc: WD domain, G-beta repeat
  misc_feature (643)..(681): Pfam Id: WD40 Pfam Desc: WD domain, G-beta repeat
  misc_feature (699)..(929): Pfam Id: Utp12 Pfam Desc: Dip2/Utp12 Family
  misc_feature (241)..(914): NCBI GI: 5803221 NCBI Desc: wd repeat-containing protein 3 [homo sapiens]
  misc_feature (1)..(910): NCBI GI: 38564423 NCBI Desc: wd repeat domain 3 [danio rerio]
  misc_feature (165)..(921): NCBI GI: 119497237 NCBI Desc: wd domain protein [neosartorya fischeri nrrl 181]
  misc_feature (165)..(880): NCBI GI: 119398007 NCBI Desc: wd domain protein [aspergillus clavatus nrrl 1]
  misc_feature (1)..(882): NCBI GI: 19112316 NCBI Desc: trp asp repeat protein [schizosaccharomyces pombe]
  misc_feature: The sequence is a functional homolog of SEQ ID NO. 502 in the 11/188,298 US application
  misc_feature: The sequence is a functional homolog of SEQ ID NO. 485 in the 11/188,298 US application
MVKAYLRYEPALTFGVIASPESNVVYDPSGRRLLAAALDRLVAWDLKRGLPSVSFAPSSSSFSLAVSCIASSPSAAVSSSIASGHADGSIRLWDAETGGCEATLHGHRSAASALRFGPSGAVLASGSKDCDVILWDVVAQAGLFRLRGHRDQVTDLVFLDSGKKLVSCSKDKFIRVWDLETQHCLQIVGGHRSEIWSMDVDPSERFLVSGSADPELQVFRIRQSVEEGEDWSKWDVLKLFGEIPRQSKERVANVRFNRDGSLVVCQVAGKTADIYRVLDETEAARKAKRRVNRKKEKASAKSMIAEDNGTIIDPLPAKNLQNPTVIVTDVFKLFQVLRASKKICSVAFSPSNPPRGCLAILSLSLNNNMLETYSVDSEKVSKMYSVEMHGHRSDIRSISLNSEDNLLMSTSHNAVKIWNPSTGECLRTIDSGYGLCSTFVGNRFALVGTQSGALEIVDIASGSLTEAIEAHAGSIRSIVPIPDEDGTVGARGFVTGSADHDVKFWEYQLVQKSDNLTVTNVRTLKMTEDVLAVSISPEGKHIAVALLDCHVKVYHMDTLKPSLNLYGHKLPVLCMDISSDGALLVTGSADKNLKIWGMDFGDCHRSIFAHSDSVMDVKFVYRTHYMFSVGKDRTVKYWDADKFELLLTLEGHHAEVWCLTISSRGDFIVTGSHDRSIRRWDRTEEQLFIEEEKEKRLEETFEADLENDEYRYGQKDDAPDEGSVGVPGRKTKETVTSADAIMDALDTAEEELKRINQHKMEEQINAKAAKFQPNVIMQGHSPSDYVLNVVSNIRPNDLEQALLALPFSDALKLMSYLKEWSLVPSKVELVCRVCLVLLQTHHNQLTATPAARSLLTELKDILYCRVKECKDTIGFNLAAMDHELLAMRSDAPFRDAKAKLMEIKQELSKRSSRVDGDEKRKKKRKKTSAES

SEQ ID NO: 6747 - DNA, 684 bp, Sorghum bicolor
  misc_feature: Ceres ANNOT ID no. 6068273
  misc_feature: Encodes the peptide sequence at SEQ ID NO 6748
atggcggcgccgcccaactccaccaccttctccggcgacgtgtgggcggagctccgcctggccgacgcccgcgacgtgccgcacatccaccgcctcatacaccagatggccgagttcgagctcctcacggacctcttcgccgccaccgaagagctcctcacctccacgctcttcccatcgccgacgccgcctcccttcacctccttcacagccctcatcctcgacctatccccctcccccatcgtcccggactcctcctccaccatcgcctcccgccgcctcgacctgtccgcgtccccgctcaccgacccggaggccgccgccttcgcctccccgcgcggcggcgggcgcgtcacggccgggttcgtgatctgcttccccaactactccactttcctctccaagcccgggctgtacgtggaggacatcttcgtgcgcgcaccctggcgccgccgcgggctcggccggatgatgctgtctgccgtcgccggcagggcggccgagctcgggatggggcgggtggagtggtgcgtgctcgactggaacaagaacgccatcgacttctacgaggggatgggcgccgatgtgctaccgcagtggcgcatctgccggctcgccggcgcggcgctggacaagtacaagggcagccaggaggaggccgccggtgggaaggctgcagagtag

SEQ ID NO: 6748 - protein, 227 aa, Sorghum bicolor
  misc_feature: Ceres ANNOT ID no. 6068273
  misc_feature (117)..(195): Pfam Id: Acetyltransf_1 Pfam Desc: Acetyltransferase (GNAT) family
  misc_feature (84)..(227): NCBI GI: 115450769 NCBI Desc: os03g0151600 [oryza sativa (japonica cultivar-group)]
  misc_feature (116)..(212): NCBI GI: 94311842 NCBI Desc: gcn5-related n-acetyltransferase [ralstonia metallidurans ch34]
  misc_feature (104)..(211): NCBI GI: 118717759 NCBI Desc: gcn5-related n-acetyltransferase [burkholderia multivorans atcc 17616]
  misc_feature (102)..(210): NCBI GI: 134277369 NCBI Desc: acetyltransferase, gnat family [burkholderia pseudomallei 305]
  misc_feature (104)..(211): NCBI GI: 84361186 NCBI Desc: cog0454: histone acetyltransferase hpa2 and related acetyltransferases [burkholderia dolosa auo158]
MAAPPNSTTFSGDVWAELRLADARDVPHIHRLIHQMAEFELLTDLFAATEELLTSTLFPSPTPPPFTSFTALILDLSPSPIVPDSSSTIASRRLDLSASPLTDPEAAAFASPRGGGRVTAGFVICFPNYSTFLSKPGLYVEDIFVRAPWRRRGLGRMMLSAVAGRAAELGMGRVEWCVLDWNKNAIDFYEGMGADVLPQWRICRLAGAALDKYKGSQEEAAGGKAAE

SEQ ID NO: 6749 - DNA, 402 bp, Sorghum bicolor
  misc_feature: Ceres ANNOT ID no. 6068281
  misc_feature: Encodes the peptide sequence at SEQ ID NO 6750
atggaggatgacaagaaggagggcaagtaccgcggcgtgcggaagcggccgtggggaaagttcgccgcggagatccgggacccggagcgcggcggctcccgcgtctggctcggcaccttcgacaccgccgaggaggccgccagggcctacgaccgcgccgcattcgccatgaagggagccacggccgtgctcaacttcccagcaggggctgccggcggccgagagaccggcggcggcggcggctcctcgtccacgtcggctccggcggccatgggtggtggcgccagcagggggagggcgccccggcctgttcctgactcggagaagttggagctggagtgcctcgacgacagggtcttggaggagatgctcgccgaggacaagtacaacaaaaactactga

SEQ ID NO: 6750 - protein, 133 aa, Sorghum bicolor
  misc_feature: Ceres ANNOT ID no. 6068281
  misc_feature (8)..(60): Pfam Id: AP2 Pfam Desc: AP2 domain
  misc_feature (1)..(133): NCBI GI: 33440020 NCBI Desc: ap23 [oryza sativa (japonica cultivar-group)]
  misc_feature (1)..(133): NCBI GI: 38567644 NCBI Desc: b1234d02.6 [oryza sativa (japonica cultivar-group)]
  misc_feature (9)..(72): NCBI GI: 33440024 NCBI Desc: ap25 [oryza sativa (japonica cultivar-group)]
  misc_feature (6)..(121): NCBI GI: 60459383 NCBI Desc: ethylene responsive element binding protein c4 [capsicum annuum]
  misc_feature (2)..(72): NCBI GI: 28274834 NCBI Desc: ethylene response factor 4 [lycopersicon esculentum]
  misc_feature: The plant flowers significantly late compared to wild-type.
  misc_feature: The plant is abnormally large.
  misc_feature: The plant is abnormally small.
  misc_feature: The sequence is a functional homolog of SEQ ID NO 14 in the 10/903,236US patent application
  misc_feature: The sequence is a functional homolog of SEQ ID NO 1466 in the 10/666,642US patent application
  misc_feature: The sequence is a functional homolog of SEQ ID NO 16 in the 10/903,236US patent application
  misc_feature: The sequence is a functional homolog of SEQ ID NO 164 in the 10/714,887US patent application
  misc_feature: The sequence is a functional homolog of SEQ ID NO 164 in the 11/435,388US patent application
  misc_feature: The sequence is a functional homolog of SEQ ID NO 1737 in the 10/374,780US patent application
  misc_feature: The sequence is a functional homolog of SEQ ID NO 18 in the 10/903,236US patent application
  misc_feature: The sequence is a functional homolog of SEQ ID NO 200 in the 10/714,887US patent application
  misc_feature: The sequence is a functional homolog of SEQ ID NO 200 in the 11/435,388US patent application
  misc_feature: The sequence is a functional homolog of SEQ ID NO 2129 in the 10/666,642US patent application
  misc_feature: The sequence is a functional homolog of SEQ ID NO 2136 in the 10/374,780US patent application
  misc_feature: The sequence is a functional homolog of SEQ ID NO 2209 in the 10/666,642US patent application
  misc_feature: The sequence is a functional homolog of SEQ ID NO 2211 in the 10/666,642US patent application
  misc_feature: The sequence is a functional homolog of SEQ ID NO 32 in the 10/903,236US patent application
  misc_feature: The sequence is a functional homolog of SEQ ID NO 36 in the 10/714,887US patent application
  misc_feature: The sequence is a functional homolog of SEQ ID NO 36 in the 10/903,236US patent application
  misc_feature: The sequence is a functional homolog of SEQ ID NO 36 in the 11/435,388US patent application
  misc_feature: The sequence is a functional homolog of SEQ ID NO 368 in the 10/225,066US patent application
  misc_feature: The sequence is a functional homolog of SEQ ID NO 6 in the 10/903,236US patent application
  misc_feature: The sequence is a functional homolog of SEQ ID NO 74 in the 10/714,887US patent application
  misc_feature: The sequence is a functional homolog of SEQ ID NO 74 in the 11/435,388US patent application
  misc_feature: The sequence is a functional homolog of SEQ ID NO 76 in the 10/714,887US patent application
  misc_feature: The sequence is a functional homolog of SEQ ID NO 76 in the 11/435,388US patent application
  misc_feature: The sequence is a functional homolog of SEQ ID NO 78 in the 10/714,887US patent application
  misc_feature: The sequence is a functional homolog of SEQ ID NO 78 in the 11/435,388US patent application
  misc_feature: Useful for making plants with altered alkaloid content
  misc_feature: Useful for making plants with altered lutein content
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated drought sensitivity
  misc_feature: Functional homolog of the protein sequence given in SEQ ID NO 13265
  misc_feature: Functional homolog of the protein sequence given in SEQ ID NO 13268
  misc_feature: Functional homolog of the protein sequence given in SEQ ID NO 13470
  misc_feature: The sequence is a functional homolog of SEQ ID NO 14 in the 20050155117 US patent application
  misc_feature: The sequence is a functional homolog of SEQ ID NO 16 in the 20050155117 US patent application
  misc_feature: The sequence is a functional homolog of SEQ ID NO 18 in the 20050155117 US patent application
  misc_feature: The sequence is a functional homolog of SEQ ID NO 32 in the 20050155117 US patent application
  misc_feature: The sequence is a functional homolog of SEQ ID NO 36 in the 20050155117 US patent application
  misc_feature: The sequence is a functional homolog of SEQ ID NO 6 in the 20050155117 US patent application
  misc_feature: The sequence is a functional homolog of SEQ ID NO 18 in the 10/903,236 US patent application
  misc_feature: The sequence is a functional homolog of SEQ ID NO 2211 in the 10/666,642 US patent application
  misc_feature: The sequence is a functional homolog of SEQ ID NO 78 in the 10/714,887 US patent application
  misc_feature: The sequence is a functional homolog of SEQ ID NO 78 in the 11/435,388 US patent application
  misc_feature: The sequence is a functional homolog of SEQ ID NO 200 in the 10/714,887 US patent application
  misc_feature: The sequence is a functional homolog of SEQ ID NO 200 in the 11/435,388 US patent application
  misc_feature: The sequence is a functional homolog of SEQ ID NO 36 in the 10/903,236 US patent application
MEDDKKEGKYRGVRKRPWGKFAAEIRDPERGGSRVWLGTFDTAEEAARAYDRAAFAMKGATAVLNFPAGAAGGRETGGGGGSSSTSAPAAMGGGASRGRAPRPVPDSEKLELECLDDRVLEEMLAEDKYNKNY

SEQ ID NO: 6751 - DNA, 954 bp, Sorghum bicolor
  misc_feature: Ceres ANNOT ID no. 6068285
  misc_feature: Encodes the peptide sequence at SEQ ID NO 6752
atggatcctccgccaccaccgttcgcctccagcagctcgtcctcgccctcgccgccgtcgccatcgtcgtcgtcgtccagcgcgagcatcaccatggtgatcatcaccgtcgtgggcatcctcgcggcgttcgcgctcctcgccagctactacgcgttcgtgaccaagtgccagctgctgcgcgcggtgtggtcgcgccacccgccgtggcaccggcgcgcgcgcgggacaagtggcggccgggaggaggcggcgtacgtcgcaggccgcgcctcagcgaccgaggacgccaggcggggcctcggcctgccgctcatccgcatgctccccgtcgtcaagttcacggctgcggcctgtgatgacgccggcggcctggcgccgaggatatccgtgtcggagtgcgccgtgtgcctgagcgagttcgtggagcgggagcgcgtccgcctgctgcccaactgctcccacgccttccacatcgactgcatcgacacctggctgcagggcagcgcgcgatgccccttctgccggagcgacgtctcgctgccggcgctcccgtcggcgcggcgcgccctggcggcggcgacggctgccctccccaggcgccgcgacgacgggctcgccagcgacagcattgtgatcgaggtgcgaggggagcacgagaggtggttcagcagccacgggacgacgacgacgacgggcgctcgtccggccggtggcggcggcagagggccccggcacccaaagcagccgccacggcggagcaaggcggagagcgtcggcgacgaggccatcgacacgaggaagacgacggacgtggagttcgcggtggagcagcccttgcggcggtccctctccctggactcctcctgcggcaagcacctctacgtgtccatccaggagctcctcgccacgcaaaggcaagtgcgcgagcgcgatccgtccgtgcattcatga

SEQ ID NO: 6752 - protein, 317 aa, Sorghum bicolor
  misc_feature: Ceres ANNOT ID no. 6068285
  misc_feature (134)..(175): Pfam Id: zf-C3HC4 Pfam Desc: Zinc finger, C3HC4 type (RING finger)
  misc_feature (3)..(314): NCBI GI: 48716498 NCBI Desc: zinc finger (c3hc4-type ring finger)-like [oryza sativa (japonica cultivar-group)]
  misc_feature (14)..(295): NCBI GI: 92918533 NCBI Desc: zinc finger, ring-type [medicago truncatula]
  misc_feature (3)..(255): NCBI GI: 41053267 NCBI Desc: zinc finger (c3hc4-type ring finger)-like [oryza sativa (japonica cultivar-group)]
  misc_feature (16)..(187): NCBI GI: 110740495 NCBI Desc: ring-h2 zinc finger protein-like [arabidopsis thaliana]
  misc_feature (16)..(187): NCBI GI: 9755785 NCBI Desc: ring-h2 zinc finger protein-like [arabidopsis thaliana]
  misc_feature: The sequence is a functional homolog of SEQ ID NO 1132 in the 10/666,642US patent application
  misc_feature: The sequence is a functional homolog of SEQ ID NO 1133 in the 10/666,642US patent application
  misc_feature: The sequence is a functional homolog of SEQ ID NO 150 in the 10/225,068US patent application
  misc_feature: The sequence is a functional homolog of SEQ ID NO 1537 in the 11/479,226US patent application
  misc_feature: The sequence is a functional homolog of SEQ ID NO 2534 in the 10/374,780US patent application
  misc_feature: Useful for making plants with modulated growth and phenotype characteristics
  misc_feature: The sequence is a functional homolog of SEQ ID NO 150 in the 20050120408 US patent application
  misc_feature: The sequence is a functional homolog of SEQ ID NO 1132 in the 20070033671 US patent application
  misc_feature: The sequence is a functional homolog of SEQ ID NO 1133 in the 20070033671 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
MDPPPPPFASSSSSSPSPPSPSSSSSSASITMVIITVVGILAAFALLASYYAFVTKCQLLRAVWSRHPPWHRRARGTSGGREEAAYVAGRASATEDARRGLGLPLIRMLPVVKFTAAACDDAGGLAPRISVSECAVCLSEFVERERVRLLPNCSHAFHIDCIDTWLQGSARCPFCRSDVSLPALPSARRALAAATAALPRRRDDGLASDSIVIEVRGEHERWFSSHGTTTTTGARPAGGGGRGPRHPKQPPRRSKAESVGDEAIDTRKTTDVEFAVEQPLRRSLSLDSSCGKHLYVSIQELLATQRQVRERDPSVHS

SEQ ID NO: 6753 - DNA, 1719 bp, Sorghum bicolor
  misc_feature: Ceres ANNOT ID no. 6068286
  misc_feature: Encodes the peptide sequence at SEQ ID NO 6754
atgcggcggctgccgaaatccctcctcctcgcctgcctctccaggcccctccgccaccgccccccgctccctctgctccacccttcgcctccacagcccccgcgcccgggggcccgcctactccccttctccactcaaaccctagccccggctcctcctcctcccccggcgcctgatgcggcgtcgacggccgagcccgcgggcctcgcgcttctggaggccgcggagcggcgcgagtccgagggcgaccaccaggaggccctcgccctcgccctcaaggcgctcgcgccgctgcaggcgtctcacggcgggtggtcgctacccgtcgcgcgcgcgctccgcctcgccggcaccgcggccacccgcgccggcagcctcagcgacgcgctcgagtccctcggcgccgctgcggagatcgtcgactacctggcccccgcgcggcgcgagggggtgcctaaggaggtggcggctgtcggcgccaccgtgtacgagcagctggcgcgcgccaagacggccatggggcaccggtgggacgcggtgggcgacctccagcgcgcgctggacctgaagctccagtgcctggagggagggagtgcggagcttggggacgcctacagggatgtcgccgaggcctatgcgggcgtgctggactttgacaaggcgctcccattgtgttccacggcgctggggattgcagagggccggtttggtgaggactcggcagaagtggctaagctccggcggcttctcatggctgtctatactgggttgggtcgccatgtggaggctctggagcaaattgatcttgctaagatggtatatgagcgattgggattgaatgttgagctttcccaggccgaaattgatggggctaatatccgtatattgttggggagatcagaggaggcgatgaatgacattaagagggtgatgcagcggtcagacaaggagagtgaggagcgtgcactggcatatgtcacaatggcaaagatattgatctccgaggagagggtttcagactcgaagcggtgcttggagattgcccgggggatcattgacgcaatggattctattgaccctggccggtttgctgaagtatatgctgagatgtcaatgttgtatgagtcgatgacacagtttgaaatgcctttgagcgcacttgacatgtctttgagcttgatgaagaaaacgcttgcagttcttgagagcgccaaggagatgcatcacattgaaggcagcatctcagcaaggatggggtggctcctcctgcatactcaaaaagctgatgagtctgttccttatctggagagagcggttgataagttgaagaattgttttggaccacgacactttgggttaggttttgcttacaagaatctggggcaggcctatcttgagatggaccaacatcagtcagctgtgaagttctacaaacttgcaaatgatattattgaagctgcatttggactgacacatgaggattctattgatacaaaacagtcccttgcaaatgcatacggactgatgggaagctacaaacttgctatagactttcaagaacaagtcgtagatgcctacagtaggtgtggcagtggtgcctttgaggacctcagggaagctaataggcttttagagcagctcaagaagaaggcacaaggattgcctcatgcagtatttcctgcatattcattgccggttctacctgaaaataatgattag

SEQ ID NO: 6754 - protein, 572 aa, Sorghum bicolor
  misc_feature: Ceres ANNOT ID no. 6068286
  misc_feature (179)..(565): NCBI GI: 115450745 NCBI Desc: os03g0149400 [oryza sativa (japonica cultivar-group)]
  misc_feature (58)..(551): NCBI GI: 102139902 NCBI Desc: kinesin light chain-related [musa acuminata]
  misc_feature (16)..(551): NCBI GI: 41052919 NCBI Desc: kinesin light chain-like protein [oryza sativa (japonica cultivar-group)]
  misc_feature (35)..(553): NCBI GI: 20152971 NCBI Desc: similar to a. thaliana protein bab01483 similar to kinesin light chain [hordeum vulgare subsp. vulgare]
  misc_feature (58)..(551): NCBI GI: 102140007 NCBI Desc: glycoside hydrolase family 17 protein [musa acuminata]
MRRLPKSLLLACLSRPLRHRPPLPLLHPSPPQPPRPGARLLPFSTQTLAPAPPPPPAPDAASTAEPAGLALLEAAERRESEGDHQEALALALKALAPLQASHGGWSLPVARALRLAGTAATRAGSLSDALESLGAAAEIVDYLAPARREGVPKEVAAVGATVYEQLARAKTAMGHRWDAVGDLQRALDLKLQCLEGGSAELGDAYRDVAEAYAGVLDFDKALPLCSTALGIAEGRFGEDSAEVAKLRRLLMAVYTGLGRHVEALEQIDLAKMVYERLGLNVELSQAEIDGANIRILLGRSEEAMNDIKRVMQRSDKESEERALAYVTMAKILISEERVSDSKRCLEIARGIIDAMDSIDPGRFAEVYAEMSMLYESMTQFEMPLSALDMSLSLMKKTLAVLESAKEMHHIEGSISARMGWLLLHTQKADESVPYLERAVDKLKNCFGPRHFGLGFAYKNLGQAYLEMDQHQSAVKFYKLANDIIEAAFGLTHEDSIDTKQSLANAYGLMGSYKLAIDFQEQVVDAYSRCGSGAFEDLREANRLLEQLKKKAQGLPHAVFPAYSLPVLPENND

SEQ ID NO: 6755 - DNA, 738 bp, Sorghum bicolor
  misc_feature: Ceres ANNOT ID no. 6068294
  misc_feature: Encodes the peptide sequence at SEQ ID NO 6756
atgacggggttcgggtcaccgtgcggggcgtgcaagttcctgcggcgcaagtgcgtgcgcggctgcgtcttcgcgccctacttctgccacgagcagggcgcggcgcacttcgccgccatccacaaggtgttcggcgccagcaacgtgtccaagcttctcgcgcacctgccgctcgccgaccgcccggaggccgccgtcaccatctcctacgaggcgcaggccaggctgcgcgaccccatctacggctgcgtcgcccacatcttcgcgctccagcagcaggtgatgaccctgcaggcgcagctggcgtcgctcaaggcgcaggcggcgcaggggcagcagggcgtgcacgaggacgccaagggctacgtgggcagcgccgccgcggagcagctagggtacggctacccctggtgcaacggcaatggaggcgtcgcagctgcaggcacggtgggcgcgcccgccgcgcagctggccggcgcgtacggcaatggcgggcacgagtccctgaccgcgctgctggggtcgtcggactacatgcagcagtcgctgtatcacgcgttcgagcacgccggcgcggacgacgacgacggccggcaggggaacgacgcgttcgaggcagcggcggagtcctcgtcgttcggggcggaggagagcggcggctggaggtcatcgtcggggtaccaagactgcgaggacctgcagagcgtggcttacgcttacctgaaccatcgctcgtaa

SEQ ID NO: 6756 - protein, 245 aa, Sorghum bicolor
  misc_feature: Ceres ANNOT ID no. 6068294
  misc_feature (1)..(245): NCBI GI: 126567721 NCBI Desc: rootless concerning crown and seminal lateral roots [zea mays]
  misc_feature (1)..(245): NCBI GI: 126567727 NCBI Desc: rootless concerning crown and seminal lateral roots [zea mays]
  misc_feature (1)..(245): NCBI GI: 126567723 NCBI Desc: rtcs-like protein [zea mays]
  misc_feature (2)..(183): NCBI GI: 48716501 NCBI Desc: lob domain protein-like [oryza sativa (japonica cultivar-group)]
  misc_feature (5)..(110): NCBI GI: 126567725 NCBI Desc: rtcn [zea mays]
  misc_feature: The plant produces a reduced number of seeds.
  misc_feature: Useful for biocontainment applications
  misc_feature: Functional homolog of the protein sequence given in SEQ ID NO 13545
MTGFGSPCGACKFLRRKCVRGCVFAPYFCHEQGAAHFAAIHKVFGASNVSKLLAHLPLADRPEAAVTISYEAQARLRDPIYGCVAHIFALQQQVMTLQAQLASLKAQAAQGQQGVHEDAKGYVGSAAAEQLGYGYPWCNGNGGVAAAGTVGAPAAQLAGAYGNGGHESLTALLGSSDYMQQSLYHAFEHAGADDDDGRQGNDAFEAAAESSSFGAEESGGWRSSSGYQDCEDLQSVAYAYLNHRS

SEQ ID NO: 6757 - DNA, 501 bp, Sorghum bicolor
  misc_feature: Ceres ANNOT ID no. 6068302
  misc_feature: Encodes the peptide sequence at SEQ ID NO 6758
atgtcttctccaagcaagcgccgggagatggacctcatgaagctgatgatgagcgactacaaggtggagatggtgaacgatgggatgcaggagttctttgttgaatttcgtgggcctaacgaaagcatttatcaaggaggtgtatggagggttagagtagagctgccagatgcgtatccttacaaatccccatcgattgtctgtttggatgtcatcaaccagacatggagcccaatgtttgatcttgtcaatgtgtttgaggtcttccttccacaacttctgttatatcctaatccttctgatccattaaatggagatgcagctgcgttgatgatgcgtgatcgccctgcttatgaacaaaaagtgaaagaatactgcgaaaaatatgccaaaccagaggatgctggtgtcatcccagaagacaaatccagtgacgaagagctgagtgaagatgaaaatgactcgggtgatgaggagataatgggcaaaccagatccatag

SEQ ID NO: 6758 - protein, 166 aa, Sorghum bicolor
  misc_feature: Ceres ANNOT ID no. 6068302
  misc_feature (7)..(126): Pfam Id: UQ_con Pfam Desc: Ubiquitin-conjugating enzyme
  misc_feature (67)..(166): NCBI GI: 6066285 NCBI Desc: ubiquitin carrier protein 4 [glycine max]
  misc_feature (67)..(166): NCBI GI: 431266 NCBI Desc: ubiquitin conjugating enzyme
  misc_feature (67)..(166): NCBI GI: 136644 NCBI Desc: ubiquitin-conjugating enzyme e2-23 kda (ubiquitin-protein ligase) (ubiquitin carrier protein)
  misc_feature (1)..(166): NCBI GI: 2815252 NCBI Desc: ubiquitin carrier protein [arabidopsis thaliana]
  misc_feature (67)..(165): NCBI GI: 51233246 NCBI Desc: ubiquitin-conjugating enzyme type e2 [aspergillus niger]
  misc_feature (67)..(166): SWISSPROT Homolog: EC 6.3.2.19 Ubiquitin-conjugating enzyme E2-21 kDa 1
MSSPSKRREMDLMKLMMSDYKVEMVNDGMQEFFVEFRGPNESIYQGGVWRVRVELPDAYPYKSPSIVCLDVINQTWSPMFDLVNVFEVFLPQLLLYPNPSDPLNGDAAALMMRDRPAYEQKVKEYCEKYAKPEDAGVIPEDKSSDEELSEDENDSGDEEIMGKPDP

SEQ ID NO: 6759 - DNA, 1671 bp, Sorghum bicolor
  misc_feature: Ceres ANNOT ID no. 6068309
  misc_feature: Encodes the peptide sequence at SEQ ID NO 6760
  misc_feature: Up-regulated in shoot tissues in response to salicylic acid treatment
atggcgttggcagggacctccaaagtagtgctgggatgtatcgcgtttgggattttctgggtgatggccgtcttccccaccgtcccgttcatgcctgttgggcggacggctgggtccctccttggtgctatgctaatggtcctgttccgcgtcatctccccggaggacgcgtattccgcgattgacctcccgatcatcggcctgcttttcgggacaatggtcgtcagcatcttccttgagagggctgacatgtttaagtacctcggaaacctgctctcgtggaagagcagaggcagcaaggacctgctgttccgagtctgcatcgtgtccgcgtttgccagcgcgcttttcaccaatgacacatgctgtgttgtcctcactgagttcatcctcaaggttgctaggcaaaacaacctgccaccacagcctttccttctggcccttgccactagttcaaacatcggctctgctgcgacgccgatcgggaaccctcagaaccttgtcatagctgtggagagtgggatctcatttggccagttcttgctgggagtttttccagctatgattgttggggttctgacaaacgctgctatcctccttttgtacttctggaaatacttgtcggtggagaaggatcaggagggtgggcaagccacaggaccagaggtggttgccgacgatgaggttacttctcatcggttcacaccggctagaatgtcacatgtttcttctctgaatccagatgatgaggattgcataagtgaaccaatcatcaggagcaacagtgtcagatctagtgtgaatgagaacctgagaagcagaagcgtcaattctgaggctgacattcagcttgccatcaagtctctgcgggcatcaagcatgtcgcatgaggtggtagaggtctcgacagtccctgatcggaaagatgaaggtgcatcctcaaggaagttcacaagaagtgctagccagcaaaggagtgtgataatagaggatttggcacccgccccagagatgaatggggaaaaggagaaagaaactgaagttgcagagaagagatggaaaatacttgtctggaagactgctgtttatcttatcactcttggtatgctcattgcacttctaatgggactgaacatgtcctggactgcaatcactgcggctcttgttcttctggcacttgattttacggatgcacaggcttgtcttgagaaggtgtcatactcactgctgatctttttctgcgggatgtttatcactgttgatggattcaataaaacgggcataccaaacacactatgggagttagtggaaccatattcacgaatcgatagtgctagaggtgttgctcttcttgctgtggtgattctcatcctttcaaatgtggcctctaatgttcctacagtcctgttgctcggtacaagagttgctgcatcagctgctgcgatttctcatggttcagagaggaaagcctggctcatccttgcatgggtcagcaccgtggctggcaacctcacccttctcggttctgccgcgaatctgattgtctgcgagcaggccaggcgtgcccagttcttcggctacaacctcaccttctggagccacctccgattcggggtcccgtcgaccatcatcgtcacggcgattgggctactcatcgtcatcagttactga

SEQ ID NO: 6760 - protein, 556 aa, Sorghum bicolor
  misc_feature: Ceres ANNOT ID no. 6068309
  misc_feature (16)..(502): Pfam Id: CitMHS Pfam Desc: Citrate transporter
  misc_feature (1)..(553): NCBI GI: 92885111 NCBI Desc: imp dehydrogenase/gmp reductase [medicago truncatula]
  misc_feature (205)..(556): NCBI GI: 115482262 NCBI Desc: os10g0447900 [oryza sativa (japonica cultivar-group)]
  misc_feature (31)..(207): NCBI GI: 19717681 NCBI Desc: arsenite transport subunit b [dictyostelium discoideum]
  misc_feature (30)..(202): NCBI GI: 11499889 NCBI Desc: arsenite transport protein (arsb) [archaeoglobus fulgidus dsm 4304]
  misc_feature (10)..(223): NCBI GI: 86158102 NCBI Desc: arsenical pump membrane protein [anaeromyxobacter dehalogenans 2cp-c]
  misc_feature: Up-regulated in shoot tissues in response to salicylic acid treatment
MALAGTSKVVLGCIAFGIFWVMAVFPTVPFMPVGRTAGSLLGAMLMVLFRVISPEDAYSAIDLPIIGLLFGTMVVSIFLERADMFKYLGNLLSWKSRGSKDLLFRVCIVSAFASALFTNDTCCVVLTEFILKVARQNNLPPQPFLLALATSSNIGSAATPIGNPQNLVIAVESGISFGQFLLGVFPAMIVGVLTNAAILLLYFWKYLSVEKDQEGGQATGPEVVADDEVTSHRFTPARMSHVSSLNPDDEDCISEPIIRSNSVRSSVNENLRSRSVNSEADIQLAIKSLRASSMSHEVVEVSTVPDRKDEGASSRKFTRSASQQRSVIIEDLAPAPEMNGEKEKETEVAEKRWKILVWKTAVYLITLGMLIALLMGLNMSWTAITAALVLLALDFTDAQACLEKVSYSLLIFFCGMFITVDGFNKTGIPNTLWELVEPYSRIDSARGVALLAVVILILSNVASNVPTVLLLGTRVAASAAAISHGSERKAWLILAWVSTVAGNLTLLGSAANLIVCEQARRAQFFGYNLTFWSHLRFGVPSTIIVTAIGLLIVISY

SEQ ID NO: 6761 - DNA, 1575 bp, Sorghum bicolor
  misc_feature: Ceres ANNOT ID no. 6068319
  misc_feature: Encodes the peptide sequence at SEQ ID NO 6762
atgcgcgcgacgatcccggccctctcgctcctggtggcgccgcgcccgcggctcccctcgctcgccgcgccggcggctggaggccgcgtccgcgtgggccgtcgtcctcggacccgcctacgcgtggcggcgccgacgtccgtcccgggggaggcggcggagcaggcggagccgagcacgtcggcgcccgagtccgagtccggcgagaagttctcgtggagggatcactggtacccggtctccctcgtcgaggacctcgaccccagccgccccaccccgttccagctcctcaaccgcgacctcgtcatctggaaggaacccaagtccggcgagtgggtcgcgctcgacgaccgctgcccccaccgccttgccccgctctcggagggcaggatcgatgagacggggtgcttgcagtgctcgtatcacggctggtcattcgatggctccggcgcctgcaccaggatcccccaggccatgcccgagggtcttgaggcccgggcggtgcgttcgccgaaggcgtgcgcgatcaagttccccaccctcgtctcccagggcttgctgttcgtgtggcccgatgagaatgggtgggagaaagccactgccaccaagcctccaatgttgccgaaagagtttgacgacccggccttctccacggtgacaatccagagggacttgttctatggttatgatacgttgatggagaacgtctctgatccatcccatatagaatttgctcaccacaaggttactggacgaagagatagagccaagcctttgacattcaagatggagtctagtggtgcctggggttactcaggggcaaattctggtaatcctcgcattactgcaacttttgaggccccttgctatgcattaaacaaaatagagatagacacaaagttacccatttttggagaccagaaatgggtcatatggatttgctctttcaacattccgatggccccaggaaagactcgttctattgtctgtagcgctcgaaactttttccagtttacaatgccaggaaaagcatggtggcagcttgtccctcgatggtatgaacattggacttcaaatttggtctatgatggtgatatgattgttcttcaaggccaagaaaagattttcctagctgcaacgaaggagacttctacagatgttaatcaacagtacacaaagatcacattcacacccacacaggctgatcgatttgttttagcattccgggcatggctaaggaaatttggcaatagtcagcctgagtggtttggaaatcctagccaggaagcattgccttccacggttctttcaaaacgtgagatgctagacagatacgagcaacacacattgaaatgctcgtcttgcaaaggagcatatcatgcattccagactctgcagaaggtattcatgggagcgacagtagtgggctgtgctaccgctgggattcctgcagatgttcagctcagactattaattggtgcagctgctttgattagtgccgctgtagcatatgcattccatgagctccagaagaattttgtattcgtggattacgtgcatgctgacattgattga

SEQ ID NO: 6762 - protein, 524 aa, Sorghum bicolor
  misc_feature: Ceres ANNOT ID no. 6068319
  misc_feature (285)..(393): Pfam Id: PaO Pfam Desc: Pheophorbide a oxygenase
  misc_feature (76)..(171): Pfam Id: Rieske Pfam Desc: Rieske [2Fe-2S] domain
  misc_feature (1)..(509): NCBI GI: 1935912 NCBI Desc: lethal leaf-spot 1 [zea mays]
  misc_feature (1)..(524): NCBI GI: 115450715 NCBI Desc: os03g0146400 [oryza sativa (japonica cultivar-group)]
  misc_feature (56)..(524): NCBI GI: 1935909 NCBI Desc: lethal leaf-spot 1 [zea mays]
  misc_feature (40)..(524): NCBI GI: 16973465 NCBI Desc: lethal leaf spot 1-like protein [lycopersicon esculentum]
  misc_feature (38)..(524): NCBI GI: 76162840 NCBI Desc: lethal leaf spot 1-like protein [glycine max]
MRATIPALSLLVAPRPRLPSLAAPAAGGRVRVGRRPRTRLRVAAPTSVPGEAAEQAEPSTSAPESESGEKFSWRDHWYPVSLVEDLDPSRPTPFQLLNRDLVIWKEPKSGEWVALDDRCPHRLAPLSEGRIDETGCLQCSYHGWSFDGSGACTRIPQAMPEGLEARAVRSPKACAIKFPTLVSQGLLFVWPDENGWEKATATKPPMLPKEFDDPAFSTVTIQRDLFYGYDTLMENVSDPSHIEFAHHKVTGRRDRAKPLTFKMESSGAWGYSGANSGNPRITATFEAPCYALNKIEIDTKLPIFGDQKWVIWICSFNIPMAPGKTRSIVCSARNFFQFTMPGKAWWQLVPRWYEHWTSNLVYDGDMIVLQGQEKIFLAATKETSTDVNQQYTKITFTPTQADRFVLAFRAWLRKFGNSQPEWFGNPSQEALPSTVLSKREMLDRYEQHTLKCSSCKGAYHAFQTLQKVFMGATVVGCATAGIPADVQLRLLIGAAALISAAVAYAFHELQKNFVFVDYVHADID

SEQ ID NO: 6763 - DNA, 627 bp, Sorghum bicolor
  misc_feature: Ceres ANNOT ID no. 6068331
  misc_feature: Encodes the peptide sequence at SEQ ID NO 6764
atggcagttcccggcggccgcaacggcctcagggacgaggacgacgagatggccgaacacgccgaggccttcgccggcgcctcggacgacgaggatgtgcctccccaccttcgcgccctcgccaacgccgcccagaccggcgacgtcgccgccctcgtggccgccctggataatcatgatggcagtattgatgttccagttgaagatggtgatactttgctccacctggcatgcttatatggtcatcttccttgtgttcagctattgttggaacgtggagctagcttggaatgcaaagatgaagaaggtgctattcctcttcacgatgcttgtgctggaggcttcactgagatggtccaatatattctcaactttgctgccaacaaggatggttgcgtagcgagaatgctcgacactgttgattctgaaggcgatacaccgctccatcatgctgctagaggagaacatttggatgttgtcaagcttcttatcgaggctggggcatcccccaagaaggagaacacttatgggcagacacctgctgatatggctgaccaagacaccgaagttcgaaccctgttgactgccaagcaaattgaggcaagcacacacatgagtggtaattaa

SEQ ID NO: 6764 - protein, 208 aa, Sorghum bicolor
  misc_feature: Ceres ANNOT ID no. 6068331
  misc_feature (69)..(101): Pfam Id: Ank Pfam Desc: Ankyrin repeat
  misc_feature (143)..(175): Pfam Id: Ank Pfam Desc: Ankyrin repeat
  misc_feature (69)..(194): NCBI GI: 28373837 NCBI Desc: chain a, 4ank: a designed ankyrin repeat protein with four identical consensus repeats
  misc_feature (70)..(203): NCBI GI: 116497071 NCBI Desc: brca1 associated ring domain 1 [homo sapiens]
  misc_feature (70)..(203): NCBI GI: 4557349 NCBI Desc: brca1 associated ring domain 1 [homo sapiens]
  misc_feature (70)..(203): NCBI GI: 2828068 NCBI Desc: brca1-associated ring domain protein [homo sapiens]
  misc_feature (70)..(203): NCBI GI: 62898379 NCBI Desc: brca1 associated ring domain 1 variant [homo sapiens]
  misc_feature: The sequence is a functional homolog of SEQ ID NO 1839 in the 10/374,780US patent application
  misc_feature: The sequence is a functional homolog of SEQ ID NO 1841 in the 10/374,780US patent application
  misc_feature: Useful for making plants with modulated growth and phenotype characteristics
  misc_feature: The sequence is a functional homolog of SEQ ID NO 1839 in the 20060162006 US patent application
  misc_feature: The sequence is a functional homolog of SEQ ID NO 1841 in the 20060162006 US patent application
MAVPGGRNGLRDEDDEMAEHAEAFAGASDDEDVPPHLRALANAAQTGDVAALVAALDNHDGSIDVPVEDGDTLLHLACLYGHLPCVQLLLERGASLECKDEEGAIPLHDACAGGFTEMVQYILNFAANKDGCVARMLDTVDSEGDTPLHHAARGEHLDVVKLLIEAGASPKKENTYGQTPADMADQDTEVRTLLTAKQIEASTHMSGN

SEQ ID NO: 6765 - DNA, 1545 bp, Sorghum bicolor
  misc_feature: Ceres ANNOT ID no. 6068345
  misc_feature: Encodes the peptide sequence at SEQ ID NO 6766
atggagaggaccggcgcgcgcagcggcaagcggtggctgccgggcctcctgctcctcgccgccacgtcctggcttctcgtcatctacttccatctcgccgtgctccgcggcccgccggtcgtgagcgcgccgcgctggtccctcgccgaggtcgcgtcagacggcggcggcggcggggacgggcagcgtttcctgcttcagcaggaggagcggctcagcaagttgatgaaggccccgcccgccgccacgggcaacgcgctctcggcggcacgggacgagcggcgacgtcgcgacgacgaatgccgggggcggtacgtgtacatccacgacctcccgccgcggttcaacgcggacatcctcgccaactgccgcaactggtacccgtggatggacatgtgcgtgtacctcgacaacggcgggctcggccggccggtggacaacgcggacggcgtgttcgccgacgaaggatggtacgccacggaccacttcggcctggacgtcatcttccacaggcggatgaagcagtacgactgcctcacttccgactcctcccgcgccgccgccgtcttcgtgccattctacgccggcttcgacgtcgtgcagcacctgtggggcgtcaactccacggcgcgggagaaggacgcgctgtcgctcgacctcgtggactggctcacgcgccggcccgagtggcgcgccatgggcggccgcgaccacttcttcctgtccgggaggacggcgtacgatcaccagagggagacggactccgagtgggggaacaagctcctccgcctgccggcggtgcagaacatgacggtgctcttcgtcgagaagctcccgtggatgagcttcgacttcgccataccgtacccgacctacttccacccggccagggacgcgcaggtcgtcgagtggcagcggcggatgcgcgccatgaagcgcgactggctattcaccttcgccggcggcgcgcgggacgacccggactccatccggcaccagctcatcaagcagtgcggctcgtcgagcttctgcaagctggtccagtgcgggaggaacgagaggaactgcctcgtcccgagcaccttcatgcgcgtgttccagggcacgcgcttctgcctgcagccgaagggagacaccatgacgcgacggtcggcgttcgacgccatcatggccggctgcgtgcccgtcttcttccacccggactctgcgtatacgcagtacaggtggcacctcccggaggcgcacgacacctactcggtgctcatcccggaggcggacgtgcgcgccggcaatgtcagcatcgaggagacgctccgcaggatcccgccggacgtggcggagcagatgacggagaccgtcatcgggctgataccgaggctggtgtacgcggacccgagatccaagctggagacgctcaaggacgccgtcgacgtgacggtggaggcggtcatcgggagggtcaacaagctgagggaggagatggcccgtgggcaagggcatctgctgcaaaagcaaagcgggaacgctggtgttcagcaaacctag

SEQ ID NO: 6766 - protein, 514 aa, Sorghum bicolor
  misc_feature: Ceres ANNOT ID no. 6068345
  misc_feature (106)..(453): Pfam Id: Exostosin Pfam Desc: Exostosin family
  misc_feature (69)..(499): NCBI GI: 115450687 NCBI Desc: os03g0144500 [oryza sativa (japonica cultivar-group)]
  misc_feature (66)..(494): NCBI GI: 75151723 NCBI Desc: xyloglucan galactosyltransferase katamari1 homolog
  misc_feature (97)..(498): NCBI GI: 71143070 NCBI Desc: at2g20370 [arabidopsis thaliana]
  misc_feature (96)..(498): NCBI GI: 92893997 NCBI Desc: exostosin-like [medicago truncatula]
  misc_feature (81)..(491): NCBI GI: 59958346 NCBI Desc: at2g31990 [arabidopsis thaliana]
  misc_feature: Useful for making plants with altered cell wall content and/or composition
  misc_feature: Functional homolog of the protein sequence encoded by LOCUS at2g20370
  misc_feature: Useful for making plants with altered cell wall content and/or composition
  misc_feature: Functional homolog of the protein sequence given in SEQ ID NO 13965
MERTGARSGKRWLPGLLLLAATSWLLVIYFHLAVLRGPPVVSAPRWSLAEVASDGGGGGDGQRFLLQQEERLSKLMKAPPAATGNALSAARDERRRRDDECRGRYVYIHDLPPRFNADILANCRNWYPWMDMCVYLDNGGLGRPVDNADGVFADEGWYATDHFGLDVIFHRRMKQYDCLTSDSSRAAAVFVPFYAGFDVVQHLWGVNSTAREKDALSLDLVDWLTRRPEWRAMGGRDHFFLSGRTAYDHQRETDSEWGNKLLRLPAVQNMTVLFVEKLPWMSFDFAIPYPTYFHPARDAQVVEWQRRMRAMKRDWLFTFAGGARDDPDSIRHQLIKQCGSSSFCKLVQCGRNERNCLVPSTFMRVFQGTRFCLQPKGDTMTRRSAFDAIMAGCVPVFFHPDSAYTQYRWHLPEAHDTYSVLIPEADVRAGNVSIEETLRRIPPDVAEQMTETVIGLIPRLVYADPRSKLETLKDAVDVTVEAVIGRVNKLREEMARGQGHLLQKQSGNAGVQQT

SEQ ID NO: 6767 - DNA, 828 bp, Sorghum bicolor
  misc_feature: Ceres ANNOT ID no. 6068354
  misc_feature: Encodes the peptide sequence at SEQ ID NO 6768
atgtcgagcttcttcccatttccagccgttcttctcgccgctcttctcatcgtcacgctccacgcatccgccatccacgcccagatacctgcctcggcaacgaccggcgccgcggtggccgcgacaaacccgcagccaggaggcagtggcggcggcgtcgtaggcgcgggcgggccggacgcgcctctggagctctacatgcacgacatccttggcgggtcgagcccgacggcgcggcccatcaccggcttgctgggcaacatctacaacgggcaggtcccgttcgcgcgccccatcggcttcagcgcgcccaggaacggcgtgcccatcccgaacgccaacggccaggtgcccacttacaacggcaacaccggcatcccgctggacaccggcctgtccggcgccgggttcctgcagccagggaacggcgcggcggcggcgccggcgcaggtgcagctgggccccgacggcctcagcctcgggttcggcaccatcacggtcatcgacgacgtgctgacgggcgggccggacctcggcgcgcagccgctcgggcgcgcgcagggcgtgtacgtggccagctccgccgacgggtcgtcgcagatgatggcgttcacggccatgatggagggcggcgagtacggcgacacgatcaacttcttcggggtgtacaaggtcggcacgccgctgtgccggctgtccattaccggtggcaccggcaagttcaagggcgcctgcgggttcgccgaggtgcgcccgctcatcgcctccggccagcacgtcaccgacggcgcagagacgctgctgaggatcaccgtccatcttgcttaa

SEQ ID NO: 6768 - protein, 275 aa, Sorghum bicolor
  misc_feature: Ceres ANNOT ID no. 6068354
  misc_feature (100)..(276): Pfam Id: Dirigent Pfam Desc: Dirigent-like protein
  misc_feature (34)..(275): NCBI GI: 8439894 NCBI Desc: contains similarity to disease resistance response protein from pisum sativum gbm18250. est gbf13940 comes from this gene. [arabidopsis thaliana]
  misc_feature (30)..(274): NCBI GI: 115452275 NCBI Desc: os03g0280700 [oryza sativa (japonica cultivar-group)]
  misc_feature (28)..(274): NCBI GI: 110737911 NCBI Desc: disease resistance response/ dirigent - like protein [arabidopsis thaliana]
  misc_feature (28)..(274): NCBI GI: 7019656 NCBI Desc: disease resistance response/ dirigent-like protein [arabidopsis thaliana]
  misc_feature (142)..(262): NCBI GI: 6227011 NCBI Desc: f12p19.3 [arabidopsis thaliana]
MSSFFPFPAVLLAALLIVTLHASAIHAQIPASATTGAAVAATNPQPGGSGGGVVGAGGPDAPLELYMHDILGGSSPTARPITGLLGNIYNGQVPFARPIGFSAPRNGVPIPNANGQVPTYNGNTGIPLDTGLSGAGFLQPGNGAAAAPAQVQLGPDGLSLGFGTITVIDDVLTGGPDLGAQPLGRAQGVYVASSADGSSQMMAFTAMMEGGEYGDTINFFGVYKVGTPLCRLSITGGTGKFKGACGFAEVRPLIASGQHVTDGAETLLRITVHLA

SEQ ID NO: 6769 - DNA, 3507 bp, Sorghum bicolor
  misc_feature: Ceres ANNOT ID no. 6068355
  misc_feature: Encodes the peptide sequence at SEQ ID NO 6770
atggccatccccgtcgaggaggccatcgccgccctttccaccttctcgctcgaggggttagctgtgctcctgtctagtgaaagatatgcaactaacagtcctattgagtacagcgatgttgctgcttatcgtctatcgctaggagaagatacaaaagcaatcaaccagctgaatacgctgatccaagaaggaaaagaaatggcatctttgctgtacacataccgtagctgtgtaaaagctctacctcagctgcctgattcaatgaagcataaccaagcggacttgtatctggaaacctatcaagttcttgacttggaaatgagtcgtttacgtgaaattcagagatggcaagcttctgctgcttctaagttggcggctgacatgcagagattctctaggccagagagactggttaatggacccacaatcactcatttttggtctatgctgaagttgcttgacgtcctactgcagcttgatcatctcaagaacgcaaaagcaagtatacctaatgatttttcatggtacaagagaacgttcactcaagtaagcacccagtggcaggataccgacaccatgagagaagagctggatgatcttcaggttcttatagtattttgcgtggagtcattggaattggattttgctcttctttttcctgagcgccataccctacttcgtgtcctcccagttttggttgtcctagcaacctcatcagagaaggagagtgagtcactttataagagggtgaagataaatcgtcttctcaatgtttttaagatgataagattgaagtcatcagatggtgtggataatgactggtcccgagatatcaaagggaacatgtatgatattgttgttgaaggcttccagcttcttagtcgatggactggcaggatttgggaacaatgtgcctggaaattctctcgccctatttcagattcgcaacaaaactccacgacatgttttgactatgaaaaggtagtacgctataactatactgctgaagaacgaagggctttgcttgaattaattggttacataaagagtattggattgatgatgcaacattgtgacactttagtgtctgaagctttgtgggaaacaatacacatggaggtccaagattttgtacaggataaacttgatactatgcttcgtacaacatttagaaagaagaaggacctttctcggattctctctgatatgcgaaccctctcagcagattggatggccaacactagtaaggcagacccagagcagcactcactacaccaagaaactgaggaaatgagacaaaacacattttacccaagcccagttgcaccaacagctgcacagattcattgtttgcaatttcttatatgtgagcttgtatctggtggtaatctgagaaaacctggaggactatttgggaatagtggctctggcatacctgtggaagatcttaaacaactagagacatttttctacaagcttagttttttcttgcatattttggattatacagcgactattggtactctaactgatcttgggtttctttggttcagagaattttaccttgaatcttctcgtgtcattcagtttccaattgaatgctcgctcccgtggatgctggtggaccatgtcattgaatcacaagatgctggtcttctcgaaagcattttgattccatttgacctttacaatgactctgctcaacatgcactaacttctctcaagcagagatttctttatgatgaaattgaagctgaggttgatctttgcttcgatcttcttgctcagaagcttaatgagatcatctttacatattacaagagctgtgcagcaagtactcttctcgatagttcatttacatatgcatgcgatgatggtgagaagtactttgtcaaacctttgcgatttgacgcgattttcaagttaaggagagtaatggttttagggaggacaattgacctaagaagcataattactcagagaatgaacaaaatattcagggaaaatattgactttctacttgagcgctttgaaaatggagatctatgtggtgttgtggaactgcaacaactattggatattttggagcttacacaccaatcagtatcaagatttcttgaattggattcttactctcttatgcttagcgagatgcaagagaatctttcgttggtttcttattcaagtcgcatctcttctcagatatggagtgagatgcagacagatttcttgccaaatttcatcctatgtaataccacacagcggtttgtccgatccataaaaggaactcaccactcttcgcatagatcaagtgcttctactgggaagccctacttttattgtggatcacacgatttgaccatggcataccagggtcttgctgggctgtaccgtgacttttttggagtccctcatatgtttgcagttgttaaacttcttggttccagatcattgcctgcaatcatccgtgctttactggatcatatatcaagtaagattacaggtttggtaccgaaaataaatgcactgcaagaagcattaccaaaatctattgggcttctttcatttgatggtggtatagcaggttgtcagaagatagttcatgaaatattgacgtgggaagcgaaatcagaagttaaaactgaagttcttcatgaccttaaggaaattggaagtgctttgtattggatgagcattctggacattgttttgagacaaatcgacactacacagttcatgcagtcagctccgtggcttggactggttccaggaaatgatgggcaagtgaagcatgcctactctgataatactccatttaccacacttttaagtgctgccaccaatgctgtgacatcaagccctgcgtgcccaaatccatctatgtttcttgtcatgtcaaagcaagctgaagctgccagtctgctgtacaaatcaaacctcaactctggtagtgtgctggagtatgctcttgcattcacaagtgctgccctggatagacactacagcaaatggagcgcaactccaaaaacagggtttatcgacattactacttcaaaggacttctatcgcatttttagcggtcttcagtatagttacttagaggatagcattaacaatccttcaaagaaacaggaaatgctgggtgattctgtagcatgggctggctgtacgatcatgtacttactgggacagcagcagcacttcgagctttttgatttctcctatcaatttctcaacgtggcagaagtagaaagtgcaacagtttcacactatcaatcttcagagaggactaaaagttcaaatttcttgcaaggctacgagggcatccttgaagcgatgaggaaggctaggaggctcaataaccatgttttctcgatgttgagggcacgatgtccccttgaggacaaggttgcatgtgcgatcaagccaagtggggcaccgcttcaccggatgaagtttatgaacaccgtttctgcatttgagacattgccacaaagagccacctga

SEQ ID NO: 6770 - protein, 1168 aa, Sorghum bicolor
  misc_feature: Ceres ANNOT ID no. 6068355
  misc_feature (1)..(1156): Pfam Id: FragX_IP Pfam Desc: Cytoplasmic Fragile-X interacting family
  misc_feature (260)..(1168): NCBI GI: 51922059 NCBI Desc: tpa: pirp; pir of plants [arabidopsis thaliana]
  misc_feature (260)..(1168): NCBI GI: 75251415 NCBI Desc: protein pir (pir of plants) (protein pirogi) (protein klunker) (atsra1)
  misc_feature (260)..(1166): NCBI GI: 144924028 NCBI Desc: cytoplasmic fragile x mental retardation protein interacting protein [medicago truncatula]
  misc_feature (242)..(1132): NCBI GI: 60465489 NCBI Desc: component of scar regulatory complex [dictyostelium discoideum]
  misc_feature (242)..(1132): NCBI GI: 40737743 NCBI Desc: rac-binding component of scar regulatory complex; pir121 [dictyostelium discoideum]
MAIPVEEAIAALSTFSLEGLAVLLSSERYATNSPIEYSDVAAYRLSLGEDTKAINQLNTLIQEGKEMASLLYTYRSCVKALPQLPDSMKHNQADLYLETYQVLDLEMSRLREIQRWQASAASKLAADMQRFSRPERLVNGPTITHFWSMLKLLDVLLQLDHLKNAKASIPNDFSWYKRTFTQVSTQWQDTDTMREELDDLQVLIVFCVESLELDFALLFPERHTLLRVLPVLVVLATSSEKESESLYKRVKINRLLNVFKMIRLKSSDGVDNDWSRDIKGNMYDIVVEGFQLLSRWTGRIWEQCAWKFSRPISDSQQNSTTCFDYEKVVRYNYTAEERRALLELIGYIKSIGLMMQHCDTLVSEALWETIHMEVQDFVQDKLDTMLRTTFRKKKDLSRILSDMRTLSADWMANTSKADPEQHSLHQETEEMRQNTFYPSPVAPTAAQIHCLQFLICELVSGGNLRKPGGLFGNSGSGIPVEDLKQLETFFYKLSFFLHILDYTATIGTLTDLGFLWFREFYLESSRVIQFPIECSLPWMLVDHVIESQDAGLLESILIPFDLYNDSAQHALTSLKQRFLYDEIEAEVDLCFDLLAQKLNEIIFTYYKSCAASTLLDSSFTYACDDGEKYFVKPLRFDAIFKLRRVMVLGRTIDLRSIITQRMNKIFRENIDFLLERFENGDLCGVVELQQLLDILELTHQSVSRFLELDSYSLMLSEMQENLSLVSYSSRISSQIWSEMQTDFLPNFILCNTTQRFVRSIKGTHHSSHRSSASTGKPYFYCGSHDLTMAYQGLAGLYRDFFGVPHMFAVVKLLGSRSLPAIIRALLDHISSKITGLVPKINALQEALPKSIGLLSFDGGIAGCQKIVHEILTWEAKSEVKTEVLHDLKEIGSALYWMSILDIVLRQIDTTQFMQSAPWLGLVPGNDGQVKHAYSDNTPFTTLLSAATNAVTSSPACPNPSMFLVMSKQAEAASLLYKSNLNSGSVLEYALAFTSAALDRHYSKWSATPKTGFIDITTSKDFYRIFSGLQYSYLEDSINNPSKKQEMLGDSVAWAGCTIMYLLGQQQHFELFDFSYQFLNVAEVESATVSHYQSSERTKSSNFLQGYEGILEAMRKARRLNNHVFSMLRARCPLEDKVACAIKPSGAPLHRMKFMNTVSAFETLPQRAT

SEQ ID NO: 6771 - DNA, 702 bp, Sorghum bicolor
  misc_feature: Ceres ANNOT ID no. 6068357
  misc_feature: Encodes the peptide sequence at SEQ ID NO 6772
atggggttcctcgaggacttccaggccagtgttgaagcattgccatctatgctgcatcggaactattcattaatgcgggagttagataaaagtttgcaaggcgtgcaactagaaaatgagcagcgctgtcagcaagaaatagaggacattaagcatggacttgaatctggaagtattacatatgacccagcaaaattgaaattttctgaagaagcaatcgaggagcagaaacactgtgttagaattgctgacgagaaggtggctttagccactcagacttatgacctggttgatgctcatatccaacagctagatcaatttatgaggaagcttgaagaaattcggcaagggactgctgttgctactactgccgctccaactgttaatgtcggagtgacaactgctgatggtactccaaagagtggacgatctggcgaaagaggcagagggggtcggaagaagtctaaggtacccacggagcagccagtgccacctattgatttagaattgcctgtggatcctaacgaacctacatactgcctctgcaaccaagtcagctatggtgagatggtggcatgcgacaatcctaattgcaaaatcgagtggtatcactatggctgtgtgggcgtcaaggagcagcccaagggaaagtggtattgcccaaattgcatcggattccagaagaagagaaaaggcaagtga

SEQ ID NO: 6772 - protein, 233 aa, Sorghum bicolor
  misc_feature: Ceres ANNOT ID no. 6068357
  misc_feature (179)..(226): Pfam Id: PHD Pfam Desc: PHD-finger
  misc_feature (124)..(230): NCBI GI: 116118315 NCBI Desc: ensangp00000011912 [anopheles gambiae str. pest]
  misc_feature (112)..(230): NCBI GI: 108879358 NCBI Desc: inhibitor of growth proteining, ing4 [aedes aegypti]
  misc_feature (112)..(230): NCBI GI: 108879359 NCBI Desc: inhibitor of growth proteining, ing4 [aedes aegypti]
  misc_feature (135)..(233): NCBI GI: 9944280 NCBI Desc: growth inhibitory protein ing1 [homo sapiens]
  misc_feature (165)..(230): NCBI GI: 58430704 NCBI Desc: inhibitor of growth-1 homologue, dng1 [dictyostelium discoideum]
MGFLEDFQASVEALPSMLHRNYSLMRELDKSLQGVQLENEQRCQQEIEDIKHGLESGSITYDPAKLKFSEEAIEEQKHCVRIADEKVALATQTYDLVDAHIQQLDQFMRKLEEIRQGTAVATTAAPTVNVGVTTADGTPKSGRSGERGRGGRKKSKVPTEQPVPPIDLELPVDPNEPTYCLCNQVSYGEMVACDNPNCKIEWYHYGCVGVKEQPKGKWYCPNCIGFQKKRKGK

SEQ ID NO: 6773 - DNA, 1689 bp, Sorghum bicolor
  misc_feature: Ceres ANNOT ID no. 6068358
  misc_feature: Encodes the peptide sequence at SEQ ID NO 6774
atgtaccgcgcggccgccagccttgcctccaaggccaggcatgccgggagtagcgctcgccaggtggcgggcagcttggcctggagcaggaactatgctgctaaggacatcaagtttggtgtccaagcccgggtcttgatgctgaggggtgttgaagaattggccgacgctgtcaaagtgacaatgggccctaagggaagaactgttattattgagcaaagctttggtgcacccaaagttacaaaggatggagtgaccgttgccaagagcattgaattcagtgacagagtaaagaacgttggtgcaagccttgtgaagcaggtcgctaattctaccaatgatacagctggggatggtactacatgtgccactgttctgacaaaggctatattcactgagggttgcaagtccgtagctgctggaatgaatgctatggatctgagacgtggtatctcaatggctgttgattctgttgtcacgaacctaaaaagcatggtgggtactatatcagctaatggggaaagggaaattggtgagctaattgcaaaagctatggagaaggttggtaaagagggagtcatcactattgcggatggcaacacactctacaacgagcttgaagttgtggaaggcatgaagttagaaaaaggttacatctctccatactttattaccgaccagaagaaccagaaatgtgaactaaatgatcccttgatattgatacacgacaaaagagtatcaaatgcgcactccgtggccaaagtgatggagttagctatgaagaagcaaaaacctctgcttattgtcgcagaagatgtagaaggtgaagcattgggtaccctgattcttaacaagcttcgtggaggtgttaaggtctgtgcagtcaaagctcctggttttggggggagcaggaaaaccaacttacaggaccttgctatccttactgggggggaagttataactgaagaacttgggatgaaccttgagaactttgagcctcagatgtttggcacttgcaaaaaggttacaatttctaaggacgacactgtcatccttgatggagctggggataagaaggcaattgaagagagagctgagcatctgagatctgcgattgagcaaagcacttctgactatgacaaggaaaagcttcaagagcgattggcaaagctttctggtggtgttgctgttctaaagattggtggagcaagtgaagtggaagtcaatgagaagaaggatagagtgacggatgcactaaatgcaaccaaagctgcagtggaggagggtattgtgccaggtgggggtgttgctcttctctatgcttcaaaagacctggatacattggagactgcaaactttgaccaaaagattggtgtccaaatcattcaaaatgctttgaagaccccggtgcatactattgcttcaaatgctggggtagaaggggctgttattgttggcaagcttttggaacaggagaacactgatctaggctatgatgcagctaaaggtgaatatgtggatatggtgaaggctggtatcatcgacccgcttaaagtgattagaacagccctgttggatgctgcaagcgtatcatctcttttgactaccacagaatctgtcattgttgagatccccaaggaagtgagtagtgcatcagcaacgggcagcatgaatgggatggaatactga

SEQ ID NO: 6774 - protein, 562 aa, Sorghum bicolor
  misc_feature: Ceres ANNOT ID no. 6068358
  misc_feature (54)..(545): Pfam Id: Cpn60_TCP1 Pfam Desc: TCP-1/cpn60 chaperonin family
  misc_feature (1)..(562): NCBI GI: 22758324 NCBI Desc: mitochondrial chaperonin-60 [oryza sativa (japonica cultivar-group)]
  misc_feature (1)..(562): NCBI GI: 22248 NCBI Desc: mitochondrial chaperonin-60 [zea mays]
  misc_feature (1)..(562): NCBI GI: 2506275 NCBI Desc: chaperonin cpn60-1, mitochondrial precursor (hsp60-1)
  misc_feature (1)..(562): NCBI GI: 309557 NCBI Desc: chaperonin 60
  misc_feature (1)..(562): NCBI GI: 2493646 NCBI Desc: chaperonin cpn60-2, mitochondrial precursor (hsp60-2)
MYRAAASLASKARHAGSSARQVAGSLAWSRNYAAKDIKFGVQARVLMLRGVEELADAVKVTMGPKGRTVIIEQSFGAPKVTKDGVTVAKSIEFSDRVKNVGASLVKQVANSTNDTAGDGTTCATVLTKAIFTEGCKSVAAGMNAMDLRRGISMAVDSVVTNLKSMVGTISANGEREIGELIAKAMEKVGKEGVITIADGNTLYNELEVVEGMKLEKGYISPYFITDQKNQKCELNDPLILIHDKRVSNAHSVAKVMELAMKKQKPLLIVAEDVEGEALGTLILNKLRGGVKVCAVKAPGFGGSRKTNLQDLAILTGGEVITEELGMNLENFEPQMFGTCKKVTISKDDTVILDGAGDKKAIEERAEHLRSAIEQSTSDYDKEKLQERLAKLSGGVAVLKIGGASEVEVNEKKDRVTDALNATKAAVEEGIVPGGGVALLYASKDLDTLETANFDQKIGVQIIQNALKTPVHTIASNAGVEGAVIVGKLLEQENTDLGYDAAKGEYVDMVKAGIIDPLKVIRTALLDAASVSSLLTTTESVIVEIPKEVSSASATGSMNGMEY

SEQ ID NO: 6775 - DNA, 1602 bp, Sorghum bicolor
  misc_feature: Ceres ANNOT ID no. 6068361
  misc_feature: Encodes the peptide sequence at SEQ ID NO 6776
atgtcctttactggttccgcccctgagcagcagcaacccgccactgcgcggatctcctcgtcctcagccggctccggaaggctcgtcactccgttctggaaagagaagtatgagagggacttcttcaaggatcgacattacctggataaagaatggggaaagtactttgaggttggttgtggagctgggaacacaatctatccgttgctttctacatatccagatatttttgtccatgcctgtgatttttctccacgagctgtcgatttggtcaagaaacacaaggacttcaaacctgaccagataaatgcattcgtctgtgatatttcatcagaacaactaaccgagaatatggaaccttcttctgctgacattgtaacgatgatctttatgctttctgcagtcgcaccagataaaatgcctatggttctggagaatgttagaagtgtcctaaaacatggtggccgtgttctctttcgggactatgccttcggtgaccttgcacaggaaaggcttatgtcaaagggacagcaaataagtgagaacttctatgtcagaggtgatggtacgcgtgcatattacttttcaaatgaatatctggtggatttattttcaaaatgtggatttactcttgaggaaatatgtgtgcacaacaagcaagttgaaaaccgttcactggagttggtgatgaacaggaattgggtccaagctaccttcaccttaaactcagctagttctcaaggtccaaatggtcaacacgatctccttgtttgcgaaggagaggaggataagctagcttctgacacatctacgaagaaaagcagcagcgaagaaattgatctttctgaagatttttgcaacatgtttgggacatcacacagccttaatgaggtacaaatcattgggatcaaagcaaaaggtcacgacttcaaaataaaaatgctcaggaaggaataccagcacacctgcaaatcaaccggcttaatgctttgggaatctgctcaattcatgtgctctcttttagcagagaatccttacattgttgcaggcaaaagggttctggagttgggctgtggctcagctggcatctgctcgatggttgctgcaagtttcactcagtttgttgtagctacagatggggatgaagaatcactcgatctccttagacaaaacatctcctcgaatctggagcctaattctctgagcagaattaagattaggaagttattttggggcaacaaagatgatacgcaggcagtccgagagctttctggtaatggtgcaggttttgattgcataataggcaccgacgtgacctacaatcccgatgctatacaccctctcttcgtgactgcgagggagctgatttctgacagagctaacaaggattcaacccctgctcttattctttgctacattcagcgacgagttgatgaggactccatcctttctaatgcaacgtcccagggtttcaggcttgtggacaaatggataaatggacttcatgagagtaacggtatcatcagttcttggttctctggtaatgatgtctgcagtgctttccggaatgcagtactttcagtattgtacttcgagctgtga

SEQ ID NO: 6776 - protein, 533 aa, Sorghum bicolor
  misc_feature: Ceres ANNOT ID no. 6068361
  misc_feature (56)..(157): Pfam Id: Methyltransf_12 Pfam Desc: Methyltransferase domain
  misc_feature (56)..(159): Pfam Id: Methyltransf_11 Pfam Desc: Methyltransferase domain
  misc_feature (36)..(533): NCBI GI: 92881408 NCBI Desc: sam (and some other nucleotide) binding motif [medicago truncatula]
  misc_feature (41)..(190): NCBI GI: 115450671 NCBI Desc: os03g0143000 [oryza sativa (japonica cultivar-group)]
  misc_feature (230)..(533): NCBI GI: 18700280 NCBI Desc: at2g26200/t1d16.16 [arabidopsis thaliana]
  misc_feature (57)..(239): NCBI GI: 116118171 NCBI Desc: ensangp00000022786 [anopheles gambiae str. pest]
  misc_feature (54)..(239): NCBI GI: 57530538 NCBI Desc: similar to mettl2 protein [gallus gallus]
MSFTGSAPEQQQPATARISSSSAGSGRLVTPFWKEKYERDFFKDRHYLDKEWGKYFEVGCGAGNTIYPLLSTYPDIFVHACDFSPRAVDLVKKHKDFKPDQINAFVCDISSEQLTENMEPSSADIVTMIFMLSAVAPDKMPMVLENVRSVLKHGGRVLFRDYAFGDLAQERLMSKGQQISENFYVRGDGTRAYYFSNEYLVDLFSKCGFTLEEICVHNKQVENRSLELVMNRNWVQATFTLNSASSQGPNGQHDLLVCEGEEDKLASDTSTKKSSSEEIDLSEDFCNMFGTSHSLNEVQIIGIKAKGHDFKIKMLRKEYQHTCKSTGLMLWESAQFMCSLLAENPYIVAGKRVLELGCGSAGICSMVAASFTQFVVATDGDEESLDLLRQNISSNLEPNSLSRIKIRKLFWGNKDDTQAVRELSGNGAGFDCIIGTDVTYNPDAIHPLFVTARELISDRANKDSTPALILCYIQRRVDEDSILSNATSQGFRLVDKWINGLHESNGIISSWFSGNDVCSAFRNAVLSVLYFEL

SEQ ID NO: 6777 - DNA, 4527 bp, Sorghum bicolor
  misc_feature: Ceres ANNOT ID no. 6068368
  misc_feature: Encodes the peptide sequence at SEQ ID NO 6778
atgccgccctcctttccttccctcccgctcccggaggccgccgccgccgccgcccacgccgcgctgctcgcgctcgccgccctcctgctcctactccgcgccgcgcgctcgctcgcctcccgctgcgcctcatgcctcaaggcgccgcgccgccgcgggggccccgccgtcgtcgtgggcgccggcgccggcgcaggcggcgccctcgcggcgacgagcgccggcgcctggcacagggccgtgctggcgtcctgcgcctacgccctgctcgcgcaggtcgccgtgctgagctacgaggtggccgtggccggctcgcgcgtcgcggcgggggcgctgctgctgccggccgtgcaggcggtgtcctgggctgcgctgctcgcgctcgcgttgcaggcccgcgccgtcggctgggccaggttcccggcgctggtgcgggtctggtgggtggtctccttcgcgctctgcgttgtcattgcgtacgacgactctaggcgcctcataggcgacggggcgcgcgctgtggattacgcgcacatggttgccaacttcgcgtccgtgccggccctcggcttcctgtgcttggttggtgtcatgggttccacaggtttggaattggagtttatggaggatgagaacggtctgcatgagccgctgctgctcggcaggcagcgcagagaggcagaggaggagctcgggtgtctgagggtcactccttacagtgatgctgggatcctcagccttgcaacattgtcttggcttagtccgttgctctccgttggtgcgcagcggccacttgagttggctgacatacccttgctggcgcacaaggaccgtgcaaagtcatgctataaggtgatgagcgctcactacgagcgccagcggctagaacaccctggtagggagccatcactgacatgggcaatactcaagtcgttctggcgagaggctgcggtcaatggtacttttgctgctgtcaacacaatcgtgtcatatgttggcccttacttgatcagctattttgtggactatctcagtggcaacattgctttcccccatgaaggttacatccttgcctccatattttttgtagcaaaattgcttgagacactcactgcccgacagtggtacttgggtgtggacatcatgggaatccatgtcaagtctgggctcactgccatggtgtataggaagggtctccgactgtcaaacgcctcacgacagagccacacgagtggtgagattgtgaattacatggccgtcgatgtgcagcgtgtgggggactatgcatggtattttcatgacatctggatgcttcccctgcagatcattcttgctctcgccatcctgtacaagaacgtcgggatcgccatggtttcaacattggtagcaactgcgttatcgatcgcagcctctgttcctgtggcgaagctgcaggagcactaccaagataagttgatggcatcaaaagatgagcgcatgcgcaagacttcagagtgcttgaaaaatatgaggattttgaagcttcaggcatgggaggatcggtaccgcctgcagttggaagagatgaggaacgtggaatgcaggtggcttcggtgggctctgtactcacaggctgcagttacatttgttttctggagctcgccgatctttgttgcagtcataactttcgggacatgcatattactcggtggccagctcactgcaggaggggttctttctgctttggcaacgtttaggatcctccaagagcctctgaggaacttcccagatctcatatctatgatggcacagacaagggtgtctttggaccgtttgtctcattttctgcagcaagaagaactgccagatgatgcaactataaatgttccacaaagtagtacagacaaggcaatcgatattaagaatggtgcattctcttggaacccatactctctgacccctacactttctgatatacagcttagtgtagtgagaggcatgagagtagcagtctgtggtgtcattggttctggcaaatcaagtctactatcgtctatacttggggagatacccaaattatgtggtcatgtcaggataagtggcacagcagcgtatgttcctcagactgcctggatacagtctggaaacatcgaggagaatattctatttggcagtccaatggatagacaacgttacaagagagtcattgcagcttgctgtctgaagaaagatcttgagctgctccaatatggagatcagactgttattggtgatagaggcattaatttgagtggaggtcagaaacaaagagttcaacttgctagagcactctaccaagatgctgacatttatttgcttgatgaccccttcagtgctgtcgatgctcatactgggagcgaactgtttaaggagtatatattgagcgcactagcaaccaaaacagtaatctacgtaacccatcaagttgagtttctaccagctgctgacctgatattggttcttaaggatggacatatcacacaagctggaaagtatgatgatcttctgcaagctggaactgatttcaatgctctggtttctgctcataaggaagctattgaaaccatggacatctttgaagattctgatggtgatacagtttcttctattcccaacaaaagactgacaccaagtattagtaatattgataacctgaaaaacaaggtgtgcgaaaatggtcaaccatctaatgcaaggggaattaaggaaaaaaagaagaaagaagagcgtaagaagaagcgtactgttcaggaggaggaaagggaacgtggaagagtgagctcaaaagtttatttgtcatacatgggggaagcttacaaaggtacactgataccgctaattatcttggctcaaaccatgttccaagttcttcagattgcgagcaactggtggatggcgtgggcaaacccacaaacagaaggagatgcccccaagacagatagtgtggtccttctggttgtttatatgtcccttgcttttgggagttcattatttgtgtttgtgagaagccttcttgtggctacgtttggtttagcagctgcccagaagctttttataaaaatgcttaggtgtgtctttcgagctccaatgtcattctttgacaccacaccatctggtcggattttgaaccgagtttctgtagatcaaagtgttgtggaccttgatatagcattcagacttggtggatttgcatcaacgacaattcaactccttggaattgttgctgtcatgagcaaagtcacatggcaagttctaattcttatagttcccatggctatcgcatgcatgtggatgcagaggtattatattgcttcatcaagggaactgactaggattttgagtgtccagaagtctccagttatccatttgtttagtgaatcaattgctggtgctgctacaataagaggctttggtcaagagaaacggtttatgaaaaggaatctctaccttcttgactgttttgctcggcctttattttccagccttgctgctattgaatggctctgcctgcgaatggaattgttgtcaactttcgtctttgctttctgcatggcaatacttgtgagctttcctcctggcacaatcgaaccaagtatggctggcctcgctgtcacatatggacttaatttaaatgctcgcatgtcaaggtggatattgagcttctgtaaactagaaaacaggataatctctgttgaacgcatttatcaatattgcaagcttcctagtgaagcaccactgattattgagaattgccgtccaccatcatcatggcctcacaatggaagcattgaactgattgatctcaaggtccgctacaaggatgatctaccattagttcttcatggtgtaagttgtatgtttccgggcgggaaaaagattgggattgtagggcgtaccggaagtggtaaatctacccttattcaggcccttttccgcctaattgaacccactggagggaagattataattgacgacattgacatttctgcaattggccttcatgatctgcggtcacggttgagtatcatccctcaagaccctacattgtttgagggtactatcagaatgaatcttgatcctcttgaagagtgtgctgatcaagaaatttgggaggcactagaaaagtgtcagctaggagaggtcattcgttccaaggaagagaaacttgacagtccagtgctagaaaacggggataactggagcgtgggacagcgccaacttattgcactgggtagggcattgctcaagcaggcaaaaattttggtacttgatgaggcgactgcatctgttgacacagcaacagataatcttatccaaaagatcattcggagtgaattcaaggactgcacagtctgtaccattgctcatcgtatccccacagtaattgacagtgaccttgttctggtccttagtgatgagttcgacacgccccagaagcttttagaggacaagtcgtctatgttcatgcagctagtatcggaatactccactcggtcgagctgtatatag

SEQ ID NO: 6778 - protein, 1508 aa, Sorghum bicolor
  misc_feature: Ceres ANNOT ID no. 6068368
  misc_feature (659)..(830): Pfam Id: ABC_tran Pfam Desc: ABC transporter
  misc_feature (1296)..(1479): Pfam Id: ABC_tran Pfam Desc: ABC transporter
  misc_feature (313)..(585): Pfam Id: ABC_membrane Pfam Desc: ABC transporter transmembrane region
  misc_feature (950)..(1220): Pfam Id: ABC_membrane Pfam Desc: ABC transporter transmembrane region
  misc_feature (19)..(1508): NCBI GI: 2980641 NCBI Desc: multi resistance protein [arabidopsis thaliana]
  misc_feature (160)..(1508): NCBI GI: 3142303 NCBI Desc: strong similarity to mrp-like abc transporter gbu92650 from a. thaliana and canalicular multi-drug resistance protein gbl49379 from rattus norvegicus. [arabidopsis thaliana]
  misc_feature (9)..(1506): NCBI GI: 115434802 NCBI Desc: os01g0173900 [oryza sativa (japonica cultivar-group)]
  misc_feature (120)..(1506): NCBI GI: 10172595 NCBI Desc: multidrug resistance-associated protein (mrp); abc-transoprter [arabidopsis thaliana]
  misc_feature (120)..(1506): NCBI GI: 42733544 NCBI Desc: multidrug resistance-associated protein [thlaspi caerulescens]
  misc_feature (19)..(1508): SWISSPROT Homolog: EC 3.6.3.44 Multidrug resistance-associated protein 5
MPPSFPSLPLPEAAAAAAHAALLALAALLLLLRAARSLASRCASCLKAPRRRGGPAVVVGAGAGAGGALAATSAGAWHRAVLASCAYALLAQVAVLSYEVAVAGSRVAAGALLLPAVQAVSWAALLALALQARAVGWARFPALVRVWWVVSFALCVVIAYDDSRRLIGDGARAVDYAHMVANFASVPALGFLCLVGVMGSTGLELEFMEDENGLHEPLLLGRQRREAEEELGCLRVTPYSDAGILSLATLSWLSPLLSVGAQRPLELADIPLLAHKDRAKSCYKVMSAHYERQRLEHPGREPSLTWAILKSFWREAAVNGTFAAVNTIVSYVGPYLISYFVDYLSGNIAFPHEGYILASIFFVAKLLETLTARQWYLGVDIMGIHVKSGLTAMVYRKGLRLSNASRQSHTSGEIVNYMAVDVQRVGDYAWYFHDIWMLPLQIILALAILYKNVGIAMVSTLVATALSIAASVPVAKLQEHYQDKLMASKDERMRKTSECLKNMRILKLQAWEDRYRLQLEEMRNVECRWLRWALYSQAAVTFVFWSSPIFVAVITFGTCILLGGQLTAGGVLSALATFRILQEPLRNFPDLISMMAQTRVSLDRLSHFLQQEELPDDATINVPQSSTDKAIDIKNGAFSWNPYSLTPTLSDIQLSVVRGMRVAVCGVIGSGKSSLLSSILGEIPKLCGHVRISGTAAYVPQTAWIQSGNIEENILFGSPMDRQRYKRVIAACCLKKDLELLQYGDQTVIGDRGINLSGGQKQRVQLARALYQDADIYLLDDPFSAVDAHTGSELFKEYILSALATKTVIYVTHQVEFLPAADLILVLKDGHITQAGKYDDLLQAGTDFNALVSAHKEAIETMDIFEDSDGDTVSSIPNKRLTPSISNIDNLKNKVCENGQPSNARGIKEKKKKEERKKKRTVQEEERERGRVSSKVYLSYMGEAYKGTLIPLIILAQTMFQVLQIASNWWMAWANPQTEGDAPKTDSVVLLVVYMSLAFGSSLFVFVRSLLVATFGLAAAQKLFIKMLRCVFRAPMSFFDTTPSGRILNRVSVDQSVVDLDIAFRLGGFASTTIQLLGIVAVMSKVTWQVLILIVPMAIACMWMQRYYIASSRELTRILSVQKSPVIHLFSESIAGAATIRGFGQEKRFMKRNLYLLDCFARPLFSSLAAIEWLCLRMELLSTFVFAFCMAILVSFPPGTIEPSMAGLAVTYGLNLNARMSRWILSFCKLENRIISVERIYQYCKLPSEAPLIIENCRPPSSWPHNGSIELIDLKVRYKDDLPLVLHGVSCMFPGGKKIGIVGRTGSGKSTLIQALFRLIEPTGGKIIIDDIDISAIGLHDLRSRLSIIPQDPTLFEGTIRMNLDPLEECADQEIWEALEKCQLGEVIRSKEEKLDSPVLENGDNWSVGQRQLIALGRALLKQAKILVLDEATASVDTATDNLIQKIIRSEFKDCTVCTIAHRIPTVIDSDLVLVLSDEFDTPQKLLEDKSSMFMQLVSEYSTRSSCI

SEQ ID NO: 6779 - DNA, 1650 bp, Sorghum bicolor
  misc_feature: Ceres ANNOT ID no. 6068388
  misc_feature: Encodes the peptide sequence at SEQ ID NO 6780
atgggcacggaggcggagcatcaggacagcagcgtccaacacgatggcgtcgtggtggtgcccgcgccgcgcccgcgcaaggggctcgcctcctgggcgctcgacctgctcgagtccctcgtcgtgcgcctcggccacgacaagaccaagccgctccactggctctccggcaacttcgcccccgtcgtcgaggagaccccgccggcccccaacctcaccgtccgcggacacctcccggagtgcttgaatggagagtttgtccgggttgggcctaatccaaagtttgtccctgttgccgggtatcactggtttgatggagacgggatgattcatgccatgcgtattaaagatggaaaagctacctatgtatcaagatatgtgaagactgctcgcctcaaacaagaagagtattttggtggagctaagtttatgaagattggagacctgaagggattttttggattgtttatggtccaaatgcagcaactccggaaaaaattcaaagtcttggattttacctatggatttgggacagctaatactgcacttatatatcatcatggtaaactcatggccttgtcagaagcagataagccatatgttgttaaggtccttgaagatggagacttgcagactcttggcttgttggattatgacaaaaggttgaaacattctttcaccgcccatccaaaggttgacccttttacagatgaaatgttcacatttggatattcacacgaacctccatactgtacataccgtgtgattaccaaagaaggagctatgcttgatcctgtgccaataacaataccagaatctgtaatgatgcatgactttgccatcacggagaattactctatttttatggacctccctttgttgttccgaccaaaggaaatggtgaagaacggtgagtttatctacaagtttgatcctacaaagaaagctcgttttggtattctcccacgctacgcaaaggatgaaaaagtcatcagatggtttgaactccctaattgcttcatattccataatgctaatgcttgggaagagggtgatgaagttgttctcattacctgccgccttgagaatccagatttggacaaggtgaatggacatcaaagtgacaagctcgaaaacttcgggaatgagctgtacgagatgagattcaacatgaaaacgggtgctgcttcacaaaagcaactgtctgtttctgctgtagattttcctcgtgttaatgagagctatactggcagaaagcagcggtttgtctactgcactatacttgatagcattgcgaaggtgactggcatcataaaatttgatctgcatgctgaaccggagagtggtaagaaagaacttgaagtgggaggaaatatacaaggcatatatgacctgggacctggtagattcggttcagaggcgatttttgttcccaagcagccaggtgtatctggagaagaagatgatggctatttgatattctttgtgcacgacgaaaatacagggaaatctgaagtaaatgttatagatgcgaagacaatgtctgctgatccagttgcagtggttgagcttcctaatagggttccttatggattccatgccttctttgtaactgaggaccaactggctcagcaagcggaggggcagtga

SEQ ID NO: 6780 - protein, 549 aa, Sorghum bicolor
  misc_feature: Ceres ANNOT ID no. 6068388
  misc_feature (42)..(539): Pfam Id: RPE65 Pfam Desc: Retinal pigment epithelial membrane protein
  misc_feature (1)..(549): NCBI GI: 71063655 NCBI Desc: 9,10-9',10' carotenoid cleavage dioxygenase 1 [zea mays]
  misc_feature (11)..(549): NCBI GI: 54778784 NCBI Desc: carotenoid cleavage dioxygenase [zea mays]
  misc_feature (11)..(549): NCBI GI: 107857142 NCBI Desc: carotenoid cleavage dioxyganase 1 [zea mays]
  misc_feature (1)..(545): NCBI GI: 30424396 NCBI Desc: crocetin dialdehyde [crocus sativus]
  misc_feature (1)..(547): NCBI GI: 49659730 NCBI Desc: carotenoid cleavage dioxygenase 1 [petunia x hybrida]
MGTEAEHQDSSVQHDGVVVVPAPRPRKGLASWALDLLESLVVRLGHDKTKPLHWLSGNFAPVVEETPPAPNLTVRGHLPECLNGEFVRVGPNPKFVPVAGYHWFDGDGMIHAMRIKDGKATYVSRYVKTARLKQEEYFGGAKFMKIGDLKGFFGLFMVQMQQLRKKFKVLDFTYGFGTANTALIYHHGKLMALSEADKPYVVKVLEDGDLQTLGLLDYDKRLKHSFTAHPKVDPFTDEMFTFGYSHEPPYCTYRVITKEGAMLDPVPITIPESVMMHDFAITENYSIFMDLPLLFRPKEMVKNGEFIYKFDPTKKARFGILPRYAKDEKVIRWFELPNCFIFHNANAWEEGDEVVLITCRLENPDLDKVNGHQSDKLENFGNELYEMRFNMKTGAASQKQLSVSAVDFPRVNESYTGRKQRFVYCTILDSIAKVTGIIKFDLHAEPESGKKELEVGGNIQGIYDLGPGRFGSEAIFVPKQPGVSGEEDDGYLIFFVHDENTGKSEVNVIDAKTMSADPVAVVELPNRVPYGFHAFFVTEDQLAQQAEGQ

SEQ ID NO: 6781 - DNA, 2217 bp, Sorghum bicolor
  misc_feature: Ceres ANNOT ID no. 6068392
  misc_feature: Encodes the peptide sequence at SEQ ID NO 6782
atgcccttatgttatacccacacccttaaagttgggcacaagaaggttcctgctgtttttaagggggaaaaaagatcaatggaggcaaagttggctttctcccaggacagcccaccaatttcgataatctgtgcagcaaagtttgtgggtctacccctaaccatcgaccctgctggctcggcacccaccctacggtttgcttctggagaatcactccatggtgtcaacccaatcctcctctaccttgccagcagtgcatcagtttcctgcttctctgggaagaatgatattgagtttgggcatgttgttgaatggcttgaatatgcccccaccttcctttcgggctctgaatttgaaaatgcctgctcatttgttgatggattcttggcctcccggacctttctggttggtcatggcctgacaattgctgacattgtagtttggtcaaatcttgctggaattggtcaacggtgggagagtctaaggaaatcaaagaaataccaaaatcttgtccgctggttcaacagcatagcttcagaatacggagacatactgaatgaagttgtggttgcatatgttgggaaacgaggaattggaaaatctcctgcaccaagccttaaggaaaaggtacatgattcaaaggatccatcagctccagaagttgatctcccaggtgcaaaagttggaaaagtctgtgttcgttttgccccagaacctagcggttacctccatattgggcatgcaaaggctgggctattgaacaaatactttgctgaaagataccaagggcgtctaatagttcgatttgatgacacaaacccttcaaaagaaagcaatgagtttgtcgagaacgttttaaaagatattgatactttggggatcaaatatgatgttgtcacatacacatctgattatttcccaaagctaatggaaatggctgaaagtttgataaagcagggtaaggcatatgttgatgacacaccaaaggaggaaatgaggaaagagaggatggatggtattgagtcaaggtgcagaaataatactgtggaggaaaatctgtcattatggaaagagatggttaatggaactgaaaggggcatgcagtgttgtgtacggggtaaacttgacatgcaggatcctaacaagtcactcagggatcctgtttactaccgctgtaatactgatcctcaccatcgtgttggttcaaagtacaaggtctatccaacatatgactttgcttgcccatttgttgatgcattggagggggtgacacatgctcttcgttccagtgaatatcatgacaggaatgcacaatattatcggattcttcaagacatggggttgaggagggtagaaatttatgaattcagccgattgaatatggtttacactcttctaagcaagcggaagcttctttggtttgtacaaaacaagaaggtcgaagattggactgacccacgttttcccactgtccaaggtatagtacgacgtggcttgaagattgaggcattgatacaatttatactccaacagggtgcttcaaaaaatctgaatcttatggagtgggataaactgtggacaatcaacaagaagataattgatccagtgtgcgcaaggcatactgctgtgctaaaagaccagcgtgtcatctttactcttacaaatggtccagagaagccatttgttcgaattttaccaaggcataagaaatttgagggtgctggaaagaaggctacaaccttcgccaacagaatttggttagattatgctgatgcagcagccattagcaagggtgaggaagtaacccttatggattgggggaatgctattgttaaagagatcaaggtggtgagtggagtaattacggaactagttggagaactacatcttgagggctccgtgaagacaacaaaattgaagatcacatggctagcagatatagaggagctagtccccctctcattggttgaatttgattatctcatcagcaagaaaaagctagaggaggaagatgacttccttgagaatctcaacccttgcactcgacgagagatcccagcccttggagatgcaaacatgaggaacctcaagcgtggagagataatacagctcgagaggaaaggctactataggtgtgatgccccttttatcagatcgtcgaaaccggtggttctgtttgccatcccagatggccggcagcaggcctcgcttaactag

SEQ ID NO: 6782 - protein, 738 aa, Sorghum bicolor
  misc_feature: Ceres ANNOT ID no. 6068392
  misc_feature (230)..(535): Pfam Id: tRNA-synt_1c Pfam Desc: tRNA synthetases class I (E and Q), catalytic domain
  misc_feature (537)..(713): Pfam Id: tRNA-synt_1c_C Pfam Desc: tRNA synthetases class I (E and Q), anti-codon binding domain
  misc_feature (57)..(737): NCBI GI: 92873328 NCBI Desc: glutamyl-trna synthetase archae/euk cytosolic; glutathione s-transferase, c-terminal-like [medicago truncatula]
  misc_feature (58)..(732): NCBI GI: 3047084 NCBI Desc: similar to aminoacyl-trna synthetases [arabidopsis thaliana]
  misc_feature (91)..(732): NCBI GI: 2370487 NCBI Desc: spac17a5.15c [schizosaccharomyces pombe]
  misc_feature (91)..(732): NCBI GI: 19114395 NCBI Desc: glutamyl-trna synthetase, cytoplasmic [schizosaccharomyces pombe]
  misc_feature (105)..(732): NCBI GI: 146453059 NCBI Desc: glutamyl-trna synthetase [lodderomyces elongisporus nrrl yb-4239]
MPLCYTHTLKVGHKKVPAVFKGEKRSMEAKLAFSQDSPPISIICAAKFVGLPLTIDPAGSAPTLRFASGESLHGVNPILLYLASSASVSCFSGKNDIEFGHVVEWLEYAPTFLSGSEFENACSFVDGFLASRTFLVGHGLTIADIVVWSNLAGIGQRWESLRKSKKYQNLVRWFNSIASEYGDILNEVVVAYVGKRGIGKSPAPSLKEKVHDSKDPSAPEVDLPGAKVGKVCVRFAPEPSGYLHIGHAKAGLLNKYFAERYQGRLIVRFDDTNPSKESNEFVENVLKDIDTLGIKYDVVTYTSDYFPKLMEMAESLIKQGKAYVDDTPKEEMRKERMDGIESRCRNNTVEENLSLWKEMVNGTERGMQCCVRGKLDMQDPNKSLRDPVYYRCNTDPHHRVGSKYKVYPTYDFACPFVDALEGVTHALRSSEYHDRNAQYYRILQDMGLRRVEIYEFSRLNMVYTLLSKRKLLWFVQNKKVEDWTDPRFPTVQGIVRRGLKIEALIQFILQQGASKNLNLMEWDKLWTINKKIIDPVCARHTAVLKDQRVIFTLTNGPEKPFVRILPRHKKFEGAGKKATTFANRIWLDYADAAAISKGEEVTLMDWGNAIVKEIKVVSGVITELVGELHLEGSVKTTKLKITWLADIEELVPLSLVEFDYLISKKKLEEEDDFLENLNPCTRREIPALGDANMRNLKRGEIIQLERKGYYRCDAPFIRSSKPVVLFAIPDGRQQASLN

SEQ ID NO: 6783 - DNA, 1176 bp, Sorghum bicolor
  misc_feature: Ceres ANNOT ID no. 6068407
  misc_feature: Encodes the peptide sequence at SEQ ID NO 6784
atgatgctgttcgaggaggatgcagccgtcatgaccatgccagatggcttgtgcatcgaggaaatttcaagccccatagctgctcatattcttgacttctatgatggcggccttggtaatgacctctttgctgcggcgactaccacctccggtccatttcctgccactgatgacgacgtttcttcgtctaccacaaccacccctcccatctgcagctacaatgacgatgctccagctgctggtgccacagcctactccccattgccatccttcgacaccactctcacggccctccttgaggaagagcaacaccatggccttgacaccgagctccttccgcagatcgacagcctttcagaagtagcatactatccaactgccaccgatgagactggcatagggcaattcaaccagatgggacttccagagaccatagctgaacaggtgcctccgatgcaaatgagcagcagtgcatctgccttgattccactcaattcagactatgatgagtgcttcacagcagcgttagctggagggttcatgggtctggaaggagccatgtatcagcaaagtggagcaattcttccaggctgcaatgcagaagcatcacaacagggattcttcaatagtgccagcagcaatagtatggtgatgattggcgagtatcagaagatgatggaaggtgaaggactgaccacagcatacaacgacacagattccatgcaagggacatttaatactaatgcagagatgcaggtaggaggaaataatcagcacctcataaacggatgcaatgggaacccagcaacattacctccaacagaactatcaggattggaagactccacattcaaggttgtccgcttgtcacctgaagagagaaaggaaaagatccataggtatataaagaaacggaacgagagaaatttcagcaaaaaaataaagtacgcttgtagaaaaaccttggcagatagcaggccccgtgtccgtggaaggtttgcaaagaatgatgaactctgtgaagcagcacaatcaggctcccagggtcatgaacattatgaacaaactgaccatatgaaagaagagatgctggacacatctgacattcttgcgcaactgagtggattaaattcctacaactacaagtataaatgcaccattgaatcatggatatga

SEQ ID NO: 6784 - protein, 391 aa, Sorghum bicolor
  misc_feature: Ceres ANNOT ID no. 6068407
  misc_feature (294)..(338): Pfam Id: CCT Pfam Desc: CCT motif
  misc_feature (212)..(391): NCBI GI: 115482424 NCBI Desc: os10g0466500 [oryza sativa (japonica cultivar-group)]
  misc_feature (10)..(391): NCBI GI: 42561691 NCBI Desc: zinc finger constans-related [arabidopsis thaliana]
  misc_feature (256)..(365): NCBI GI: 2341026 NCBI Desc: f19p19.3 [arabidopsis thaliana]
  misc_feature (274)..(339): NCBI GI: 87240457 NCBI Desc: cct [medicago truncatula]
  misc_feature (289)..(348): NCBI GI: 115483703 NCBI Desc: os11g0101200 [oryza sativa (japonica cultivar-group)]
  misc_feature: The sequence is a functional homolog of SEQ ID NO. 370 in the 11/188,298 US application
MMLFEEDAAVMTMPDGLCIEEISSPIAAHILDFYDGGLGNDLFAAATTTSGPFPATDDDVSSSTTTTPPICSYNDDAPAAGATAYSPLPSFDTTLTALLEEEQHHGLDTELLPQIDSLSEVAYYPTATDETGIGQFNQMGLPETIAEQVPPMQMSSSASALIPLNSDYDECFTAALAGGFMGLEGAMYQQSGAILPGCNAEASQQGFFNSASSNSMVMIGEYQKMMEGEGLTTAYNDTDSMQGTFNTNAEMQVGGNNQHLINGCNGNPATLPPTELSGLEDSTFKVVRLSPEERKEKIHRYIKKRNERNFSKKIKYACRKTLADSRPRVRGRFAKNDELCEAAQSGSQGHEHYEQTDHMKEEMLDTSDILAQLSGLNSYNYKYKCTIESWI

SEQ ID NO: 6785 - DNA, 2178 bp, Sorghum bicolor
  misc_feature: Ceres ANNOT ID no. 6068426
  misc_feature: Encodes the peptide sequence at SEQ ID NO 6786
atgaatggtaggaaagatagggggaggtttagcagatttatacaccgcttgtcagtgcaatgcctgtgctctggggatcagacgaacacgatggatcgggcaatccaattatcggagaacatagacataaaagatggcatgaccagccggactccaaatcctgtggctgggcggcatgtcaataatgttggcatggaggaggttgagttgtcgctacagggaggtggctcccttaattatgaggaagcaagggcattgcttggaagggtagaataccaaaggggacatattgaagaagcacttcgcgtatttgatgggataaagatatctgcactaattcctgagatgaaaaagtctgtcgttagaaaagttggccagcaaaagcctcgcccacattccagttctctgacaatgcccttccattctgttactatactgatggagactatatatcttaaatctcttgcactgcatgatcttggaaagtttgaagaagctgcacgtgagtgcagtgcaatattggatattgtggaatctgcagcacctgaaggtttgccgagcaactttggaaatgattgtaacttgaatgaaacaatatgcagagcagttgagttacttcctgagctttggaaactaggaggttttcctcttgaaactatctcttcatataggagggctcttgttagtaattggaaccttgatgcaaagaccattgctaaactacagaaagaatttgctgtttttctactatacagtggctatgaagccggacctcccaagcttcgatgtcaattggatggtttatttgtacctcagaataatctggaagaagctattcttcttttgttgattctattggtgaagttcaatcttaagaggattgaaagggatgcaactgtgatgcatcacttaagttttgcactgtccgtgtcagggcagttgaaacctcttgctcgtcagtttgaagcactattacctggtcttctagacaatagagagtggctgtacattgttgcattgtgctacttagcatcaggtgacgatttaaatgcactgaatcttcttagaagggtattgaagtctggagaagattcaaacagtctcaaagaacttctcctggcttcaaaagtttgtggcgaagacagtgctcatgctggagaaggagttttatatgctcgtagagcccttgccaatcagcatggaggttgtgatcaaatggaggttgttgcaggccgtttgcttggcatttccctttccaatcttgctagatatgctacaactgatatagagagagctgctcagcagcatgaagcattggaggtgcttgctaatgctggaaaaaagatgcacagcagagattttgggacaatatacagtctcagccttgaaaatgctgtgcagagaaaattagatagagcagctcattatgcaaagaagctgttgaaattagaggctgggtcagaattgaagacttggctgcttatagctcgaataatgagtgcccaaaaacgatttgaagatgctgagtgcattgtagatgccgcattagatcaggctgggaagtggtctcaaggagatctattgcaaaccaaagccaaaattcagattgcccatgggcagtttaggaaagcaattgagacatatacacagcttcttgctctgatccaacttattgtgaagagttttggtgctgggatttctgtcttgcagggaactaggactgataaaagtctggaaataaaaacatggtatgatcttgcccttttgtacctaagaatgtctcaatggaaggatgcagaactttgcatatccaaaataaaagctatcagtccatattctcccttggcttgtcatgctataggaaagctcaatgaaggcaaaggttttatgaaagaggctctgcgagcatactcaacagcgttagacctcgatcctaaacatgtaccgagtttgttatcaactgctactgttcttcgacagctttataagaagcccttgcctgttgctagatgcttcctaactgatgcgttgagactagacagaacaaaccatgttgcctggttcaaccttggcttactctatgaagacgaaggtgacagcgcagcgattgaagctgctgaatgttttagggctgctgcacttcttgaagaaaatgccccggcagaacctttcagatga

SEQ ID NO: 6786 - protein, 725 aa, Sorghum bicolor
  misc_feature: Ceres ANNOT ID no. 6068426
  misc_feature (1)..(725): NCBI GI: 78708807 NCBI Desc: new cdna-based gene [oryza sativa (japonica cultivar-group)]
  misc_feature (9)..(725): NCBI GI: 56381953 NCBI Desc: at4g28600 [arabidopsis thaliana]
  misc_feature (45)..(724): NCBI GI: 27450574 NCBI Desc: pollen-specific calmodulin-binding protein [arabidopsis thaliana]
  misc_feature (60)..(725): NCBI GI: 77556181 NCBI Desc: calmodulin-binding protein mpcbp [oryza sativa (japonica cultivar-group)]
  misc_feature (82)..(724): NCBI GI: 10086260 NCBI Desc: calmodulin-binding protein mpcbp [zea mays]
MNGRKDRGRFSRFIHRLSVQCLCSGDQTNTMDRAIQLSENIDIKDGMTSRTPNPVAGRHVNNVGMEEVELSLQGGGSLNYEEARALLGRVEYQRGHIEEALRVFDGIKISALIPEMKKSVVRKVGQQKPRPHSSSLTMPFHSVTILMETIYLKSLALHDLGKFEEAARECSAILDIVESAAPEGLPSNFGNDCNLNETICRAVELLPELWKLGGFPLETISSYRRALVSNWNLDAKTIAKLQKEFAVFLLYSGYEAGPPKLRCQLDGLFVPQNNLEEAILLLLILLVKFNLKRIERDATVMHHLSFALSVSGQLKPLARQFEALLPGLLDNREWLYIVALCYLASGDDLNALNLLRRVLKSGEDSNSLKELLLASKVCGEDSAHAGEGVLYARRALANQHGGCDQMEVVAGRLLGISLSNLARYATTDIERAAQQHEALEVLANAGKKMHSRDFGTIYSLSLENAVQRKLDRAAHYAKKLLKLEAGSELKTWLLIARIMSAQKRFEDAECIVDAALDQAGKWSQGDLLQTKAKIQIAHGQFRKAIETYTQLLALIQLIVKSFGAGISVLQGTRTDKSLEIKTWYDLALLYLRMSQWKDAELCISKIKAISPYSPLACHAIGKLNEGKGFMKEALRAYSTALDLDPKHVPSLLSTATVLRQLYKKPLPVARCFLTDALRLDRTNHVAWFNLGLLYEDEGDSAAIEAAECFRAAALLEENAPAEPFR

SEQ ID NO: 6787 - DNA, 1299 bp, Sorghum bicolor
  misc_feature: Ceres ANNOT ID no. 6068431
  misc_feature: Encodes the peptide sequence at SEQ ID NO 6788
atggtgatgctatcgggcatcgggagcaggaagccgcctcccttcctctcgtcctcctcctcgtcgtactccaagcgctcccgcgccgcccggcgcctgccgtccctgcccaggccgcctgtcgcgccgccagcgccacaccccgccgcgaggtggaggaggaggaaggcgcccgcccggctgtggatgaggatggatcggtggggcaggtgcgaggtgttcatgagcgacagggccttcgtcgcggaacgctccggggtgcacgcgcgcgacctccgcgtcgtcgggccccttctctcccgctgtcccagcatcctcgctcgagagaaggccatggtaatcaatctggagttcataagagctattgtaaccgctgatgaagtcctgctgctggaacctcttgctcaggaggttattcctttcatcgataaattgaggcggcattttccattgaagagcgtggaggttgacgttggtgccacacaagtgggtaatgtggatggcaagcatgctaaaactggtgcagagtgtgggctcccctttgagtttcaggtgctggagctcgccctagaagctgtatgcttatcatttcactccagcctatctgatcttaataagcatgcaatttttgtgctggatgagttgactgagaacgtgagcactaggaatctcgagcgtgttcgaagcctgaaaagaaatctaacctctctgctcgctggtgtgcacaaggtcagagatgaagtagagcatcttttggatcataatgaaaatagggcacaactgcacctatcaaggaagcaaataaaaagtccgcaggatgaagctctactggtctcttctgctttaaattgcaattttccttcaaaaacaaacctggatatacgaaattctgttattaaccaaggcacgggcattgctgtggttgcgccattggacgacactgtaggagacctagagatgttacttgaatcttatttcatgcagctggatggaattcgcaacagaattacgatggtccgaggatatatcgttgacacagaagactacatcaacatccaacttgacaacctacgcaatggacttattcagctccatctcatactgattattgtatcctttggcatatccaccaacacgttgatagctgcatcgtttgccatcaacatgcctaacaatggggactataagaagtttgtaggtgacttttggcaatttgttgggggcacatcatctttctgcttgctggtcatcgttgttttgttggggtatgcatggaggaacaggctactcggcagttga

SEQ ID NO: 6788 - protein, 432 aa, Sorghum bicolor
  misc_feature: Ceres ANNOT ID no. 6068431
  misc_feature (57)..(430): Pfam Id: CorA Pfam Desc: CorA-like Mg2+ transporter protein
  misc_feature (12)..(432): NCBI GI: 25360850 NCBI Desc: mrs2-4 [arabidopsis thaliana]
  misc_feature (17)..(432): NCBI GI: 92889086 NCBI Desc: mg2+ transporter protein, cora-like [medicago truncatula]
  misc_feature (18)..(429): NCBI GI: 30688025 NCBI Desc: magnesium transporter cora-like family protein (mrs2-6) [arabidopsis thaliana]
  misc_feature (18)..(429): NCBI GI: 25360918 NCBI Desc: mrs2-6 [arabidopsis thaliana]
  misc_feature (53)..(432): NCBI GI: 25360941 NCBI Desc: mrs2-7 [arabidopsis thaliana]
MVMLSGIGSRKPPPFLSSSSSSYSKRSRAARRLPSLPRPPVAPPAPHPAARWRRRKAPARLWMRMDRWGRCEVFMSDRAFVAERSGVHARDLRVVGPLLSRCPSILAREKAMVINLEFIRAIVTADEVLLLEPLAQEVIPFIDKLRRHFPLKSVEVDVGATQVGNVDGKHAKTGAECGLPFEFQVLELALEAVCLSFHSSLSDLNKHAIFVLDELTENVSTRNLERVRSLKRNLTSLLAGVHKVRDEVEHLLDHNENRAQLHLSRKQIKSPQDEALLVSSALNCNFPSKTNLDIRNSVINQGTGIAVVAPLDDTVGDLEMLLESYFMQLDGIRNRITMVRGYIVDTEDYINIQLDNLRNGLIQLHLILIIVSFGISTNTLIAASFAINMPNNGDYKKFVGDFWQFVGGTSSFCLLVIVVLLGYAWRNRLLGS

SEQ ID NO: 6789 - DNA, 378 bp, Sorghum bicolor
  misc_feature: Ceres ANNOT ID no. 6068446
  misc_feature: Encodes the peptide sequence at SEQ ID NO 6790
atggagtccgtggtgaacccgaaggcgtacccgctggctgatgcgcagctgacgatgggtatcctcgacatcatccagcaggcggccaactacaagcagctcaagaagggagctaatgaagcgaccaagaccctcaacagggggatatcggagttcgtagtgatggcggcggacacggagccgctcgagatcctgctccacctcccattgctagctgaggataagaacgtgccatatgtatttgttccatcaaaacaagctcttggccgagcttgtggggtgacaaggccggtcattgcttgctcagtgaccagcaatgagggtagccagctgaaacaacagatacagggtctcaaggtacttaatattgtcttgtag

SEQ ID NO: 6790 - protein, 125 aa, Sorghum bicolor
  misc_feature: Ceres ANNOT ID no. 6068446
  misc_feature (19)..(113): Pfam Id: Ribosomal_L7Ae Pfam Desc: Ribosomal protein L7Ae/L30e/S12e/Gadd45 family
  misc_feature (2)..(119): NCBI GI: 47027071 NCBI Desc: ribosomal protein l7 [hyacinthus orientalis]
  misc_feature (5)..(119): NCBI GI: 21592866 NCBI Desc: ribosomal protein l7ae-like [arabidopsis thaliana]
  misc_feature (4)..(119): NCBI GI: 21592608 NCBI Desc: ribosomal protein l7ae-like [arabidopsis thaliana]
  misc_feature (4)..(119): NCBI GI: 21554922 NCBI Desc: ribosomal protein l7ae-like [arabidopsis thaliana]
  misc_feature (5)..(119): NCBI GI: 119720778 NCBI Desc: ribosomal protein l7ae-like [brassica rapa]
MESVVNPKAYPLADAQLTMGILDIIQQAANYKQLKKGANEATKTLNRGISEFVVMAADTEPLEILLHLPLLAEDKNVPYVFVPSKQALGRACGVTRPVIACSVTSNEGSQLKQQIQGLKVLNIVL

SEQ ID NO: 6791 - DNA, 1104 bp, Sorghum bicolor
  misc_feature: Ceres ANNOT ID no. 6068448
  misc_feature: Encodes the peptide sequence at SEQ ID NO 6792
atggaggcggcgacgatggcgtggacggcggcggtggtcggggtggggctggtgtactggttcgtctgggtcatgggcgcggcggaggtgaagggcaagcgggcggtggatctcaagatgggatccatcacgcgggacaaggtgcaggacaagtacacgcagtactggtccttcttccgccgccccaaggagacggccaccaccgcggcgtcggcggagaaggtgccggccttcgtcgacaccttctacaacctcgtcaccgacatctacgagtggggctggggccagtccttccacttctccccgtcgctcccaggccgctcccaccgcgacgccacgcgcgtccacgaggagcgcgtcgccgacctcctcggcgccaggccaggccaccgcctcctcgacgtcggctgcggcgtcggcgggcccatgcgcgccatcgccgcgcactcgggatccaacgtcgtcggcatcaccatcaacgagtaccaggtgaaccgcgcccgcgcgcacaaccgcaaggccggcctcgactccccgcgctgcgaggtcgtctgcggcaacttcctctccatgcccttccccgacggctccttcgacggcgcctactccatcgaggccacctgccacgcgcccaggctgcaggacgtctacggcgaggtcttccgcgtgctcaagccgggcgggttctacgtctcctacgagtgggtcaccaccccgctgtaccgcgccgaggaccccgaacacgtcgagtgcatccacggcatcgagcgcggcgacgcgctcccggggctccgccgccaggacgagatctcgtccatcgccaaggaggtcggcttcgaggtggtcaaggagcaggacctggcgcttccccccgcgctgccctggtggacgcgcctcaagatgggccgcgtcgcctactggcgcaactccctcgtcgtccgcgtgctcaccatgctccggatcgcgcccaagggtgtctccgaggtgcacgagatgctgtacgagaccgcgcagcacctcacccgcggcggcgagaccggcatcttcacgcccatgcacatggtgctcctccgcaagcctgtctccaccgaggaggcgaaatag

SEQ ID NO: 6792 - protein, 367 aa, Sorghum bicolor
  misc_feature: Ceres ANNOT ID no. 6068448
  misc_feature (241)..(360): Pfam Id: Sterol_MT_C Pfam Desc: Sterol methyltransferase C-terminal
  misc_feature (133)..(232): Pfam Id: Methyltransf_11 Pfam Desc: Methyltransferase domain
  misc_feature (133)..(230): Pfam Id: Methyltransf_12 Pfam Desc: Methyltransferase domain
  misc_feature (72)..(320): Pfam Id: CMAS Pfam Desc: Cyclopropane-fatty-acyl-phospholipid synthase
  misc_feature (112)..(294): Pfam Id: Ubie_methyltran Pfam Desc: ubiE/COQ5 methyltransferase family
  misc_feature (1)..(364): NCBI GI: 68566013 NCBI Desc: 24-methylenesterol c-methyltransferase 2 (24-sterol c-methyltransferase 2) (sterol-c-methyltransferase 2)
  misc_feature (1)..(364): NCBI GI: 3560533 NCBI Desc: 24-methylene lophenol c24(1)methyltransferase [oryza sativa]
  misc_feature (1)..(360): NCBI GI: 2246454 NCBI Desc: s-adenosyl-methionine-sterol-c- methyltransferase [nicotiana tabacum]
  misc_feature (1)..(366): NCBI GI: 22136020 NCBI Desc: 24-sterol c-methyltransferase [arabidopsis thaliana]
  misc_feature (1)..(366): NCBI GI: 1061040 NCBI Desc: sterol-c-methyltransferase [arabidopsis thaliana]
  misc_feature (1)..(364): SWISSPROT Homolog: EC 2.1.1.143 24-methylenesterol C-methyltransferase 2
MEAATMAWTAAVVGVGLVYWFVWVMGAAEVKGKRAVDLKMGSITRDKVQDKYTQYWSFFRRPKETATTAASAEKVPAFVDTFYNLVTDIYEWGWGQSFHFSPSLPGRSHRDATRVHEERVADLLGARPGHRLLDVGCGVGGPMRAIAAHSGSNVVGITINEYQVNRARAHNRKAGLDSPRCEVVCGNFLSMPFPDGSFDGAYSIEATCHAPRLQDVYGEVFRVLKPGGFYVSYEWVTTPLYRAEDPEHVECIHGIERGDALPGLRRQDEISSIAKEVGFEVVKEQDLALPPALPWWTRLKMGRVAYWRNSLVVRVLTMLRIAPKGVSEVHEMLYETAQHLTRGGETGIFTPMHMVLLRKPVSTEEAK

SEQ ID NO: 6793 - DNA, 1923 bp, Sorghum bicolor
  misc_feature: Ceres ANNOT ID no. 6068457
  misc_feature: Encodes the peptide sequence at SEQ ID NO 6794
atgcccccgcctctcccgccagatccgatcgagccgtgcgcgccggcgccggcgatggacgcggcgctacccgccgcagtcgtcgccaccatcctctcccgcctcgacgtccgctccctgctcctcgccgccgccgcctgccgcggcctccgcgcctgcgcctcccacgcgctcgccttcctcccctccttccacctcctcgaggtagccctgacgcacgaactactgcgcccgttgctgccgctgaacccgagcctgcggagcctgcgcctcgactgcgctcgcctcgaggatgccgccatcgcctgcctcgcacgccccggcctgcacgagctcctccttctcaactgcgacaacatcagcggccgcctgctctgcgagctcggcaccacctgcagagatctcagggtgctttctctcaactctcttggtgcacgtaggggactggtggtaaatttctctgatctacaggaattgctcaatggatgttctcagctagagagtctgagattggcacttgatttctcaacttttgatgaccctgactttggtcgtgtatgggcatctgcttctgaaaagctatcatctcttgagatcggttatattcctatgacaatgttacttgaacttctggcagcagttacagaagcacaacaatacatggattatgttaaggcaccagttttctttcctagccttcaaaagttatgcctggctgtggatttcataaccgaccatctcattggttccatatcagtcgcacttccatcactgactcatctggacctgcaagatgcacccattgtggagcctaattcatcatcagatctcaccaatgctggtcttcagcaaatcaatccacatggtaaactgaagcatatttctctcatgcgcagccaggaattcttagtaacatccttccgtcgagtgaatgatcttggaatcctgttgatggctgacaggtgttcaaatcttgagagtgtatgcctaggtggtttctctcgtgttacagacactggtttcagggcaattattcactcttgttctggtcttcacaagcttcgggtgtcccatggaagccatttaactgatctggttttccatgacattatagccacttctctttgcctaacacatgtgagtctaaggtggtgcaaactcctaactaatgttgggattgagagattatcatgcaacaaggatctcaatgtactggatcttagggattgccgcagtttgggtgatgaagctgttagagctctgagttgccttcccaagttacagactttgacgttggatggcactgatattagcgaccaatcattgaaatatctgggacttggaacatgtcctctaacttccttgtctctgagggggtgccggaagcttacaaatgattgtatcactttgttatttgctggccctgtgaagcagagcctgcaggtgttggatctctccagaattccaagtatcacagatgatggtatcatgttgttagcaaggagcagaactcctcttattgagctccgaatgcgagaaaatccaaaaatcggggatgcctctgtgatggctcttgcttccatgcaattggatggtggaacttgtggcagcagcttgcagctgctggatctttttgactgtggtgggattacaccccttgcaactcgttggtttaagaaaccttacttccctagattgcggtggctgggaattacaggtagcttgaatagggttatggtggatgcactgtctcgaagccggcctttcttacatatggcttgtcgtggtgaagaattagggtctatgctctgggacacctcctctgactggtatcggcacaatgacgatgatcttgatgagctcgaacagtggctcttggagggtgagccggtttcagatgatgacaccatcatggaagaatga

SEQ ID NO: 6794 - protein, 640 aa, Sorghum bicolor
  misc_feature: Ceres ANNOT ID no. 6068457
  misc_feature (23)..(638): NCBI GI: 92898823 NCBI Desc: cyclin-like f-box [medicago truncatula]
  misc_feature (19)..(605): NCBI GI: 24111385 NCBI Desc: at1g55590/f20n2_18 [arabidopsis thaliana]
  misc_feature (232)..(571): NCBI GI: 42407347 NCBI Desc: f-box protein family-like [oryza sativa (japonica cultivar-group)]
  misc_feature (310)..(551): NCBI GI: 50415070 NCBI Desc: mgc81000 protein [xenopus laevis]
  misc_feature (310)..(551): NCBI GI: 16306582 NCBI Desc: f-box and leucine-rich repeat protein 2 [homo sapiens]
MPPPLPPDPIEPCAPAPAMDAALPAAVVATILSRLDVRSLLLAAAACRGLRACASHALAFLPSFHLLEVALTHELLRPLLPLNPSLRSLRLDCARLEDAAIACLARPGLHELLLLNCDNISGRLLCELGTTCRDLRVLSLNSLGARRGLVVNFSDLQELLNGCSQLESLRLALDFSTFDDPDFGRVWASASEKLSSLEIGYIPMTMLLELLAAVTEAQQYMDYVKAPVFFPSLQKLCLAVDFITDHLIGSISVALPSLTHLDLQDAPIVEPNSSSDLTNAGLQQINPHGKLKHISLMRSQEFLVTSFRRVNDLGILLMADRCSNLESVCLGGFSRVTDTGFRAIIHSCSGLHKLRVSHGSHLTDLVFHDIIATSLCLTHVSLRWCKLLTNVGIERLSCNKDLNVLDLRDCRSLGDEAVRALSCLPKLQTLTLDGTDISDQSLKYLGLGTCPLTSLSLRGCRKLTNDCITLLFAGPVKQSLQVLDLSRIPSITDDGIMLLARSRTPLIELRMRENPKIGDASVMALASMQLDGGTCGSSLQLLDLFDCGGITPLATRWFKKPYFPRLRWLGITGSLNRVMVDALSRSRPFLHMACRGEELGSMLWDTSSDWYRHNDDDLDELEQWLLEGEPVSDDDTIMEE

SEQ ID NO: 6795 - DNA, 675 bp, Sorghum bicolor
  misc_feature: Ceres ANNOT ID no. 6068458
  misc_feature: Encodes the peptide sequence at SEQ ID NO 6796
atggcggcgccggtgacggtgtacgggccggtgatctcaccggcggtggcccgcgtggcggcctgcctcctggagaaggacgtgccgttccagatcgagccggtggacatgtccaagggcgagcacaagtcgccgtccttcctcaagctccagcccttcggccaggtccctgccttcaaggaccacctcacaaccgtctttgagtcaagggctatttgccgttacatatgtgatcagtatgcggaccgtggtaaccaggcgctctttggcaagaaagaagatggtgcggttggccgtgctgccattgaacaatggatagagtctgaaggccagagctttaacccaccgagcctggctattatcttccagcttgcatttgcaccaatgatgggccgggccactgacctggctgtggttgagcagaatgaagccaaactcgctaaggtgcttgatgtgtatgaccaacggctgggggagagccagtactttgctggtgatgatttctccctggccgaccttgtgcacttgcccaatgcggatttccttgtgaacaggactaacaaggctggcttgatcaccgaaagaaagaatctggctagatggtgggatgatgtctcggctcgtcctgcatggaaaaaggttactgagatgcagagcacaccgaggtcctcttag

SEQ ID NO: 6796 - protein, 224 aa, Sorghum bicolor
  misc_feature: Ceres ANNOT ID no. 6068458
  misc_feature (3)..(78): Pfam Id: GST_N Pfam Desc: Glutathione S-transferase, N-terminal domain
  misc_feature (117)..(209): Pfam Id: GST_C Pfam Desc: Glutathione S-transferase, C-terminal domain
  misc_feature (1)..(196): NCBI GI: 11385471 NCBI Desc: glutathione s-transferase gst 10 [zea mays]
  misc_feature (8)..(221): NCBI GI: 11385459 NCBI Desc: glutathione s-transferase gst 22 [glycine max]
  misc_feature (1)..(218): NCBI GI: 11385469 NCBI Desc: glutathione s-transferase gst 9 [zea mays]
  misc_feature (5)..(211): NCBI GI: 114795078 NCBI Desc: glutathione s-transferase [pyrus communis]
  misc_feature (5)..(221): NCBI GI: 11385463 NCBI Desc: glutathione s-transferase gst 24 [glycine max]
MAAPVTVYGPVISPAVARVAACLLEKDVPFQIEPVDMSKGEHKSPSFLKLQPFGQVPAFKDHLTTVFESRAICRYICDQYADRGNQALFGKKEDGAVGRAAIEQWIESEGQSFNPPSLAIIFQLAFAPMMGRATDLAVVEQNEAKLAKVLDVYDQRLGESQYFAGDDFSLADLVHLPNADFLVNRTNKAGLITERKNLARWWDDVSARPAWKKVTEMQSTPRSS

SEQ ID NO: 6797 - DNA, 681 bp, Sorghum bicolor
  misc_feature: Ceres ANNOT ID no. 6068459
  misc_feature: Encodes the peptide sequence at SEQ ID NO 6798
atggcagcaggtttgcaagtgtttggccagccggcatctactgatgttgccagggttctgacatgcctgtttgagaagaaattggaatttgagcttgtccgcatcgatacatttaagacacatcacaagcttcctgagttcattaggctgcgggatccgaatggccaagtgaccttcaagcatggcgacaaaactcttgttgattcaagggatatatgccggtatgtttgtaaccaatttccaaatgacggaaacaagaccctttatggatctggtgctctagaacgggcatcaatagaacagtggcttcaggcagaagctcaaaactttggccctcccagttctgcacttgtctttcagctggcatttattcctcatctcagtcatctgggcattcgtcaggaccctgctgttattgctgaaaatgaggataaactgaagcaggtccttgatgtttatgacgaaatactctccaagaatgagtacctggctggtgatgaattcaccttggctgacctttctcaccttccaaactcgcactacatcgtgaatactgaaaggggaagaaagctcttcactaacaagaagaatgtggcaaaatggtatgacaaactctccaagctcgagacatggaagcaggttgtcaagatgcagaaggaacatcctggcgcatttgagtaa

SEQ ID NO: 6798 - protein, 226 aa, Sorghum bicolor
  misc_feature: Ceres ANNOT ID no. 6068459
  misc_feature (3)..(78): Pfam Id: GST_N Pfam Desc: Glutathione S-transferase, N-terminal domain
  misc_feature (118)..(209): Pfam Id: GST_C Pfam Desc: Glutathione S-transferase, C-terminal domain
  misc_feature (1)..(226): NCBI GI: 11385469 NCBI Desc: glutathione s-transferase gst 9 [zea mays]
  misc_feature (1)..(226): NCBI GI: 11385475 NCBI Desc: glutathione s-transferase gst 12 [zea mays]
  misc_feature (1)..(226): NCBI GI: 11385477 NCBI Desc: glutathione s-transferase gst 13 [zea mays]
  misc_feature (95)..(226): NCBI GI: 115450569 NCBI Desc: os03g0135200 [oryza sativa (japonica cultivar-group)]
  misc_feature (5)..(155): NCBI GI: 11385479 NCBI Desc: glutathione s-transferase gst 14 [zea mays]
MAAGLQVFGQPASTDVARVLTCLFEKKLEFELVRIDTFKTHHKLPEFIRLRDPNGQVTFKHGDKTLVDSRDICRYVCNQFPNDGNKTLYGSGALERASIEQWLQAEAQNFGPPSSALVFQLAFIPHLSHLGIRQDPAVIAENEDKLKQVLDVYDEILSKNEYLAGDEFTLADLSHLPNSHYIVNTERGRKLFTNKKNVAKWYDKLSKLETWKQVVKMQKEHPGAFE

SEQ ID NO: 6799 - DNA, 1641 bp, Sorghum bicolor
  misc_feature: Ceres ANNOT ID no. 6068468
  misc_feature: Encodes the peptide sequence at SEQ ID NO 6800
atggaggccggcacggtgcggtgcgcggccaaccacgcgccgctgtcgccgatcagcttcatcgagcgcgccgccgccgtctacggggcccgccccgcggtggtgtacggggaccggcgccacacgtgggcggagacgcgggggcgctgcctccgcgtggcggccgcgctcgccacacgcttcggcgtcgcgcgcggtgatgtggtcgctgtcctcagccccaacgtgccggcgatgtacgagctgcacttcgccgtgcccatggccggcgcggtgctctgcacgttcaacacgcggcacgacgcggccatggtgtccgtcctgctgaagcactccggcgccaaggtgttcctcgtcgagtcgaacctcctcgacgtcgggagagccgcgttgaagcgcctcggcgagtccaactccgccgcccttccggtcctgctcaccatctcagacgacaccgactccgacgactacgaggatctcgtcaggaacgcccccgaccggttcgacatccggtggccggcggacgagctggacccgatctcgctcaactacacgtccggcacgacgtcgcggcccaagggcgtggtgtacagccaccgcggcgcgtacctcaacaccatcgccacggtgctcgcgtacgacatcaccgccatgccgacgtacctgtggaccgtgcccatgttccactgcaacggctggaacctgccgtggggcgtcgccatgcagggcggcaccaacgtatgcctccgccacttcaccgccggggtcatcttcgacagcatcgcgcggcacggcgtgacgcacatgggcggcgcgcccacggtgctgaacatgatcgccaacgcgccgcccgcggaccggatgccgctgccggggcccgtccgcgtcatgacgggcggcgcgccgccgccgccgcgcgtcctgttcgcggtggaggagctcggcttcgtggtgtaccacatctacggcctcacggagacgtacggcccggcgaccgtgtgcacgtggatgcccgagtgggacgcgctgccggcggagcaccgcgcgcggctcaaggcgcggcaggggttccaccacatcgcgatgcaggacgcggacgtcaagaacccaacaacgatggagtgcgtgccgcacgacggcgagacggtgggcgaggtgatgttccgaggcaacaccgtgatgagcggctactacaaggacctgaaggcgaccaaggagtcgatggccggcgggtggctgcacaccggggacctcgccgtgcggcaccccgacgggtacatcgagctcaaggaccgggccaaggacatcatcatctcgggcggcgagaacatcagctccatcgaggtggagtcagtgatcttcagccaccctgccgtcctcgaggcggcggtcgtggcgcggccagacgaccactggggcgagacgccgtgcgcgttcgtcaagctcaaggacggcgccagcgccacggaagcggagatcataagcttctgccgggagaggctgccccactacatggcgcccaagacggtggtgttcgaggatatgcccaagacttcaacggggaagacgcagaagtttgttctccgtgataaggctcgcgccatgggcagcctgacaaagattgccagcagcaaaatgtaa

SEQ ID NO: 6800 - protein, 546 aa, Sorghum bicolor
  misc_feature: Ceres ANNOT ID no. 6068468
  misc_feature (42)..(464): Pfam Id: AMP-binding Pfam Desc: AMP-binding enzyme
  misc_feature (1)..(546): NCBI GI: 18394877 NCBI Desc: amp-dependent synthetase and ligase family protein [arabidopsis thaliana]
  misc_feature (1)..(546): NCBI GI: 20799711 NCBI Desc: adenosine monophosphate binding protein 1 ampbp1 [arabidopsis thaliana]
  misc_feature (1)..(546): NCBI GI: 18700260 NCBI Desc: at1g20560/f2d10_4 [arabidopsis thaliana]
  misc_feature (69)..(546): NCBI GI: 8778599 NCBI Desc: f5m15.12 [arabidopsis thaliana]
  misc_feature (69)..(546): NCBI GI: 8886956 NCBI Desc: f2d10.4 [arabidopsis thaliana]
MEAGTVRCAANHAPLSPISFIERAAAVYGARPAVVYGDRRHTWAETRGRCLRVAAALATRFGVARGDVVAVLSPNVPAMYELHFAVPMAGAVLCTFNTRHDAAMVSVLLKHSGAKVFLVESNLLDVGRAALKRLGESNSAALPVLLTISDDTDSDDYEDLVRNAPDRFDIRWPADELDPISLNYTSGTTSRPKGVVYSHRGAYLNTIATVLAYDITAMPTYLWTVPMFHCNGWNLPWGVAMQGGTNVCLRHFTAGVIFDSIARHGVTHMGGAPTVLNMIANAPPADRMPLPGPVRVMTGGAPPPPRVLFAVEELGFVVYHIYGLTETYGPATVCTWMPEWDALPAEHRARLKARQGFHHIAMQDADVKNPTTMECVPHDGETVGEVMFRGNTVMSGYYKDLKATKESMAGGWLHTGDLAVRHPDGYIELKDRAKDIIISGGENISSIEVESVIFSHPAVLEAAVVARPDDHWGETPCAFVKLKDGASATEAEIISFCRERLPHYMAPKTVVFEDMPKTSTGKTQKFVLRDKARAMGSLTKIASSKM

SEQ ID NO: 6801 - DNA, 576 bp, Sorghum bicolor
  misc_feature: Ceres ANNOT ID no. 6068470
  misc_feature: Encodes the peptide sequence at SEQ ID NO 6802
atgtcgagccggagacaggcgtggcagtttgcggctgcgctggtcttcttccacggctctgagtatgtcctcgctgccgctttccacggccgccagaacgtcaccgctacttcacttcttattagcaagcagtatgtattggcaatgggttttgcaatgctggaacacctgacagaaattcttattttcccggaagtaaaggagtactggtttgtcagtaatactggccttgtaatggttattgtcggtgaaattatccgtaaacttgctgtagtgacagctggacgttccttcacgcacgttataagaacttattatgaagatcagcatcagttgatcacccatggactgtataggtttatgcgccatcctgggtattctggctttcttatatgggcagtaggaacccaggttatgctgtgtaatccattatcaacagttgcattcacactggtcttgtggagattcttttcaaaacggataccgtatgaagaatttttcttgaggcagttctttggctcagagtacgatgaatacgcacagagagtacactctggattaccatttattaaatga

SEQ ID NO: 6802 - protein, 191 aa, Sorghum bicolor
  misc_feature: Ceres ANNOT ID no. 6068470
  misc_feature (74)..(170): Pfam Id: ICMT Pfam Desc: Isoprenylcysteine carboxyl methyltransferase (ICMT) family
  misc_feature (1)..(191): NCBI GI: 38344151 NCBI Desc: osjnba0041a02.18 [oryza sativa (japonica cultivar-group)]
  misc_feature (1)..(191): NCBI GI: 116310933 NCBI Desc: b0403h10-osigba0105a11.23 [oryza sativa (indica cultivar-group)]
  misc_feature (38)..(191): NCBI GI: 115460354 NCBI Desc: os04g0602900 [oryza sativa (japonica cultivar-group)]
  misc_feature (2)..(190): NCBI GI: 10177821 NCBI Desc: farnesyl cysteine carboxyl methyltransferase-like protein [arabidopsis thaliana]
  misc_feature (8)..(191): NCBI GI: 1906804 NCBI Desc: farnesyl cysteine carboxyl methyltransferase [xenopus laevis]
MSSRRQAWQFAAALVFFHGSEYVLAAAFHGRQNVTATSLLISKQYVLAMGFAMLEHLTEILIFPEVKEYWFVSNTGLVMVIVGEIIRKLAVVTAGRSFTHVIRTYYEDQHQLITHGLYRFMRHPGYSGFLIWAVGTQVMLCNPLSTVAFTLVLWRFFSKRIPYEEFFLRQFFGSEYDEYAQRVHSGLPFIK

SEQ ID NO: 6803 - DNA, 1206 bp, Sorghum bicolor
  misc_feature: Ceres ANNOT ID no. 6068473
  misc_feature: Encodes the peptide sequence at SEQ ID NO 6804
  misc_feature: Up-regulated in shoot tissues in response to methyl jasmonate treatment
  misc_feature: Up-regulated in root tissues in response to methyl jasmonate treatment
  misc_feature: Down-regulated in shoot tissues in response to aminocyclopropane carboxylic treatment
atggacgttgactcggacccggccgcctcgagcaagcccacgcagatggacctcgaggaacagacggacacgaaggggaaggggaaggggaaggcagaggaggggagcgggaagggcgaggagctcgcggactccatcagtagcctctcaatcggtcaggggcgcaccaatttcaagaagaagcctgtgatcatcatcgtcatcggcatggctgggacggggaagacgactttgatgcaccggctggtatgcgatacgcagggatcaaataagaggggctacgtcgtcaacctcgaccctgcggtgatgaccttgccattcggggccaacattgatattcgtgacactgtgcggtataaggatgtgatgaaggagtacacccttggtcccaatggtggcatcctcacctcgcttaacttgtttgccactaagtttgatgaggttgtgtctgtcattgaaaggcgtgcggaccaattggattatgtactggtggacactcctggtcagattgagatcttcacttggtcagcttcaggagctatcattactgaagcttttgcatcgacgtttccaacagttgtagcatatgttgttgacactcccagatcaacaaaccctgttactttcatgagcaacatgctctatgcctgcagtattctctacaaaactcgcctccctctagtcctgacattcaacaaggttgatgttgccaaacatgagttcgctatcgaatggatgcaagactttgaggcgtttcagacagctttggaatcggacaaatcgtactccgctacatatacacgaagcctctccctggctcttgacgaattctacaagaatttgcgctctgttggagtatctgcgatttctggtgctggagtcaatacattttttgaagctatagaagcaagcgccaaggaatacatggaaacctacagggctgatcttgacaagaggattgctgaaaaggaaagattggaggaagaacgcaggaaggagaatatggaaaaattgcagaaagatatgatgaaatccaaaggacaaactgtggttctcagcactgggttgaaggacaaaaattctgtttctgacatgatggatgatgccgatgaggaggaagaagaggaagcattggaagattttgggttttctgaggaagatgaagatgaaggagaagacgaggaagtggctcattttggtttttga

SEQ ID NO: 6804 - protein, 401 aa, Sorghum bicolor
  misc_feature: Ceres ANNOT ID no. 6068473
  misc_feature (67)..(307): Pfam Id: ATP_bind_1 Pfam Desc: Conserved hypothetical ATP binding protein
  misc_feature (38)..(399): NCBI GI: 23505917 NCBI Desc: at4g21800/f17l22_260 [arabidopsis thaliana]
  misc_feature (60)..(401): NCBI GI: 3646130 NCBI Desc: atp(gtp)-binding protein [homo sapiens]
  misc_feature (60)..(401): NCBI GI: 123993209 NCBI Desc: xpa binding protein 1, gtpase [synthetic construct]
  misc_feature (60)..(342): NCBI GI: 119620962 NCBI Desc: xpa binding protein 1, gtpase, isoform cra_a [homo sapiens]
  misc_feature (42)..(399): NCBI GI: 108873772 NCBI Desc: xpa-binding protein 1 (mbdin) [aedes aegypti]
  misc_feature: Up-regulated in shoot tissues in response to methyl jasmonate treatment
  misc_feature: Up-regulated in root tissues in response to methyl jasmonate treatment
  misc_feature: Down-regulated in shoot tissues in response to aminocyclopropane carboxylic treatment
MDVDSDPAASSKPTQMDLEEQTDTKGKGKGKAEEGSGKGEELADSISSLSIGQGRTNFKKKPVIIIVIGMAGTGKTTLMHRLVCDTQGSNKRGYVVNLDPAVMTLPFGANIDIRDTVRYKDVMKEYTLGPNGGILTSLNLFATKFDEVVSVIERRADQLDYVLVDTPGQIEIFTWSASGAIITEAFASTFPTVVAYVVDTPRSTNPVTFMSNMLYACSILYKTRLPLVLTFNKVDVAKHEFAIEWMQDFEAFQTALESDKSYSATYTRSLSLALDEFYKNLRSVGVSAISGAGVNTFFEAIEASAKEYMETYRADLDKRIAEKERLEEERRKENMEKLQKDMMKSKGQTVVLSTGLKDKNSVSDMMDDADEEEEEEALEDFGFSEEDEDEGEDEEVAHFGF

SEQ ID NO: 6805 - DNA, 909 bp, Sorghum bicolor
  misc_feature: Ceres ANNOT ID no. 6068481
  misc_feature: Encodes the peptide sequence at SEQ ID NO 6806
atggccgcggcgccgtccatggaggtggagcaggatctcccaggcttccggttccaccccaccgaggaggagctcctcagcttctacctctcccgcgtggtccacggcaagcagctccacttcgacatcatcggcaccctcaacatctaccgccatgacccctgggaccttcctgcgatggcgaagatcggggagcgggagtggtacttcttcgtgccgcgcgaccgcaaggccggcaacggcgggcggccgaaccggacgacggagcgcgggttctggaaggccacggggtcggacaggtccatccggagctccggcgacgccaagcgcgtgatcgggctcaagaagacgctcgtcttctaccaggggcgcgccccgcgcggcaccaagacggactgggtcatgaacgagtaccgcctccccgaccacgccgccgccggccgcgccgcgccgccggctcccaaggaggacatggtgctgtgcaagatctacaggaaggccacaccactgaaggagctggaacagagggcctctgccatggaggagatgcagaggcgcagcagcgcggccagagcagcatccctggcccaggccgcaggctccgccgtcgacgactacctgtcggtgtcgtcggaggacgcccacgatagcaccttcctgcatttcccgtcctcgtcctcgtccccgccgtcgggcgacagctacggcgcgccggcgccggcgcccagggaggccaagacggaagccgcggaccccccggcggtgaggcacggtgacctgcccaccctgcaggtgccgacgaacaacctcggagtcgcggactggacgcagatgcaggacccgttccagctgcgcagcccgtggcaggaccagcttttcttctctcccttagcccacctgctctactga

SEQ ID NO: 6806 - protein, 302 aa, Sorghum bicolor
  misc_feature: Ceres ANNOT ID no. 6068481
  misc_feature (12)..(141): Pfam Id: NAM Pfam Desc: No apical meristem (NAM) protein
  misc_feature (6)..(194): NCBI GI: 62546193 NCBI Desc: nac6 protein [glycine max]
  misc_feature (12)..(278): NCBI GI: 2264373 NCBI Desc: nam (no apical meristem)-like protein [arabidopsis thaliana]
  misc_feature (33)..(278): NCBI GI: 20857250 NCBI Desc: at2g17040/at2g17040 [arabidopsis thaliana]
  misc_feature (13)..(233): NCBI GI: 20197337 NCBI Desc: nam (no apical meristem)-like protein [arabidopsis thaliana]
  misc_feature (13)..(148): NCBI GI: 115474489 NCBI Desc: os08g0113500 [oryza sativa (japonica cultivar-group)]
  misc_feature: The sequence is a functional homolog of SEQ ID NO 745 in the 11/479,226US patent application
  misc_feature: The sequence is a functional homolog of SEQ ID NO 853 in the 10/374,780US patent application
  misc_feature: Useful for making plants with modulated growth and phenotype characteristics
  misc_feature: The sequence is a functional homolog of SEQ ID NO 853 in the 20060162006 US patent application
  misc_feature: The sequence is a functional homolog of SEQ ID NO 745 in the 20070022495 US patent application
  misc_feature: The sequence is a functional homolog of SEQ ID NO 745 in the 11/479,226 US patent application
  misc_feature: The sequence is a functional homolog of SEQ ID NO 2 in US patent 7230164
  misc_feature: The sequence is a functional homolog of SEQ ID NO 6 in US patent 7230160
  misc_feature: The sequence is a functional homolog of SEQ ID NO 116 in the 10/225,066 US patent application
  misc_feature: The sequence is a functional homolog of SEQ ID NO 2476 in the 10/374,780 US patent application
  misc_feature: The sequence is a functional homolog of SEQ ID NO 88 in the 11/375,241 US patent application
  misc_feature: The sequence is a functional homolog of SEQ ID NO 853 in the 10/374,780 US patent application
  misc_feature: Useful for making plants with altered terpenoid content
  misc_feature: Functional homolog of the protein sequence given in SEQ ID NO 13966
  misc_feature: The sequence is a functional homolog of SEQ ID NO 854 in the 11/435,388 US patent application
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 851 in the 10/374,780 US patent application
  misc_feature: The sequence is a functional homolog of SEQ ID NO 104 in the 10/225,068 US patent application
  misc_feature: The sequence is a functional homolog of SEQ ID NO 2014 in the 10/374,780 US patent application
  misc_feature: The sequence is a functional homolog of SEQ ID NO 22 in the 10/286,264 US patent application
  misc_feature: The sequence is a functional homolog of SEQ ID NO 314 in the 10/412,699 US patent application
  misc_feature: The sequence is a functional homolog of SEQ ID NO 734 in the 11/479,226 US patent application
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated water use efficiency
  misc_feature: The sequence is a functional homolog of SEQ ID NO 2840 in the 10/374,780 US patent application
  misc_feature: The sequence is a functional homolog of SEQ ID NO 450 in the 10/225,066 US patent application
  misc_feature: Useful for making plants with modulated light quality response
  misc_feature: Functional homolog of the protein sequence given in SEQ ID NO 13870
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MAAAPSMEVEQDLPGFRFHPTEEELLSFYLSRVVHGKQLHFDIIGTLNIYRHDPWDLPAMAKIGEREWYFFVPRDRKAGNGGRPNRTTERGFWKATGSDRSIRSSGDAKRVIGLKKTLVFYQGRAPRGTKTDWVMNEYRLPDHAAAGRAAPPAPKEDMVLCKIYRKATPLKELEQRASAMEEMQRRSSAARAASLAQAAGSAVDDYLSVSSEDAHDSTFLHFPSSSSSPPSGDSYGAPAPAPREAKTEAADPPAVRHGDLPTLQVPTNNLGVADWTQMQDPFQLRSPWQDQLFFSPLAHLLY

SEQ ID NO: 6807 - DNA, 1146 bp, Sorghum bicolor
  misc_feature: Ceres ANNOT ID no. 6068499
  misc_feature: Encodes the peptide sequence at SEQ ID NO 6808
atggaggccgtcctacggcatccatcgctctcgcgcctcaagcctccgaacccgaaccttcccagaacgccatcgccatcccttcctcccccatctctcctccgccttcgggcgcgccggctcatcgccgccgcggtgttccaggaccagaagccgaaggagccagcaagcaagggaggcgatgacgaggaggcctacggcgaggtggaccgcatcgtctccagccgcaccgtcagcagcccggtgttcgcggaggacggctcggccagcgccgccgtcgccacggaatacctggtggagtggaaggacgggcacgagccgtcgtgggtgcccaaggaggccatagccgcggacgtggtggccgagtacgagacgccgtggtggacggcggcgaagaaggcggacgcggaggcgctggcggcgctgctcgcggacgagacgctgcggcgggaccccgacgcggaggacgcgcaggggcgcaccgcggcgcacttcgccgcggggctggggtccgaggagtgcctgcgcgcgctcgccgcggccggggcggacttgggccaccgggagcgcgcggggggagggctcacgccgctgcacatcgcggtcgggtacggccgcgcgggcgccgtgcgcgcgctgctggagctgggcgcggacccggaggcccccgacgggcagggccgcacgccgctggagctggtccaggaggtgctcgccaggacgcccaagggcaacccggcggcgttccagctgcggcaggggcttgaggcggcgcagaaggagctggagaaggccgtgtacgagtgggccgaggtggagaaggtgatcgacggccgcggcgaaggcaagtggcgggagtacctggtggagtggcgcgacggtggcgagagggagtgggtgaaggcggcgtgggtggcagaggacctggtgagcgacttcgaggcagggctggagtacgccgtggcggaggcggtggtcgacaagaggcaggtggcgacggcgacggcggaaggggagaacagatgggagtaccttgtgaaatgggtggacattgaggaggccacatgggagcccgccgagaacgtggacgccgagctcgtgcaggagttcgagctgcggcagtcggggtctgcaggtggtgactga

SEQ ID NO: 6808 - protein, 381 aa, Sorghum bicolor
  misc_feature: Ceres ANNOT ID no. 6068499
  misc_feature (193)..(225): Pfam Id: Ank Pfam Desc: Ankyrin repeat
  misc_feature (320)..(373): Pfam Id: Chromo Pfam Desc: 'chromo' (CHRromatin Organisation MOdifier) domain
  misc_feature (1)..(381): NCBI GI: 75301812 NCBI Desc: probable signal recognition particle 43 kda protein, chloroplast precursor
  misc_feature (6)..(381): NCBI GI: 115450531 NCBI Desc: os03g0131900 [oryza sativa (japonica cultivar-group)]
  misc_feature (3)..(374): NCBI GI: 4102582 NCBI Desc: cao [arabidopsis thaliana]
  misc_feature (96)..(339): NCBI GI: 119358846 NCBI Desc: cao undefined product (ic) [ostreococcus tauri]
  misc_feature (131)..(235): NCBI GI: 19070767 NCBI Desc: apospory-associated protein [oryza sativa]
  misc_feature: The sequence is a functional homolog of SEQ ID NO 1813 in the 10/374,780US patent application
  misc_feature: The sequence is a functional homolog of SEQ ID NO 1839 in the 10/374,780US patent application
  misc_feature: Useful for making plants with altered Lignin content
  misc_feature: Useful for making plants with modulated growth and phenotype characteristics
  misc_feature: GREAT-hit functional homolog of the protein sequence given in SEQ ID NO 13141
  misc_feature: The sequence is a functional homolog of SEQ ID NO 1813 in the 20060162006 US patent application
  misc_feature: The sequence is a functional homolog of SEQ ID NO 1839 in the 20060162006 US patent application
  misc_feature: The sequence is a functional homolog of SEQ ID NO 1813 in the 10/374,780 US patent application
MEAVLRHPSLSRLKPPNPNLPRTPSPSLPPPSLLRLRARRLIAAAVFQDQKPKEPASKGGDDEEAYGEVDRIVSSRTVSSPVFAEDGSASAAVATEYLVEWKDGHEPSWVPKEAIAADVVAEYETPWWTAAKKADAEALAALLADETLRRDPDAEDAQGRTAAHFAAGLGSEECLRALAAAGADLGHRERAGGGLTPLHIAVGYGRAGAVRALLELGADPEAPDGQGRTPLELVQEVLARTPKGNPAAFQLRQGLEAAQKELEKAVYEWAEVEKVIDGRGEGKWREYLVEWRDGGEREWVKAAWVAEDLVSDFEAGLEYAVAEAVVDKRQVATATAEGENRWEYLVKWVDIEEATWEPAENVDAELVQEFELRQSGSAGGD

SEQ ID NO: 6809 - DNA, 1656 bp, Sorghum bicolor
  misc_feature: Ceres ANNOT ID no. 6068502
  misc_feature: Encodes the peptide sequence at SEQ ID NO 6810
atgccggccgggcgcttggtcgaagcgttactcttctttccgctgacgccgtcgtgtttctctcaggcgcggcattacagcacgaggaagggaggcgacggcaccggtcctccgaagccgaaaggtggtggctcctccgcgccaaagaacctcaggccagggggcatattcttctgccccctgtggaaatcatatctgtcacttgcgtttgcgtcctatgtcgtcgatatagtgctattggtaacattcaatttcgatgggtgttcgcctaccggttttcaagcttaccttgttggggggtgcgtgagagatttgctactcaaaagggtacctaaagattttgacgtgattaccactgcaagtctcgaacagcttaagaaaaatatattcaggcgatctatgattgtaggcaaacgctttccaatatgtcttcttaaaatgcgtgactctgtaattgagatttctagctttcaaacagttcctaagtatgggaatagaagtgaagcggtaaattatgtggaagagttgaatggctctgatgttagggatattcttcgctggaaggattctatgagaagagacttcacagtaaatggtcttttctttaacccgatgaactacaaaatttatgattacgtgaatggagtaagggatatgagaaaaaacaaagtgtgcacagtgattcctgctcatatttctttcatggaggaccctgcaaggattttacgtggcttcagaattgctgctcgccttggtttccagttttccagtgaaacttctaatgcgatacgtgatctttcttcgtctataattaatattgacaaggcaaggttgatgatggaaatgaattatataatgtcttatggggcagcagggccttctgttaggttgcttagaaaatatggactacttgatattttactgcctttccaggcagcatatttgtccgatcagctgaagggtggttcaagtgacagagatctaatgcttatgaaactactggctaatcttgataggttgctctctgcggaccggccatgccatagctctttgtggctggcgttgttggtatttcacagtgcattggttatatctccacaggacacgctggtaataagagcttttgctgcaatgttgtatttcggaacatgggaaaccacagtcaaatttctggaagaagttggacctgaagtttcatttgccccagagacaatggggccttctcggaccaaactggatgatcttatggaacaaacgtcacatcttgcatcactagtcaattcttccgtagatacattgacatgtctacatggtctggagcaatcgctagccagattctccgaacctccgcaattttcaggagtagtactcacatctaacaatgataggaaaaggttgtcagtcatatttgagggccttgcttctgacctactttcatatgacgagagaagagggatgcgcgggattgattactggtcgctgaaacatggggatcctgcagaggtgcgatttgttctgggtaaagtgatcatggacaccatgtacgacaagctaccatgtgaatctactgaggacgaggacgctgctgcaacggtagagccagctgcagatcttgctggtggaagaagcctacctccactgtcctcattgttctaa

SEQ ID NO: 6810 - protein, 551 aa, Sorghum bicolor
  misc_feature: Ceres ANNOT ID no. 6068502
  misc_feature (95)..(225): Pfam Id: PolyA_pol Pfam Desc: Poly A polymerase head domain
  misc_feature (92)..(538): NCBI GI: 42569106 NCBI Desc: polynucleotide adenylyltransferase family protein [arabidopsis thaliana]
  misc_feature (45)..(530): NCBI GI: 21742315 NCBI Desc: osjnbb0039f02.3 [oryza sativa (japonica cultivar-group)]
  misc_feature (86)..(515): NCBI GI: 22327016 NCBI Desc: polynucleotide adenylyltransferase family protein [arabidopsis thaliana]
  misc_feature (92)..(515): NCBI GI: 42571667 NCBI Desc: polynucleotide adenylyltransferase family protein [arabidopsis thaliana]
  misc_feature (92)..(515): NCBI GI: 42562367 NCBI Desc: polynucleotide adenylyltransferase family protein [arabidopsis thaliana]
MPAGRLVEALLFFPLTPSCFSQARHYSTRKGGDGTGPPKPKGGGSSAPKNLRPGGIFFCPLWKSYLSLAFASYVVDIVLLVTFNFDGCSPTGFQAYLVGGCVRDLLLKRVPKDFDVITTASLEQLKKNIFRRSMIVGKRFPICLLKMRDSVIEISSFQTVPKYGNRSEAVNYVEELNGSDVRDILRWKDSMRRDFTVNGLFFNPMNYKIYDYVNGVRDMRKNKVCTVIPAHISFMEDPARILRGFRIAARLGFQFSSETSNAIRDLSSSIINIDKARLMMEMNYIMSYGAAGPSVRLLRKYGLLDILLPFQAAYLSDQLKGGSSDRDLMLMKLLANLDRLLSADRPCHSSLWLALLVFHSALVISPQDTLVIRAFAAMLYFGTWETTVKFLEEVGPEVSFAPETMGPSRTKLDDLMEQTSHLASLVNSSVDTLTCLHGLEQSLARFSEPPQFSGVVLTSNNDRKRLSVIFEGLASDLLSYDERRGMRGIDYWSLKHGDPAEVRFVLGKVIMDTMYDKLPCESTEDEDAAATVEPAADLAGGRSLPPLSSLF

SEQ ID NO: 6811 - DNA, 1617 bp, Sorghum bicolor
  misc_feature: Ceres ANNOT ID no. 6068504
  misc_feature: Encodes the peptide sequence at SEQ ID NO 6812
atgggcggaggggacggggacgccgacgccggcggcgagcccgcggccgcgcaggccacgctgcacatccggtgcaccaacggctccaagttcgccgtgcgggccgacctgggcaccaccgtcggggcgttcaaggcgatcgtcgccgagagctgcgacgtgccggcgccgcagcagcggctgatctacaagggtcggatcttgaaggacgaccaaaccctagccagctacggtgtggagacagaccatacaatccacatggtacgtggtgctgcgccaccaccagcatctactgcacctgcagccaaccaagaacctaccactgctgctcctgccagttccccggcagcaggattgggtggcttgttacaaagtctgggtgctacaggggctgctgctaacagtggggggtcaggtttgtttggatctggcctccctgagttagaccagatgcaacaacagctagcggaaaatccgaacttgatgagggaaataatgaatatgccacttatgcagaatttgatgaacagtcctgaactcatacgcagtataataatgaacaatcctcaaatgcgtgagcttattgatcgcaatccagatcttgctcatgtcctcaatgatccaagcatcatgcgccagacttttgaagcagttcggaatcctgaactcatgagggagatgatgcggaacacagacagagccatgagcaacattgaatcttctccagaaggattcaacatgctccgtcgcatgtatgaaactgtccaagagccttttctgaatgcaacaacaatgggtagcgagggtgatcgaaactcgaatccatttgctgctcttctaggaaaccaggggtctaaccaagcaagagactcagctgcaaatggaacaactacagcttcagaccccacttcaggctctccagctccaaatactaatccacttccaaatccttggggcccaaatgctggctctacccaaggagcagcaaggtcccctcctgctagcaacactaggagtaccacagcaagtggcctaggagggttgggttcagcagatttgggaagtatgcttggtgccagtggtggtggctctgatgctaccttcttgactcaagttttgcaaaacccaactatgatgcagatgatgcaaaacattatgtctaatcctcagtccatgaatcagctgcttaatatgaatccaaatgtacgtaacatgatggaatccaatactcaaatgagagaaatgattcagaatccagaatttcttcgccagttgacgtctcctgaaacattgcagcaattaatttcattccagcagtctttgatgtcacaacttggccaacaacaagctggacaggagcggacacaatcaggctctggtgcaggcaatgtcaacctcaacaccttgatgaacatgttcagcgggcttggtgctggtggtggcctaggtgttccaaatgctcctaatgtgccgccagaagaactgtatgcaacacaattagctcagctccaagaaatgggtttctttgacacacaggagaacatccgagccttggccgctaccgctggaaatgttcatgctgcagtggagcgacttcttggaaatatgggccaatag

SEQ ID NO: 6812 - protein, 538 aa, Sorghum bicolor
  misc_feature: Ceres ANNOT ID no. 6068504
  misc_feature (24)..(92): Pfam Id: ubiquitin Pfam Desc: Ubiquitin family
  misc_feature (495)..(532): Pfam Id: UBA Pfam Desc: UBA/TS-N domain
  misc_feature (6)..(491): NCBI GI: 119613639 NCBI Desc: ubiquilin 2 [homo sapiens]
  misc_feature (6)..(491): NCBI GI: 6563288 NCBI Desc: ubiquitin-like product chap1/dsk2 [homo sapiens]
  misc_feature (2)..(535): NCBI GI: 22726191 NCBI Desc: ubiquilin 1 isoform 2 [mus musculus]
  misc_feature (2)..(535): NCBI GI: 16753205 NCBI Desc: ubiquilin 1 isoform 2 [homo sapiens]
  misc_feature (21)..(533): NCBI GI: 7230507 NCBI Desc: ubiquitin-like fusion protein sona; suppressor of nosa [dictyostelium discoideum]
MGGGDGDADAGGEPAAAQATLHIRCTNGSKFAVRADLGTTVGAFKAIVAESCDVPAPQQRLIYKGRILKDDQTLASYGVETDHTIHMVRGAAPPPASTAPAANQEPTTAAPASSPAAGLGGLLQSLGATGAAANSGGSGLFGSGLPELDQMQQQLAENPNLMREIMNMPLMQNLMNSPELIRSIIMNNPQMRELIDRNPDLAHVLNDPSIMRQTFEAVRNPELMREMMRNTDRAMSNIESSPEGFNMLRRMYETVQEPFLNATTMGSEGDRNSNPFAALLGNQGSNQARDSAANGTTTASDPTSGSPAPNTNPLPNPWGPNAGSTQGAARSPPASNTRSTTASGLGGLGSADLGSMLGASGGGSDATFLTQVLQNPTMMQMMQNIMSNPQSMNQLLNMNPNVRNMMESNTQMREMIQNPEFLRQLTSPETLQQLISFQQSLMSQLGQQQAGQERTQSGSGAGNVNLNTLMNMFSGLGAGGGLGVPNAPNVPPEELYATQLAQLQEMGFFDTQENIRALAATAGNVHAAVERLLGNMGQ

SEQ ID NO: 6813 - DNA, 3138 bp, Sorghum bicolor
  misc_feature: Ceres ANNOT ID no. 6068518
  misc_feature: Encodes the peptide sequence at SEQ ID NO 6814
atggcggggacggaggccttcgaagcctacttccgccgagcggatttgaaccaggacggccgcatcagcggccaggaggccgtcgccttcttccagggcgccaacctgccgcagcaagtcctcgctcaggtatggatgcacgccgatcagaacaagactggcttcctcggccgcccggaattcttcaacgcactgcgcctggtcaccgtggcgcagagcgggcgtcagctcacgcccgacatagtgcagtcggcgctctatggtcccgctgcggctcgaattccagctcccaagatagccgcggggccggctcctgcacagatgggtgctgcgggggcgcctaggcctcaggggagtgctgcgatgacgcccacaccagggcaggttggagcggctcagatgaatccggctgccacaccaaggccccagggaagcggcatgatgccgacatctagtcaagttagcatgccacaggtgaaccctggtgctgctccaaggccccaagggatcagttctatgatgccagctgcgagtcagggtggtgctcttcaagcaagtcaatttgctggaccaagggcaatgcagccgcagcctcctaacctaggaattactcaacagcaaccttctagtaccggtttcatgcggccaccacaggttggagctccagcaacttcatttcaagctcaagcgcctggaatcaatcaaggtttggtcggtggaggcagcatgggaggatctgtcggttggcaaggcggtaatgctgcctcagtgggaggcattccgcaagctataccaggagctgctcctttacagacaacacgaggtggatttggcccaggtttacctagcacaatgggcatggcgcctggacaacaggtacaggcaatgtcttcatcgccattgcctatgcagagcaacagtgctgtgttgcctcaggattcaaaagccttggtactgtctggaaatggccctgctagcagttctggatcaagcgcagacatcttctctgcacttacacagccgaagccaagcgtatctgctcctgcacctcagacaagctcgattccgagctcatctagttttatgcccacgccaactggctcccagaacctgactaatctcgcacagtttggttcgttgcaaggtagcagccaacctcaacagactcagcctgtcgtaaagcccagtcctgctccagctgcacctgttgtctctgttgggatttctaattcagcttcccaatggccgaaaattactcaatctgacatccagaagtacatgaaagtctttggggatgttgatagggacagagatggcaaaataactggcgcagaagctcgcactctgttcctcagttggaggcttccaagagaggtcttgaagcaagtgtgggatttgtctgaccaagacaatgatggcatgctttctttgagagagttttgcattgctctttatttaatggagaggcaccgagctggaactcctcttcccccggcacttcctgactctcttaggcatgatgagacactgttacgagctacaggcttgccttcaacagcatacaatgggccatcatggcaacataatcaaggaggactaccacaaagaggccctggagcagctggggtgcctggtggtgtgcggccacccttgccaccacatttgcattcaactgatggggctagcagaccagggcaaccaagatctcacatgcctgggatggataatcatgtagtaaatcaagggaacaaagatgaaaaaagtggagtgaaccaggctgcccaggaggtggtggatgctcctaagaaggttgaggtggagaagcaagtcctggattctagagagaaactggagtattaccgcacaaagatgcaagatcttgtcctgtataaaagtcggtgtgacaataggctgaatgagattacagaaagggcgtcctctgataaacgtgaggtggaatcattggctaagaaatatgaagagaagtacaagcaagtagctgagttagcttccaaactagcagttgaagaagctgcatatcgtgatgttcaggagagaaaagttgagctgcatgatgcgttgattaaaatggtacaaggtggaagtgttgatggtttgcttcaggttcgagccgatcgaatccaatatcaattagaagagatggaaaaagctcttagtgaacggtgcaaacactttggacttcaattcaaatcatccgcatcagttgagcttccttccggttgggaacctgggccacaagagggactcattgagtgggatgaagactgggataagtttgaagatgaagggtttagtattgttaaggataatggtacaatacaggaaaacccagtttctgctgaaaatggaaaagtgccatctctttgggatgatggtgatgatatgtctcctgttgcatcctctaatggtcatatcaaggaagaaaggcgttacagtggaggtgatcaagtggctgagagtgaaatagcatatgattttggtgatgaatctgtgagaagtcctggcagtgctggaagaagtgcctcaggcagtccatttaaatcttcccgctttgggatgcatgattcatctcccagcaaaagagaaagttacagtgaccatggtggttctgaatctgtttttggtgacaagtttgctgatgaaacttcttggaactttgatgatcaagatactgactctgtttggggttctactgcactgaacactgaggctgatcaacatggtggcacacatagctctttctttgggtccgaggcaggctctccaagtggcgctagtgtatttggaaagaagaggagtacattctttgatgattctgttccaagttctcctgcatacacatctgggttctctccaaaattcggtgaaagccgtgatgatagctcctttgggaggtttgattccttcagatcccaagacactggattcttccctcaggaaagtcgtttctccaggtttgactccattagcagctccaaaggcgagaatgtatcaggattcgatacagggaatagctcacaaaattttggccggtttgactcttttgatgacgccgatccatttggttcaagtggaccttttaaagcatctggaagccggtctccacccaagttctga

SEQ ID NO: 6814 - protein, 1045 aa, Sorghum bicolor
  misc_feature: Ceres ANNOT ID no. 6068518
  misc_feature (3)..(959): NCBI GI: 42562225 NCBI Desc: calcium-binding ef hand family protein [arabidopsis thaliana]
  misc_feature (3)..(968): NCBI GI: 5263313 NCBI Desc: contains similarity to gbu07707 epidermal growth factor receptor substrate (eps15) from homo sapiens and contains 2 pf00036 ef hand domains. ests gbt44428 and gbaa395440 come from
  misc_feature (3)..(968): NCBI GI: 5263313 (continued) this gene. [arabidopsis thaliana]
  misc_feature (311)..(924): NCBI GI: 140053428 NCBI Desc: eps15 homology (eh) [medicago truncatula]
  misc_feature (2)..(136): NCBI GI: 119627227 NCBI Desc: epidermal growth factor receptor pathway substrate 15, isoform cra_a [homo sapiens]
  misc_feature (2)..(136): NCBI GI: 119627228 NCBI Desc: epidermal growth factor receptor pathway substrate 15, isoform cra_b [homo sapiens]
MAGTEAFEAYFRRADLNQDGRISGQEAVAFFQGANLPQQVLAQVWMHADQNKTGFLGRPEFFNALRLVTVAQSGRQLTPDIVQSALYGPAAARIPAPKIAAGPAPAQMGAAGAPRPQGSAAMTPTPGQVGAAQMNPAATPRPQGSGMMPTSSQVSMPQVNPGAAPRPQGISSMMPAASQGGALQASQFAGPRAMQPQPPNLGITQQQPSSTGFMRPPQVGAPATSFQAQAPGINQGLVGGGSMGGSVGWQGGNAASVGGIPQAIPGAAPLQTTRGGFGPGLPSTMGMAPGQQVQAMSSSPLPMQSNSAVLPQDSKALVLSGNGPASSSGSSADIFSALTQPKPSVSAPAPQTSSIPSSSSFMPTPTGSQNLTNLAQFGSLQGSSQPQQTQPVVKPSPAPAAPVVSVGISNSASQWPKITQSDIQKYMKVFGDVDRDRDGKITGAEARTLFLSWRLPREVLKQVWDLSDQDNDGMLSLREFCIALYLMERHRAGTPLPPALPDSLRHDETLLRATGLPSTAYNGPSWQHNQGGLPQRGPGAAGVPGGVRPPLPPHLHSTDGASRPGQPRSHMPGMDNHVVNQGNKDEKSGVNQAAQEVVDAPKKVEVEKQVLDSREKLEYYRTKMQDLVLYKSRCDNRLNEITERASSDKREVESLAKKYEEKYKQVAELASKLAVEEAAYRDVQERKVELHDALIKMVQGGSVDGLLQVRADRIQYQLEEMEKALSERCKHFGLQFKSSASVELPSGWEPGPQEGLIEWDEDWDKFEDEGFSIVKDNGTIQENPVSAENGKVPSLWDDGDDMSPVASSNGHIKEERRYSGGDQVAESEIAYDFGDESVRSPGSAGRSASGSPFKSSRFGMHDSSPSKRESYSDHGGSESVFGDKFADETSWNFDDQDTDSVWGSTALNTEADQHGGTHSSFFGSEAGSPSGASVFGKKRSTFFDDSVPSSPAYTSGFSPKFGESRDDSSFGRFDSFRSQDTGFFPQESRFSRFDSISSSKGENVSGFDTGNSSQNFGRFDSFDDADPFGSSGPFKASGSRSPPKF

SEQ ID NO: 6815 - DNA, 867 bp, Sorghum bicolor
  misc_feature: Ceres ANNOT ID no. 6068520
  misc_feature: Encodes the peptide sequence at SEQ ID NO 6816
atggcggccgtgcagcgactcctccgggcagccgcctccggtggttcggcggcggccaggaggcgcatgacgtcgctggcgacggagcaggcgccgtctgcggccgccgggttcccgttcgcggcggaggagagggcaaggcggctgccgatggcggagaggaacgtgcagtgggtgttcctgggctgcccgggcgtgggcaagggcacctacgcgagccgcctctcgcgcctcctcggcgtgccccacatcgcgacgggggaccttgttcgcgacgagctcgcctccaccgggccacttgctacgcagcttgctgaaattgttaatcaggggaaattggtttctgatgaaattatcttcaaccttttgtcaaaaaggcttaagaaaggagaagaccagggagaatcaggatttattcttgatggttttccccgtacagtaaaacaagcggaaattcttgatggcgttacagacattgatatggtggttaatctaaaactaagagaagatgttctagtagagaagtgcctcggcagaaggatttgcggccaatgtggaaagaacttcaatttggcctgcattgatgttaagggtgaaaatgggctaccagcaatctacatggaaccactgttgcccccaaacaactgcatgtcaaagcttattacccgcgctgatgataccgaagaggtagtcagaaatcggcttcggatatataacgacatgagtcaacctgtggaaggtttctaccgggagcaggggaagctcttggaatttgacttgcctggtgggatccctgaatcttggccaaagctgctccaggttctaaacctcgaggaccaagaggagttgaagctggctgcagcatag

SEQ ID NO: 6816 - protein, 288 aa, Sorghum bicolor
  misc_feature: Ceres ANNOT ID no. 6068520
  misc_feature (60)..(254): Pfam Id: ADK Pfam Desc: Adenylate kinase
  misc_feature (1)..(287): NCBI GI: 90265247 NCBI Desc: h0624f09.8 [oryza sativa (indica cultivar-group)]
  misc_feature (1)..(287): NCBI GI: 32488408 NCBI Desc: osjnba0043a12.38 [oryza sativa (japonica cultivar-group)]
  misc_feature (1)..(287): NCBI GI: 115461234 NCBI Desc: os04g0671100 [oryza sativa (japonica cultivar-group)]
  misc_feature (1)..(288): NCBI GI: 25990718 NCBI Desc: adenylate kinase [solanum tuberosum]
  misc_feature (2)..(175): NCBI GI: 77745507 NCBI Desc: adenylate kinase family-like protein [solanum tuberosum]
  misc_feature (1)..(288): SWISSPROT Homolog: EC 2.7.4.3 Adenylate kinase, chloroplast precursor
MAAVQRLLRAAASGGSAAARRRMTSLATEQAPSAAAGFPFAAEERARRLPMAERNVQWVFLGCPGVGKGTYASRLSRLLGVPHIATGDLVRDELASTGPLATQLAEIVNQGKLVSDEIIFNLLSKRLKKGEDQGESGFILDGFPRTVKQAEILDGVTDIDMVVNLKLREDVLVEKCLGRRICGQCGKNFNLACIDVKGENGLPAIYMEPLLPPNNCMSKLITRADDTEEVVRNRLRIYNDMSQPVEGFYREQGKLLEFDLPGGIPESWPKLLQVLNLEDQEELKLAAA

SEQ ID NO: 6817 - DNA, 807 bp, Sorghum bicolor
  misc_feature: Ceres ANNOT ID no. 6068521
  misc_feature: Encodes the peptide sequence at SEQ ID NO 6818
atggcggcgcccatgtccgccatcgagtccgcgtggcaggtcctgatcgccaacttcaccgagttccagctcgccaccgtcgtcaccttcctgctccacgagaccgtcttcttcctctccggcctcccctccctcctcttcgagcgcttcggactcttcgccaagtacaagatccagaagaagagcaacacccctgcttaccaaaacagatgtgtcttgcgtcttattctgtaccatgtctgtgtgaacctgcctgtcatgattttctcataccctgccttcagatttatgggtcttaggagctctcttcctctaccacattggacggttgttgtatctcaagttcttttctactttgtccttgaggattttatattctactgggggcacagggcactgcatacgaaatggctatacaagcatgttcacagcgtccaccacgagtatgccacaccctttggtttaacttccgaatatgcccacccagctgaaattttgttcctgggattcgccacagtggttggtcctgctcttactggccctcatctgttcaccctgtggctgtggatggtgttgaggatattggagacagttgaagctcacagcggctatcacttcccatggagcccatcaaatttcctgccactgtatggcggctcggacttccatgactaccatcaccgtgtgctgtacacaaagtcagggaactatgcctcgacatttgtttatatggactggttgtttgggacggacaaggattatcgcaaggcaaagaccattgaggagaaagaagggaagaatctgtag

SEQ ID NO: 6818 - protein, 268 aa, Sorghum bicolor
  misc_feature: Ceres ANNOT ID no. 6068521
  misc_feature (115)..(228): Pfam Id: FA_hydroxylase Pfam Desc: Fatty acid hydroxylase
  misc_feature (6)..(264): NCBI GI: 92875070 NCBI Desc: sterol desaturase [medicago truncatula]
  misc_feature (6)..(262): NCBI GI: 16973471 NCBI Desc: sterol 4-alpha-methyl-oxidase [arabidopsis thaliana]
  misc_feature (13)..(262): NCBI GI: 42570971 NCBI Desc: sterol 4-alpha-methyl-oxidase 1 (smo1) [arabidopsis thaliana]
  misc_feature (13)..(262): NCBI GI: 8778563 NCBI Desc: f22g5.23 [arabidopsis thaliana]
  misc_feature (6)..(245): NCBI GI: 34978966 NCBI Desc: c-4 sterol methyl oxidase 2 [nicotiana benthamiana]
  misc_feature: Useful for making plants with altered sterol content
  misc_feature: Useful for making plants with modulated seed size
  misc_feature: Useful for making plants with modulated cold sensitivity
  misc_feature: Useful for making plants with modulated nitrogen use efficiency
  misc_feature: GREAT-hit functional homolog of the protein sequence given in SEQ ID NO 13234
  misc_feature: GREAT-hit functional homolog of the protein sequence given in SEQ ID NO 13481
  misc_feature: GREAT-hit functional homolog of the protein sequence given in SEQ ID NO 13504
  misc_feature: Useful for making plants with altered sterol content
  misc_feature: Functional homolog of the protein sequence given in SEQ ID NO 13504
  misc_feature: Useful for making plants with modulated cold sensitivity
  misc_feature: Functional homolog of the protein sequence given in SEQ ID NO 13234
MAAPMSAIESAWQVLIANFTEFQLATVVTFLLHETVFFLSGLPSLLFERFGLFAKYKIQKKSNTPAYQNRCVLRLILYHVCVNLPVMIFSYPAFRFMGLRSSLPLPHWTVVVSQVLFYFVLEDFIFYWGHRALHTKWLYKHVHSVHHEYATPFGLTSEYAHPAEILFLGFATVVGPALTGPHLFTLWLWMVLRILETVEAHSGYHFPWSPSNFLPLYGGSDFHDYHHRVLYTKSGNYASTFVYMDWLFGTDKDYRKAKTIEEKEGKNL

SEQ ID NO: 6819 - DNA, 291 bp, Sorghum bicolor
  misc_feature: Ceres ANNOT ID no. 6068528
  misc_feature: Encodes the peptide sequence at SEQ ID NO 6820
atggtgaggacgacgacggtggtcggcagggagaggagcgggggcgtgaggcagtacaacaggtccaaggtgcctcgcctgagatggacgcccgatctgcaccactgcttcgtccacgccatccacaagctcggaggccaggacaaggctacgccgaagcgagttctgcagctgatgggagtgggaggactcaccatatctcatgtcaaaagccacctgcaggttcactatctggagttctctcaggatcttggattctgttcttcatttccttctcctatctactactga

SEQ ID NO: 6820 - protein, 96 aa, Sorghum bicolor
  misc_feature: Ceres ANNOT ID no. 6068528
  misc_feature (26)..(77): Pfam Id: Myb_DNA-binding Pfam Desc: Myb-like DNA-binding domain
  misc_feature (12)..(76): NCBI GI: 92871144 NCBI Desc: homeodomain-related [medicago truncatula]
  misc_feature (14)..(76): NCBI GI: 7527727 NCBI Desc: t5e21.10 [arabidopsis thaliana]
  misc_feature (14)..(76): NCBI GI: 79344640 NCBI Desc: dna binding / transcription factor [arabidopsis thaliana]
  misc_feature (11)..(76): NCBI GI: 140057815 NCBI Desc: homeodomain-related [medicago truncatula]
  misc_feature (13)..(76): NCBI GI: 115483751 NCBI Desc: os11g0106100 [oryza sativa (japonica cultivar-group)]
  misc_feature: The sequence is a functional homolog of SEQ ID NO 1339 in the 10/374,780US patent application
  misc_feature: Useful for making plants with modulated growth and phenotype characteristics
  misc_feature: The sequence is a functional homolog of SEQ ID NO 1339 in the 20060162006 US patent application
  misc_feature: The sequence is a functional homolog of SEQ ID NO 2636 in the 10/374,780 US patent application
  misc_feature: The sequence is a functional homolog of SEQ ID NO 320 in the 10/225,066 US patent application
  misc_feature: Useful for making plants with modulated biomass
  misc_feature: Functional homolog of the protein sequence given in SEQ ID NO 13568
  misc_feature: The sequence is a functional homolog of SEQ ID NO 256 in the 10/666,642 US patent application
  misc_feature: The sequence is a functional homolog of SEQ ID NO 254 in the 10/666,642 US patent application
  misc_feature: Useful for making plants with modulated flowering time
  misc_feature: Functional homolog of the protein sequence given in SEQ ID NO 13579
  misc_feature: The sequence is a functional homolog of SEQ ID NO 1338 in the 10/374,780 US patent application
  misc_feature: The sequence is a functional homolog of SEQ ID NO 1857 in the 10/374,780 US patent application
  misc_feature: Useful for making plants with altered alkaloid content
  misc_feature: Useful for making plants with altered lignin content
  misc_feature: Functional homolog of the protein sequence given in SEQ ID NO 13089
  misc_feature: Useful for making plants with altered terpenoid content
  misc_feature: Functional homolog of the protein sequence given in SEQ ID NO 12902
  misc_feature: The sequence is a functional homolog of SEQ ID NO 1459 in the 11/479,226 US patent application
  misc_feature: The sequence is a functional homolog of SEQ ID NO 208 in the 10/374,780 US patent application
  misc_feature: The sequence is a functional homolog of SEQ ID NO 590 in the 10/225,066 US patent application
  misc_feature: The sequence is a functional homolog of SEQ ID NO 1339 in the 10/374,780 US patent application
  misc_feature: The sequence is a functional homolog of SEQ ID NO 1589 in the 11/479,226 US patent application
  misc_feature: The sequence is a functional homolog of SEQ ID NO 762 in the 10/412,699 US patent application
  misc_feature: The sequence is a functional homolog of SEQ ID NO 1062 in the 10/225,066 US patent application
  misc_feature: The sequence is a functional homolog of SEQ ID NO 2788 in the 10/374,780 US patent application
  misc_feature: The sequence is a functional homolog of SEQ ID NO 134 in the 10/666,642 US patent application
  misc_feature: The sequence is a functional homolog of SEQ ID NO 2058 in the 10/374,780 US patent application
  misc_feature: The sequence is a functional homolog of SEQ ID NO 1097 in the 11/479,226 US patent application
  misc_feature: The sequence is a functional homolog of SEQ ID NO 2402 in the 10/374,780 US patent application
  misc_feature: The sequence is a functional homolog of SEQ ID NO 548 in the 10/225,066 US patent application
  misc_feature: The sequence is a functional homolog of SEQ ID NO 1108 in the 11/479,226 US patent application
  misc_feature: The sequence is a functional homolog of SEQ ID NO 116 in the 10/286,264 US patent application
  misc_feature: The sequence is a functional homolog of SEQ ID NO 2056 in the 10/374,780 US patent application
  misc_feature: The sequence is a functional homolog of SEQ ID NO 482 in the 10/412,699 US patent application
  misc_feature: The sequence is a functional homolog of SEQ ID NO 384 in the 10/374,780 US patent application
  misc_feature: The sequence is a functional homolog of SEQ ID NO 426 in the 10/225,066 US patent application
  misc_feature: The sequence is a functional homolog of SEQ ID NO 190 in the 10/225,066 US patent application
  misc_feature: The sequence is a functional homolog of SEQ ID NO 2866 in the 10/374,780 US patent application
  misc_feature: The sequence is a functional homolog of SEQ ID NO 440 in the 10/666,642 US patent application
  misc_feature: Useful for making plants with modulated oxidative stress sensitivity
  misc_feature: Functional homolog of the protein sequence given in SEQ ID NO 12904
  misc_feature: The sequence is a functional homolog of SEQ ID NO 2862 in the 10/374,780 US patent application
  misc_feature: The sequence is a functional homolog of SEQ ID NO 990 in the 10/225,066 US patent application
  misc_feature: The sequence is a functional homolog of SEQ ID NO 132 in the 10/666,642 US patent application
  misc_feature: The sequence is a functional homolog of SEQ ID NO 252 in the 10/666,642 US patent application
  misc_feature: The sequence is a functional homolog of SEQ ID NO 1450 in the 10/666,642 US patent application
  misc_feature: The sequence is a functional homolog of SEQ ID NO 1796 in the 11/479,226 US patent application
  misc_feature: The sequence is a functional homolog of SEQ ID NO 2616 in the 10/374,780 US patent application
  misc_feature: The sequence is a functional homolog of SEQ ID NO 648 in the 10/225,066 US patent application
  misc_feature: The sequence is a functional homolog of SEQ ID NO 888 in the 10/412,699 US patent application
  misc_feature: The sequence is a functional homolog of SEQ ID NO 1093 in the 11/479,226 US patent application
  misc_feature: The sequence is a functional homolog of SEQ ID NO 478 in the 10/412,699 US patent application
  misc_feature: The sequence is a functional homolog of SEQ ID NO 933 in the 10/666,642 US patent application
  misc_feature: The sequence is a functional homolog of SEQ ID NO 934 in the 10/666,642 US patent application
  misc_feature: The sequence is a functional homolog of SEQ ID NO 580 in the 10/666,642 US patent application
  misc_feature: The sequence is a functional homolog of SEQ ID NO 2000 in the 11/479,226 US patent application
  misc_feature: The sequence is a functional homolog of SEQ ID NO 2462 in the 10/374,780 US patent application
  misc_feature: The sequence is a functional homolog of SEQ ID NO 432 in the 11/435,388 US patent application
  misc_feature: The sequence is a functional homolog of SEQ ID NO 742 in the 10/225,066 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 172 in the 10/666,642 US patent application
  misc_feature: The sequence is a functional homolog of SEQ ID NO 2510 in the 10/374,780 US patent application
  misc_feature: The sequence is a functional homolog of SEQ ID NO 686 in the 10/412,699 US patent application
  misc_feature: The sequence is a functional homolog of SEQ ID NO 976 in the 10/225,066 US patent application
MVRTTTVVGRERSGGVRQYNRSKVPRLRWTPDLHHCFVHAIHKLGGQDKATPKRVLQLMGVGGLTISHVKSHLQVHYLEFSQDLGFCSSFPSPIYY

SEQ ID NO: 6821 - DNA, 2880 bp, Sorghum bicolor
  misc_feature: Ceres ANNOT ID no. 6068532
  misc_feature: Encodes the peptide sequence at SEQ ID NO 6822
atggaggccatcatgaaggaaaatcttgagcagatcaagacagaggcagtggatctggagaacattcctatggacgaagtatttaccttcctcaaatgcagtaaggaaggcctcagctccaatgaagcccaggcacgcgccgccatgttcggtcccaataaactagaagaaagaaaggagaacaaggtgctgaagttcctgatgtttatgaacaacccgttgtcgtgggtgatggagctagccgctgtgatggccattgcgcttgccaacggcggcaacaggccgccggactggcaagattttgtcggcatcgtggtgctccttatcctcaactccaccatctcatttattgaggagaacaatgccgggagcgctgcagaggctctcatggccaaccttgcgcctaagaccaaggtgttgcgtgacggccgatggagcgaggaggacgcggcggtcctcgtcccgggtgacattatcagcatcaagctcggcgacatcatcccagctgacgctcgcttgctcgacggcgacgcgctcaagattgaccagtcggcactcactggcgagtgtcttccggtcaccaagaaccccggcagcagcgtctactcgggctccacgtgcaagcagggcgagatcgaggccattgtcatcgccaccggcgtgcacaccttctttggcagggcggcgcaccttgtcgacagcaccaaccaggtcggccacttccagaaggtgctccaggccattggcaacttctgcataggatccatcgccattggcttattcgtcgagatcatcgtcatgtacgcggtccagcaccgccagtaccgtgaaggcatcgacaacctcctcgtgcttctgatcggcggcatcccaattgccatgcctacggtgctctccgtcaccatggcaatcggctcccacaggctgtcgttgcagggcgctatcaccaagcgcatgactgccatcgaggagatggccggcatggatgtgctctgcagtgacaagaccggcacgctcaccctcaacaagctcagtgtcgaccgcagccttgttgagatctttgccgcgggcgttgaaaaggacgatgttatcttgttcgctgccagggcatctagggtggagaaccaggacgccatcgacgccgccatggttggcatgctaagtgatccaaaggaggccagggatggcattcaggaggtgcacttcttccccttcaaccccgtcgacaagcggacagccctcacctatattgatctcgctgatggcagctggcaccgtgtcagcaagggtgcacccgaacagatattggctctctgcaactgtggagataatgtccagaacttggttcacactgtgattgacaagtatgccgagcatggtcttcgatctcttgcagttgcaagacagcaagttccggagaagtgcaaagaaagcctcggagagccatgggaatttgtgggtctgcttcctctcctggacccaccgaggtcagacagttctgatacaatcatgaaagcgctcaacctaggtgtcaatgtgaagatgatcactggtgatcagctcgccattgctaaggagaccgggagaaggctagggatgggctcaaacatgtatccatcatcggctctgcttgggcagagcaaagatgaagccactgcttctattcctgtggatgacttgattgagaaggccgacggttttgctggcgtcttcccagagcacaagtatgagattgtcaagaagctgcaggagatgaagcacatttgcggaatgaccggagatggtgtgaacgatgcgcctgctttgaagaaagccgatatcggaattgccgtagctggagctactgatgcagcacggagcgcctctgacattgtgcttactcaagaaggactcagtgtcatcattagcgctgtgctcactagcagggccatcttccagaggatgaagaactacaccatatatgcggtttcaatcactattcgtattgtgcttggatttttactgattgcactgatatggaaattcgatttctcaccgttcatgattctggtcattgccattctgaatgatggcactatcatgactattgcaaaggacagagtaaaaccgtcgccacaccctgatagctggaagctgaacgagatctttgccacaggcgtcgtgtatggagcttacatggcagtaatgactgtcgtattcttctgggccatgagaagcaccgacttcttttctaacactttccacgtgagatctctgcgcggcagcaccgaggagatgatgtctgccctgtacctgcaagtgagcatcatcagccaggccctcatcttcgtgacgcggtcgcgcagctggtgcttcaccgaacgccccggcttctggctgtgcgcagcgttcgtcatcgcgcagatcgttgccactctgattgcagtgttggccaactttggatttgcccacatcagaggaatcggatggggatgggcgggcgtcatctggctctacagcctcgtcaccttcgtgcccctggacctgttcaagttcgccatccgctacgtgctgagcggcagggcctggaacaacctcctgcagaacaagacggccttcacgaccaagaagaactacggcggggaggagcgcaaggcgcagtgggcgacgacgcagcgcagcctgcacggcctccctacgaccaccgaggccgaggccgccggcgccggcggcggcggcaaccacgcggcggagctgtcggagatcgccgagcaggccaagcggcgagccgagttcgcgaggctgtgccagaggaacacgctgaggggccaactggagtcgtcggcgaggcgcagggggatcgacatcaacgcggtcaggacgccctactacagcgtgtaa

SEQ ID NO: 6822 - protein, 959 aa, Sorghum bicolor
  misc_feature: Ceres ANNOT ID no. 6068532
  misc_feature (103)..(324): Pfam Id: E1-E2_ATPase Pfam Desc: E1-E2 ATPase
  misc_feature (10)..(91): Pfam Id: Cation_ATPase_N Pfam Desc: Cation transporter/ATPase, N-terminus
  misc_feature (328)..(615): Pfam Id: Hydrolase Pfam Desc: haloacid dehalogenase-like hydrolase
  misc_feature (9)..(956): NCBI GI: 20302439 NCBI Desc: plasma membrane h+-atpase [oryza sativa (japonica cultivar-group)]
  misc_feature (9)..(956): NCBI GI: 75232938 NCBI Desc: plasma membrane atpase (proton pump)
  misc_feature (9)..(956): NCBI GI: 39545733 NCBI Desc: osjnba0071i13.11 [oryza sativa (japonica cultivar-group)]
  misc_feature (8)..(956): NCBI GI: 113374057 NCBI Desc: p-type h+-atpase [zostera marina]
  misc_feature (8)..(956): NCBI GI: 6759597 NCBI Desc: plasma membrane h+ atpase [prunus persica]
  misc_feature (9)..(956): SWISSPROT Homolog: EC 3.6.3.6 Plasma membrane ATPase
MEAIMKENLEQIKTEAVDLENIPMDEVFTFLKCSKEGLSSNEAQARAAMFGPNKLEERKENKVLKFLMFMNNPLSWVMELAAVMAIALANGGNRPPDWQDFVGIVVLLILNSTISFIEENNAGSAAEALMANLAPKTKVLRDGRWSEEDAAVLVPGDIISIKLGDIIPADARLLDGDALKIDQSALTGECLPVTKNPGSSVYSGSTCKQGEIEAIVIATGVHTFFGRAAHLVDSTNQVGHFQKVLQAIGNFCIGSIAIGLFVEIIVMYAVQHRQYREGIDNLLVLLIGGIPIAMPTVLSVTMAIGSHRLSLQGAITKRMTAIEEMAGMDVLCSDKTGTLTLNKLSVDRSLVEIFAAGVEKDDVILFAARASRVENQDAIDAAMVGMLSDPKEARDGIQEVHFFPFNPVDKRTALTYIDLADGSWHRVSKGAPEQILALCNCGDNVQNLVHTVIDKYAEHGLRSLAVARQQVPEKCKESLGEPWEFVGLLPLLDPPRSDSSDTIMKALNLGVNVKMITGDQLAIAKETGRRLGMGSNMYPSSALLGQSKDEATASIPVDDLIEKADGFAGVFPEHKYEIVKKLQEMKHICGMTGDGVNDAPALKKADIGIAVAGATDAARSASDIVLTQEGLSVIISAVLTSRAIFQRMKNYTIYAVSITIRIVLGFLLIALIWKFDFSPFMILVIAILNDGTIMTIAKDRVKPSPHPDSWKLNEIFATGVVYGAYMAVMTVVFFWAMRSTDFFSNTFHVRSLRGSTEEMMSALYLQVSIISQALIFVTRSRSWCFTERPGFWLCAAFVIAQIVATLIAVLANFGFAHIRGIGWGWAGVIWLYSLVTFVPLDLFKFAIRYVLSGRAWNNLLQNKTAFTTKKNYGGEERKAQWATTQRSLHGLPTTTEAEAAGAGGGGNHAAELSEIAEQAKRRAEFARLCQRNTLRGQLESSARRRGIDINAVRTPYYSV

SEQ ID NO: 6823 - DNA, 2691 bp, Sorghum bicolor
  misc_feature: Ceres ANNOT ID no. 6068537
  misc_feature: Encodes the peptide sequence at SEQ ID NO 6824
atgctgcagagcaagtcattcgtgaagaagacgaagcaaggccgcatccaaaaggttgttagggagcactacctccgcgatgacgtctactgcggcttcgtcccctgctccgcctgcgccgccgccgctgagcgcaagctcgccgccgccgccgctgccatcctcgtcgtagacaccaacgtcgtgctccaccagatcgatttgctggagaaccccgcgattgaggatgtcgtcttgctgtcagtggtgctggacgaggtgaagaataagaacctttcggttttcaacaggatcaaggcactctgtaccaacaaagcacggaggttctatgttttcgccaacgagcagcacagggatacttatgtcaaagatatggttggggagagctctaatgatcgtaatgacagagcaattcgtgttgctgctcgttggtaccaaagccatcttggtgagagcgtgaaggttctactgattacaaatgacagagataacaaaaggaaagctattgaagaaggccttaacgctgagacagttgagtcatatgtaagatcgcttgcacagcctggtttgcttgatttggtggttgttccatctagtggagatgttaccatggaagatgtagaagaccatagaccatccaagaagaaagtaatctataatgagcacaaaccaatgtcagagattacatctggtttgcgatgtggaatctatcatcaagggaagcttcgagttaatcgttacaatccatttgaagcttatgttgggagcgagagcattggagacgagattgttatccgtggccgctcaaatatgaacagggcctttgatggtgatatagttgctgttgagctcttgccacaagatcaatggcatgagtcgaagtctttcatagcagatgatgatgaagaagaagaagatgtccatctggtccccaatagtgctgacgatgctcctaggaacaccaattctacacaatcaacagttggatcttcagctccttctgtctccagtcgtccagttggacgtgttgtgggtataatcaagcgaaattggaattcgtactgtgggtccttggagccgatgcctatgcctgctggtagtgggggcgttgctcatgctttatttgtttcaaaagatcgaagagttccaaagatccgaattcaaaccaggcagcttgagaatctcgtgaacaaaagaattgttgttgcggttgattcatgggatgttttgtctcgatatccatcaggacactatgttgtcttaatagagaatgatatcaacaccaggcctttctctactcaagtccttgcttgtttgccacctttaccttggacattatcaccagaggatctggctaatcctaatagacaagacttgcgccaagtgagagtctttagtgtggatccaccagatatcgctgatgtcactaattttgttcatcctggtacccctcttgatgaggaagctgcgcagaggggcacttctgtttatcttgttgggcagcggattgatatgcttccgaagcccctgactgaagatgtttgttcacttcgtgctgatgttgaaagattggcattctctgtcatttgggaaatgactcctgatgctgatgtcatatccacaagatatacaaagagtgttatcaaatcttgtgctgcaatgtcttatgttgaagcccaggcaagaatggatgacagccgtttagttgatccacttactgtagatttgcggaacttaaattcattggcaaagatcatgcgacaacgacgttgtgaaagaggagctctgactcttgcttctgcagaagtaaaatttgagatcgatagtgaaactcatgatcctcttgacataggaatttatcaaattcgcgaggcaaatcaaatgattgaagagtttatgttggctgcgaatgtttctgttgctgagaagattttgaagcacttccccttatgttcattgctaaggcgccatcctagcccaacaaaagagatgcttgagccattactccgtaccgcctcttctgttggcctcaatctggatgtatcatcctcaaaggcattagctgaatcacttgacaacgcaaagagcaatgacccatacttcaacaagcttattagaattttggcgactagatgcatgacacaggcagtttatttctgcagtggagatttgaccttttctgagtattaccattacgggcttgcagcttctctttacactcatttcacctctcccattcgcagatatgcagatgttgttgttcatagactgctagctgcagctctaggtattgcaaagctcccgccaatctttcaggatggtccacaacttacaggaatcgctgacaacctgaattacagacatcgaaatgcccagatggcaagcagagcatcggtagaactccacacccacatatatttcaagacaaggccaactgacactgaagctaggatagtaaagatcaaggcaaatggtttcatagtctttgtcccaaagttcggcatagaagggcccatctaccttactccgaagggagacaaaggtggtgattgggtagttgacgaggtgcaccagagagtaaccaagcccggaacaaacatcagctatgctgtcctccagagtgttaggattcatatggaagtagttgaacctcagcctcatcgcccaaagctgcaactcaccctcatatga

SEQ ID NO: 6824 - protein, 896 aa, Sorghum bicolor
  misc_feature: Ceres ANNOT ID no. 6068537
  misc_feature (456)..(764): Pfam Id: RNB Pfam Desc: RNB domain
  misc_feature (472)..(896): NCBI GI: 145207992 NCBI Desc: riken cdna 2810028n01 [mus musculus]
  misc_feature (472)..(860): NCBI GI: 15292611 NCBI Desc: sd10981p [drosophila melanogaster]
  misc_feature (472)..(860): NCBI GI: 24649634 NCBI Desc: cg6413-pa [drosophila melanogaster]
  misc_feature (472)..(860): NCBI GI: 125776017 NCBI Desc: ga19573-pa [drosophila pseudoobscura]
  misc_feature (472)..(896): NCBI GI: 19113445 NCBI Desc: mitotic control protein dis3 [schizosaccharomyces pombe]
MLQSKSFVKKTKQGRIQKVVREHYLRDDVYCGFVPCSACAAAAERKLAAAAAAILVVDTNVVLHQIDLLENPAIEDVVLLSVVLDEVKNKNLSVFNRIKALCTNKARRFYVFANEQHRDTYVKDMVGESSNDRNDRAIRVAARWYQSHLGESVKVLLITNDRDNKRKAIEEGLNAETVESYVRSLAQPGLLDLVVVPSSGDVTMEDVEDHRPSKKKVIYNEHKPMSEITSGLRCGIYHQGKLRVNRYNPFEAYVGSESIGDEIVIRGRSNMNRAFDGDIVAVELLPQDQWHESKSFIADDDEEEEDVHLVPNSADDAPRNTNSTQSTVGSSAPSVSSRPVGRVVGIIKRNWNSYCGSLEPMPMPAGSGGVAHALFVSKDRRVPKIRIQTRQLENLVNKRIVVAVDSWDVLSRYPSGHYVVLIENDINTRPFSTQVLACLPPLPWTLSPEDLANPNRQDLRQVRVFSVDPPDIADVTNFVHPGTPLDEEAAQRGTSVYLVGQRIDMLPKPLTEDVCSLRADVERLAFSVIWEMTPDADVISTRYTKSVIKSCAAMSYVEAQARMDDSRLVDPLTVDLRNLNSLAKIMRQRRCERGALTLASAEVKFEIDSETHDPLDIGIYQIREANQMIEEFMLAANVSVAEKILKHFPLCSLLRRHPSPTKEMLEPLLRTASSVGLNLDVSSSKALAESLDNAKSNDPYFNKLIRILATRCMTQAVYFCSGDLTFSEYYHYGLAASLYTHFTSPIRRYADVVVHRLLAAALGIAKLPPIFQDGPQLTGIADNLNYRHRNAQMASRASVELHTHIYFKTRPTDTEARIVKIKANGFIVFVPKFGIEGPIYLTPKGDKGGDWVVDEVHQRVTKPGTNISYAVLQSVRIHMEVVEPQPHRPKLQLTLI

SEQ ID NO: 6825 - DNA, 1164 bp, Sorghum bicolor
  misc_feature: Ceres ANNOT ID no. 6068538
  misc_feature: Encodes the peptide sequence at SEQ ID NO 6826
atgaggttctggtctctgctcgtcgtagcatggctgccggttctgcaggtcctcctcgttggcttgctcggagctcttctcgcgtccagccgcctcgacgttctcacgtccgatgctcggaggaacatcaacaaggttgtttacatcgtcttcgttccatcgcttgttttctccagcttgtcgagtaccgtcacgctcaaggacatcgtttcttggtggttcatgccagtgaacatgggcatcgtgttcctgatcggagcggttctagggtgggtgtctgtcaaggtcttcagacctgaagaacatcttcagggacttgtcattgcttgctgctcatcaggtaactggggaaccattcctctgatgattgttccagcaatttgcaatgaggagggcagccctttcggagacgccagcacctgcaactctcttggtctctcttatgtgtccttgtcaatggcgctcggcaacttctatatatggacgcacagctacagtgtcatgaagagatccgctacgctgtacaaggcaaaacggcgtaagaaagacgctcagattgacacaagcaaagaacattttggacaggatgcagctggtgattacgccgcttttgttccactgtcctctgaagatttatccgatgatgttggaagcaactcggttacttctcccttgcttccaaatgatcctagagctagcgtcttgggttactacttgagaagagcagaggagttggcggtggagatactgaaagaactatggtcaccgccaagtgtagctgcgaaggttctcctctcagggggcgctacaattccatgcacggtgctgattctcggtggaaatctaaccaaaggtataggcaagacggtggtcaagcccagtgtgctcatatcagtaattgtcatacgttttgttctcctcccgacttgcggaatcggcatcgtcacagcagccaccaagcttgggttgctaccgaattctcccctgtaccgctacgtgctcctcctgcaatccacggttcctccagccatgagcattggcacaatagctcagctgtttgatgtgggggaagaggagtgctctatcatcttcctgtggacgcacctagttgctgcccttgctctcacgctttggtcgacggtgttcatgtcacttgtactgtga

SEQ ID NO: 6826 - protein, 387 aa, Sorghum bicolor
  misc_feature: Ceres ANNOT ID no. 6068538
  misc_feature (9)..(379): Pfam Id: Mem_trans Pfam Desc: Membrane transport protein
  misc_feature (1)..(281): NCBI GI: 92867962 NCBI Desc: auxin efflux carrier [medicago truncatula]
  misc_feature (1)..(281): NCBI GI: 92867960 NCBI Desc: auxin efflux carrier [medicago truncatula]
  misc_feature (1)..(172): NCBI GI: 22329697 NCBI Desc: auxin efflux carrier family protein [arabidopsis thaliana]
  misc_feature (1)..(358): NCBI GI: 140066984 NCBI Desc: auxin efflux carrier [medicago truncatula]
  misc_feature (1)..(356): NCBI GI: 115480587 NCBI Desc: os09g0554300 [oryza sativa (japonica cultivar-group)]
MRFWSLLVVAWLPVLQVLLVGLLGALLASSRLDVLTSDARRNINKVVYIVFVPSLVFSSLSSTVTLKDIVSWWFMPVNMGIVFLIGAVLGWVSVKVFRPEEHLQGLVIACCSSGNWGTIPLMIVPAICNEEGSPFGDASTCNSLGLSYVSLSMALGNFYIWTHSYSVMKRSATLYKAKRRKKDAQIDTSKEHFGQDAAGDYAAFVPLSSEDLSDDVGSNSVTSPLLPNDPRASVLGYYLRRAEELAVEILKELWSPPSVAAKVLLSGGATIPCTVLILGGNLTKGIGKTVVKPSVLISVIVIRFVLLPTCGIGIVTAATKLGLLPNSPLYRYVLLLQSTVPPAMSIGTIAQLFDVGEEECSIIFLWTHLVAALALTLWSTVFMSLVL

SEQ ID NO: 6827 - DNA, 1851 bp, Sorghum bicolor
  misc_feature: Ceres ANNOT ID no. 6068544
  misc_feature: Encodes the peptide sequence at SEQ ID NO 6828
atggcgactccgccgccgcccctccgccgcgccgctgcgcttctcctcgtcgtcctcgccggcgtcctcgcctccaccgcgcgcgccgatctcgtcatctccaaggcagatcggagggttgatctgacctcgcatatcgtccgcatcctcgcttcccttaaggttgaaaatgttggaccggaccctgtctctcaagttttactgtcttttcccaatatccaagccaagaacttggcagctattagagcattcggcagtgaaggaaaagtgaagggtcaaagtactattctgccaattgaagttgttcaaccttctggagctccaccggacctgacgttcttttcagcattgttgcccaaacctttggagaagggaaagactctgtacttggatgtcttgactgtgttcacacactctcttcaaccattcccagaagaaatcactcaagctgaagcacaacttgttgtctatcaggatagtgctcattacttgtcaccttaccctgttaaggcacagacacttgctatcagattgcctggcgggagggttgaatcatacacaaggcatccaaatgcaaaacttgtggattcagaactgaaatatggaccatttcatgatcttcccccgttttcctacttacctgtgattgttcattttgagaacaacaatccttttgcagtcgcaaaggaagttataagggagattgaaatatcccactgggggaatgtacagattacagaacactacaacattgcccatggtggtgccagactcaagggtgaattttccaggatcgattatcaatctagaccttacgtaaggggtgtttcatcttttaggcatcttattgcaaaactgcctccaagggcacactctatttattacagagatgagattggtaatatttcaacatcacatgtgtggagtgattctatgaagacccaactggaaattgaaccaaggtttccattgtttggtgggtggcaaacaaccttcactgttggttatggtttaccacttgaagactttgttttctattctgatggaaagagatttctcaatatcacatttggttctccattggaggaagttctcattgaaaagcttgttgtaaaggttgttctacctgaaggatcaaaggatatcgaagtttcagctccctttccaacacagcagcggcaagaggttaagtattcacaccttgacattgttggaaggccagttgttgtcttggagaaacctgatgttattccagagcataatttatatttccaggtttactacaaattcagcaacatatccttgctcacagagccgttgatgctgattactggtttcttcctcctgtttgtggcctgtattgtttacatgcgtactgatatgtcaatatccaagagctctccttcctacttggccaagctgcaatgggatgaggtgcaagccactgttcagaaaatccagggtatctttgagcaatgcttagcagttcatgataaactggaggcctcgttgcgtgatttgtctaggacaggagacattcagtcttgcaaggcagctcgtaaagctgctgacgcacagtttaaggagctatcaaaagatctgaagccgctgttgatgactctacagtcatctccccagtcttatcagatatggccaaaggtagaggacttgattgcaaaggagagagagatgcaggagaagctcatgacaaggcattccactgttgtcgacagctttgagaagaagttgcgtgggcaagatgtagagaacaggattgctttgcagcagcagaaagttgccgcactgaggcaggaggttgaatctcttttagagtacattagtgagatttga

SEQ ID NO: 6828 - protein, 616 aa, Sorghum bicolor
  misc_feature: Ceres ANNOT ID no. 6068544
  misc_feature (30)..(458): Pfam Id: Ribophorin_I Pfam Desc: Ribophorin I
  misc_feature (1)..(616): NCBI GI: 115463069 NCBI Desc: os05g0301500 [oryza sativa (japonica cultivar-group)]
  misc_feature (8)..(616): NCBI GI: 92875103 NCBI Desc: ribophorin i [medicago truncatula]
  misc_feature (1)..(466): NCBI GI: 140064986 NCBI Desc: ribophorin i [medicago truncatula]
  misc_feature (352)..(616): NCBI GI: 5918187 NCBI Desc: ribophorin i [hordeum vulgare]
  misc_feature (10)..(592): NCBI GI: 37497110 NCBI Desc: ribophorin i [danio rerio]
MATPPPPLRRAAALLLVVLAGVLASTARADLVISKADRRVDLTSHIVRILASLKVENVGPDPVSQVLLSFPNIQAKNLAAIRAFGSEGKVKGQSTILPIEVVQPSGAPPDLTFFSALLPKPLEKGKTLYLDVLTVFTHSLQPFPEEITQAEAQLVVYQDSAHYLSPYPVKAQTLAIRLPGGRVESYTRHPNAKLVDSELKYGPFHDLPPFSYLPVIVHFENNNPFAVAKEVIREIEISHWGNVQITEHYNIAHGGARLKGEFSRIDYQSRPYVRGVSSFRHLIAKLPPRAHSIYYRDEIGNISTSHVWSDSMKTQLEIEPRFPLFGGWQTTFTVGYGLPLEDFVFYSDGKRFLNITFGSPLEEVLIEKLVVKVVLPEGSKDIEVSAPFPTQQRQEVKYSHLDIVGRPVVVLEKPDVIPEHNLYFQVYYKFSNISLLTEPLMLITGFFLLFVACIVYMRTDMSISKSSPSYLAKLQWDEVQATVQKIQGIFEQCLAVHDKLEASLRDLSRTGDIQSCKAARKAADAQFKELSKDLKPLLMTLQSSPQSYQIWPKVEDLIAKEREMQEKLMTRHSTVVDSFEKKLRGQDVENRIALQQQKVAALRQEVESLLEYISEI

SEQ ID NO: 6829 - DNA, 1290 bp, Sorghum bicolor
  misc_feature: Ceres ANNOT ID no. 6068552
  misc_feature: Encodes the peptide sequence at SEQ ID NO 6830
atggagaggaagcaagccgcctacagcaacctcgatgagaggtacgcgatccagggggagaagtaccaggggcagcagtacagccacatctacttcacgcgccttcaccacatgcggaatctgctccacgccctcgtcccctcctggaagccgcaactccctgtcactacagtgttaggactcgaagaaggaaaggattgcataattgttggaactttatataagcacatgaagttgaagccttccattcttgatgaatatgccaaagagaggtctgcaattcctcttgtcaaaccgcataatttcatgcatcctgatgatcatctcattctcgaagatgaaagtggaagggttacacttgcaggagccattcctccagcagcatttgtgactggggttgtagtggctctccatgggaaggaaacaagtgctggcaactttcttgttgaagatgttcttgaggctggtcttcctccccaaactgcattgtctagcgcagcagaagacaagtatgtggtattcgtatctgggctaagtgtaggaagtgacacattcaatcctctacaattccaactccttattgaccatgtcacagggcatctgggtgatgagaatgagcaatccatagcatcaaatatagtacgtgttgtggttgctgggaattcagtgcatatttcaccaaggtttgtcaacggtcagacggtagcatcaaaagatcaatccaggatagcagagcctatcaaggaattggatataatgcttacccagctcgtggcatcgttgcctgtagatatgatgccggggtgtcatgatccggcaaatttttctttgcctcagcagcctctgcacagatgccttttctctggggcatccacgtacaacactttctcgtcatgttcaaatccccatcaatttgagcttgacagtgtccagtttcttggaacatctggccagaacatagatgacctgtacaagtactctgatgctaaagacaagctggaattcatggaaagaacactgagatggcgccatcttgctcctactgctccaaatagtctaggctgttatccatacacagacaaggatcctttccttgttgaaagttgcccgcacgtctactttgttgggaatcaagataaatatgaaactcgattgttggaagggccagaaaaacagaaagtgaggctaatctccatcccaaggttctctgagagtggagttgctgttatgctcaatctgaggaacttggaatgcagcacattgagtttctctacaagctttgatgcctga

SEQ ID NO: 6830 - protein, 429 aa, Sorghum bicolor
  misc_feature: Ceres ANNOT ID no. 6068552
  misc_feature (172)..(383): Pfam Id: DNA_pol_E_B Pfam Desc: DNA polymerase alpha/epsilon subunit B
  misc_feature (1)..(429): NCBI GI: 13431489 NCBI Desc: dna polymerase delta small subunit
  misc_feature (153)..(412): NCBI GI: 23306120 NCBI Desc: putataive dna polymerase delta small subunit [oryza sativa (japonica cultivar-group)]
  misc_feature (2)..(428): NCBI GI: 42569857 NCBI Desc: dna polymerase delta small subunit-related [arabidopsis thaliana]
  misc_feature (2)..(425): NCBI GI: 28279582 NCBI Desc: polymerase (dna directed), delta 2, regulatory subunit [danio rerio]
  misc_feature (2)..(425): NCBI GI: 47086937 NCBI Desc: polymerase (dna directed), delta 2, regulatory subunit [danio rerio]
  misc_feature (1)..(429): SWISSPROT Homolog: EC 2.7.7.7 DNA polymerase delta small subunit
MERKQAAYSNLDERYAIQGEKYQGQQYSHIYFTRLHHMRNLLHALVPSWKPQLPVTTVLGLEEGKDCIIVGTLYKHMKLKPSILDEYAKERSAIPLVKPHNFMHPDDHLILEDESGRVTLAGAIPPAAFVTGVVVALHGKETSAGNFLVEDVLEAGLPPQTALSSAAEDKYVVFVSGLSVGSDTFNPLQFQLLIDHVTGHLGDENEQSIASNIVRVVVAGNSVHISPRFVNGQTVASKDQSRIAEPIKELDIMLTQLVASLPVDMMPGCHDPANFSLPQQPLHRCLFSGASTYNTFSSCSNPHQFELDSVQFLGTSGQNIDDLYKYSDAKDKLEFMERTLRWRHLAPTAPNSLGCYPYTDKDPFLVESCPHVYFVGNQDKYETRLLEGPEKQKVRLISIPRFSESGVAVMLNLRNLECSTLSFSTSFDA

SEQ ID NO: 6831 - DNA, 1179 bp, Sorghum bicolor
  misc_feature: Ceres ANNOT ID no. 6068561
  misc_feature: Encodes the peptide sequence at SEQ ID NO 6832
atggcgacgcagcggctcgtggcggcgctggtggcctgcctcctggtgctggcggcgctgccggtgcgcgggcgcaacatcacggccatcctgcaggggtacaaggagtacaagctgtacaaccagtacctatcggagacgaaggtgtgcgacgagatcaactcgcggcagtcgacgtcgatgaccatcctggtgctctccaacgacgccatgacgacgctggccaaggacgccggggactcgctccccgccatcaagaacgcgctgcgcctccactcggtgctcgactactacgaccgcaagaaggtgaagaagtacggcgacgagagcgccgccacgctgtaccaggccacgggcgacgccgcggagaccacgggcaacgtcaaggtggtggaccaggaggacaagaactacggcttctcggcggccaccgcgggcgccaggatctgcaccgtcaccaaggaagtggagacgcacccgttcaagttcgccatcctcgaggtcacggcgcccatcgagttcgacggcctcttcgacgtcccttccaccgccaacctcacccgcctcctggagcgcgccggctgcaaggtgttcgcgtcgctggccgcctccacgggcgtgctcaagtcgtacgaggacgccatggacaagggcctcaccctgttcgccgtcaacgacgacgcgttcagcgccaaggacgtgcctgacgtcaagaccatgtccaaagccaacctcaccaagctcctccagctccacgccctgccttcctacaacaccaagacgtcgctcaagtccgtcaagggctcgctccgcacgctggcccccaaggacgacgtcaaggtggtcgccaagggcgacgacgtctcgctcgacaccggcaagaccaggtcccgcgtcgcgtccacggtcgtcgacagcgtcccgttctgcctcctcaccatggacagcctcctggtgccgccggagctctacgtcggcgctccggaggcggcaccggcgcctgcgccggtggacgcgccacaggggtccccgcccgcggcggatgcaccgtcggtggcagcggaccacgcggaccacaagtccaagaagtctacggcgtcgtccgccgtcgcgtcgcgcccggtcgccgcgctcgccgcgacggccgtgtgttccgtcgtgctcgcgtccctcttgtga

SEQ ID NO: 6832 - protein, 392 aa, Sorghum bicolor
  misc_feature: Ceres ANNOT ID no. 6068561
  misc_feature (194)..(320): Pfam Id: Fasciclin Pfam Desc: Fasciclin domain
  misc_feature (26)..(392): NCBI GI: 115349888 NCBI Desc: fasciclin-like protein fla2 [triticum aestivum]
  misc_feature (2)..(379): NCBI GI: 115349894 NCBI Desc: fasciclin-like protein fla5 [triticum aestivum]
  misc_feature (2)..(366): NCBI GI: 115349886 NCBI Desc: fasciclin-like protein fla1 [triticum aestivum]
  misc_feature (1)..(391): NCBI GI: 21595125 NCBI Desc: endosperm-specific protein-like protein [arabidopsis thaliana]
  misc_feature (1)..(377): NCBI GI: 14190409 NCBI Desc: at3g60900/t4c21_310 [arabidopsis thaliana]
  misc_feature: Useful for making plants with altered cell wall content and/or composition
  misc_feature: Functional homolog of the protein sequence encoded by LOCUS at2g45470
  misc_feature: Functional homolog of the protein sequence encoded by LOCUS at3g60900
  misc_feature: Useful for making plants with altered carbohydrate content
  misc_feature: Functional homolog of the protein sequence given in SEQ ID NO 13968
MATQRLVAALVACLLVLAALPVRGRNITAILQGYKEYKLYNQYLSETKVCDEINSRQSTSMTILVLSNDAMTTLAKDAGDSLPAIKNALRLHSVLDYYDRKKVKKYGDESAATLYQATGDAAETTGNVKVVDQEDKNYGFSAATAGARICTVTKEVETHPFKFAILEVTAPIEFDGLFDVPSTANLTRLLERAGCKVFASLAASTGVLKSYEDAMDKGLTLFAVNDDAFSAKDVPDVKTMSKANLTKLLQLHALPSYNTKTSLKSVKGSLRTLAPKDDVKVVAKGDDVSLDTGKTRSRVASTVVDSVPFCLLTMDSLLVPPELYVGAPEAAPAPAPVDAPQGSPPAADAPSVAADHADHKSKKSTASSAVASRPVAALAATAVCSVVLASLL

SEQ ID NO: 6833 - DNA, 1746 bp, Sorghum bicolor
  misc_feature: Ceres ANNOT ID no. 6068565
  misc_feature: Encodes the peptide sequence at SEQ ID NO 6834
atggcccccgccgtcgccgcagcggggtcctcgcctcgcaggtggctcgcggcggccgtcatcgcgctcgcctgtgccctcgcgccggcggccgctaggcctgacaaggagatgcgggagaagttctacgggacgctcgtcaccaacggcacgcacaacgctaccggggacggcagcatcgccgagatgttcggccgcgtgctcgacaaggagttctccgacagcgacacgcccgacgctcctgacaagagtagcttcaacaacagcgtgtcagatcatcaagctgttctggagacagtagctgtcattacacatgacaagaagaagaatgattcgcagcatactaattccccaaaatctttccaaattggtgacatgtttggaggccaggatgagaactctgatgacttggaaactgtgatagataaagaggataatgtttttgtgatgtcaaatcgtaaaacgaagtatccaactcttcaactagatttacgattgattaaagatctagtaattataatcgtttcagctactggtggtggtatcatattctcttgtatggggcagccggttattgttggctacctacttgctggttctctagttggacctgggggtttgaactttatcaatgaaatggtgcaggtggagacttttgctcaatttggtgtagtgtttcttctttttgctcttggtcttgagttttcactgactaagttgaaagctgtaggtcctgttgctgtactcggaggtctgcttcagattgctctgttcatgttcttgtgtggcctcactgcagcgttgtgtggtgctaaatcatctgaaggagtgtttgttggtgccttcttgtctatgtcatctactgcagtggtttcaaagtttttagtggaaaaaggtagtacaaacacacttcatggtcaagttacaatcggaacccttatacttcaggattgtgcagtgggcttgctgtttgctctccttcctgttcttggaggtgctagtggcattttcggaggagtgatgtcaatggcgaaactgttgcttgtgttatccatatttgtagctgttacgtatatgatgacatggtcaattgttcctcgattcttaaaactgatgattcagttatcttcacagacaaatgaactctaccaactggcctccgttgcattttgcttgcttctagcctggtgcagtgactattgtggattgagtcttgaattggggtcattccttgctggcgttatgatatcaaccacagattttgctcatcatactatggagcaggtcgaacccattcgcaatctatttgcagcgctcttccttgcaagcattggaatgctcatacatgttaagttcttgtggaatcatgttgacatattacttgcagctgttatactggttataatagtaaagagcattgttgtaactattgttgtaaaggcatttggatacagcatcagaacagcttttgttgttgggctgtccttagctcagataggagagtttgcttttgtgcttttgagccgtgcctcccatctccatcttgttggggggaaaatgtatctactattactgggaacaactgcccttagcttggtaacaactcctctcattttcaaactaattcctgtggtaatgcaccttggcatccttatgcgttggttcccctcggaaaacagtatgcagagtgagcttccattacaggataaagcggttatgcttgaagctcacaacagatcactctaa

SEQ ID NO: 6834 - protein, 581 aa, Sorghum bicolor
  misc_feature: Ceres ANNOT ID no. 6068565
  misc_feature (170)..(540): Pfam Id: Na_H_Exchanger Pfam Desc: Sodium/hydrogen exchanger family
  misc_feature (19)..(574): NCBI GI: 10177870 NCBI Desc: potassium/proton antiporter-like protein [arabidopsis thaliana]
  misc_feature (359)..(581): NCBI GI: 115450469 NCBI Desc: os03g0127900 [oryza sativa (japonica cultivar-group)]
  misc_feature (159)..(543): NCBI GI: 119488481 NCBI Desc: sodium/hydrogen exchanger [lyngbya sp. pcc 8106]
  misc_feature (160)..(573): NCBI GI: 23123962 NCBI Desc: cog0475: kef-type k+ transport systems, membrane components [nostoc punctiforme pcc 73102]
  misc_feature (160)..(554): NCBI GI: 119510988 NCBI Desc: sodium/hydrogen exchanger [nodularia spumigena ccy9414]
  misc_feature: The sequence is a functional homolog of SEQ ID NO. 516 in the 11/188,298 US application
MAPAVAAAGSSPRRWLAAAVIALACALAPAAARPDKEMREKFYGTLVTNGTHNATGDGSIAEMFGRVLDKEFSDSDTPDAPDKSSFNNSVSDHQAVLETVAVITHDKKKNDSQHTNSPKSFQIGDMFGGQDENSDDLETVIDKEDNVFVMSNRKTKYPTLQLDLRLIKDLVIIIVSATGGGIIFSCMGQPVIVGYLLAGSLVGPGGLNFINEMVQVETFAQFGVVFLLFALGLEFSLTKLKAVGPVAVLGGLLQIALFMFLCGLTAALCGAKSSEGVFVGAFLSMSSTAVVSKFLVEKGSTNTLHGQVTIGTLILQDCAVGLLFALLPVLGGASGIFGGVMSMAKLLLVLSIFVAVTYMMTWSIVPRFLKLMIQLSSQTNELYQLASVAFCLLLAWCSDYCGLSLELGSFLAGVMISTTDFAHHTMEQVEPIRNLFAALFLASIGMLIHVKFLWNHVDILLAAVILVIIVKSIVVTIVVKAFGYSIRTAFVVGLSLAQIGEFAFVLLSRASHLHLVGGKMYLLLLGTTALSLVTTPLIFKLIPVVMHLGILMRWFPSENSMQSELPLQDKAVMLEAHNRSL

SEQ ID NO: 6835 - DNA, 1917 bp, Sorghum bicolor
  misc_feature: Ceres ANNOT ID no. 6068586
  misc_feature: Encodes the peptide sequence at SEQ ID NO 6836
atggcccattcgccggcgcccagcggcggcggggggcagcagccgctggtggtgtcgctcaactgcctcgacgacccatcgctggagcaggaggtgctggcgggcgtggccgcggtggagcacgtgccgctctccgccgtcgcctcgggccgcgtcgaggccgcctccgcggtgctgctcccctccctcgccttcctcccgcgcgccgcgcagcgccggctgcggccctggcagctgctgctctgcctcggctccgcggaccgcgcggccgacgcggcggtggccgccgacctgggactccgcctcgtccacgtcgatgccaaccgcgccgaggaggtcgccgacaccgtcatggcgctcatcctcggcctgctccgccggacccacctgctctcgcgccacgcctcgtcggccccggccgccgtcgccgccggctggcttggctccgtccagcccatgtgccgtggcatgcggcgctgccgtggcctcgtgctcggcatcattggccggtccgcggccgcccgctgcctcgccactcgtagtctcgcgtttcggatgagcgtgctctacttcgatccgcgctacgtggtaagtgggaaaacaaagcggccttctattgttttcccttctgcagcaaggagaatggacacactcaatgatttattagcagcaagtgaccttgtttcactgcattgtggattaacaaatgaaacaatgcatatacttaacgctgactgcctgcagcatataaagcctggagctttcatagtcaatactggtagttgccagcttatagatgactgtgcactcaaacagctcttgattgatggtaccatagctggttgcgcattggatggtgctgaaggtccacagtggatggaagcatgggtgcgggagatgccaaatgttttaattcttccacggagtgcagactacagtgaagaagtgtggatggaaataagagagaaagcaatcactatgttacagtcctttttctttgatggtgttcttccaagtagcgcaatttctgatgaagatgaggaaataagtgaagctaaaaatgaagatgactatctagacccacagacaaaggatagccagtcacagatttttgatgctgaaatagatgaaagccacttaacgctggagtatgaaaagaaaagagccatatcccaccataaagagcctcaggcgtctggaaagtctgtaaacattggctcccggtctgaaggaaggcgtagtcgttctggaaagaaagggaaaaagaggcctgctcatcgcagacctcaacagaaaccagataacttgtctgctgtggagagtgacagtaactattcctcccggagagatgatgacactgcaatgagtagcagggaccaggttgtaagttccagttcacgatttgcctctcctgaggactcaaaatacaagcataaatctcttgctgaatccccaatggaaatagcatctgagaagaaggtgcctgtactacttggtagaaagtaccctgacaaactaaaagatggttttgttgtagctttgagagcaagagataattcagggtaccatgttgcaagacaaagagtagttggtggtggtggctggattcttgatgttgtctcaaccaccacaaacagggatcccgctgcccagttcctcgttactttcaaaaacaaggatactatggggctccgatcctttgttgctggtggtaagctactacagattaataggaagatggagtttgtgtttgcaagccattcttttgatgtttgggagagctggatgctggacggttccttgctggagggtagcaagcttatcaattgcagaaatccttcggctgtattggatgtctgcattgagatcctcgcggcaccaagtgaagaagatggagtcactaggtggctagattag

SEQ ID NO: 6836 - protein, 638 aa, Sorghum bicolor
  misc_feature: Ceres ANNOT ID no. 6068586
  misc_feature (118)..(310): Pfam Id: 2-Hacid_dh_C Pfam Desc: D-isomer specific 2-hydroxyacid dehydrogenase, NAD bindingdomain
  misc_feature (13)..(638): NCBI GI: 28804254 NCBI Desc: angustifolia [ipomoea nil]
  misc_feature (1)..(638): NCBI GI: 2505877 NCBI Desc: dehydrogenase [arabidopsis thaliana]
  misc_feature (1)..(638): NCBI GI: 15408535 NCBI Desc: c-terminal binding protein [arabidopsis thaliana]
  misc_feature (1)..(631): NCBI GI: 8920588 NCBI Desc: contains similarity to a dehydrogenase from arabidopsis thaliana gby12776 and contains a d-isomer specific 2-hydroxyacid dehydrogenases pf00389 and myb-like dna binding
  misc_feature (1)..(631): NCBI GI: 8920588 (continued) pf00249 domains. ests gbz48385, gbz48386 come from this gene
  misc_feature (200)..(638): NCBI GI: 115450445 NCBI Desc: os03g0126100 [oryza sativa (japonica cultivar-group)]
MAHSPAPSGGGGQQPLVVSLNCLDDPSLEQEVLAGVAAVEHVPLSAVASGRVEAASAVLLPSLAFLPRAAQRRLRPWQLLLCLGSADRAADAAVAADLGLRLVHVDANRAEEVADTVMALILGLLRRTHLLSRHASSAPAAVAAGWLGSVQPMCRGMRRCRGLVLGIIGRSAAARCLATRSLAFRMSVLYFDPRYVVSGKTKRPSIVFPSAARRMDTLNDLLAASDLVSLHCGLTNETMHILNADCLQHIKPGAFIVNTGSCQLIDDCALKQLLIDGTIAGCALDGAEGPQWMEAWVREMPNVLILPRSADYSEEVWMEIREKAITMLQSFFFDGVLPSSAISDEDEEISEAKNEDDYLDPQTKDSQSQIFDAEIDESHLTLEYEKKRAISHHKEPQASGKSVNIGSRSEGRRSRSGKKGKKRPAHRRPQQKPDNLSAVESDSNYSSRRDDDTAMSSRDQVVSSSSRFASPEDSKYKHKSLAESPMEIASEKKVPVLLGRKYPDKLKDGFVVALRARDNSGYHVARQRVVGGGGWILDVVSTTTNRDPAAQFLVTFKNKDTMGLRSFVAGGKLLQINRKMEFVFASHSFDVWESWMLDGSLLEGSKLINCRNPSAVLDVCIEILAAPSEEDGVTRWLD

SEQ ID NO: 6837 - DNA, 1197 bp, Sorghum bicolor
  misc_feature: Ceres ANNOT ID no. 6068587
  misc_feature: Encodes the peptide sequence at SEQ ID NO 6838
atggcggccgcgtcactcaagctcgcctcccccaaacctctcgcctccgcgccgtccgcgctcctcggcgggcgccgcgaccaggcgcgacccctcccggcgcgccgcctcgctccgcccgcccgcgtcgccgtgcagcccaccgccgcgccgcgcatcggctccttcgacaaggtgctggaggcgctgatccgcgggaccgacttctcggaggaggacgcggagacgacgctgcggctgctgttggatgagaaggacgaggcgcgcatctccgccttcctcgtcctcctcagggccaagggcgagacctacgaagagatcgtggggctagcgaaggcgatgctgagctgctgcgtccgggtcgacgggctggaagacgccgttgacattgtcgggaccggcggcgacggcgcagacaccgtcaacatctccaccgggtccaccatcctcgctgccgcggccggcgccaaggtcgctaagcaaggaagcagggccagttcgtcggcgtgcggcagcgccgatgtgctggaggcgctaggagtcaacatcgagcttggacccgagggtattaaacgatgtgtcaatgaggtgggtgttggattcatgatgtctgcaaattatcatcctgcaatgaaaattgtcagacctgtgaggaagaagctaaaaataaagacagttttcaatatccttggtcctctattgaatccagcaagggtgcctcatgctgttattggtgtttaccatgaaaacatagttaccaagatggctaaggctgctcagaaatttggaatgaagagagcactggtcgtccattcaaagggtttggatgaaataagcccacttggtcctggatatatccttgatgttactccagggaagattgaaaaaatgctcttcgatccattggattttggaattcctcgatgcacattggaagatctgaaaggaggtgatccagcatttaatgcaaaagttcttcaggatgttcttgctggtcaaagggggtccattgcagatgcccttcttagactaattccaattttgctgcacattctaaatgctgctgcatccctacttgtcagtggtaaagtgaagaatttacatgatggtgttgcactagcacaggaaacacagaggtccgggaaagccattaatacacttgagtcttggataaaggtttcaaatgtaagcacataa

SEQ ID NO: 6838 - protein, 398 aa, Sorghum bicolor
  misc_feature: Ceres ANNOT ID no. 6068587
  misc_feature (124)..(384): Pfam Id: Glycos_transf_3 Pfam Desc: Glycosyl transferase family, a/b domain
  misc_feature (55)..(119): Pfam Id: Glycos_trans_3N Pfam Desc: Glycosyl transferase family, helical bundle domain
  misc_feature (33)..(395): NCBI GI: 92897212 NCBI Desc: imp dehydrogenase/gmp reductase [medicago truncatula]
  misc_feature (34)..(397): NCBI GI: 20259900 NCBI Desc: anthranilate phosphoribosyltransferase, chloroplast precursor [arabidopsis thaliana]
  misc_feature (39)..(397): NCBI GI: 28394222 NCBI Desc: phosphorybosyl anthranilate transferase 1 [arabidopsis thaliana]
  misc_feature (60)..(394): NCBI GI: 89331618 NCBI Desc: anthranilate phosphoribosyltransferase [chlamydophila felis fe/c-56]
  misc_feature (60)..(394): NCBI GI: 33301710 NCBI Desc: anthranilate phosphoribosyltransferase
  misc_feature (34)..(397): SWISSPROT Homolog: EC 2.4.2.18 Anthranilate phosphoribosyltransferase, chloroplast precursor
MAAASLKLASPKPLASAPSALLGGRRDQARPLPARRLAPPARVAVQPTAAPRIGSFDKVLEALIRGTDFSEEDAETTLRLLLDEKDEARISAFLVLLRAKGETYEEIVGLAKAMLSCCVRVDGLEDAVDIVGTGGDGADTVNISTGSTILAAAAGAKVAKQGSRASSSACGSADVLEALGVNIELGPEGIKRCVNEVGVGFMMSANYHPAMKIVRPVRKKLKIKTVFNILGPLLNPARVPHAVIGVYHENIVTKMAKAAQKFGMKRALVVHSKGLDEISPLGPGYILDVTPGKIEKMLFDPLDFGIPRCTLEDLKGGDPAFNAKVLQDVLAGQRGSIADALLRLIPILLHILNAAASLLVSGKVKNLHDGVALAQETQRSGKAINTLESWIKVSNVST

SEQ ID NO: 6839 - DNA, 1563 bp, Sorghum bicolor
  misc_feature: Ceres ANNOT ID no. 6068589
  misc_feature: Encodes the peptide sequence at SEQ ID NO 6840
  misc_feature: Up-regulated in shoot tissues in response to salicylic acid treatment
atgcccagccatgaggcctgctgcggcaccatgttctgggtgtacctcatgtcctgcttcgggctcgtcatgttcgccggcctcatgtcgggcctcaccctcggactcatgtccctcagcctcgtcgacctcgaggtgctgtccaaggccggcacgcccaaggacaagcgcaacgccgccaggatcctacccgtcgtgaagaaccagcacctgctcctctgcacgctcctcatcggcaactcgctcgccatggaagcgctgcccatattcctcgacacgcttgtgccgccctacgtcgccatcctcatctccgtcacgctcatcctcgcgttcggcgagatcatcccgcaagccatctgcacgcgctacgggctcagcgtgggggccaaggcggcgcccgtggtccgcgtactgctcatccttttcttccctgtcgcctacccgatcagtaagttgttggactcgctactgggaaagggacattttgcactaatgagaagagctgagctaaagacattagttgatatgcatggcaatgaggctggaaaaggtggagagctgactcatgatgaaaccactatcattacaggagctctggagctgactcaaaagattgcaaaagatgccatgactcctatatctgagacattctcacttgacataaatgctaagctggacttacacacgatgggtatgataatgactagagggcatagtcgtgttcctatatactctgggattccaagcaatattatcggccttatattggtaaaaaacttgattacttgccgagctgaggatgaagtgcccattcgtaatgttactatcagaaaaattccaagggtggctgatgatcttcctctctatgacattctaaatgagttccagaaaggtcacagccacatggctgtggtagttaaacgaacaaaggaatcaggagcatccactgaaaagcaaaagagcacaactgcagattataaaataaaccccaaagatgctcttgctgatggctcatccccctcttctgctagtgctgccggaagtcgtagaattaacatagagaagcatggagacgggcgctcatataataagaaatcagaaaggaagcgggaaaacattcttgattttaacaccgatccacttccatgctattcaatggatgaggaggcagtcggaataatcacaatggaagatgtcatggaagaactgctacaggaagaaatctatgatgaaacagacgagtatgttgatgtacataacaagatcaggataaacatgttacctccaggcaaatcactgtcacctactatatctcctggtggtggacccttatctcaggggcttcgaaggactcctatggcatctccgttctcaccataccaccatggtagttctgtcttacgttccccagcttcgaaccatggtcagtcacctgggattttaccgacaatactttctcctggaagatcacctactgcacaaacacctgggcaaagttcaccaagtggaagtcaggtttcaataaattccaacggtcaacataaaaaggacggtgagagctaa

SEQ ID NO: 6840 - protein, 520 aa, Sorghum bicolor
  misc_feature: Ceres ANNOT ID no. 6068589
  misc_feature (210)..(318): Pfam Id: CBS Pfam Desc: CBS domain pair
  misc_feature (7)..(350): NCBI GI: 42568492 NCBI Desc: cbs domain-containing protein-related [arabidopsis thaliana]
  misc_feature (7)..(417): NCBI GI: 42569036 NCBI Desc: cbs domain-containing protein [arabidopsis thaliana]
  misc_feature (7)..(417): NCBI GI: 92882068 NCBI Desc: cbs [medicago truncatula]
  misc_feature (7)..(417): NCBI GI: 20856058 NCBI Desc: at4g33700/t16l1_190 [arabidopsis thaliana]
  misc_feature (3)..(437): NCBI GI: 92871388 NCBI Desc: cbs [medicago truncatula]
  misc_feature: Up-regulated in shoot tissues in response to salicylic acid treatment
MPSHEACCGTMFWVYLMSCFGLVMFAGLMSGLTLGLMSLSLVDLEVLSKAGTPKDKRNAARILPVVKNQHLLLCTLLIGNSLAMEALPIFLDTLVPPYVAILISVTLILAFGEIIPQAICTRYGLSVGAKAAPVVRVLLILFFPVAYPISKLLDSLLGKGHFALMRRAELKTLVDMHGNEAGKGGELTHDETTIITGALELTQKIAKDAMTPISETFSLDINAKLDLHTMGMIMTRGHSRVPIYSGIPSNIIGLILVKNLITCRAEDEVPIRNVTIRKIPRVADDLPLYDILNEFQKGHSHMAVVVKRTKESGASTEKQKSTTADYKINPKDALADGSSPSSASAAGSRRINIEKHGDGRSYNKKSERKRENILDFNTDPLPCYSMDEEAVGIITMEDVMEELLQEEIYDETDEYVDVHNKIRINMLPPGKSLSPTISPGGGPLSQGLRRTPMASPFSPYHHGSSVLRSPASNHGQSPGILPTILSPGRSPTAQTPGQSSPSGSQVSINSNGQHKKDGES

SEQ ID NO: 6841 - DNA, 1065 bp, Sorghum bicolor
  misc_feature: Ceres ANNOT ID no. 6068593
  misc_feature: Encodes the peptide sequence at SEQ ID NO 6842
atggctgcgtcggcgacgccgaggccgtcgctgatcctcccgcgtgccgcctcgcactcgcactcccagcccagcgccgtcggcctcacctccgaccgcgtcgccgcctcccgccgccggcgcggcgactttgttttcgtcgtcaatccctccggcgccaatggacgcacgggaaagcagtggaagcagctgctgccgctcctccgcacccgcctcgccgatcagtgcaacatttgcgagtgcatcacttcgggcccgtcccatgccatagatgtcacaagggaggctataaaggatggggctgatgctgtgatcgctgttggaggtgatggtacgcttcatgaggtggtgaatggtttcttttgtaaaggaagtccagtgcgtgctctcgatcgagggcctgaccattcaacggcgctcggtctcattccacttggaaccggctcagattttgctcggacatttggctggacaaatgatccttgtgacgcgattgatcgaattgtgagaggagtaaaatcaaaactagacataggcgtgatggagggtccaaacagggaaccacacttttttgttaatgtggctgatatccatttgagtgctaaggcaggctattttgcttctatgtacaagagatttggcaacttatgctatgtatttggagctttaagaggcttttggggacatagtaatcaagatatgagaataaaggtaaatgggggagaatggggaactgtccataaagtcactgccctgtgcataggaaatgccaagtactttggtggtggtatgaagataactccaacagctgatccatttagtggcaaccttgaggttgttattcttcaagatttcaaatggtacgactttcttctgaagctacacaggctctatggaggcacacatctatcagtgaatggtgtttcgtcaatgagggttcaatcaattgaagtagaagaggtgacgggtagtggtggcatttttgtgcaatctgatggggagcatttcggctttctgccaaccaaattttcagttcttcctggtgcagttgatttcttctgctag

SEQ ID NO: 6842 - protein, 354 aa, Sorghum bicolor
  misc_feature: Ceres ANNOT ID no. 6068593
  misc_feature (43)..(184): Pfam Id: DAGK_cat Pfam Desc: Diacylglycerol kinase catalytic domain
  misc_feature (47)..(350): NCBI GI: 121539253 NCBI Desc: diacylglycerol kinase, catalytic region [anaeromyxobacter sp. fw109-5]
  misc_feature (47)..(346): NCBI GI: 52842556 NCBI Desc: transcriptional regulator [legionella pneumophila subsp. pneumophila str. philadelphia 1]
  misc_feature (45)..(347): NCBI GI: 145623080 NCBI Desc: diacylglycerol kinase, catalytic region [petrotoga mobilis sj95]
  misc_feature (44)..(334): NCBI GI: 116491917 NCBI Desc: diacylglycerol kinase family protein [pediococcus pentosaceus atcc 25745]
  misc_feature (47)..(350): NCBI GI: 120404721 NCBI Desc: diacylglycerol kinase, catalytic region [mycobacterium vanbaalenii pyr-1]
MAASATPRPSLILPRAASHSHSQPSAVGLTSDRVAASRRRRGDFVFVVNPSGANGRTGKQWKQLLPLLRTRLADQCNICECITSGPSHAIDVTREAIKDGADAVIAVGGDGTLHEVVNGFFCKGSPVRALDRGPDHSTALGLIPLGTGSDFARTFGWTNDPCDAIDRIVRGVKSKLDIGVMEGPNREPHFFVNVADIHLSAKAGYFASMYKRFGNLCYVFGALRGFWGHSNQDMRIKVNGGEWGTVHKVTALCIGNAKYFGGGMKITPTADPFSGNLEVVILQDFKWYDFLLKLHRLYGGTHLSVNGVSSMRVQSIEVEEVTGSGGIFVQSDGEHFGFLPTKFSVLPGAVDFFC

SEQ ID NO: 6843 - DNA, 1146 bp, Sorghum bicolor
  misc_feature: Ceres ANNOT ID no. 6068594
  misc_feature: Encodes the peptide sequence at SEQ ID NO 6844
atggctgctcccgaggcgccctcatgctacgtcgggatcgcgcggcagtccgccgccttccgccttatgaagcaaatgggatgggaagaaggtgaaggccttggcaaagacaagcaaggcataaagggtcatgttagagtgaaaaacaagcaggacacactaggtgttggtgtagatagccctcataacaaatgggtatatgataccacccaatttgacaacatactgaagaaacttaaagtgcaatcagctaatcctattcaagaagaggttgcagctgtaaaaagtgattcgcctgacgtcactccaaaggaggacaaatcagcaaaagctgaagttactaaagttactcgacctcaaggaagatacaagaaaagagagagggggaaaagtgtgagctcttattcagcaacggatcttcaaggcatactcgtacgcaaaaacgaagataattctcaagtggatcagaaacttgaaccgacatgcttggatgaacctgatcccatcatctgtccggatgcagtatcccaagctgatgatgtgaactggtgggggcacaaatttggattcgttacaggagggtttctaggagcaaaatctcgtaaaaataaatcttcacaaaaagatcctgctaatgtccgccagacatttgcggaggaagatcaagaaaatttatacaatcttgttcaggataaagctacttctggaaagcagggtcttggcatcaaaggcctgccaatgaaagttgctggccaacgttggaagggaaacaaaacttcgtttgttgatagcgatgacgataattcaacccaatccgatgaatattcagaaattgaagagagtgacgataaggaagaacctatcagtgcttctgaatcaatagacacagacaagaatacagaaaaggaattgcttgtggatgctagaccgaaaaccaaggtcaagaaactttgcaaaagaatacttcgtcaggccccatctcagtcaatgaaattgaaggatcttaaggtagccgttgaggaacactcaaatgttgtattctccagcttctcatgtagacgcgaagctctgttgtttctgaagaaaaagcttcaaggaagcaggaaattcaatgtggacggcaagaaagttcatctcgtgtcatga

SEQ ID NO: 6844 - protein, 381 aa, Sorghum bicolor
  misc_feature: Ceres ANNOT ID no. 6068594
  misc_feature (15)..(59): Pfam Id: G-patch Pfam Desc: G-patch domain
  misc_feature (1)..(381): NCBI GI: 27363372 NCBI Desc: at1g63980/f22c12_9 [arabidopsis thaliana]
  misc_feature (1)..(381): NCBI GI: 79320606 NCBI Desc: nucleic acid binding [arabidopsis thaliana]
  misc_feature (95)..(381): NCBI GI: 6692106 NCBI Desc: f22c12.25 [arabidopsis thaliana]
  misc_feature (21)..(319): NCBI GI: 24656362 NCBI Desc: cg11180-pa [drosophila melanogaster]
  misc_feature (21)..(167): NCBI GI: 95769319 NCBI Desc: pin2-interacting protein 1 [bos taurus]
MAAPEAPSCYVGIARQSAAFRLMKQMGWEEGEGLGKDKQGIKGHVRVKNKQDTLGVGVDSPHNKWVYDTTQFDNILKKLKVQSANPIQEEVAAVKSDSPDVTPKEDKSAKAEVTKVTRPQGRYKKRERGKSVSSYSATDLQGILVRKNEDNSQVDQKLEPTCLDEPDPIICPDAVSQADDVNWWGHKFGFVTGGFLGAKSRKNKSSQKDPANVRQTFAEEDQENLYNLVQDKATSGKQGLGIKGLPMKVAGQRWKGNKTSFVDSDDDNSTQSDEYSEIEESDDKEEPISASESIDTDKNTEKELLVDARPKTKVKKLCKRILRQAPSQSMKLKDLKVAVEEHSNVVFSSFSCRREALLFLKKKLQGSRKFNVDGKKVHLVS

SEQ ID NO: 6845 - DNA, 1881 bp, Sorghum bicolor
  misc_feature: Ceres ANNOT ID no. 6068617
  misc_feature: Encodes the peptide sequence at SEQ ID NO 6846
atggcgcacgatcccagtctgggcttcgcggactacttctcggcagcggcggcggctggcgccacggcgatggacgacgacgacgtcggggcgccggagctctatggcttgcacgccgacatggagttcctcggcatgcgtggcctggccgccatgcccgccgcggcccaccaccaccaccaccacggccacggccacagcaaggccggtgtgctcgtcgacgacgacgcggggccagacggcagcggctccaacacggacgacgccaccatgcgattcctgagcgagcagcagcatcatccgagtcaccagcaggcgccgctgtcgctatcgctgtgccggccggacggtggtggcgtgggcgtgacgacgtcgttgcacgagcaacaacaacaactcggcggcggctcgtcccggcaccatcagcagcagcatccggcgccgcccgcggcgtggatgcagcagcacgactactcgccgcagccgcagcacgcgtggcacctgcgcggctccaggttcctcgtccccgcgcagcaggtcctgcaggagttctgcagcctccccgtggacagcagcagcgccgccgcttccagcaagcgcgcctccaagccgtcctcgcaccagcagcaagaagacggcggagaggggtcgtcgtcgtcggcctcctgggcgccgtcgctgcagatccaggccatggacgcgctggagctgcagcggctcaaggacaagctctacatcatgctggaagaggtggaccggagataccggcggtactgcgagcagatgcgtgcgctggcgggcgggttcgaggcggtggccggggagcgcgcggcggcggcgtacacggcgctggcgtcgcgcaccatctcgcggcacttccggagcctccgtgacggcgtggtggcgcagctgcaggcggcgcggagggcgctcggggagaaggacgtggcggtgcccgggatgacgcgcggggacacgccacggctgagggtgctggaccagtgcatccgccagcagaaggcgctcacccaggccggcatggtggaggcccacccgtggcgaccccagcgcggactccctgagcgcgcagtcaccatcctccgggcatggctcttcgagcacttcctgcacccgtatccaagcgacgtggacaagcatatcctggctcgccagacgggcctctcacggagccaggtgtccaactggttcatcaatgcgcgggtcaggctctggaagccaatggtggaggagatgtacgtcgaggagatgaaggctgaaggccagctggaagacggcggcggcggggaccagcagcagggccagggcgtcagcaacaaccctaaccctagcaacgccgccgccgaggcggctgatgatggctgcggggacaacggcgccgtcgtcgtcgaccggaagccgacgcgggcgcagctcctgcacgacgcgggctcgctcgcctccgtcgtcaacatcggcagcggctcacgcgcgggcgccgcagcgcggccgctcgagaacttcggcatcgtggaccacctcgacttcgacgcgtacggcggcggccaccacgccggcgggggcttcggcggcggcgtgtcgctcacgctgggcctgcagcagcacgactcccacgacggcggcgtcaacatcgcgttcggcgcgccgccgacgcccgcacaccaccacggcggcgccgcggggtacctgttcgctccgacgacgacggccggccatcagatgggcggcggcctgcacccggggcagcaacaccacgtccagttcggcggcgccagcatcgacggcgaggcggcgcacgggcaggagcattaccggggccttcagggcgccgggtttcacctcctgcgtgacctggccgggtga

SEQ ID NO: 6846 - protein, 626 aa, Sorghum bicolor
  misc_feature: Ceres ANNOT ID no. 6068617
  misc_feature (166)..(302): Pfam Id: POX Pfam Desc: Associated with HOX
  misc_feature (164)..(572): NCBI GI: 31323443 NCBI Desc: bell-like homeodomain protein 3 [lycopersicon esculentum]
  misc_feature (164)..(561): NCBI GI: 22652121 NCBI Desc: bel1-related homeotic protein 14 [solanum tuberosum]
  misc_feature (56)..(540): NCBI GI: 115465946 NCBI Desc: os06g0108900 [oryza sativa (japonica cultivar-group)]
  misc_feature (164)..(430): NCBI GI: 28202125 NCBI Desc: homeobox protein [arabidopsis thaliana]
  misc_feature (168)..(552): NCBI GI: 13877513 NCBI Desc: bel1-like homeobox 4 [arabidopsis thaliana]
  misc_feature: The sequence is a functional homolog of SEQ ID NO 2332 in the 10/374,780US patent application
  misc_feature: The sequence is a functional homolog of SEQ ID NO 270 in the 10/412,699US patent application
  misc_feature: The sequence is a functional homolog of SEQ ID NO 56 in the 10/225,068US patent application
  misc_feature: The sequence is a functional homolog of SEQ ID NO 591 in the 11/479,226US patent application
  misc_feature: Useful for making plants with modulated growth and phenotype characteristics
  misc_feature: The sequence is a functional homolog of SEQ ID NO 270 in the 20040045049 US patent application
  misc_feature: The sequence is a functional homolog of SEQ ID NO. 320 in the 11/188,298 US application
  misc_feature: The sequence is a functional homolog of SEQ ID NO. 499 in the 11/188,298 US application
MAHDPSLGFADYFSAAAAAGATAMDDDDVGAPELYGLHADMEFLGMRGLAAMPAAAHHHHHHGHGHSKAGVLVDDDAGPDGSGSNTDDATMRFLSEQQHHPSHQQAPLSLSLCRPDGGGVGVTTSLHEQQQQLGGGSSRHHQQQHPAPPAAWMQQHDYSPQPQHAWHLRGSRFLVPAQQVLQEFCSLPVDSSSAAASSKRASKPSSHQQQEDGGEGSSSSASWAPSLQIQAMDALELQRLKDKLYIMLEEVDRRYRRYCEQMRALAGGFEAVAGERAAAAYTALASRTISRHFRSLRDGVVAQLQAARRALGEKDVAVPGMTRGDTPRLRVLDQCIRQQKALTQAGMVEAHPWRPQRGLPERAVTILRAWLFEHFLHPYPSDVDKHILARQTGLSRSQVSNWFINARVRLWKPMVEEMYVEEMKAEGQLEDGGGGDQQQGQGVSNNPNPSNAAAEAADDGCGDNGAVVVDRKPTRAQLLHDAGSLASVVNIGSGSRAGAAARPLENFGIVDHLDFDAYGGGHHAGGGFGGGVSLTLGLQQHDSHDGGVNIAFGAPPTPAHHHGGAAGYLFAPTTTAGHQMGGGLHPGQQHHVQFGGASIDGEAAHGQEHYRGLQGAGFHLLRDLAG

SEQ ID NO: 6847 - DNA, 906 bp, Sorghum bicolor
  misc_feature: Ceres ANNOT ID no. 6068622
  misc_feature: Encodes the peptide sequence at SEQ ID NO 6848
atggcgtcgtcgcaggcgaacctcgacaagatgcagctccgccagagctaccgcaacgtctggcacaccgacatgaccaacgccatccaggccgacttcccctactgctgcctcgcgctgtggtgtggaccttgtgtgtcgtacatgcttcgcaaaagggctctttacaatgacatgtcaagatatgtctgttgtgctggctacatgccatgcagtggaaagtgtggcgagagccggtgcccagagttctgtcttgcaactgaggtgtgcctttgctttggcaattcagttgcatcaacccgcttcttgctgcaagatgaattcaacatacaaacaactcagtgcgacaactgcatcattggcttcatgttctgccttcaacaagttgcttgcatcttctctatagttgcagctattgttggcagcgaggagctttcagaggcttcccagatccttaactgtctgtctgatttggtctattggacggtttgtgcctgtatgcagacgcagcacaaagtcgaaatggacaaaagggatggaaagttcggcccaccacagcccatggcagtgcccccagtgcaacaaatgtcacgcattgatcagcctatgccgcctcctgctggatatgcaccacaaccagcatatgggcagccttatggtggctatccacctcctgctggtcaaggttatccgccagctggatacccccagggcggtggataccctcctgctcaaggctacccacagggtggtggataccctccacctgctcaaggttacccccagggtggtgcatatcctccgcctggttcttaccctccacaaggttcgtaccccccagcacagggctcctaccctccagcacagggctcctaccctccagcacaaagctaccctggcaagtaa

SEQ ID NO: 6848 - protein, 301 aa, Sorghum bicolor
  misc_feature: Ceres ANNOT ID no. 6068622
  misc_feature (21)..(145): Pfam Id: PLAC8 Pfam Desc: PLAC8 family
  misc_feature (180)..(299): NCBI GI: 671859 NCBI Desc: annexin vii [dictyostelium discoideum]
  misc_feature (180)..(299): NCBI GI: 90970870 NCBI Desc: annexin vii [dictyostelium discoideum ax4]
  misc_feature (180)..(299): NCBI GI: 113965 NCBI Desc: annexin a7 (annexin vii) (synexin)
  misc_feature (204)..(299): NCBI GI: 3288572 NCBI Desc: annexin max4 [oryzias latipes]
  misc_feature (204)..(299): NCBI GI: 41529812 NCBI Desc: pgyrp protein [chlamydomonas reinhardtii]
MASSQANLDKMQLRQSYRNVWHTDMTNAIQADFPYCCLALWCGPCVSYMLRKRALYNDMSRYVCCAGYMPCSGKCGESRCPEFCLATEVCLCFGNSVASTRFLLQDEFNIQTTQCDNCIIGFMFCLQQVACIFSIVAAIVGSEELSEASQILNCLSDLVYWTVCACMQTQHKVEMDKRDGKFGPPQPMAVPPVQQMSRIDQPMPPPAGYAPQPAYGQPYGGYPPPAGQGYPPAGYPQGGGYPPAQGYPQGGGYPPPAQGYPQGGAYPPPGSYPPQGSYPPAQGSYPPAQGSYPPAQSYPGK

SEQ ID NO: 6849 - DNA, 972 bp, Sorghum bicolor
  misc_feature: Ceres ANNOT ID no. 6068623
  misc_feature: Encodes the peptide sequence at SEQ ID NO 6850
atgcagggcggcggcggcggcggtgatcaagcaggagggagcctaggcatggacatgggcgtggggtacgccgccggcagcggcggcgccgagtgctcgtcgtcgacttcggcggcggctgcagcagcggctgccgcggccgccgcagccgccgcggcggcggccgaggcggaggagcggcagctgctcaagggggagatcgcggtgcacccgctgtgcgagcagctggtggcggcgcacgtggggtgcctgcgcgtggcgacgcccatcgaccacctcccgctcatcgacgcgcagctggcccagtccagcggcctcctccactcctacgccgcccaccaccgccccttcctctccccgcacgacaagcacgacctcgactccttcctcgcgcagtatctgatgctgctgtgctcgttccgggagcagctgcagcagcacgtccgggtgcacgccgtggaggccgtcatggcgtgccgcgagatcgagcagtcgctccaggacctcaccggagcgacgctagaggaagggacgggggcgaccatgtcggaggacgaggacgagccccccatgctagagggggccctggacatgggctccgatgggcacgacatgatgggcttcggcccgctcctgcccaccgactcggagcgctcactcatggagagggtcaggcaggagcttaagatcgagctcaagcagggtttcaagtcaagaatagaggatgtgagggaggaaattctgaggaaaaggagggccgggaagctgcctggggacaccaccagcatcctcaagcaatggtggcagcagcactccaagtggccataccccacggaagacgataaggcaaagcttgttgaagagactggcctgcagctgaaacaaatcaacaactggttcatcaaccagaggaagcgaaactggcacaacaactcccagacgtcaaccctcaaatcaaagcgtaaaaggtga

SEQ ID NO: 6850 - protein, 323 aa, Sorghum bicolor
  misc_feature: Ceres ANNOT ID no. 6068623
  misc_feature (116)..(171): Pfam Id: KNOX2 Pfam Desc: KNOX2 domain
  misc_feature (61)..(105): Pfam Id: KNOX1 Pfam Desc: KNOX1 domain
  misc_feature (227)..(248): Pfam Id: ELK Pfam Desc: ELK domain
  misc_feature (57)..(323): NCBI GI: 115450409 NCBI Desc: os03g0123500 [oryza sativa (japonica cultivar-group)]
  misc_feature (38)..(322): NCBI GI: 11878230 NCBI Desc: homeodomain transcription factor knat7 [arabidopsis thaliana]
  misc_feature (54)..(322): NCBI GI: 8493589 NCBI Desc: strong similarity to homeobox protein hd1 from brassica napus gi1170191, and contains a lactate/malate dehydrogenase pf00056 domain. [arabidopsis thaliana]
  misc_feature (53)..(322): NCBI GI: 453949 NCBI Desc: homeodomain-containing protein [brassica napus]
  misc_feature (10)..(323): NCBI GI: 4098246 NCBI Desc: homeobox 2 protein [lycopersicon esculentum]
  misc_feature: No seed is being produced by the plant
  misc_feature: The plant flowers significantly late compared to wild-type.
  misc_feature: The sequence is a functional homolog of SEQ ID NO 708 in the 10/374,780US patent application
  misc_feature: The sequence is a functional homolog of SEQ ID NO 709 in the 10/374,780US patent application
  misc_feature: The sequence is a functional homolog of SEQ ID NO 710 in the 10/374,780US patent application
  misc_feature: The sequence is a functional homolog of SEQ ID NO 711 in the 10/374,780US patent application
  misc_feature: The sequence is a functional homolog of SEQ ID NO 712 in the 10/374,780US patent application
  misc_feature: Useful for biocontainment applications
  misc_feature: Useful for making plants with altered Lignin content
  misc_feature: Useful for making plants with altered terpenoid content
  misc_feature: Useful for making plants with modulated flowering time
  misc_feature: Useful for making plants with modulated growth and phenotype characteristics
  misc_feature: GREAT-hit functional homolog of the protein sequence given in SEQ ID NO 12885
  misc_feature: GREAT-hit functional homolog of the protein sequence given in SEQ ID NO 13102
  misc_feature: GREAT-hit functional homolog of the protein sequence given in SEQ ID NO 13103
  misc_feature: The sequence is a functional homolog of SEQ ID NO 708 in the 20060162006 US patent application
  misc_feature: The sequence is a functional homolog of SEQ ID NO 709 in the 20060162006 US patent application
  misc_feature: The sequence is a functional homolog of SEQ ID NO 710 in the 20060162006 US patent application
  misc_feature: The sequence is a functional homolog of SEQ ID NO 711 in the 20060162006 US patent application
  misc_feature: The sequence is a functional homolog of SEQ ID NO 712 in the 20060162006 US patent application
  misc_feature: Useful for making plants with altered carbohydrate content
  misc_feature: Functional homolog of the protein sequence given in SEQ ID NO 13967
  misc_feature: Useful for making plants with altered terpenoid content
  misc_feature: Functional homolog of the protein sequence given in SEQ ID NO 13103
  misc_feature: Useful for making plants with altered lignin content
  misc_feature: Functional homolog of the protein sequence given in SEQ ID NO 12885
  misc_feature: The sequence is a functional homolog of SEQ ID NO 711 in the 10/374,780 US patent application
  misc_feature: Useful for making plants with altered sterol content
  misc_feature: Useful for making plants with modulated flowering time
  misc_feature: Functional homolog of the protein sequence given in SEQ ID NO 13436
  misc_feature: The sequence is a functional homolog of SEQ ID NO 490 in the 11/435,388 US patent application
  misc_feature: The sequence is a functional homolog of SEQ ID NO 76 in the 10/374,780 US patent application
  misc_feature: The sequence is a functional homolog of SEQ ID NO 882 in the 10/225,066 US patent application
  misc_feature: The sequence is a functional homolog of SEQ ID NO 713 in the 10/374,780 US patent application
  misc_feature: The sequence is a functional homolog of SEQ ID NO 712 in the 10/374,780 US patent application
  misc_feature: The sequence is a functional homolog of SEQ ID NO 1996 in the 10/374,780 US patent application
  misc_feature: The sequence is a functional homolog of SEQ ID NO 594 in the 11/479,226 US patent application
  misc_feature: The sequence is a functional homolog of SEQ ID NO 604 in the 11/435,388 US patent application
  misc_feature: The sequence is a functional homolog of SEQ ID NO 902 in the 10/225,066 US patent application
  misc_feature: The sequence is a functional homolog of SEQ ID NO 710 in the 10/374,780 US patent application
  misc_feature: The sequence is a functional homolog of SEQ ID NO 709 in the 10/374,780 US patent application
  misc_feature: The sequence is a functional homolog of SEQ ID NO 708 in the 10/374,780 US patent application
  misc_feature: The sequence is a functional homolog of SEQ ID NO. 499 in the 11/188,298 US application
  misc_feature: The sequence is a functional homolog of SEQ ID NO. 320 in the 11/188,298 US application
MQGGGGGGDQAGGSLGMDMGVGYAAGSGGAECSSSTSAAAAAAAAAAAAAAAAAAEAEERQLLKGEIAVHPLCEQLVAAHVGCLRVATPIDHLPLIDAQLAQSSGLLHSYAAHHRPFLSPHDKHDLDSFLAQYLMLLCSFREQLQQHVRVHAVEAVMACREIEQSLQDLTGATLEEGTGATMSEDEDEPPMLEGALDMGSDGHDMMGFGPLLPTDSERSLMERVRQELKIELKQGFKSRIEDVREEILRKRRAGKLPGDTTSILKQWWQQHSKWPYPTEDDKAKLVEETGLQLKQINNWFINQRKRNWHNNSQTSTLKSKRKR

SEQ ID NO: 6851 - DNA, 1536 bp, Sorghum bicolor
  misc_feature: Ceres ANNOT ID no. 6068625
  misc_feature: Encodes the peptide sequence at SEQ ID NO 6852
atggatcaccacctcacgccgtcgccgccgtcgccgatggagaactccgcggcggggccgtcctcgaagccgccgacaccggcgtccacgcccaactcacgcctcgcctcggcgccgtcctcccgccactccgccacgacgtcgcacgcgtcggcgccgtcgtcggcaccgacgccggcctcccgcaccgtctacagcgaccgcttcatccccagccgcaccggatccaacctcgcgctcttcgacctcgccccctcgccatccgccgcatcctcctcccacgaaggcgggcccgcggtctcgtctggatctgcgaccgccgcgtcgccctactgcgcgctcctccgcgccgcgctcttcgggcccgacacgcccgaccgggtcgcgtcctcggccaccgcgtgctcgtcgtcctcctccccggggccctcgcctgtgggcacccccgccaccgggaacatcttcagattcaagacggaggtgcgccggagcgccaagagggcgcttttctccggagaggaagaggaggacgcactgttccccggcattttcaccaccaggggcgcgggcccaaggaaggttccaaggtcgccctacaaggacgacttctacctgaaccttgtagattggtcatcacataatgtcctcgcagttgggttgggcaattgtgtttacttgtggaatgcatgcagcagcaaggtcaccaagctttgtgatttgggggtggatgacaatgtttgttctgtgggatgggcgcagcgcggcactcacctagctgtaggcacaaatcaaggaaaagttcagatctgggatgcaactcgttgtaaaagaataagaacgatggaaagccatcgcatgcgtgtaggtgctcttgcatggagttcttcattgctttcttctggaagccgtgacaagagcatcctccaccatgatatccgtgctcaagaagattatgttagcaagcttaccgggcataaatctgaggtttgtggactcaagtggtcttacgacaatcggcagcttgcatcaggtggcaatgataacagactttttgtttggaatccacattcagtacaaccagtactgaagtatactgagcacacagcagctgtcaaagctattgcctggtctcctcatcttcatggcttgcttgcatctggtggaggaaccgcagatagatgcatacggttttggaatacgaccactaatacaaacttgagctgtgtggacactggaagccaggtctgcaatcttgcgtggtcaaagaatgtaaatgagcttgttagcacccatgggtactctcagaaccaaataattgtttggagatatccaacaatgtcgaagcttgccactttgacagggcatacatacagagtattatatttagctatttcccctgatggccagaccatagttactggtgctggtgatgaaacactccgtttttggaacgtgttcccttcaccaaagtcccagagttctgatagtttaagttgcatcgggggaacatcatttgttagaagctacatccggtga

SEQ ID NO: 6852 - protein, 511 aa, Sorghum bicolor
  misc_feature: Ceres ANNOT ID no. 6068625
  misc_feature (316)..(354): Pfam Id: WD40 Pfam Desc: WD domain, G-beta repeat
  misc_feature (446)..(484): Pfam Id: WD40 Pfam Desc: WD domain, G-beta repeat
  misc_feature (54)..(511): NCBI GI: 33860243 NCBI Desc: cell cycle switch protein ccs52a [lupinus luteus]
  misc_feature (15)..(511): NCBI GI: 66932877 NCBI Desc: cell cycle switch protein ccs52a [lotus corniculatus var. japonicus]
  misc_feature (29)..(511): NCBI GI: 66932879 NCBI Desc: cell cycle switch protein ccs52a [pisum sativum]
  misc_feature (46)..(511): NCBI GI: 4558462 NCBI Desc: cell cycle switch protein [medicago sativa subsp. x varia]
  misc_feature (51)..(511): NCBI GI: 7158292 NCBI Desc: wd-repeat cell cycle regulatory protein [medicago truncatula]
  misc_feature: The plant is abnormally small.
  misc_feature: Useful for making plants with modulated biomass
  misc_feature: GREAT-hit functional homolog of the protein sequence given in SEQ ID NO 13536
  misc_feature: The sequence is a functional homolog of SEQ ID NO 2 in US patent 7101712
  misc_feature: Useful for making plants with modulated biomass
  misc_feature: Functional homolog of the protein sequence given in SEQ ID NO 13536
  misc_feature: The sequence is a functional homolog of SEQ ID NO. 502 in the 11/188,298 US application
MDHHLTPSPPSPMENSAAGPSSKPPTPASTPNSRLASAPSSRHSATTSHASAPSSAPTPASRTVYSDRFIPSRTGSNLALFDLAPSPSAASSSHEGGPAVSSGSATAASPYCALLRAALFGPDTPDRVASSATACSSSSSPGPSPVGTPATGNIFRFKTEVRRSAKRALFSGEEEEDALFPGIFTTRGAGPRKVPRSPYKDDFYLNLVDWSSHNVLAVGLGNCVYLWNACSSKVTKLCDLGVDDNVCSVGWAQRGTHLAVGTNQGKVQIWDATRCKRIRTMESHRMRVGALAWSSSLLSSGSRDKSILHHDIRAQEDYVSKLTGHKSEVCGLKWSYDNRQLASGGNDNRLFVWNPHSVQPVLKYTEHTAAVKAIAWSPHLHGLLASGGGTADRCIRFWNTTTNTNLSCVDTGSQVCNLAWSKNVNELVSTHGYSQNQIIVWRYPTMSKLATLTGHTYRVLYLAISPDGQTIVTGAGDETLRFWNVFPSPKSQSSDSLSCIGGTSFVRSYIR

SEQ ID NO: 6853 - DNA, 2013 bp, Sorghum bicolor
  misc_feature: Ceres ANNOT ID no. 6068628
  misc_feature: Encodes the peptide sequence at SEQ ID NO 6854
atggcttctctctgcgcgtccaccaccaccaccatctctgccttcctactcatactcttcatccattccggccactctccggccgccgcattctacctcccgggtagctatcctcagcggtaccgccctggcgacacccttgccgccaaggtgaactccctgacctcgccgtcctccaagctcccctacccttactactcccttcccttctgcgccccgcaacacggtgcgaggcacgctgcggagagcctcggcgagctcctcctcggcgaccgcatcgagacgtcgccgtaccgcttctccatgctcaacaacaccaccacgccattgttcctctgccgcaccgacccgctgtcccctggcaccaccgagctcatcaagtcccgcatcgatgacgcctatcaggtcaacctcctcctcgacaccctccctgtcatgcgctacgtgaagaacccggtcgcgcccgacgtgctccaccgatccaccggcttccccgtcggtgtccgcgccgacgacggcgagtactacgtgtacaaccacataaagctcaccgtgctggtgaacaagcagaacaccaccaccagggtggagagcttgatggcgaccgccgacgggtccgatctgatcagcttcaccggcggcaaggagggcagcggctacacggtcgtcgggttcgaggtcgtcccgtgcagcgtggagcacgacgcggcggctatcaagaacaagagcatgtacgacgagatcacgttgaaggcaaccaccggctgcgacccgtcggtggtgagcatgcgcgtgcaggacaacatgccgctggtcttctcctacgaggtggccttcgtggagagcagcatcgagtggccgtcgcgctgggacgcgtacctcgagatgggtggtgccaaggtgcactggttctccatcctcaactccatcgtggtggtctcgttcctggccgcgatcgtgctcgtcatcctgctgcgcaccgtgcgacgcgacctcgcgcagtacgaggagctcggcggcagcgagtctgggacgcacgcggacgagctagccgggtggaagctcgtggccggcgacgtgttccgggagcccagccacccggtgctcctctgcgttctcgtcggcgatggcgtgcgcatcctgggtatgggcgtggtcaccatcgtcttcgccgcgctcgggttcatgtcgcccgcgtgccgcggcgcgctggtcaccggcatgctgtgcttctacctcgtcctaggcgtggccgccgggtacacggccgtgagtctctggaagacggttcggcagggcgacaccgacgggtggaagtccgtggcgtggcgcgcgtcgttcgccttcccgggcgtcgggttcgccgtgttcaccgtgctcaactgcgtgctctggtacaacggaagcaccggagccgtgccgttcctgctgttcgtcgtcatcctcctcctgtggttcttcgtctccgtgcctctcacccttgccgggggcctcctcgcctcccgcgttcgccacatcgagtttcctgtcaagaccaacaagatcgcccgccaggtgccggcggcacagtgctcgccgtgggtgttcgtggcggtggccgggacgctgccgttcgggacgctgttcatcgagctcttcttcatcatgtcgagcctgtggctgggccgcgtctactacgtgttcgggttcctgctggtggtgctgtcgctgctggtgacggtgtgcgccgaggtgtcggtggtgctcacgtacatgggcctgtgcgtggaggactggcggtggtggtggcgcgccttcttcgcctccggctccgtcgcgctctacaccctgagctacgctgtctactacctggtgttcgagctgcatagcctcgccgggcccgtttctgccgcgctctacgtcggctactccttgctcatggctctcgccgtcatgctcgccaccggcgctgtcggactcggcgcctcgttctgcttcgtccactacctcttctccaccgtcaagctggactga

SEQ ID NO: 6854 - protein, 670 aa, Sorghum bicolor
  misc_feature: Ceres ANNOT ID no. 6068628
  misc_feature (61)..(628): Pfam Id: EMP70 Pfam Desc: Endomembrane protein 70
  misc_feature (1)..(670): NCBI GI: 38175639 NCBI Desc: endosomal protein-like [oryza sativa (japonica cultivar-group)]
  misc_feature (31)..(670): NCBI GI: 10176814 NCBI Desc: endosomal protein-like [arabidopsis thaliana]
  misc_feature (1)..(366): NCBI GI: 38175638 NCBI Desc: endosomal protein-like [oryza sativa (japonica cultivar-group)]
  misc_feature (222)..(670): NCBI GI: 92897792 NCBI Desc: nonaspanin (tm9sf) [medicago truncatula]
  misc_feature (187)..(670): NCBI GI: 115480625 NCBI Desc: os09g0557800 [oryza sativa (japonica cultivar-group)]
  misc_feature: Useful for making plants with altered cell wall content and/or composition
  misc_feature: Functional homolog of the protein sequence encoded by LOCUS at5g35160
  misc_feature: Useful for making plants with altered cell wall content and/or composition
  misc_feature: Functional homolog of the protein sequence given in SEQ ID NO 13969
MASLCASTTTTISAFLLILFIHSGHSPAAAFYLPGSYPQRYRPGDTLAAKVNSLTSPSSKLPYPYYSLPFCAPQHGARHAAESLGELLLGDRIETSPYRFSMLNNTTTPLFLCRTDPLSPGTTELIKSRIDDAYQVNLLLDTLPVMRYVKNPVAPDVLHRSTGFPVGVRADDGEYYVYNHIKLTVLVNKQNTTTRVESLMATADGSDLISFTGGKEGSGYTVVGFEVVPCSVEHDAAAIKNKSMYDEITLKATTGCDPSVVSMRVQDNMPLVFSYEVAFVESSIEWPSRWDAYLEMGGAKVHWFSILNSIVVVSFLAAIVLVILLRTVRRDLAQYEELGGSESGTHADELAGWKLVAGDVFREPSHPVLLCVLVGDGVRILGMGVVTIVFAALGFMSPACRGALVTGMLCFYLVLGVAAGYTAVSLWKTVRQGDTDGWKSVAWRASFAFPGVGFAVFTVLNCVLWYNGSTGAVPFLLFVVILLLWFFVSVPLTLAGGLLASRVRHIEFPVKTNKIARQVPAAQCSPWVFVAVAGTLPFGTLFIELFFIMSSLWLGRVYYVFGFLLVVLSLLVTVCAEVSVVLTYMGLCVEDWRWWWRAFFASGSVALYTLSYAVYYLVFELHSLAGPVSAALYVGYSLLMALAVMLATGAVGLGASFCFVHYLFSTVKLD

SEQ ID NO: 6855 - DNA, 954 bp, Sorghum bicolor
  misc_feature: Ceres ANNOT ID no. 6068639
  misc_feature: Encodes the peptide sequence at SEQ ID NO 6856
atggagaggatgcagctgcagctgcaagggcccatcgcctcttcgctgtgggcggacaagcagcagcaggcggccagcaccagcgccgcggtggcggcggcgcagatgcccttcctggcgttgctccagggcgcgggcgtcgtcatggaggcggaggagcagcagcagcatgacgggcgcaagcggcaggccttcgcgcgcgccgtctccgacctcgacctgctcgagagctgcgtcacgcaggcggcggtggctcctgctgcggcgtctgcgcccgtggccagcaggaccgagaggcggaggaagcggccgagaccccgcgcgcgggccgcgccgccgccggagaagcgcaggaagcccgaggaggccgagagccagcggatgacgcacatcgccgtggagcgcaaccggcggcgcctcatgaacgaccacctcgcctcgctccgctccctcatcccctccagctacatcccccgcggcgaccaggcgacagtggtgggtggcgcgatcgactacgtgaagcaactggagcagcagctggtggcattgcaggcggccgcggccgcgcgtcgcgacggtaccggcgccggcgccgcggtggccacggccgcgtcggacggcgtgttcgtgtccccgcagtacgcgagctactcggactcgtcgcgcggcggcctcggcgccggcgtggacgtggaggccacggccgcggtgggcgggcacgtgcgcgtgcgcgtcgcggggaggcggtggcccggacggctcgtgcgcgccgtcgccgcgctcgaggacctccgcctcgcgatcttgcacctcgccgacacctccgtcggacatgacgccgacgtgaactgcttcaacctcaagatggaggaagggtgcgaggtggcgacggcggatgaggtggcgacggtggtgcaccagatcttcgcctacgccgccggcgcatgctgctga

SEQ ID NO: 6856 - protein, 317 aa, Sorghum bicolor
  misc_feature: Ceres ANNOT ID no. 6068639
  misc_feature (126)..(177): Pfam Id: HLH Pfam Desc: Helix-loop-helix DNA-binding domain
  misc_feature (80)..(185): NCBI GI: 116311027 NCBI Desc: osigba0142i02-osigba0101b20.1 [oryza sativa (indica cultivar-group)]
  misc_feature (112)..(307): NCBI GI: 18395124 NCBI Desc: basic helix-loop-helix (bhlh) family protein [arabidopsis thaliana]
  misc_feature (49)..(317): NCBI GI: 140063709 NCBI Desc: helix-loop-helix dna-binding [medicago truncatula]
  misc_feature (86)..(185): NCBI GI: 21593074 NCBI Desc: bhlh dna-binding protein-like protein [arabidopsis thaliana]
  misc_feature (107)..(308): NCBI GI: 124359713 NCBI Desc: helix-loop-helix dna-binding [medicago truncatula]
  misc_feature: The plant produces a reduced number of seeds.
  misc_feature: The sequence is a functional homolog of SEQ ID NO 1274 in the 10/666,642US patent application
  misc_feature: The sequence is a functional homolog of SEQ ID NO 1500 in the 10/374,780US patent application
  misc_feature: The sequence is a functional homolog of SEQ ID NO 1501 in the 10/374,780US patent application
  misc_feature: The sequence is a functional homolog of SEQ ID NO 1503 in the 10/374,780US patent application
  misc_feature: The sequence is a functional homolog of SEQ ID NO 1504 in the 10/374,780US patent application
  misc_feature: The sequence is a functional homolog of SEQ ID NO 1703 in the 10/374,780US patent application
  misc_feature: Useful for biocontainment applications
  misc_feature: Useful for making plants with modulated growth and phenotype characteristics
  misc_feature: Useful for making plants with modulated nitrogen use efficiency
  misc_feature: Functional homolog of the protein sequence given in SEQ ID NO 13213
  misc_feature: Functional homolog of the protein sequence encoded by LOCUS at4g01460
  misc_feature: The sequence is a functional homolog of SEQ ID NO 1500 in the 20060162006 US patent application
  misc_feature: The sequence is a functional homolog of SEQ ID NO 1501 in the 20060162006 US patent application
  misc_feature: The sequence is a functional homolog of SEQ ID NO 1503 in the 20060162006 US patent application
  misc_feature: The sequence is a functional homolog of SEQ ID NO 1504 in the 20060162006 US patent application
  misc_feature: The sequence is a functional homolog of SEQ ID NO 1703 in the 20060162006 US patent application
  misc_feature: The sequence is a functional homolog of SEQ ID NO 1501 in the 10/374,780 US patent application
  misc_feature: The sequence is a functional homolog of SEQ ID NO. 483 in the 11/188,298 US application
MERMQLQLQGPIASSLWADKQQQAASTSAAVAAAQMPFLALLQGAGVVMEAEEQQQHDGRKRQAFARAVSDLDLLESCVTQAAVAPAAASAPVASRTERRRKRPRPRARAAPPPEKRRKPEEAESQRMTHIAVERNRRRLMNDHLASLRSLIPSSYIPRGDQATVVGGAIDYVKQLEQQLVALQAAAAARRDGTGAGAAVATAASDGVFVSPQYASYSDSSRGGLGAGVDVEATAAVGGHVRVRVAGRRWPGRLVRAVAALEDLRLAILHLADTSVGHDADVNCFNLKMEEGCEVATADEVATVVHQIFAYAAGACC

SEQ ID NO: 6857 - DNA, 1437 bp, Sorghum bicolor
  misc_feature: Ceres ANNOT ID no. 6068640
  misc_feature: Encodes the peptide sequence at SEQ ID NO 6858
atgctccggctggccttcccgctcgtctcccacctcccgcgcacgaaaccagccgcagtccgcccacgccctccacttgctcgacgatatgcctcctccgcctccacctccgcctcctccttctccccgcctccctctcccttgctaccgccgccgctacccccggcctccgcctacgtccacctccccttctgccgcaagcgctgccattactgcgacttccccatcgttgccctcggctcatcctcagcaccctcccctggcggtggcgaggccgcggaagaccccaggatcgtcgactacgtgcaactcctgctccgcgaggtctccgccacgcgcccggtctccgacgacggcgtgccgctcgagaccgtcttcttcgggggcggcacgccgtcgctcgtcccgccgcgcctggtcgccacgatcctcgacgcgctgcgcgccaggttcggcctgtcggcgtgccccgaggtctccatcgagatggaccccggcacgttcgacgccgccaggctcagggagctcgtgggcgtgggcgtcaaccgcgtctcgctcggtgtgcaggcgttccaggaggacctgctgcgggcgtgtggacgcgcgcacggcgtgaaggaggtgcacgaggccgtcgggatcgtcacggcgtgcgaggggctgcagaattggagcatggacctcatctcctcgctgccgaatcagacccaggagatgtgggaggaaagcttgaggtgcaccgtggatgcaaggcccactcacgtttccgtgtatgatctgcaaattgagcagggcaccaagtttgggcaaatgtattctcctggtgtctttcctcttccgagtgacactgagtctgcaaacttctacaagattgcttcgaagcggctttctgaagcaggatataatcactatgagatcagtagctactgcaagcctggatacgagtgcaagcacaacctaacatactggcagaaccggcccttctatgcctttggtcttggatctgcaagctacattaacggtatcaggtactccaggcccagaagaacaaaggagtatgcagaatgggttcagaagttagaggatggaacgtggtgccatgagtctagaagctctgatatgaaggacatggcactggatgtggttatgctatcactgagaacagcttgggggcttgatttgcaaagtttcagtaaatcctttgggaaaagcctggcgctatcactgtgtaacacatttaagcctttcgtggagagtgggcttgtaattgccatggatatggatcgacgagccttgccacatattgattttgagttggacctgcaaaatgaagatgattttggaagcagagttgcattcatccgtctcagcgacccagatggatttttattgtccaacgagttgatttcacttgcttttgggataatctcaccttga

SEQ ID NO: 6858 - protein, 478 aa, Sorghum bicolor
  misc_feature: Ceres ANNOT ID no. 6068640
  misc_feature (59)..(247): Pfam Id: Radical_SAM Pfam Desc: Radical SAM superfamily
  misc_feature (320)..(433): Pfam Id: HemN_C Pfam Desc: HemN C-terminal region
  misc_feature (54)..(478): NCBI GI: 10177310 NCBI Desc: oxygen-independent coproporphyrinogen-like protein [arabidopsis thaliana]
  misc_feature (55)..(473): NCBI GI: 126657581 NCBI Desc: coproporphyrinogen iii oxidase [cyanothece sp. ccy0110]
  misc_feature (52)..(436): NCBI GI: 17232448 NCBI Desc: coproporphyrinogen iii oxidase [nostoc sp. pcc 7120]
  misc_feature (56)..(422): NCBI GI: 119512056 NCBI Desc: coproporphyrinogen iii oxidase [nodularia spumigena ccy9414]
  misc_feature (57)..(404): NCBI GI: 22298735 NCBI Desc: oxygen independent coprophorphyrinogen iii oxidase 2 [thermosynechococcus elongatus bp-1]
MLRLAFPLVSHLPRTKPAAVRPRPPLARRYASSASTSASSFSPPPSPLLPPPLPPASAYVHLPFCRKRCHYCDFPIVALGSSSAPSPGGGEAAEDPRIVDYVQLLLREVSATRPVSDDGVPLETVFFGGGTPSLVPPRLVATILDALRARFGLSACPEVSIEMDPGTFDAARLRELVGVGVNRVSLGVQAFQEDLLRACGRAHGVKEVHEAVGIVTACEGLQNWSMDLISSLPNQTQEMWEESLRCTVDARPTHVSVYDLQIEQGTKFGQMYSPGVFPLPSDTESANFYKIASKRLSEAGYNHYEISSYCKPGYECKHNLTYWQNRPFYAFGLGSASYINGIRYSRPRRTKEYAEWVQKLEDGTWCHESRSSDMKDMALDVVMLSLRTAWGLDLQSFSKSFGKSLALSLCNTFKPFVESGLVIAMDMDRRALPHIDFELDLQNEDDFGSRVAFIRLSDPDGFLLSNELISLAFGIISP

SEQ ID NO: 6859 - DNA, 585 bp, Sorghum bicolor
  misc_feature: Ceres ANNOT ID no. 6068650
  misc_feature: Encodes the peptide sequence at SEQ ID NO 6860
atgtcggtgtcgtcgtcgctgtccaacttcctgctctgctgcttctacccgtccgccggccaccgccacgggcaccgcggcggcgcgtactactacagcagccacccgacgagcgccaacaccctctactaccacgagggccccttcgccgggcgcaggatgggccggagcagcaggccgctgtcgctgcagacggtggagctgaaggtgcggatgtgctgctcgggctgcgagcgggtggtgaagcacgcggtgagtcggctgcgcggtgtggactcggtggaggtggacgtggagatggagaaggtgacggtgacggggtacgtagaccggcaccgggtgctcaaggaggtccggcgcgccggcaagaaggcggagttctggcccaacccggacctgccgctgcacttcacctccgccaaggactacttccacgacgaggagtcgtaccgccgcacctacaactactaccgccacggctacaacggcgacaagcacggccagctccacgagccgcaccgcggcgccgaccccgtcagcaacatgttcaacgacgacgacgtcaacgcctgctccatcatgtag

SEQ ID NO: 6860 - protein, 194 aa, Sorghum bicolor
  misc_feature: Ceres ANNOT ID no. 6068650
  misc_feature (67)..(127): Pfam Id: HMA Pfam Desc: Heavy-metal-associated domain
  misc_feature (30)..(194): NCBI GI: 145333005 NCBI Desc: metal ion binding [arabidopsis thaliana]
  misc_feature (72)..(194): NCBI GI: 44917509 NCBI Desc: at2g18196 [arabidopsis thaliana]
  misc_feature (63)..(194): NCBI GI: 92899055 NCBI Desc: heavy metal transport/detoxification protein [medicago truncatula]
  misc_feature (90)..(194): NCBI GI: 92875937 NCBI Desc: heavy metal transport/detoxification protein [medicago truncatula]
  misc_feature (61)..(172): NCBI GI: 15221451 NCBI Desc: copper-binding family protein [arabidopsis thaliana]
MSVSSSLSNFLLCCFYPSAGHRHGHRGGAYYYSSHPTSANTLYYHEGPFAGRRMGRSSRPLSLQTVELKVRMCCSGCERVVKHAVSRLRGVDSVEVDVEMEKVTVTGYVDRHRVLKEVRRAGKKAEFWPNPDLPLHFTSAKDYFHDEESYRRTYNYYRHGYNGDKHGQLHEPHRGADPVSNMFNDDDVNACSIM

SEQ ID NO: 6861 - DNA, 1275 bp, Sorghum bicolor
  misc_feature: Ceres ANNOT ID no. 6068655
  misc_feature: Encodes the peptide sequence at SEQ ID NO 6862
atggagtacgagcgcatccatgagccgctcccgcgtcgtcagtccggcggattctctccagctaagctacgagcaatgcttcgcgggctagagaagcaccagcgcaacaacggcgaggacacgtcgccggaggccaacgactccggcgagcttgacgaccggaggagcttggaatgctccacctccaccgagatgtcgagcaacagcggccacaggtcaagaaaccgagccccggacgacgacagcttcgactcggagagcagctcatcggggccgccgacggtcaagaggtcgaccgcggtcgccgcgttactgccgcccttctctcggccaaccccgtccaagtgggacgacgccgagaagtggatttccagcccgacgtcaaaccgtactggccgtgcggggcctaccgccggaactgtgccaaagaagtctgcattggcattccctgaacatggaggccgtccaccagccgttgctaaggtggtcacggatgtgcctaccaacactggaccattggttaagaattcagatggtcttgccgatcctgatttacttaaacctgcacacaatgcttcaatagttgacgaaccagcacctgcagttaggtctgtctctatgagagacatgggaacagaaatgactccaattgccagccaggagccttcccggaccgcgactcctataattgcatctagtccaacttcttctcggacaccaactccacaacgcaccacagaactcagtgtgagtaatatagattctaacaaaatggagatgtctgaagaggagctacaaataagtacaagacaggaaattatggatcttggcgaaaggttaggcaagacaactatagctgcatgggcaagcaaggaagagaaaactgccgcacattccacgagtactacagcctataaggctgtcgatatcaacagggagaatcgagcggcagattggcaggaggcagagaaggcaaagtatcttgcaaggtttcagatggaggaagcaaagatccaagcttgggaaaatctccagaaagcgaaaattgaagctgaaatgaaaaggatagaggctaagatagagcgaaaacgggcgcgcgagcaggacaggctcgcgagcaagctggccgcagtaagccaccgagcggaggcgaagagggaggccgcggaggtgaggaggaaccaggaagccgcgagaacggaggagcaggcagcccagatccgagaaaccgggcatacgccttcctccttctcctgctggtgctggtgcctgtga

SEQ ID NO: 6862 - protein, 424 aa, Sorghum bicolor
  misc_feature: Ceres ANNOT ID no. 6068655
  misc_feature (307)..(418): Pfam Id: Remorin_C Pfam Desc: Remorin, C-terminal region
  misc_feature (200)..(423): NCBI GI: 38344336 NCBI Desc: osjnba0058k23.18 [oryza sativa (japonica cultivar-group)]
  misc_feature (200)..(423): NCBI GI: 116309948 NCBI Desc: h0714h04.6 [oryza sativa (indica cultivar-group)]
  misc_feature (200)..(423): NCBI GI: 115460610 NCBI Desc: os04g0620200 [oryza sativa (japonica cultivar-group)]
  misc_feature (202)..(422): NCBI GI: 92884019 NCBI Desc: remorin, c-terminal region [medicago truncatula]
  misc_feature (182)..(422): NCBI GI: 46805746 NCBI Desc: remorin protein-like [oryza sativa (japonica cultivar-group)]
  misc_feature: The sequence is a functional homolog of SEQ ID NO 104 in the 10/666,642US patent application
  misc_feature: The sequence is a functional homolog of SEQ ID NO 1040 in the 10/666,642US patent application
  misc_feature: The sequence is a functional homolog of SEQ ID NO 1041 in the 10/666,642US patent application
  misc_feature: The sequence is a functional homolog of SEQ ID NO 1042 in the 10/666,642US patent application
  misc_feature: The sequence is a functional homolog of SEQ ID NO 264 in the 10/666,642US patent application
  misc_feature: Useful for making plants with modulated growth and phenotype characteristics
  misc_feature: The sequence is a functional homolog of SEQ ID NO 104 in the 20070033671 US patent application
  misc_feature: The sequence is a functional homolog of SEQ ID NO 104 in the 20070033671 US patent application
  misc_feature: The sequence is a functional homolog of SEQ ID NO 1040 in the 20070033671 US patent application
  misc_feature: The sequence is a functional homolog of SEQ ID NO 1041 in the 20070033671 US patent application
  misc_feature: The sequence is a functional homolog of SEQ ID NO 1042 in the 20070033671 US patent application
  misc_feature: The sequence is a functional homolog of SEQ ID NO 264 in the 20070033671 US patent application
  misc_feature: The sequence is a functional homolog of SEQ ID NO 1041 in the 10/666,642 US patent application
MEYERIHEPLPRRQSGGFSPAKLRAMLRGLEKHQRNNGEDTSPEANDSGELDDRRSLECSTSTEMSSNSGHRSRNRAPDDDSFDSESSSSGPPTVKRSTAVAALLPPFSRPTPSKWDDAEKWISSPTSNRTGRAGPTAGTVPKKSALAFPEHGGRPPAVAKVVTDVPTNTGPLVKNSDGLADPDLLKPAHNASIVDEPAPAVRSVSMRDMGTEMTPIASQEPSRTATPIIASSPTSSRTPTPQRTTELSVSNIDSNKMEMSEEELQISTRQEIMDLGERLGKTTIAAWASKEEKTAAHSTSTTAYKAVDINRENRAADWQEAEKAKYLARFQMEEAKIQAWENLQKAKIEAEMKRIEAKIERKRAREQDRLASKLAAVSHRAEAKREAAEVRRNQEAARTEEQAAQIRETGHTPSSFSCWCWCL

SEQ ID NO: 6863 - DNA, 1017 bp, Sorghum bicolor
  misc_feature: Ceres ANNOT ID no. 6068658
  misc_feature: Encodes the peptide sequence at SEQ ID NO 6864
atggatccattggaaatgcagcacgactcgaagaaatccaataagcccaaatattctaagttcacgcagcaggagcttccagcatgcaaaccactgctaactccagcaattgtcatttctaccttcttactggttggcatcctatttgtcccaattggtctcgcatcgctttctgcatcacaagagattgtggagctggtacatagatatgatacaagttgtgtgccctcggctgataaagttgggttcattcaggacactaaaacggacaaatcatgcactagaactctaactgtacctaagcatatgaagagcccaattcaaatatattaccagatcggtgacttctatcaaaaccatcgacggtacgtgaaaagtcgtagtgataaacaattgctgtataaagatgctgcacacttgacaaaagattgtgagcctgaagtttatggtgctgatggtgctccaatcgttccatgtggcctcattgcttggagtttgttcaatgatacatatacaatttcggtcaacaagaaagctattgaagtgaataaaaaggatatagcttggcagagtgacaagaacaaaaaatttggcagtgatgtttatcccagaaactttcagaacggaaatcttataggtggtgctaagctaaatgagagcataccgttaagtgagcaagaagatctcattgtttggatgagaactgctgccctcccaactttcagaaagctctatggaagaattgagacagatattatggaaaatgatcaactcacagtggttatacagaacaactataacacatacagttttggagggtcaaaagcactggtcctttcaactacatcttggattggaggcaaaaataattttattggtgtcgcatatctgagtgttggtggtttttgccttttccttgcactgctttttttagttctctacatgattaagcccaggactcttggtgacccctcattcttgtcatggaataggtgtaccctggactatccaaactaa

SEQ ID NO: 6864 - protein, 338 aa, Sorghum bicolor
  misc_feature: Ceres ANNOT ID no. 6068658
  misc_feature (56)..(325): Pfam Id: CDC50 Pfam Desc: LEM3 (ligand-effect modulator 3) family / CDC50 family
  misc_feature (15)..(319): NCBI GI: 115465051 NCBI Desc: os05g0529900 [oryza sativa (japonica cultivar-group)]
  misc_feature (11)..(331): NCBI GI: 49388971 NCBI Desc: lem3 (ligand-effect modulator 3)-like [oryza sativa (japonica cultivar-group)]
  misc_feature (11)..(331): NCBI GI: 52076505 NCBI Desc: lem3-like [oryza sativa (japonica cultivar-group)]
  misc_feature (19)..(331): NCBI GI: 42562089 NCBI Desc: lem3 (ligand-effect modulator 3) family protein / cdc50 family protein [arabidopsis thaliana]
  misc_feature (35)..(331): NCBI GI: 4966357 NCBI Desc: >f3o9.16 [arabidopsis thaliana]
  misc_feature: Useful for making plants with modulated nitrogen use efficiency
  misc_feature: Functional homolog of the protein sequence given in SEQ ID NO 13263
MDPLEMQHDSKKSNKPKYSKFTQQELPACKPLLTPAIVISTFLLVGILFVPIGLASLSASQEIVELVHRYDTSCVPSADKVGFIQDTKTDKSCTRTLTVPKHMKSPIQIYYQIGDFYQNHRRYVKSRSDKQLLYKDAAHLTKDCEPEVYGADGAPIVPCGLIAWSLFNDTYTISVNKKAIEVNKKDIAWQSDKNKKFGSDVYPRNFQNGNLIGGAKLNESIPLSEQEDLIVWMRTAALPTFRKLYGRIETDIMENDQLTVVIQNNYNTYSFGGSKALVLSTTSWIGGKNNFIGVAYLSVGGFCLFLALLFLVLYMIKPRTLGDPSFLSWNRCTLDYPN

SEQ ID NO: 6865 - DNA, 2049 bp, Sorghum bicolor
  misc_feature: Ceres ANNOT ID no. 6068662
  misc_feature: Encodes the peptide sequence at SEQ ID NO 6866
atggcgccagtcagtttgcctcctggtttcaggttccaccccactgacgaggaactcatcatctactaccttaagaggaagatcaacgggagacagatagagctcgaaatcattcctgaggttgatctctacaagtgtgagccctgggatttgccagaaaaatcctttcttccaagcaaagaccttgaatggtatttcttcagccctcgggaccgcaagtacccaaatggatcaaggacaaaccgtgcaacaaaatctgggtactggaaggcaactgggaaggacagaaaggtgaactcgcacaggcgtgcagttggtatgaagaagaccttggtgtactatcggggccgagctccacatggttctcgcactgattgggtcatgcatgagtaccgcctcgacgagagggaatgcgagactgacactggcttacaggacgcgtatgcattatgccgagtttttaagaagacagcgcctgggccaaaaatcatagagcattatggtgcagtgcaccaccccatcgagcaacctcagtggatggcaagcagtgttgaccgctccccaacgctggacttgtccagtgatgttagaggtgatgatttcgagagcagcagtttctcattcccgactgaggcgccgatggactccatgcatggtgggttcgggatgcagatgagtgcacctcacgaggatggcaaatggatgcagttcctgagcgaagacgcctttaacgccaccaatcctttcttcatgaatccagcttcttccagcttctcatgtctcccatccaaggtggatgttgcactggagtgtgcaaggcttcagcacaggctctcattacctcccctggaggtggaggacttcccacaggacgtcagcctcgacacaaagacgagcgtgctccgcagcaaccccaacgaggttgacatccttcaagagttcctctccgtggcttcggcctctcaggagctaatcaacggcaccagcagcagctacgctgcagaaatgtggccaggcgctggcccaagcagcaccagcacccactacatcaatgaactatcttccctcgttgagcttggggtgaaggcaaaagaggaggcagacaatttctaccatatggactgcattggcacatctgtaggattcgcatcaaagccggtccatgtcgatgaaccggttaggttggttgagattgctgacatggaggagttcaaggaagagaagaggcaagtagagaaccttagaggagtgaggcttcacaacaatgacctaggagagattgttgtagaaggagatgaaagcaatccaacggactgcatcacacaataccccatatcagacgctgctgacaattcaggagaagccggtcacctgaccgatcccactaacgccggcggcctagacactacacccatcttctcgcaatctcaacctgacgactttgctattgggttcagtgacgacgtcaaccctaatgcatctttcgacctgtatgagaaggttgacgtcaaacatgggctcttcgtctcaacagtcggtgcaccgaagacattcttccaccacgttgagccatcgaagaaggtcagcttccacctgaatcccgtagcaagcgacgtcagcaaggcgatcgagaagttccatttccccattagtgtgacaaccaaagttagtggcagcagcatttccatttttagcaagttgaaggcgctcatcagggacaaattcctggtgaagaagctgccttcattatcataccaaagatccttaagcagcaaagaaacagcggcagcgagtgagctgctgcagatagtgtcgtcgctcctcttaacaccaatggaagtcacaggccccacgacgatgactaccgagcaagagttggtcaagaaggcgaagaaggtgatgaagccggggcccggttgtgatggaagccatgcatggcttcttccattctccaagaggagcaaaggcatttccagcatgttttttagtgggaaatgggcgtttctgacatccgcattggccatccgcactccagggtgcaatcactga

SEQ ID NO: 6866 - protein, 682 aa, Sorghum bicolor
  misc_feature: Ceres ANNOT ID no. 6068662
  misc_feature (6)..(134): Pfam Id: NAM Pfam Desc: No apical meristem (NAM) protein
  misc_feature (1)..(682): NCBI GI: 140067655 NCBI Desc: no apical meristem (nam) protein [medicago truncatula]
  misc_feature (1)..(427): NCBI GI: 6227016 NCBI Desc: contains similarity to gbaf123310 nac domain protein nam gene from arabidopsis thaliana
  misc_feature (1)..(326): NCBI GI: 15237939 NCBI Desc: no apical meristem (nam) family protein [arabidopsis thaliana]
  misc_feature (1)..(194): NCBI GI: 6714418 NCBI Desc: nam-like protein (no apical meristem) [arabidopsis thaliana]
  misc_feature (1)..(194): NCBI GI: 145651780 NCBI Desc: at3g03200 [arabidopsis thaliana]
  misc_feature: The sequence is a functional homolog of SEQ ID NO 10 in the 10/225,066US patent application
  misc_feature: The sequence is a functional homolog of SEQ ID NO 10 in the 10/714,887US patent application
  misc_feature: The sequence is a functional homolog of SEQ ID NO 10 in the 11/435,388US patent application
  misc_feature: The sequence is a functional homolog of SEQ ID NO 106 in the 10/225,066US patent application
  misc_feature: The sequence is a functional homolog of SEQ ID NO 1064 in the 10/225,066US patent application
  misc_feature: The sequence is a functional homolog of SEQ ID NO 136 in the 11/375,241US patent application
  misc_feature: The sequence is a functional homolog of SEQ ID NO 1873 in the 11/479,226US patent application
  misc_feature: The sequence is a functional homolog of SEQ ID NO 2018 in the 10/374,780US patent application
  misc_feature: The sequence is a functional homolog of SEQ ID NO 2340 in the 10/374,780US patent application
  misc_feature: The sequence is a functional homolog of SEQ ID NO 2472 in the 10/374,780US patent application
  misc_feature: The sequence is a functional homolog of SEQ ID NO 2478 in the 10/374,780US patent application
  misc_feature: The sequence is a functional homolog of SEQ ID NO 2838 in the 10/374,780US patent application
  misc_feature: The sequence is a functional homolog of SEQ ID NO 304 in the 10/374,780US patent application
  misc_feature: The sequence is a functional homolog of SEQ ID NO 390 in the 10/374,780US patent application
  misc_feature: The sequence is a functional homolog of SEQ ID NO 520 in the 11/435,388US patent application
  misc_feature: The sequence is a functional homolog of SEQ ID NO 572 in the 10/225,066US patent application
  misc_feature: The sequence is a functional homolog of SEQ ID NO 612 in the 11/435,388US patent application
  misc_feature: The sequence is a functional homolog of SEQ ID NO 620 in the 11/479,226US patent application
  misc_feature: The sequence is a functional homolog of SEQ ID NO 682 in the 11/435,388US patent application
  misc_feature: The sequence is a functional homolog of SEQ ID NO 718 in the 10/225,066US patent application
  misc_feature: The sequence is a functional homolog of SEQ ID NO 80 in the 10/225,068US patent application
  misc_feature: The sequence is a functional homolog of SEQ ID NO 838 in the 10/225,066US patent application
  misc_feature: The sequence is a functional homolog of SEQ ID NO 853 in the 10/374,780US patent application
  misc_feature: The sequence is a functional homolog of SEQ ID NO 974 in the 10/225,066US patent application
  misc_feature: Useful for making plants with modulated growth and phenotype characteristics
  misc_feature: Useful for making plants with modulated nitrogen use efficiency
  misc_feature: Functional homolog of the protein sequence encoded by LOCUS at5g13180
  misc_feature: The sequence is a functional homolog of SEQ ID NO 80 in the 20050120408 US patent application
  misc_feature: The sequence is a functional homolog of SEQ ID NO 10 in the 20050160493 US patent application
  misc_feature: The sequence is a functional homolog of SEQ ID NO 106 in the 20050160493 US patent application
  misc_feature: The sequence is a functional homolog of SEQ ID NO 1064 in the 20050160493 US patent application
  misc_feature: The sequence is a functional homolog of SEQ ID NO 572 in the 20050160493 US patent application
  misc_feature: The sequence is a functional homolog of SEQ ID NO 974 in the 20050160493 US patent application
  misc_feature: The sequence is a functional homolog of SEQ ID NO 2018 in the 20060162006 US patent application
  misc_feature: The sequence is a functional homolog of SEQ ID NO 853 in the 20060162006 US patent application
  misc_feature: The sequence is a functional homolog of SEQ ID NO 612 in the 20060272060 US patent application
  misc_feature: The sequence is a functional homolog of SEQ ID NO 612 in the 11/435,388 US patent application
  misc_feature: The sequence is a functional homolog of SEQ ID NO 2478 in the 10/374,780 US patent application
  misc_feature: The sequence is a functional homolog of SEQ ID NO 572 in the 10/225,066 US patent application
  misc_feature: The sequence is a functional homolog of SEQ ID NO 344 in the 10/666,642 US patent application
  misc_feature: Useful for making plants with altered carbohydrate content
  misc_feature: Functional homolog of the protein sequence given in SEQ ID NO 13622
  misc_feature: The sequence is a functional homolog of SEQ ID NO 1157 in the 11/479,226 US patent application
  misc_feature: The sequence is a functional homolog of SEQ ID NO 1416 in the 10/666,642 US patent application
  misc_feature: The sequence is a functional homolog of SEQ ID NO 30 in the 10/286,264 US patent application
  misc_feature: The sequence is a functional homolog of SEQ ID NO 430 in the 11/435,388 US patent application
  misc_feature: The sequence is a functional homolog of SEQ ID NO 518 in the 10/412,699 US patent application
  misc_feature: Useful for making plants with modulated water use efficiency
  misc_feature: The sequence is a functional homolog of SEQ ID NO 2418 in the 10/374,780 US patent application
  misc_feature: The sequence is a functional homolog of SEQ ID NO 554 in the 10/225,066 US patent application
  misc_feature: The sequence is a functional homolog of SEQ ID NO 68 in the 10/286,264 US patent application
  misc_feature: The sequence is a functional homolog of SEQ ID NO 316 in the 10/412,699 US patent application
  misc_feature: The sequence is a functional homolog of SEQ ID NO 738 in the 11/479,226 US patent application
  misc_feature: The sequence is a functional homolog of SEQ ID NO 2346 in the 10/374,780 US patent application
  misc_feature: The sequence is a functional homolog of SEQ ID NO 238 in the 10/225,068 US patent application
  misc_feature: The sequence is a functional homolog of SEQ ID NO 338 in the 10/412,699 US patent application
  misc_feature: The sequence is a functional homolog of SEQ ID NO 774 in the 11/479,226 US patent application
  misc_feature: Useful for making plants with altered terpenoid content
  misc_feature: Functional homolog of the protein sequence given in SEQ ID NO 13140
  misc_feature: Useful for biocontainment applications
  misc_feature: Functional homolog of the protein sequence given in SEQ ID NO 13623
  misc_feature: The sequence is a functional homolog of SEQ ID NO 2776 in the 10/374,780 US patent application
  misc_feature: The sequence is a functional homolog of SEQ ID NO 416 in the 10/225,066 US patent application
  misc_feature: Useful for making plants with modulated nitrogen use efficiency
  misc_feature: Functional homolog of the protein sequence given in SEQ ID NO 13624
  misc_feature: The sequence is a functional homolog of SEQ ID NO 326 in the 10/412,699 US patent application
  misc_feature: The sequence is a functional homolog of SEQ ID NO 760 in the 11/479,226 US patent application
  misc_feature: The sequence is a functional homolog of SEQ ID NO 890 in the 10/374,780 US patent application
  misc_feature: Useful for making plants with altered cell wall content and/or composition
  misc_feature: Useful for making plants with altered lignin content
  misc_feature: Functional homolog of the protein sequence given in SEQ ID NO 13620
  misc_feature: The sequence is a functional homolog of SEQ ID NO 2060 in the 10/374,780 US patent application
  misc_feature: The sequence is a functional homolog of SEQ ID NO 516 in the 10/412,699 US patent application
  misc_feature: The sequence is a functional homolog of SEQ ID NO 2470 in the 10/374,780 US patent application
  misc_feature: The sequence is a functional homolog of SEQ ID NO 798 in the 10/225,066 US patent application
  misc_feature: The sequence is a functional homolog of SEQ ID NO 26 in the 10/286,264 US patent application
  misc_feature: The sequence is a functional homolog of SEQ ID NO 336 in the 10/412,699 US patent application
  misc_feature: The sequence is a functional homolog of SEQ ID NO 770 in the 11/479,226 US patent application
  misc_feature: Useful for making plants with modulated oxidative stress sensitivity
  misc_feature: Functional homolog of the protein sequence given in SEQ ID NO 13621
  misc_feature: The sequence is a functional homolog of SEQ ID NO 1196 in the 10/412,699 US patent application
  misc_feature: The sequence is a functional homolog of SEQ ID NO 865 in the 10/374,780 US patent application
  misc_feature: The sequence is a functional homolog of SEQ ID NO 328 in the 10/374,780 US patent application
  misc_feature: The sequence is a functional homolog of SEQ ID NO 852 in the 10/225,066 US patent application
  misc_feature: The sequence is a functional homolog of SEQ ID NO 100 in the 10/374,780 US patent application
  misc_feature: The sequence is a functional homolog of SEQ ID NO 318 in the 10/412,699 US patent application
  misc_feature: The sequence is a functional homolog of SEQ ID NO 749 in the 11/479,226 US patent application
  misc_feature: The sequence is a functional homolog of SEQ ID NO 884 in the 10/225,066 US patent application
  misc_feature: The sequence is a functional homolog of SEQ ID NO 1197 in the 10/412,699 US patent application
  misc_feature: The sequence is a functional homolog of SEQ ID NO 866 in the 10/374,780 US patent application
  misc_feature: The sequence is a functional homolog of SEQ ID NO. 362 in the 11/188,298 US application
  misc_feature: The sequence is a functional homolog of SEQ ID NO. 466 in the 11/188,298 US application
  misc_feature: The sequence is a functional homolog of SEQ ID NO. 335 in the 11/188,298 US application
MAPVSLPPGFRFHPTDEELIIYYLKRKINGRQIELEIIPEVDLYKCEPWDLPEKSFLPSKDLEWYFFSPRDRKYPNGSRTNRATKSGYWKATGKDRKVNSHRRAVGMKKTLVYYRGRAPHGSRTDWVMHEYRLDERECETDTGLQDAYALCRVFKKTAPGPKIIEHYGAVHHPIEQPQWMASSVDRSPTLDLSSDVRGDDFESSSFSFPTEAPMDSMHGGFGMQMSAPHEDGKWMQFLSEDAFNATNPFFMNPASSSFSCLPSKVDVALECARLQHRLSLPPLEVEDFPQDVSLDTKTSVLRSNPNEVDILQEFLSVASASQELINGTSSSYAAEMWPGAGPSSTSTHYINELSSLVELGVKAKEEADNFYHMDCIGTSVGFASKPVHVDEPVRLVEIADMEEFKEEKRQVENLRGVRLHNNDLGEIVVEGDESNPTDCITQYPISDAADNSGEAGHLTDPTNAGGLDTTPIFSQSQPDDFAIGFSDDVNPNASFDLYEKVDVKHGLFVSTVGAPKTFFHHVEPSKKVSFHLNPVASDVSKAIEKFHFPISVTTKVSGSSISIFSKLKALIRDKFLVKKLPSLSYQRSLSSKETAAASELLQIVSSLLLTPMEVTGPTTMTTEQELVKKAKKVMKPGPGCDGSHAWLLPFSKRSKGISSMFFSGKWAFLTSALAIRTPGCNH

SEQ ID NO: 6867 - DNA, 723 bp, Sorghum bicolor
  misc_feature: Ceres ANNOT ID no. 6068670
  misc_feature: Encodes the peptide sequence at SEQ ID NO 6868
atggatcccgcggcaggaggcgccggccagcagcgccagaacaaagcttcggcgggcaagaaggcaaagaagggcagcggcagcggcagcggcgggagatggccgtcggtcaagcccaagaaggatctccagatcaatcgcctcaagggcacccacctcctcaccattccggacttcttcacttccgccgaggccaagactttcattgatgttgctgagtctatgggcttcacgcaccagggcagtttggggccactaaagggggaggcttacagagacaatgatcggatatctgtgatggatccattgcttgctcaagccatttgggaatcaggaataaacagaatttttacagacatcagcgtttctggcaaagtagcaacaggattgaatccaaatatcaggttctacaggtacactgaaggtcagcgctttggtcggcatattgatgagagtgtcgaccttggggatggttctaaaacgtattatacgcttttaatttacctttctggcaaaggaagcgcaaaggattcatctggacaagctcttgttggaggggagactgtcttttatgatcaaagaggtggagttgttgctgaggttgctccagtgcaaggaatggcactcctccacctacatggcgccaaatgtatgctgcatgaagcccgggttgtgaaaaagaatgccaagtatgtactccgttcagatgttgtattttcttag

SEQ ID NO: 6868 - protein, 240 aa, Sorghum bicolor
  misc_feature: Ceres ANNOT ID no. 6068670
  misc_feature (53)..(239): NCBI GI: 44980904 NCBI Desc: abr017cp [eremothecium gossypii]
  misc_feature (53)..(239): NCBI GI: 45185246 NCBI Desc: abr017cp [eremothecium gossypii]
  misc_feature (52)..(239): NCBI GI: 126738251 NCBI Desc: uncharacterized iron-regulated protein [roseobacter sp. sk209-2-6]
  misc_feature (56)..(239): NCBI GI: 68344016 NCBI Desc: oxidoreductase, 2og-fe(ii) oxygenase family family [pseudomonas fluorescens pf-5]
  misc_feature (54)..(239): NCBI GI: 115380660 NCBI Desc: oxidoreductase, 2og-fe(ii) oxygenase family family [stigmatella aurantiaca dw4/3-1]
MDPAAGGAGQQRQNKASAGKKAKKGSGSGSGGRWPSVKPKKDLQINRLKGTHLLTIPDFFTSAEAKTFIDVAESMGFTHQGSLGPLKGEAYRDNDRISVMDPLLAQAIWESGINRIFTDISVSGKVATGLNPNIRFYRYTEGQRFGRHIDESVDLGDGSKTYYTLLIYLSGKGSAKDSSGQALVGGETVFYDQRGGVVAEVAPVQGMALLHLHGAKCMLHEARVVKKNAKYVLRSDVVFS

SEQ ID NO: 6869 - DNA, 1395 bp, Sorghum bicolor
  misc_feature: Ceres ANNOT ID no. 6068672
  misc_feature: Encodes the peptide sequence at SEQ ID NO 6870
atggcgtcggaggccaagaacgtgggcatcctcgccatggacatctacttcccgcccaactgcgtgctccaggaagagttggaaacacatgatggcgtgagcaaagggaagtataccattgggcttgggcaggaaagtatggcattttgcactgaagttgaggatgttatttcgatgagcttgacagtggtgaagtccctcctgaaaaattataacattgacccaaagtgcattggacgtttggaagttggcagtgaaacagtaatagacaagagcaagtctataaagacatggctgatgcagatatttgaggaatctggcaatactgatattgaaggagttgactcctcaaatgcatgctatggtgggacagctgcattgtttaattgtgttaactgggttgaaagcaactcatgggatgggcgttatggacttgttgtttgcacagacagtgcggtttacgctgaaggtccggctcgtcctactggtggtgcggctgctattgcaatgctgattggaccaaatgctcctatttcttttgaaagtaaatataggggatcccatatggcccatgtatacgacttttacaagcccgatctcgcgagtgaatatccggtggttgatgggaagctatcacagacatgctaccttatggcattggactcctgctacaatgtattttgcaaaaagtatgaaaagaatgagggaaagcagttttcaatttttgatgcagattatgttgtgttccattctccatacaacaagcttgtacagaaaagctttgctcgtttgtactacaatgatttcctgagaaactgcagcacggttgatgaagagtcaagggaaaaattggcaccctatgcaggcttgtcatctgaagaaagctaccagagtcgcgaccttgaaaaggcatctcagcaagttgcaaagaacctgtacgactccaaggttcagccaacaacattgatcccaaaacaagttgggaatatgtatacagcatcactctatgccgctcttgcatcgattattcataatagacatgaaactctggcagggcagaggattgttatgttttcatatggcagtgggttgacatcaacaatgttctctttcaagattaatgaaggccagcaccctttcagtctgctaaacattgcaaacataatggatgtttccaagaaattgaaggcaagacatgtggttcccccaaagaaatttgtcgagacactgaaactgatggagcaccgctatggggcgaaagattttgtgaccagtcaagatacaagtttgctatctgcaggtacatattatctcacgcacgttgactccatgtaccgaaggttctatgacgtgaaaggtgacagtgtcaccactgcaatctccaacggccactga

SEQ ID NO: 6870 - protein, 464 aa, Sorghum bicolor
  misc_feature: Ceres ANNOT ID no. 6068672
  misc_feature (178)..(452): Pfam Id: HMG_CoA_synt_C Pfam Desc: Hydroxymethylglutaryl-coenzyme A synthase C terminal
  misc_feature (4)..(177): Pfam Id: HMG_CoA_synt_N Pfam Desc: Hydroxymethylglutaryl-coenzyme A synthase N terminal
  misc_feature (5)..(464): NCBI GI: 42795470 NCBI Desc: hmg-coa synthase 2 [hevea brasiliensis]
  misc_feature (5)..(464): NCBI GI: 16417956 NCBI Desc: hydroxymethylglutaryl coenzyme a synthase [hevea brasiliensis]
  misc_feature (5)..(464): NCBI GI: 14916100 NCBI Desc: hydroxymethylglutaryl coenzyme a synthase [hevea brasiliensis]
  misc_feature (5)..(464): NCBI GI: 7799986 NCBI Desc: hmg-coa synthase [brassica juncea]
  misc_feature (5)..(464): NCBI GI: 11192003 NCBI Desc: hmg-coa synthase [brassica juncea]
  misc_feature (5)..(464): SWISSPROT Homolog: EC 2.3.3.10 Hydroxymethylglutaryl-CoA synthase
  misc_feature: Useful for making plants with modulated nitrogen use efficiency
  misc_feature: GREAT-hit functional homolog of the protein sequence given in SEQ ID NO 13003
  misc_feature: Useful for making plants with modulated nitrogen use efficiency
  misc_feature: Functional homolog of the protein sequence given in SEQ ID NO 13003
MASEAKNVGILAMDIYFPPNCVLQEELETHDGVSKGKYTIGLGQESMAFCTEVEDVISMSLTVVKSLLKNYNIDPKCIGRLEVGSETVIDKSKSIKTWLMQIFEESGNTDIEGVDSSNACYGGTAALFNCVNWVESNSWDGRYGLVVCTDSAVYAEGPARPTGGAAAIAMLIGPNAPISFESKYRGSHMAHVYDFYKPDLASEYPVVDGKLSQTCYLMALDSCYNVFCKKYEKNEGKQFSIFDADYVVFHSPYNKLVQKSFARLYYNDFLRNCSTVDEESREKLAPYAGLSSEESYQSRDLEKASQQVAKNLYDSKVQPTTLIPKQVGNMYTASLYAALASIIHNRHETLAGQRIVMFSYGSGLTSTMFSFKINEGQHPFSLLNIANIMDVSKKLKARHVVPPKKFVETLKLMEHRYGAKDFVTSQDTSLLSAGTYYLTHVDSMYRRFYDVKGDSVTTAISNGH

SEQ ID NO: 6871 - DNA, 1050 bp, Sorghum bicolor
  misc_feature: Ceres ANNOT ID no. 6068680
  misc_feature: Encodes the peptide sequence at SEQ ID NO 6872
atggggttcctcgggcggaggccgtggctgctgttcctcgccctcgccctcgcttccgcggccgtcgccgtcgccgtggaagcctccgagggagacgctgatccgctctacagagcttgtgtggaaggatgccaaaagacaggctccctgaaggagacttctattaaacactgtttggtgccaaccgatggccaacctgctgacaaatcatggtacacgcacgagccactgtacttgcaatggaaggactggaactgcaagagtgaatgcagataccactgtatgatggaaagggagagtgaaagggcaaagcttggccttcagcctgttaagtatcatggaaagtggcctctgaagcgtgcctctgtgtttcaggaacctttatctgcatctctttctgctcttactcttgttgtgcaatttaatgggtggctatcgtttttcctcttgctttattataagcttcctctacgatcagaaactcacaagacatactatgaatacactggcttgtggcacatttatgggctccttgccatgaattcatggttctggagtgccatatatcacagttgtgacacaacttggacagaaaagctatatttttcatcagctgctgcctttctggggtattctctcattttgacaatcctgcggactttaaatttaagagacgaagcttctagagttatggttgccgctcctattctggcttttgtaacaacccacattctgtacctcaacttctacgaacttgacaaaggcctgaacatgaaggtttgtactgtgataagcattgctcagtgtctcctatgggcactgtgggctgtcatgactcggcatccttcaaggctgaagatcatatttgtttccattggaggtgcggttgcagtacttctggaagcttatgacattcctccgcgatggggatatgtagatggccgtgcaatctgccttgctgtggctatacccctgtcgtacctttggtggagctttgccaaggaagatgctgagatgcgaacatcagcaatcctgaagaagacacgataa

SEQ ID NO: 6872 - protein, 349 aa, Sorghum bicolor
  misc_feature: Ceres ANNOT ID no. 6068680
  misc_feature (73)..(345): Pfam Id: Per1 Pfam Desc: Per1-like
  misc_feature (10)..(349): NCBI GI: 82400132 NCBI Desc: per1-like family protein [solanum tuberosum]
  misc_feature (10)..(349): NCBI GI: 82621128 NCBI Desc: per1-like family protein [solanum tuberosum]
  misc_feature (8)..(349): NCBI GI: 20147283 NCBI Desc: at5g62130/mtg10_150 [arabidopsis thaliana]
  misc_feature (12)..(264): NCBI GI: 140057270 NCBI Desc: per1-like [medicago truncatula]
  misc_feature (12)..(190): NCBI GI: 92898600 NCBI Desc: per1-like [medicago truncatula]
MGFLGRRPWLLFLALALASAAVAVAVEASEGDADPLYRACVEGCQKTGSLKETSIKHCLVPTDGQPADKSWYTHEPLYLQWKDWNCKSECRYHCMMERESERAKLGLQPVKYHGKWPLKRASVFQEPLSASLSALTLVVQFNGWLSFFLLLYYKLPLRSETHKTYYEYTGLWHIYGLLAMNSWFWSAIYHSCDTTWTEKLYFSSAAAFLGYSLILTILRTLNLRDEASRVMVAAPILAFVTTHILYLNFYELDKGLNMKVCTVISIAQCLLWALWAVMTRHPSRLKIIFVSIGGAVAVLLEAYDIPPRWGYVDGRAICLAVAIPLSYLWWSFAKEDAEMRTSAILKKTR

SEQ ID NO: 6873 - DNA, 1062 bp, Sorghum bicolor
  misc_feature: Ceres ANNOT ID no. 6068682
  misc_feature: Encodes the peptide sequence at SEQ ID NO 6874
atgaccggaggaggggaggagcaggggagatcgctgttcggcatgtctctgacggaccggcccaggtggcagcagttcttgatctgctcctcgggcttcttcttcggctacctcgtcaatggcatctgcgaggagtacgtgtacaacaggcttcagttcagctacgggtggtacttcacgtttgtgcaggggttcgtgtacctggcactgatacggctgcaggggttcacggtgaagcagatggtgaacccgtggcggacctacgtgcgcctctcggctgtgctcatgggctccaatggcctcaccaagggctccctcgccttcctcaattaccctgcacaaatcatgtttaagtcaaccaaggttctaccggtgatggtaatgggagcttttatccctggtttaaggcgcaagtacccgttccaagagtatgtatcagccgtgatgctcgtcattggcctcatactcttcacgctcgcggatgcgcagacatcgcctaacttcagcttggtcggcgtcgccatggtgtccggggcacttgtcatggatgcttttcttggcaacctgcaagaagcaatcttcaagatgaacccagacacgactcagatggagatgctgttctgctccactgttgttggccttccattcctagcagtgccaatggtgttaacaggtgagctcatgacggcatggacttcctgctcccagcatctgtacgtgtacgcggtgctggtgtttgaggcgatggccacgttcgtcggccaggtctccgtgctctccctcatcgcgcttttcggcgccgcaaccacagccatggtgacgacggcgaggaaagcagtgacgctgctgctgtcgtacctgatattcaccaagcctctgacggagcagcacgcgacggggctcctcctgataaccatgggcatcgtcatcaagctcctgccggagaacaaggagggacgtctgcgccggctgccgaagaagacggaggagcgctctggcgatgatgacgacaagccccttgagagcagagaagcggacgcggaaaaggcaagtttggtgtag

SEQ ID NO: 6874 - protein, 353 aa, Sorghum bicolor
  misc_feature: Ceres ANNOT ID no. 6068682
  misc_feature (26)..(319): Pfam Id: UAA Pfam Desc: UAA transporter family
  misc_feature (172)..(313): Pfam Id: TPT Pfam Desc: Triose-phosphate Transporter family
  misc_feature (6)..(348): NCBI GI: 124360233 NCBI Desc: solute carrier family 35 member b3, related [medicago truncatula]
  misc_feature (12)..(325): NCBI GI: 119575639 NCBI Desc: solute carrier family 35, member b3, isoform cra_c [homo sapiens]
  misc_feature (12)..(325): NCBI GI: 119575644 NCBI Desc: solute carrier family 35, member b3, isoform cra_f [homo sapiens]
  misc_feature (12)..(325): NCBI GI: 119575638 NCBI Desc: solute carrier family 35, member b3, isoform cra_b [homo sapiens]
  misc_feature (12)..(310): NCBI GI: 4680677 NCBI Desc: cgi-19 protein [homo sapiens]
  misc_feature: The sequence is a functional homolog of SEQ ID NO. 484 in the 11/188,298 US application
  misc_feature: The sequence is a functional homolog of SEQ ID NO. 360 in the 11/188,298 US application
MTGGGEEQGRSLFGMSLTDRPRWQQFLICSSGFFFGYLVNGICEEYVYNRLQFSYGWYFTFVQGFVYLALIRLQGFTVKQMVNPWRTYVRLSAVLMGSNGLTKGSLAFLNYPAQIMFKSTKVLPVMVMGAFIPGLRRKYPFQEYVSAVMLVIGLILFTLADAQTSPNFSLVGVAMVSGALVMDAFLGNLQEAIFKMNPDTTQMEMLFCSTVVGLPFLAVPMVLTGELMTAWTSCSQHLYVYAVLVFEAMATFVGQVSVLSLIALFGAATTAMVTTARKAVTLLLSYLIFTKPLTEQHATGLLLITMGIVIKLLPENKEGRLRRLPKKTEERSGDDDDKPLESREADAEKASLV

SEQ ID NO: 6875 - DNA, 633 bp, Sorghum bicolor
  misc_feature: Ceres ANNOT ID no. 6068691
  misc_feature: Encodes the peptide sequence at SEQ ID NO 6876
atggagcgggagcaggagcaggaggcgggcacagcacagcaactgctcggtcggcgcgtgcgcgcggacacgcgacacccggtgtaccgcggcatccggtaccgcgggggcaagtgggtgtcggagatccgggagccgcgcaagtccaacaggatctggctgggcacgtacccggcgccggagatggccgccgcggcctacgacgccgccgcattggctctgcggggcgccgaggccgcgctcaacttccccggcgcggccatgtcccggcccgcgccggcgtcgtgctctcccgacgacatccgcgcggccgctgcggccgccgctgccgcggtgatcggccgttcccattcgccgcaggtgggtggtgaagcagctgctggtggtggttgcggtgcaagcacttggtcgtccggtgccggtgcccagggccaggtgccggagcaccgagcgggcgacaggcggatcgtggacgaggacgacgtgttccaggtgccgcgactgctggcgggcatggccgaggggttgatgatgagcccaccgaggctcgtcggccccgcgacggacggcgccgtgttgctggaggaggacggcagcgaggacggcgtggtgagcctgtgggatcactcgtga

SEQ ID NO: 6876 - protein, 210 aa, Sorghum bicolor
  misc_feature: Ceres ANNOT ID no. 6068691
  misc_feature (27)..(77): Pfam Id: AP2 Pfam Desc: AP2 domain
  misc_feature (2)..(210): NCBI GI: 32455216 NCBI Desc: transcription factor [oryza sativa (japonica cultivar-group)]
  misc_feature (21)..(209): NCBI GI: 116310031 NCBI Desc: osigba0127a14.7 [oryza sativa (indica cultivar-group)]
  misc_feature (17)..(111): NCBI GI: 79013964 NCBI Desc: c-repeat binding facor 1b [eucalyptus gunnii]
  misc_feature (17)..(111): NCBI GI: 102230394 NCBI Desc: c-repeat binding factor [eucalyptus globulus]
  misc_feature (16)..(209): NCBI GI: 77744832 NCBI Desc: ap2/erebp transcription factor [arabidopsis thaliana]
  misc_feature: The sequence is a functional homolog of SEQ ID NO 1050 in the 10/666,642US patent application
  misc_feature: The sequence is a functional homolog of SEQ ID NO 1222 in the 10/374,780US patent application
  misc_feature: The sequence is a functional homolog of SEQ ID NO 1226 in the 10/374,780US patent application
  misc_feature: The sequence is a functional homolog of SEQ ID NO 1227 in the 10/374,780US patent application
  misc_feature: The sequence is a functional homolog of SEQ ID NO 1232 in the 10/374,780US patent application
  misc_feature: The sequence is a functional homolog of SEQ ID NO 1233 in the 10/374,780US patent application
  misc_feature: The sequence is a functional homolog of SEQ ID NO 1234 in the 10/374,780US patent application
  misc_feature: The sequence is a functional homolog of SEQ ID NO 1411 in the 10/412,699US patent application
  misc_feature: The sequence is a functional homolog of SEQ ID NO 706 in the 11/435,388US patent application
  misc_feature: The sequence is a functional homolog of SEQ ID NO 712 in the 11/435,388US patent application
  misc_feature: The sequence is a functional homolog of SEQ ID NO 718 in the 11/435,388US patent application
  misc_feature: The sequence is a functional homolog of SEQ ID NO 776 in the 11/435,388US patent application
  misc_feature: The sequence is a functional homolog of SEQ ID NO 778 in the 11/435,388US patent application
  misc_feature: The sequence is a functional homolog of SEQ ID NO 780 in the 11/435,388US patent application
  misc_feature: Useful for making plants with modulated growth and phenotype characteristics
  misc_feature: The sequence is a functional homolog of SEQ ID NO 1411 in the 20040045049 US patent application
  misc_feature: The sequence is a functional homolog of SEQ ID NO 1226 in the 20060162006 US patent application
  misc_feature: The sequence is a functional homolog of SEQ ID NO 1227 in the 20060162006 US patent application
  misc_feature: The sequence is a functional homolog of SEQ ID NO 1232 in the 20060162006 US patent application
  misc_feature: The sequence is a functional homolog of SEQ ID NO 1233 in the 20060162006 US patent application
  misc_feature: The sequence is a functional homolog of SEQ ID NO 1234 in the 20060162006 US patent application
  misc_feature: The sequence is a functional homolog of SEQ ID NO 776 in the 20060272060 US patent application
  misc_feature: The sequence is a functional homolog of SEQ ID NO 778 in the 20060272060 US patent application
  misc_feature: The sequence is a functional homolog of SEQ ID NO 780 in the 20060272060 US patent application
  misc_feature: The sequence is a functional homolog of SEQ ID NO 1050 in the 20070033671 US patent application
  misc_feature: The sequence is a functional homolog of SEQ ID NO 1233 in the 10/374,780 US patent application
MEREQEQEAGTAQQLLGRRVRADTRHPVYRGIRYRGGKWVSEIREPRKSNRIWLGTYPAPEMAAAAYDAAALALRGAEAALNFPGAAMSRPAPASCSPDDIRAAAAAAAAAVIGRSHSPQVGGEAAAGGGCGASTWSSGAGAQGQVPEHRAGDRRIVDEDDVFQVPRLLAGMAEGLMMSPPRLVGPATDGAVLLEEDGSEDGVVSLWDHS

SEQ ID NO: 6877 - DNA, 714 bp, Sorghum bicolor
  misc_feature: Ceres ANNOT ID no. 6068695
  misc_feature: Encodes the peptide sequence at SEQ ID NO 6878
atgagctcgttagatgccacacgagctgagctcggcctcgttgttctgtacctgaacaaagccgaggctcgggacaagatctgcagggccatccagtacggctccaagttcataagcaacgggcagcctggcacggcgcaggatgtcgataaatcgaccaccttggctcgcaaagttttccggctcctcaagtgggtgaatgatctgcatgctcttatcagcccgccggctaaagggacacctctcacccttgtcctgcttggcaagtccaaaaatgcgctgctttcgacgttcttgttcctggatcaatttgtgtggttaggacgaacagggataatcaagaacaaggaggcgacggaccgggttgccaggatatccttgtactgctggatggcttcttctgtctgtgcaggtctagttgagcttggagagcttaaaaggctatcaagatcaatgaggaagcttgcaagagagctgaggaacacagataaatatgagaatgaacagtaccaaaacaaaatgaagcagtcagatgaaaggctcctggcccttgtcaaggcggccatggacgtggtcgtggccattgggcttcttcaattggcgcccaagaaggtcactccaagggtgacaggagcctttgggttcatcacctcgctcatctcctgctatcagcaacttccttcccgcgctcctttggccaaagtcaaagtttga

SEQ ID NO: 6878 - protein, 237 aa, Sorghum bicolor
  misc_feature: Ceres ANNOT ID no. 6068695
  misc_feature (11)..(226): Pfam Id: PEX11 Pfam Desc: Peroxisomal biogenesis factor 11 (PEX11)
  misc_feature (1)..(234): NCBI GI: 92886312 NCBI Desc: peroxisomal biogenesis factor 11 [medicago truncatula]
  misc_feature (1)..(230): NCBI GI: 55296207 NCBI Desc: peroxisomal biogenesis factor 11 protein-like [oryza sativa (japonica cultivar-group)]
  misc_feature (1)..(230): NCBI GI: 115466122 NCBI Desc: os06g0127000 [oryza sativa (japonica cultivar-group)]
  misc_feature (1)..(234): NCBI GI: 56368449 NCBI Desc: peroxisomal membrane protein pex11-2 [arabidopsis thaliana]
  misc_feature (131)..(229): NCBI GI: 16323256 NCBI Desc: at2g45740/f4i18.28 [arabidopsis thaliana]
MSSLDATRAELGLVVLYLNKAEARDKICRAIQYGSKFISNGQPGTAQDVDKSTTLARKVFRLLKWVNDLHALISPPAKGTPLTLVLLGKSKNALLSTFLFLDQFVWLGRTGIIKNKEATDRVARISLYCWMASSVCAGLVELGELKRLSRSMRKLARELRNTDKYENEQYQNKMKQSDERLLALVKAAMDVVVAIGLLQLAPKKVTPRVTGAFGFITSLISCYQQLPSRAPLAKVKV

SEQ ID NO: 6879 - DNA, 924 bp, Sorghum bicolor
  misc_feature: Ceres ANNOT ID no. 6068699
  misc_feature: Encodes the peptide sequence at SEQ ID NO 6880
atggtttcgctatgccatccgattcggatccgagcatgcgggaacaccgcgacgaggaggaatgcagcagcggcgaaggtcctctgctccatgcagcaaacgccgccgccgccggcccagagcacgatcaaggttgttatcgttggggccacgaaggagatcgggaggacggccgttcttgcggtgaccaaggccaggggaatggagcttgcaggggcgatcgactcgcagtgcattggcgaggacgcaggacagataagtggcatggatgagccattggagatccctgtgctgaacgacctcaccatggttctgggctccatagcgcagtcgagggcaactggcgtggttgtcgatttcagcgagccttcagctgtttacgacaatgtaaagcaggcagcggcatttggtttaagcagcgtcgtctatgttccaaaaattgagttagatacagtaactgaactttcagcattttgcgagaaggcaagcatgggctgcttggttgcaccaacattatcaattggctccgtgctccttcagcaagctgctatacaggcctcattccattacagcaatgtcgagattgtggaatcaagacctaacccatcggatctgccatcgcaagatgcaatacagattgcaaataacatatcagatcttggtcagatatacaacagggaagatatggattccagcagtccagctaggggccaactacttggggaagatggagtgcgtgtgcatagtatggttctccctggtctcgtttccagcacatcaatcaacttctcaggcccaggagagatttacgccttacggcatgatgttgcaaacgttcaatgcctgatgccaggactaatcctggcaatacggaaggtggtacggttgaagaacttgatttacgggctagagaagttcttgtag

SEQ ID NO: 6880 - protein, 307 aa, Sorghum bicolor
  misc_feature: Ceres ANNOT ID no. 6068699
  misc_feature (175)..(307): Pfam Id: DapB_C Pfam Desc: Dihydrodipicolinate reductase, C-terminus
  misc_feature (43)..(172): Pfam Id: DapB_N Pfam Desc: Dihydrodipicolinate reductase, N-terminus
  misc_feature (27)..(307): NCBI GI: 92881537 NCBI Desc: dihydrodipicolinate reductase [medicago truncatula]
  misc_feature (29)..(307): NCBI GI: 10177745 NCBI Desc: dihydrodipicolinate reductase-like protein [arabidopsis thaliana]
  misc_feature (29)..(307): NCBI GI: 21536648 NCBI Desc: dihydrodipicolinate reductase-like protein [arabidopsis thaliana]
  misc_feature (40)..(307): NCBI GI: 75906697 NCBI Desc: dihydrodipicolinate reductase [anabaena variabilis atcc 29413]
  misc_feature (40)..(307): NCBI GI: 17230034 NCBI Desc: dihydrodipicolinate reductase [nostoc sp. pcc 7120]
MVSLCHPIRIRACGNTATRRNAAAAKVLCSMQQTPPPPAQSTIKVVIVGATKEIGRTAVLAVTKARGMELAGAIDSQCIGEDAGQISGMDEPLEIPVLNDLTMVLGSIAQSRATGVVVDFSEPSAVYDNVKQAAAFGLSSVVYVPKIELDTVTELSAFCEKASMGCLVAPTLSIGSVLLQQAAIQASFHYSNVEIVESRPNPSDLPSQDAIQIANNISDLGQIYNREDMDSSSPARGQLLGEDGVRVHSMVLPGLVSSTSINFSGPGEIYALRHDVANVQCLMPGLILAIRKVVRLKNLIYGLEKFL

SEQ ID NO: 6881 - DNA, 1161 bp, Sorghum bicolor
  misc_feature: Ceres ANNOT ID no. 6068700
  misc_feature: Encodes the peptide sequence at SEQ ID NO 6882
atggagacggaggaggacgacagcggcgggtgtgacttcctcgactggctcggccccgacacctccaccaccgtcttcgagctcctcgacgaccccgccgacctcgcccgcgtcggcgccgtctcccgctcctggcgccgattcgtgaccgagaacgaattcagcaagcgcctgtgtcggcggatatgcccggaggccgccagcttcacccgcgcggtcgtggtgacccgttcgccgccgccgccgcagcccgccgcgtccgcgtccgagtccagccaggacgctgagtgcagggcccgcgagggggagcacgcggcctactcctacctcgccggcgcgatcgtctccgccaagcccgctatggacctcatcatgcgctgcgtcggcgcctccagcaccgacttcttccccgacgagagcatggagaacacgctcgtgccgcatgaatgggtgaaccaccgccactcgtactggtccagcggcggcaaggacaaccccgacgcccccgagagcttgacctacaggctctcctctgacctctgcgtgattgatgagatcagggtgcgcccctacaaagctgcttttcagcttggccatcctatttactcttccaaggcggtgaggatccggctgggtcattccaagcttgatcctggaacagagactttcgtgtcagctgagaatgagaacctgacagcaatcgctgatgaaaactacacgtggacatacacgtcgccagagttccctatgcttcaggaaaatgtgttgcaaaccttcaagcttccacgccctgccctttgcattggtggtatagtgaagattgaacttctggggagattacagaaacaatctacagatgataagtattacatatgtgtctgccatgtccaagtgatggggcgctcactttcaccagatttaatgatagacatctccgatcctgctgattactcaaacctcaagtatttgccgggtgccggtaacttgcgcccagaagacctactgagcagtgacgccaaggaggactcatcggactggcgctcgcttgtttctaggtacaggcagatgaggcaattggcgatggtgtatatgctgcttggacctgtgcagtttgcggatgaagaagacgaagctgaggctgacatgctgcacttgttgtag

SEQ ID NO: 6882 - protein, 386 aa, Sorghum bicolor
  misc_feature: Ceres ANNOT ID no. 6068700
  misc_feature (12)..(381): NCBI GI: 124360855 NCBI Desc: cyclin-like f-box [medicago truncatula]
  misc_feature (12)..(381): NCBI GI: 92886311 NCBI Desc: cyclin-like f-box [medicago truncatula]
  misc_feature (12)..(215): NCBI GI: 2252871 NCBI Desc: a_tm018a10.10 gene product [arabidopsis thaliana]
  misc_feature (12)..(111): NCBI GI: 140045859 NCBI Desc: cyclin-like f-box [medicago truncatula]
METEEDDSGGCDFLDWLGPDTSTTVFELLDDPADLARVGAVSRSWRRFVTENEFSKRLCRRICPEAASFTRAVVVTRSPPPPQPAASASESSQDAECRAREGEHAAYSYLAGAIVSAKPAMDLIMRCVGASSTDFFPDESMENTLVPHEWVNHRHSYWSSGGKDNPDAPESLTYRLSSDLCVIDEIRVRPYKAAFQLGHPIYSSKAVRIRLGHSKLDPGTETFVSAENENLTAIADENYTWTYTSPEFPMLQENVLQTFKLPRPALCIGGIVKIELLGRLQKQSTDDKYYICVCHVQVMGRSLSPDLMIDISDPADYSNLKYLPGAGNLRPEDLLSSDAKEDSSDWRSLVSRYRQMRQLAMVYMLLGPVQFADEEDEAEADMLHLL

SEQ ID NO: 6883 - DNA, 1332 bp, Sorghum bicolor
  misc_feature: Ceres ANNOT ID no. 6068703
  misc_feature: Encodes the peptide sequence at SEQ ID NO 6884
atggacgtcgagggcgaggtccccgccgcggcggcggcggcggtggcgaacggcctgggcggcgcggaggaggcctctgcagcgccggtctcggccgagcagctggacgtggaggcttacgcggcgcagtactcgggccggacccgcctcgcgcgcctgctcttcatcgcggaccggtgcggggtggaggcgatgcagctcgaggcgctgcggatggcgtacgatgagatcaagcgcggggaggacgtgcagctccaccgggacgtcgccgccaagatcggaggccgccttggtccgcgcttcggcctcgaccaggcgtgggtcgacaccgtcacccgccgcgccgatcagcgcaaggagaagctcgagaacgagctcaatggatacaggactaacctgatcaaagagagcatcagaatgggctacaatgacattggtgatttcttctatgcccatggccaactttcggatgccttcaaaagctacatcaggactcgggactattgcaccacttccaaacatatagttcagatgtgcatgaatgtgattctggttagcattgagctggggcaatatgcacatgtttcaaactatgtcagcaaagcagagcaaaccccagactctctggatcctgtcattgtcgccaagctgaaggcagctgcaggattagccaacttggaaacaaagaaatacaaatttgctgctcgtaagtttgttgagacaggaattgaactaggaaacaactactctgaagtcatagctcctcaagatgtagcggtctatggtgcactttgtgcacttgcttcttttgaccgttcagacctgaagagcaaagtcatcgacaatatcaacttccgtaactttctggagctggtgcctgaagtaagggagctggttaatgatttttatgcaagtcgctatggatcttgcttgggtcatcttgagaagctaaagcctaacctgctcctggatatccatttgcatgagcatgtagagactctgtatatggatattcgccacaaagcgatcatacagtacacacttccttttatatctgttgatctcaacttgatggcaactgcctttaagacttctgtctccatgctggagaaggagctggccgcactgattactgagaacaaaatacaggcccggatagactcccacaacaagatcctctacgcaaggcatgctgaccagagaaatgcaactttccaacgtgtccttcaaaccggcaatgactttgagagagatgtcaagtccatgcttctgcgggccaacctcctcaagcatgattacattcagaaggcgagtggaccaaggaagatgtaa

SEQ ID NO: 6884 - protein, 443 aa, Sorghum bicolor
  misc_feature: Ceres ANNOT ID no. 6068703
  misc_feature (293)..(397): Pfam Id: PCI Pfam Desc: PCI domain
  misc_feature (1)..(443): NCBI GI: 7208213 NCBI Desc: constitutive photomorphogenic 11 [oryza sativa subsp. indica]
  misc_feature (1)..(443): NCBI GI: 10443485 NCBI Desc: rcop11 protein [oryza sativa]
  misc_feature (20)..(443): NCBI GI: 432446 NCBI Desc: fus6
  misc_feature (20)..(443): NCBI GI: 6850881 NCBI Desc: fusca protein fus6 [arabidopsis thaliana]
  misc_feature (31)..(432): NCBI GI: 92886307 NCBI Desc: helix-turn-helix, arac type; proteasome component region pci [medicago truncatula]
  misc_feature: Useful for making plants with modulated low light sensitivity
  misc_feature: GREAT-hit functional homolog of the protein sequence given in SEQ ID NO 13379
  misc_feature: Useful for making plants with modulated light quality sensitivity
  misc_feature: Useful for making plants with modulated low light sensitivity
  misc_feature: Functional homolog of the protein sequence given in SEQ ID NO 13379
MDVEGEVPAAAAAAVANGLGGAEEASAAPVSAEQLDVEAYAAQYSGRTRLARLLFIADRCGVEAMQLEALRMAYDEIKRGEDVQLHRDVAAKIGGRLGPRFGLDQAWVDTVTRRADQRKEKLENELNGYRTNLIKESIRMGYNDIGDFFYAHGQLSDAFKSYIRTRDYCTTSKHIVQMCMNVILVSIELGQYAHVSNYVSKAEQTPDSLDPVIVAKLKAAAGLANLETKKYKFAARKFVETGIELGNNYSEVIAPQDVAVYGALCALASFDRSDLKSKVIDNINFRNFLELVPEVRELVNDFYASRYGSCLGHLEKLKPNLLLDIHLHEHVETLYMDIRHKAIIQYTLPFISVDLNLMATAFKTSVSMLEKELAALITENKIQARIDSHNKILYARHADQRNATFQRVLQTGNDFERDVKSMLLRANLLKHDYIQKASGPRKM

SEQ ID NO: 6885 - DNA, 1101 bp, Sorghum bicolor
  misc_feature: Ceres ANNOT ID no. 6068705
  misc_feature: Encodes the peptide sequence at SEQ ID NO 6886
atgtgggtgacgtcgtcgatgccgcaggtgtgggacgaggaggccgcggccaagggcggcggcgcggcggcggtgacccccgcgccggcggcggccatgctgggctcgctggcggggtggctgtcgcggaccgtgcagccgcagccgcccccgccacgggtgtgcggcaccgagggaggaccccccgtgacggcgcccaggctcaggctccgcgacggccgccacctcgcctactgcgagagcggcgtgcctcgcgaccaggccaggttcaaggtcgtcttctcccacggcttcaccggctcccgcgaggacagcgtccgcgcctcccaggaagtggcggaggagctgggcgtgtacatggtgggcttcgaccgcgccgggtacgggcagagcgaccccaaccccaaccggtccgtcaagagcgcggcgctggacgtggaggagctcgcggacgcgctggggctcggccccaagttctacgtcatcggcatctccctcggctgccatgccgtctggggcgccctcaagtacatccccgacaggatcgccggcgcggcaatgatggcgccggtggtgaactactggtggccagggttccctccggagctggcggcggaggtgtacgcgaagcaggaggtaggggaccagtgggcgctgcgggtgtcgcaccacgcgccggggatcctccactggtggatggaccagagctggctgcccacgtcgacggtggtggccggcacgacgccgctgccgaacgcgcgcgacgccgagatccggcgcaacatgcaggcggacggcacgttccagcagaagcgggagcaggcgacgcagcaggggatccacgagtcctactaccgcgacatgaccgtcatgttcggcaagtgggagttcgaccccatggcgttgccggagccgccgtgccccgtgcacctgtggcagggagacgaggacggcctcgtccccgtcgtcctgcagaggtacctcgccggcaagctcgcctgggtcaactaccacgagctccccggcaccggacacttcctgtcggcggtgcctgggctcggagacaccgtcctcaggacccttttcggtcagaagcagtag

SEQ ID NO: 6886 - protein, 366 aa, Sorghum bicolor
  misc_feature: Ceres ANNOT ID no. 6068705
  misc_feature (118)..(364): Pfam Id: Abhydrolase_1 Pfam Desc: alpha/beta hydrolase fold
  misc_feature (48)..(366): NCBI GI: 115487372 NCBI Desc: os12g0152100 [oryza sativa (japonica cultivar-group)]
  misc_feature (36)..(361): NCBI GI: 20161637 NCBI Desc: p0489b03.5 [oryza sativa (japonica cultivar-group)]
  misc_feature (25)..(361): NCBI GI: 15232465 NCBI Desc: hydrolase, alpha/beta fold family protein [arabidopsis thaliana]
  misc_feature (27)..(361): NCBI GI: 115458272 NCBI Desc: os04g0412000 [oryza sativa (japonica cultivar-group)]
  misc_feature (27)..(361): NCBI GI: 116310144 NCBI Desc: h0717b12.6 [oryza sativa (indica cultivar-group)]
MWVTSSMPQVWDEEAAAKGGGAAAVTPAPAAAMLGSLAGWLSRTVQPQPPPPRVCGTEGGPPVTAPRLRLRDGRHLAYCESGVPRDQARFKVVFSHGFTGSREDSVRASQEVAEELGVYMVGFDRAGYGQSDPNPNRSVKSAALDVEELADALGLGPKFYVIGISLGCHAVWGALKYIPDRIAGAAMMAPVVNYWWPGFPPELAAEVYAKQEVGDQWALRVSHHAPGILHWWMDQSWLPTSTVVAGTTPLPNARDAEIRRNMQADGTFQQKREQATQQGIHESYYRDMTVMFGKWEFDPMALPEPPCPVHLWQGDEDGLVPVVLQRYLAGKLAWVNYHELPGTGHFLSAVPGLGDTVLRTLFGQKQ

SEQ ID NO: 6887 - DNA, 3186 bp, Sorghum bicolor
  misc_feature: Ceres ANNOT ID no. 6068712
  misc_feature: Encodes the peptide sequence at SEQ ID NO 6888
atggacgcgcgcccgcgacggcggaggccgcgcacggcggaggaggcggcggcgacgctgcggaaggcgtggtgccggctgcggctgtccgcgcgcgacccggcacgcgtgccgccctgggacgccgtcgtgctcacggccgccagcccccagcaggccgcgctctacaaccgccagctcgagcgcgcccgcgccctcggccgctttcccgcatccaccgcggccatcgccgtccctgacccagacggcgctcgcatcggctccggcgccgccacgctccacgccgtcgccgccctcgcccgccaactcgccgcccaggcttccaaggaagagatcggcgaattccttctcgaagcagcaaatggtggttcgggggatgaggccgcgatcgccgcggcatcgagcatcatggcgaagaagcacgtgctcttgcttcacgccgggggcgacagcaagagggttccctgggcgaaccccatggggaaggcgtttctccctctgccttacttggccggagacaatcccgatggacctgttccgcttttgttcgatcacattcttgccatctcctccagtgcaaggcaagctttcaacaaccaaggagggatcttcataatgaccggggatgttctcccgtgctttgatgcctccaacctatatcttcctgacgatgctgcttgtattgtgacggtgcccaccactctggatgtggctgctaatcatggagtggttgtagcatcaaaggacggtgggattgatcaggagacctattcgctatgtttggttgatgatctcctgcagaagccgacagtgagcgagcttgtagagggccatgccatcctagatgatgggagagcattgcttgacacaggaataatagcagcaaggggtaaagcgtggcaggaccttgttacccttgcactctcatctagccatactgtgattaaggagctcatgactagtaacaaagagctcagcttgtatgaggatcttgtggcggcatgggtaccagccaagcatgaatggttgcgaaaccgtccattggggaaggaactgatttctgctttaggaaaacaaaggattttcagcttttgttcatataacttctcatttttacattttggcacatccgtggaggttcttgatcacctggcgggttcctattctggacttgtaggtcgaaggcatatgtgctcactaccagagaccactgcttgtgatattgcagcgacagctattattttgtctaccaagatttcttctggggtctcaataggagaggattcattggtttatgattcagtactttgcggtagaatacggattggctcacaatgtattgttgtcacggtgaatatacgtgagtttcatagtagcacttgtttcacattacctgatcgacattgcctctgggaagtacctttggtaaactctgcagaaagagttttggtttactgtggtcttcacgataatccaaaagtttctattaagatggatgggacattctgtggcaagccatggataaatgtcttggaagatcttagaatccaggttgtggatctgtgggattcaaccagccaggacaaatgcttatggactgcaaagctttttcctgtcatgtctctcccagaaatgcttaatgttggcatgtggcttatgggatcagtatgtgacccagatgggaaaatagcttccttgtggagaaaatcacagaggatcagcttggacgagctgcatcgtgctattgattacagacaactttgcaccgattcgagcaagcatcaggcagatcttgcagctgacatagccaaggcttgcatgaactatggcttacttgggcgtaatctgtttcaactttgtgaggaaatgttacaaaaggatacatgtttagcggtctatgaagaattactttcgttttttccaagtcacagggatcagtatcctggggttcttcctcagagcagagaatatcaggtcaagatggatctgcttagagcttctggagatctttccactgcatgtatggtggaagagaaagtgtgggcttccatagcaagcgaaactgcgtcggcaataaaatatggatcgaaagagccatcgagtggcaagatgtcttcaaaccatggaaacttgcatcccaggaaggctgttgtagaattaccagtccgtgtggattttgttgggggttggagtgatacacctccgtggagcttggagcgtccaggttgtgttttgaatatggcaatatgcttgcaaggaagccttccagttggtgctatgatagagacaacagaagaccaccttggagtaagaatcgaagatgatgctggtagaaatgtttatattgataatctgtcatgtatttctcctccattcaaagaaagtgatccattccgtcttgttaagtctgctcttattgttactggaatccttggccacaagatattgtcaaaatcaggtctgaacattaggacatgggcaaatgttcctcgtggaagtgggctgggaacttctagcatattagctgctgctgttgttaagggactatttcaagtaatggaagacgatgaaagtgatgataatgttgctagagctgtgctagtggtggagcaaataatgggcacaggtggtgggtggcaagaccaaattggtggcctatatcctgggatcaagtgcgcccagagttttccaggacaaccattacggttgcaagttgttccagtgttgaccactcctcagttgattcaggaattagaagaacgtctcctggttgtattcactggccaagtaaggcttgcccaccaagtcctgcagaaagttgtgacccggtacctccgtcgcgacaatatcttgatatctagcatcaagaggcttgccgaattagctaagatcgggagagaagccctgatgaatggtgaattggacgagctcggcggaatattgctggaggcctggaggctgcaccaggagctagaccctttctgcagcaacaagctcgtggacaagctgtttgctttcgctggcccttactgctgtggttacaagctggtcggagccggtggcggtggctttgcgttgctgcttgccaagaatgtgagctgcgctaaagaacttagacgggcacttgaagagtctgccaccttcgatgtgaaggtgtacgattggaacgtcgccatgccacggtga

SEQ ID NO: 6888 - protein, 1061 aa, Sorghum bicolor
  misc_feature: Ceres ANNOT ID no. 6068712
  misc_feature (147)..(544): Pfam Id: Fucokinase Pfam Desc: L-fucokinase
  misc_feature (822)..(889): Pfam Id: GHMP_kinases_N Pfam Desc: GHMP kinases N terminal domain
  misc_feature (965)..(1045): Pfam Id: GHMP_kinases_C Pfam Desc: GHMP kinases C terminal
  misc_feature (9)..(1059): NCBI GI: 18378810 NCBI Desc: ghmp kinase-related [arabidopsis thaliana]
  misc_feature (132)..(603): NCBI GI: 140055099 NCBI Desc: sugar transporter superfamily; fucose-1-phosphate guanylyltransferase [medicago truncatula]
  misc_feature (714)..(1058): NCBI GI: 116222866 NCBI Desc: l-fucokinase [solibacter usitatus ellin6076]
  misc_feature (717)..(1045): NCBI GI: 31322498 NCBI Desc: l-fucose kinase [mus musculus]
  misc_feature (717)..(1045): NCBI GI: 55925156 NCBI Desc: fucokinase [homo sapiens]
MDARPRRRRPRTAEEAAATLRKAWCRLRLSARDPARVPPWDAVVLTAASPQQAALYNRQLERARALGRFPASTAAIAVPDPDGARIGSGAATLHAVAALARQLAAQASKEEIGEFLLEAANGGSGDEAAIAAASSIMAKKHVLLLHAGGDSKRVPWANPMGKAFLPLPYLAGDNPDGPVPLLFDHILAISSSARQAFNNQGGIFIMTGDVLPCFDASNLYLPDDAACIVTVPTTLDVAANHGVVVASKDGGIDQETYSLCLVDDLLQKPTVSELVEGHAILDDGRALLDTGIIAARGKAWQDLVTLALSSSHTVIKELMTSNKELSLYEDLVAAWVPAKHEWLRNRPLGKELISALGKQRIFSFCSYNFSFLHFGTSVEVLDHLAGSYSGLVGRRHMCSLPETTACDIAATAIILSTKISSGVSIGEDSLVYDSVLCGRIRIGSQCIVVTVNIREFHSSTCFTLPDRHCLWEVPLVNSAERVLVYCGLHDNPKVSIKMDGTFCGKPWINVLEDLRIQVVDLWDSTSQDKCLWTAKLFPVMSLPEMLNVGMWLMGSVCDPDGKIASLWRKSQRISLDELHRAIDYRQLCTDSSKHQADLAADIAKACMNYGLLGRNLFQLCEEMLQKDTCLAVYEELLSFFPSHRDQYPGVLPQSREYQVKMDLLRASGDLSTACMVEEKVWASIASETASAIKYGSKEPSSGKMSSNHGNLHPRKAVVELPVRVDFVGGWSDTPPWSLERPGCVLNMAICLQGSLPVGAMIETTEDHLGVRIEDDAGRNVYIDNLSCISPPFKESDPFRLVKSALIVTGILGHKILSKSGLNIRTWANVPRGSGLGTSSILAAAVVKGLFQVMEDDESDDNVARAVLVVEQIMGTGGGWQDQIGGLYPGIKCAQSFPGQPLRLQVVPVLTTPQLIQELEERLLVVFTGQVRLAHQVLQKVVTRYLRRDNILISSIKRLAELAKIGREALMNGELDELGGILLEAWRLHQELDPFCSNKLVDKLFAFAGPYCCGYKLVGAGGGGFALLLAKNVSCAKELRRALEESATFDVKVYDWNVAMPR

SEQ ID NO: 6889 - DNA, 600 bp, Sorghum bicolor
  misc_feature: Ceres ANNOT ID no. 6068713
  misc_feature: Encodes the peptide sequence at SEQ ID NO 6890
atgaggatgcgtgcgcgggcggcattgccatcggcgtcggcgtcggtgctgctgctcctcctgctcctggtgggcggctccgccggcgccgtgtacaaggtgggcgacctggacgcctggggcgtgccgccgccgtccaagcccgacgtctacaagcgctgggccaagtccatccacttcgcgctcggcgactccatctggttcctgtacccgccgagccaggactcggtgctgcaggtgacgccggaggccttcgcgtcctgcgacctgtcgcgccccgtggccaggctcgccgacggcaactccttcttcaacctcaccacgccgggccgcgcctactacgccagcggcgcgccgggtcactgccgcaagggccagaagctctgggtcgacgtccccatggccaacggcacctacctccagccctccgccaccgacctcgccgcgctcgcgcccacacccgccgccgacccgcccgccggagggcgccagcgcctcgcccgcgccccgcgccgccgtcgccgccgctggatccgtcgtcgccctcctctgcttcgccctccaaatcctcctccactgatgatgacatttgatgtgtag

SEQ ID NO: 6890 - protein, 199 aa, Sorghum bicolor
  misc_feature: Ceres ANNOT ID no. 6068713
  misc_feature (40)..(126): Pfam Id: Cu_bind_like Pfam Desc: Plastocyanin-like domain
  misc_feature (7)..(171): NCBI GI: 115450295 NCBI Desc: os03g0115000 [oryza sativa (japonica cultivar-group)]
  misc_feature (8)..(160): NCBI GI: 46359847 NCBI Desc: at1g64640 [arabidopsis thaliana]
  misc_feature (11)..(170): NCBI GI: 92897797 NCBI Desc: blue (type 1) copper domain [medicago truncatula]
  misc_feature (5)..(154): NCBI GI: 34146796 NCBI Desc: at2g25060 [arabidopsis thaliana]
  misc_feature (15)..(155): NCBI GI: 22775566 NCBI Desc: phosphoprotein ntepb3 [nicotiana tabacum]
MRMRARAALPSASASVLLLLLLLVGGSAGAVYKVGDLDAWGVPPPSKPDVYKRWAKSIHFALGDSIWFLYPPSQDSVLQVTPEAFASCDLSRPVARLADGNSFFNLTTPGRAYYASGAPGHCRKGQKLWVDVPMANGTYLQPSATDLAALAPTPAADPPAGGRQRLARAPRRRRRRWIRRRPPLLRPPNPPPLMMTFDV

SEQ ID NO: 6891 - DNA, 594 bp, Sorghum bicolor
  misc_feature: Ceres ANNOT ID no. 6068714
  misc_feature: Encodes the peptide sequence at SEQ ID NO 6892
atggccgacccgcggctgtaccctacggggtccgggtccgacgaccgccgcgacgccgcctaccccggctccgagcgccgcctctacaacccgtaccaggacctcaacctcccctaccggcagctctacgaccttcccacctccccggagttcctcttccaggaggaggccgtcgcgcagcgccggtcctggggcgagaacctcacctactacacgggcgtcggctacctcggcggcgccgtggccggggccgcgatggggctccgcgacgccgcccgcggcgccgagcccggggagcccgccaagatccgggccaaccgcgtcctcaactcctgcggcagctcggggcgccgcgtcggcaacacgctcggggtcatcggcctcatgtacgctgggatcgagagcgccatggtcgccgcgcgagaccgcgacgactggatcaacagcgtcacggccgggctcggcaccggcgcgctcttccgcgccgctaacgggccgcgctcggcggtcgtcgccggggccgtcggtggggttcttgctggcgccgccgcggctgccaagcaggttgggaagagatacgtccctgccctctga

SEQ ID NO: 6892 - protein, 197 aa, Sorghum bicolor
  misc_feature: Ceres ANNOT ID no. 6068714
  misc_feature (57)..(190): Pfam Id: Tim17 Pfam Desc: Tim17/Tim22/Tim23 family
  misc_feature (1)..(197): NCBI GI: 31433092 NCBI Desc: putaive mitochondrial inner membrane protein [oryza sativa (japonica cultivar-group)]
  misc_feature (25)..(195): NCBI GI: 92871492 NCBI Desc: mitochondrial import inner membrane translocase, subunit tim23 [medicago truncatula]
  misc_feature (13)..(195): NCBI GI: 92892983 NCBI Desc: mitochondrial import inner membrane translocase, subunit tim17/22 [medicago truncatula]
  misc_feature (23)..(195): NCBI GI: 38678778 NCBI Desc: mitochondrial inner membrane translocase tm23-2 [arabidopsis thaliana]
  misc_feature (27)..(195): NCBI GI: 140046310 NCBI Desc: mitochondrial import inner membrane translocase, subunit tim17/22 [medicago truncatula]
MADPRLYPTGSGSDDRRDAAYPGSERRLYNPYQDLNLPYRQLYDLPTSPEFLFQEEAVAQRRSWGENLTYYTGVGYLGGAVAGAAMGLRDAARGAEPGEPAKIRANRVLNSCGSSGRRVGNTLGVIGLMYAGIESAMVAARDRDDWINSVTAGLGTGALFRAANGPRSAVVAGAVGGVLAGAAAAAKQVGKRYVPAL

SEQ ID NO: 6893 - DNA, 3150 bp, Sorghum bicolor
  misc_feature: Ceres ANNOT ID no. 6068722
  misc_feature: Encodes the peptide sequence at SEQ ID NO 6894
atggaaggcacggaggcgctgttccccggcgacggaggcggcggcgaccccatggacttctcgtggaccgctgacggggagaagcaccgggacccggcggtggcttgcgccagccccggccgcgacgacgaggctacctcggctccgaccccggccccgccctcttcgccgcgggaggtggcggagtccatgatcctcgtgcccgggccgcgcgtcgtcatgtccggcctcagtctggctgattgccgttcagatgactgtgttctcttcattaatgctggtggtggtgcaatcgaaggctgtgatccctgtgtgaaggtttctggtgattcattctttgaaggaggggatgtgatagagacaaatgagagcatagttgaaggtggcgattgtccatttatttatcactcagcaagatatggcagtttcagctacaagttcaatggtcttgcccctggatcctattttctagatctgcatttcgctgagattctttacacatgtgggccaaaaggaattagcatgtttgatgtattgtctcaactcgatgtgtatgctgtagttggaggaaacagggcccttcaagtgcgtgatattagggttactgttgagatgaatggtgctgttatgatcaatttcaaaggaagtgataatattggtcttgcactcatggcagcaaactcagttaccgatgacaatgtcttgtgcaaaagatgttcatctgatattgaccagactaggacaagtaaactgatctcaaagtatgagaagcagattgaggagctcaccagccaatgcactatgaagtccaatgagtgttctatggcatggtcttctgtagacactaccaatgtggagcttggcagacttaaaatagagcttcaccaaaagggtgctgaaatggagaatcttgtgcaagctcttggtagagagagtgaccaactaagagatgtttctcataaatatgaaaatgacaagaaattgtggagtgctgctatatctaatatggaaaggaaaatcaaggccatgaaacaagagcaggcattgttgtcacttgaagcacatgattgtgcgaatgcaattcctgatttgagcaagatgattggagcagttcaggccctagttgcacagtgtgaagatttaaaattgaagtactatgaagagatggacaagaggaagaaacttcacaacattgttcaggagacaaaaggaaacattagggttttctgtcgatgccgacccttaagcaaagatgaggtgtcatcaggccagaaatgtgtagtggaattcgatggatccagtgatggtgacattgtaattgcaaatggcggaacaactaaaaagacctttaagtttgatagaatcttcacgccaaaggatgatcaagatatagtgtatgccgatgcgtctccactggtcacatctgtgttagatggctataatgtatgcatctttgcctacgggcagacaggaacaggaaagacgtttaccatggaaggaactgagagtaatagaggtgttaactatagaactctggaagaactgttcaatattgcagaggagaggaaagaaagtgtcacatatgacttatctgttagtgttcttgaggtttacaatgaacagataagagaccttcttgccacgtctccatctaaaaagctggagatcaagccaaacagtgaagggcaaaatcatgtccctgggttagtggaggccaaaattgagaacataaatgaggtttggaaagttttgcaaactggaagcaatgcaagggctgttggttcaaacaatgttaatgagcacagcagtcgctcccactgcatgctatgcatcatggtgagggctaagaacctgcttactggagaatgtacaagtagtaagctttggcttgtagatttggctggaagtgagcgtttagccaagactgatgtgcaaggcgaacgacttaaggaagcacaaaatattaacagatcactttctgcattgggtgatgtcatttcagctcttgctacaaaaaacagccatataccctacagaaattccaaattgacacacttgctgcaagattctctaggaggagactcaaaagcattaatgtttgtgcaaattagcccatccaataatgatgtttcagaaaccttgagttcattaaactttgccagccgtgttcggcgtattgaattgggaccagcaaagaagcaggttgatactgttgaacttcaaaagaccaaacagatgcttgaaagagctaagcaagaactcagacttaaggatgattctttgagaaagctagaggaaaacttacagaatttggagaccaaagccaaagggaaagagcaactttgcaaaaacttgcaagaaaaggtaaaagagcttgagggccagttagattccaaggcacattcacaaattgcatcagagaaacagcagcatcagctttctggaaaactaaaagagaaagaagaaatgtgtactgctcttcagcagaagatcaaggagctggagctcaagttaaaggaacaagaacaccagcgatcagtcgcggaactaaaggcaagagaaataggacatgagctgttggaaacacagagaaccgagtcaatgcttcagattaagctaagagatcttgaaagcaagaccaaagagcaggacacaaacatgatgtcagtggagtccaccgtcgtcgcgactcctgtaaacgtgaagctgccgctgccgccgccgctgccgtttcccagggatgaagcattgagcgagaaggagaaccgcatcctgaggagctcagacgccctgaacaagcagcagcctcacgctgagaggccttcacttcctcctgatgctcctcaagcgggcaacgagaagaagaggaaaggagacgcgaggaacgcatccatcggcggcggccagcaagagaacaatggcgtcgccccaggtggccagaacactgcgaggaagaggagcctgccggccgagcgtgaggcgaggctcaagaggaagtcgaccgaacctcctcctcaggtgaagaatttggtaaggtcgacggcgtcgtcgagggcggctgccgctgctacgaacaaggcggctccgagctccagagtcaccaagcagcagcaaccaggcgggaacaagaccagagggtgggttaggtag

SEQ ID NO: 6894 - protein, 1049 aa, Sorghum bicolor
  misc_feature: Ceres ANNOT ID no. 6068722
  misc_feature (411)..(727): Pfam Id: Kinesin Pfam Desc: Kinesin motor domain
  misc_feature (180)..(1000): NCBI GI: 42569244 NCBI Desc: kinesin motor protein-related [arabidopsis thaliana]
  misc_feature (421)..(1049): NCBI GI: 115450279 NCBI Desc: os03g0114000 [oryza sativa (japonica cultivar-group)]
  misc_feature (258)..(809): NCBI GI: 144924475 NCBI Desc: kinesin, motor region [medicago truncatula]
  misc_feature (381)..(792): NCBI GI: 15240982 NCBI Desc: kinesin motor protein-related [arabidopsis thaliana]
  misc_feature (485)..(917): NCBI GI: 115489584 NCBI Desc: os12g0616000 [oryza sativa (japonica cultivar-group)]
MEGTEALFPGDGGGGDPMDFSWTADGEKHRDPAVACASPGRDDEATSAPTPAPPSSPREVAESMILVPGPRVVMSGLSLADCRSDDCVLFINAGGGAIEGCDPCVKVSGDSFFEGGDVIETNESIVEGGDCPFIYHSARYGSFSYKFNGLAPGSYFLDLHFAEILYTCGPKGISMFDVLSQLDVYAVVGGNRALQVRDIRVTVEMNGAVMINFKGSDNIGLALMAANSVTDDNVLCKRCSSDIDQTRTSKLISKYEKQIEELTSQCTMKSNECSMAWSSVDTTNVELGRLKIELHQKGAEMENLVQALGRESDQLRDVSHKYENDKKLWSAAISNMERKIKAMKQEQALLSLEAHDCANAIPDLSKMIGAVQALVAQCEDLKLKYYEEMDKRKKLHNIVQETKGNIRVFCRCRPLSKDEVSSGQKCVVEFDGSSDGDIVIANGGTTKKTFKFDRIFTPKDDQDIVYADASPLVTSVLDGYNVCIFAYGQTGTGKTFTMEGTESNRGVNYRTLEELFNIAEERKESVTYDLSVSVLEVYNEQIRDLLATSPSKKLEIKPNSEGQNHVPGLVEAKIENINEVWKVLQTGSNARAVGSNNVNEHSSRSHCMLCIMVRAKNLLTGECTSSKLWLVDLAGSERLAKTDVQGERLKEAQNINRSLSALGDVISALATKNSHIPYRNSKLTHLLQDSLGGDSKALMFVQISPSNNDVSETLSSLNFASRVRRIELGPAKKQVDTVELQKTKQMLERAKQELRLKDDSLRKLEENLQNLETKAKGKEQLCKNLQEKVKELEGQLDSKAHSQIASEKQQHQLSGKLKEKEEMCTALQQKIKELELKLKEQEHQRSVAELKAREIGHELLETQRTESMLQIKLRDLESKTKEQDTNMMSVESTVVATPVNVKLPLPPPLPFPRDEALSEKENRILRSSDALNKQQPHAERPSLPPDAPQAGNEKKRKGDARNASIGGGQQENNGVAPGGQNTARKRSLPAEREARLKRKSTEPPPQVKNLVRSTASSRAAAAATNKAAPSSRVTKQQQPGGNKTRGWVR

SEQ ID NO: 6895 - DNA, 2910 bp, Sorghum bicolor
  misc_feature: Ceres ANNOT ID no. 6068736
  misc_feature: Encodes the peptide sequence at SEQ ID NO 6896
atggcgctctcggggatgcgggggctctccgtcttcatcagcgacatacgcaactgccacaacaaggagcaggagcgcctccgcgtcgacaaggagctcggcaacatccgcacgcggttcaaaaacgagaagggcttatcaccatacgagaagaaaaaatatgtatggaaaatgctttacatttatatgctgggttatgatgttgattttgggcatatggaaactgtctcgttgatatctgcaccaaagtatcctgagaagcaggttggttatattgtgacatcttgcttactgaatgagaacaatgatttcttaagaatggtaataaatacagtacggaatgacataatcggacgaaatgagactttccagtgcttagcattgacaatggtaggtaacattggtgggaaagaattttctgagtcactagccccagatgtccagaaacttcttatttcaagtagttgccgtcctgttgtcagaaagaaggctgctctatgccttctgcggctttataggaagaatcctgatgttgtgaatattgatggctgggcggatcgaatggcacaacttctagatgaacgtgatctaggtgtgctgacatctgtcatgagtctttttgtttcactagtatccaacaatgctgaagcatattggaattgtcttccaaaatgtgtaagaatattggagaggttagcaagaaatcaagatattccacaagagtacacttactacggaattccatccccttggcttcaggtaaagacaatgagagctcttcagtacttccctaccattgaagatcccaacgcaagacgagctttgtttgaggtcttacagcgcattttgatgggtactgatgttgttaaaaacgttaacaagaacaatgcctcacatgctgttctctttgaagctcttgctctggtcatgcatctggatgctgaaaaggagatgatgtcacagtgtgtggctcttcttgggaagtttattgcagtccgggagccaaacattcggtaccttggtctggaaaacatgactaggatgctgttagtaacagatgtgcaggatatcattaaaaggcaccaggctcagatcattacatctttgaaggacccagatatcagcattagacggagggctcttgatttattatatggcatgtgtgatgttacaaatgcaaaggaaattgttgaggagttattgcagtaccttaatacagctgaatttgcaatgcgtgaagagttgtctctgaaggcagctatacttgcagaaaaatttgctccagaactattgtggtatgttgatgttattcttcagcttatagacaaagctggagattttgtaagtgatgatatatggtatcgagtggtacaatttgtcacgaacaatgaagatctacagtcatatgctgcagctaaagcgagagaatatcttgacaagcctgctttacatgagacgatggtcaaggtgagtgcctaccttcttggggagtatggccatcttttggcccggagacctggctgtagccctaaggaattgtttgctattataaatgataaacttccgacagtatcgtatgagagttatattgatgttgaaatacaacagagagcagttgaatattttgaactaagcaggaaaggccctgctttggcagatgtgttggctgaaatgccaaaattccctgaacgtgagtctgcgctgttgaagaaggctgaagatgctgaaattgacacagcagagcaaagtgctataaagctacgtagtcagcaacaaacttccagtgctcttgttgtagctgatcacccccctgcaaatggatctgcaccaccagctaatcatctcactcttgtgaagatgccaagccaaactgtttctgacactcaggagagtggagtaatttatgaagaggctcccaagcctcccgttgaagctcccaaagaaaatgggactcccgtcgaagtggagagcagggacacaaacattactgaaatcaacaatgagattaaagctgaacctccctctacatctcattctacttctcccgcagacctcctggcagatcttttgggtcctcttgcgatagagggccctcctgctgtagagcaaaatcctgcccaaggattgaatgctaatcaaagtccagttgatgacttggcacttgctacccttgaggatcagtccaactcagttcagccaactgtcaacgtcgaggaaaagtttcacatattgtgcacaaaagatagcggagtgctgtatgaggatcctcacattcagattggtttgaaagcggagtggcgtgcccatcatggccgtcttattcttttcctgggtaacaaaaatacttcagcccttacgtcagtgcgggcgctgattttgcctcctggtcatttgaaaatggaactttcgtcagttcccgatactattcctccaagagcacaggtgcaagttccacttgaggttgcgaatctccgtgcaagtagagatgttgcggttctagatttctcatatacttttggaactttggtggatgccaaacttcgactccctgttgtattgaataaatttttgcagcctataactcttacccctgaagaatttttcccccagtggaaagcgctgactgttcattcgctgaaggttcaagaagtggttaaaggtgtgaaaccaatgcctctttctgagatggctaatcttttcatgagccttcacttggctgtcgcccccggacttgataacaacccaaacaatctggttgcatgcacaacattcttttctgaagcaacgcgtgccatgctttgtctgataagagttgaaacagatccacaagacaggacccaactgcggctaacagttgcctcgggcgaccaatatttgacattcgagtatagtcttgctccttttctttaa

SEQ ID NO: 6896 - protein, 969 aa, Sorghum bicolor
  misc_feature: Ceres ANNOT ID no. 6068736
  misc_feature (25)..(549): Pfam Id: Adaptin_N Pfam Desc: Adaptin N terminal region
  misc_feature (742)..(850): Pfam Id: Alpha_adaptinC2 Pfam Desc: Adaptin C-terminal domain
  misc_feature (3)..(962): NCBI GI: 20466360 NCBI Desc: alpha-adaptin c-like protein [arabidopsis thaliana]
  misc_feature (3)..(962): NCBI GI: 20466205 NCBI Desc: alpha-adaptin [arabidopsis thaliana]
  misc_feature (3)..(962): NCBI GI: 10178251 NCBI Desc: alpha-adaptin [arabidopsis thaliana]
  misc_feature (3)..(375): NCBI GI: 10176948 NCBI Desc: alpha-adaptin c homolog [arabidopsis thaliana]
  misc_feature (5)..(693): NCBI GI: 28574818 NCBI Desc: cg4260-pa, isoform a [drosophila melanogaster]
MALSGMRGLSVFISDIRNCHNKEQERLRVDKELGNIRTRFKNEKGLSPYEKKKYVWKMLYIYMLGYDVDFGHMETVSLISAPKYPEKQVGYIVTSCLLNENNDFLRMVINTVRNDIIGRNETFQCLALTMVGNIGGKEFSESLAPDVQKLLISSSCRPVVRKKAALCLLRLYRKNPDVVNIDGWADRMAQLLDERDLGVLTSVMSLFVSLVSNNAEAYWNCLPKCVRILERLARNQDIPQEYTYYGIPSPWLQVKTMRALQYFPTIEDPNARRALFEVLQRILMGTDVVKNVNKNNASHAVLFEALALVMHLDAEKEMMSQCVALLGKFIAVREPNIRYLGLENMTRMLLVTDVQDIIKRHQAQIITSLKDPDISIRRRALDLLYGMCDVTNAKEIVEELLQYLNTAEFAMREELSLKAAILAEKFAPELLWYVDVILQLIDKAGDFVSDDIWYRVVQFVTNNEDLQSYAAAKAREYLDKPALHETMVKVSAYLLGEYGHLLARRPGCSPKELFAIINDKLPTVSYESYIDVEIQQRAVEYFELSRKGPALADVLAEMPKFPERESALLKKAEDAEIDTAEQSAIKLRSQQQTSSALVVADHPPANGSAPPANHLTLVKMPSQTVSDTQESGVIYEEAPKPPVEAPKENGTPVEVESRDTNITEINNEIKAEPPSTSHSTSPADLLADLLGPLAIEGPPAVEQNPAQGLNANQSPVDDLALATLEDQSNSVQPTVNVEEKFHILCTKDSGVLYEDPHIQIGLKAEWRAHHGRLILFLGNKNTSALTSVRALILPPGHLKMELSSVPDTIPPRAQVQVPLEVANLRASRDVAVLDFSYTFGTLVDAKLRLPVVLNKFLQPITLTPEEFFPQWKALTVHSLKVQEVVKGVKPMPLSEMANLFMSLHLAVAPGLDNNPNNLVACTTFFSEATRAMLCLIRVETDPQDRTQLRLTVASGDQYLTFEYSLAPFL

SEQ ID NO: 6897 - DNA, 3981 bp, Sorghum bicolor
  misc_feature: Ceres ANNOT ID no. 6068743
  misc_feature: Encodes the peptide sequence at SEQ ID NO 6898
atggccgccggcggccacctccgtccgggctcctacctgggggacgtctcggcgctctccttcctcccctcctcgccgcaccctctcctcctcgccggcacgggatcgcagctgctcttgtacgaagtgggcgccgccaggctcgtcgcgtcgttccgagtgttcgacggggtgcgcgtccacggtatcgagccacggagcggaggccccgacagctacacgctcgcggtgttcggcgagaggagggtgaagctattctccctccgattcggtgctgaagcagatggcggcgaggtggacgaggcgcggcttgagctggagcagaggctcccggggttcgaccattgggtgctcgacgctcgtttcttggaggttgatgggctgcttgcgattggtctgagtgataattcagtaacactgtgggatctaagcaagtgttcgttggttacccgagtgaagtctccagagaagtgccttctgtattccatgagaatgtggggagactctgttggagagcttcttgtggcatctgggaccattttaaacgagattcttatatggaaattggcatcacaagttctgggatcctccatggtatgctcgaatgaaggagatacttctgatgtaaacagtcccaaaattataaatcttgatgataatcagcacatgacagttcaccttggtaggctgaaggagcatgaaggctcaatattccgaatagcttggtcctctgatggatcaaaatttatgtctgtttctgatgaccgtagtgctcgcgtgtggatgttgactttcaaatcacagggttctgtcaatcagacagccagtcaagacaatgttgaaattataccaaaactcactctttttgggcatagtgctaggatatgggactgctatgtttctgattctatggttataactgctggtgaggattgtacttgttgcatttggggaatggatggaaagctaatcaaaatgttcaaagaacacattgggcgaggaatatggcgatgcctatttgacccaagctcactgatcgtggtcactgctgggtttgattcagcaatcaaagtgcactatctatgcaattctatttttcatgacatagtggaagataaaagggtctctgatggtctgaactatgattctgagatctttgttgtatcctctccttctgtttcggggcagtatggtccccttgatagcaaaagcgagtatgttcgttgtctacactttgcagaagaaaatattctgtatgttgccacaaacaatggatatctgcatcatgctgaactctctaacatagaggatgtaagatggactgagattattcaggtcactgagaaagcaccaattatctgcatggatgtcatgacaacatactcaaacctttctttgaatagggaggacacaattgcccttggagatggacggggaaatgttactattgtccgtttaaccagtggcagcactgaacctaaactagatctatcttttacctggtcagcagaaaaagatcgacaactactaggagtatactggtgcaaggctcttgaatgtagccacattttcacagctgatcctaggggtgtgcttaagttgtggaacataagagatgccctgttctcaagtactgatattatcaatacacctcagatgtttccacttgtagcagtgtttgaatcctcctttggagctcgaatcatgtgtctagatgcatctcctggagaggagatccttatagctggtgataaaaagggtaacatcacagcctttcctttccctaaaacatcggcactgcatgccagtggtctgatgcaacagaagatgcttccgtgtgatcgttttaaaggagctcatggcatttctagtgtcgcaagtgttcatataaaagactcaatttctgatcatattgaaattcacactaccgggggagatggttgcatttgccttttcaaatatggaagaaatgtgcaaaagattgaattttttggaatgaggcaagtaaaagaactgggcaccattcaatccatctacactaatcttgcatctgagagccaattgagtagtacctacgcaataggtttcacctctgcagattttataatttgggaccttgagaatgaaacaaagatggctcaagtatcctgtggaggctggcgacgcccttattcttattatcttgggacagtccccgagtatcagaactgctttgcctttgtaaaggatcatcatattcacattcacaggcactgggcaccaactcatgataagaaattactcccacaagttctccatttgcagtttcatggtagagaagtgcactcattgtgcttcatagatccagcaagccattcggatcctgagaataactcagatctgttggtagcaaccggatgtgaagatggaactgtgcgccttacaggtttcttgactggtagttctggaaaatggcattcctcaaagttgctaggggagcatgtaggtggatcagctgtgcgagcaacatgcttcatcccaaggacctatacagtaacatgtaaatcatataatgacagtttgaacggtatttctgatggcattgctgttgaaaaagacgagactttcttactcatatctgttggatcaaagcaagtcctcactacttggattttgcaaccgaggaatgcagaaaacagacaagtatgttcgagtggcttagatattgactccaagcaaaacgccaaaaacttggaaaatgttgattcagccatgtcatttcaatggctaactacccacatgccatcaaagcttcctaggaacgggctgaaatctggccacataaaacagagcattgaggaaggaaattcctctgttgtacagccaaatatggacattgtggatcatatggaaaatgactggcgttacctttctgttacagcatttcatttgaaacatccgcttctcaggttgacagtatgttttgttgttgttgcttgctcggatgcaacggttgtgcttcgtgctcttctgttaccttctcgattgtggtttgatgttgccttgttggttccacaggcatcgccagttttggtgctgcgccatattatcatcaatgctggccactataaagatgatgctggagacagataccttattgtgagtggatcaacagatggtagcattactttttggaacctgacagagaccattcatggcttcatgcaactaatatcggagactcaaccacatatgaatattgattgtcaaaagcgtcccaggactggaagagggagtcaaggcggccgtcgccggtggagatcactggcatatgctttgaagaagagagatggagatatgtcaccctctaatgagagtaacctgggtagtctaaacgctgctgaaaattcacctgaagcttctggtgtggaaaacactcagactatagtgcatgaagcaagtgacagctcaaacactgagatgccttcaagtacccaatcttgtgatatacctgaattgagaccaatgcacctgttatccggtgttcaccagtctggcgttaattgcctccacatatcatactcaacacctgacaagtcatactgcatcataagtggcggggatgatcaagctgttcagtgcttcaacttcagagtagtatcttcagaggattgcttaacaaccacaacaagactaaattcgcatgacaatgacacacttaaaattctatatcagcataaggcatcatcagctcatagtgcagcagttaaaggaatctggacagacggcacttgggctttctctactggccttgatcaaagagtaagatgctggaagatgggattgatcggccaattcacggaatactcccatgctatcattagcgtgcccgagcctgaaactctagacgttttccatgaccgagcaaagaggaagtaccacattgctgttgctggaaggggtatgcaaatggtcgagttctcaccacctggagatgtttaa

SEQ ID NO: 6898 - protein, 1326 aa, Sorghum bicolor
  misc_feature: Ceres ANNOT ID no. 6068743
  misc_feature (224)..(262): Pfam Id: WD40 Pfam Desc: WD domain, G-beta repeat
  misc_feature (282)..(318): Pfam Id: WD40 Pfam Desc: WD domain, G-beta repeat
  misc_feature (1212)..(1321): NCBI GI: 140055595 NCBI Desc: wd40-like [medicago truncatula]
  misc_feature (217)..(361): NCBI GI: 19909881 NCBI Desc: wd-repeat protein p122 [mus musculus]
  misc_feature (229)..(361): NCBI GI: 11072093 NCBI Desc: wd repeat domain 6 protein [homo sapiens]
  misc_feature (233)..(357): NCBI GI: 6522999 NCBI Desc: spbc1306.02 [schizosaccharomyces pombe]
  misc_feature (222)..(358): NCBI GI: 44984414 NCBI Desc: afl056cp [eremothecium gossypii]
MAAGGHLRPGSYLGDVSALSFLPSSPHPLLLAGTGSQLLLYEVGAARLVASFRVFDGVRVHGIEPRSGGPDSYTLAVFGERRVKLFSLRFGAEADGGEVDEARLELEQRLPGFDHWVLDARFLEVDGLLAIGLSDNSVTLWDLSKCSLVTRVKSPEKCLLYSMRMWGDSVGELLVASGTILNEILIWKLASQVLGSSMVCSNEGDTSDVNSPKIINLDDNQHMTVHLGRLKEHEGSIFRIAWSSDGSKFMSVSDDRSARVWMLTFKSQGSVNQTASQDNVEIIPKLTLFGHSARIWDCYVSDSMVITAGEDCTCCIWGMDGKLIKMFKEHIGRGIWRCLFDPSSLIVVTAGFDSAIKVHYLCNSIFHDIVEDKRVSDGLNYDSEIFVVSSPSVSGQYGPLDSKSEYVRCLHFAEENILYVATNNGYLHHAELSNIEDVRWTEIIQVTEKAPIICMDVMTTYSNLSLNREDTIALGDGRGNVTIVRLTSGSTEPKLDLSFTWSAEKDRQLLGVYWCKALECSHIFTADPRGVLKLWNIRDALFSSTDIINTPQMFPLVAVFESSFGARIMCLDASPGEEILIAGDKKGNITAFPFPKTSALHASGLMQQKMLPCDRFKGAHGISSVASVHIKDSISDHIEIHTTGGDGCICLFKYGRNVQKIEFFGMRQVKELGTIQSIYTNLASESQLSSTYAIGFTSADFIIWDLENETKMAQVSCGGWRRPYSYYLGTVPEYQNCFAFVKDHHIHIHRHWAPTHDKKLLPQVLHLQFHGREVHSLCFIDPASHSDPENNSDLLVATGCEDGTVRLTGFLTGSSGKWHSSKLLGEHVGGSAVRATCFIPRTYTVTCKSYNDSLNGISDGIAVEKDETFLLISVGSKQVLTTWILQPRNAENRQVCSSGLDIDSKQNAKNLENVDSAMSFQWLTTHMPSKLPRNGLKSGHIKQSIEEGNSSVVQPNMDIVDHMENDWRYLSVTAFHLKHPLLRLTVCFVVVACSDATVVLRALLLPSRLWFDVALLVPQASPVLVLRHIIINAGHYKDDAGDRYLIVSGSTDGSITFWNLTETIHGFMQLISETQPHMNIDCQKRPRTGRGSQGGRRRWRSLAYALKKRDGDMSPSNESNLGSLNAAENSPEASGVENTQTIVHEASDSSNTEMPSSTQSCDIPELRPMHLLSGVHQSGVNCLHISYSTPDKSYCIISGGDDQAVQCFNFRVVSSEDCLTTTTRLNSHDNDTLKILYQHKASSAHSAAVKGIWTDGTWAFSTGLDQRVRCWKMGLIGQFTEYSHAIISVPEPETLDVFHDRAKRKYHIAVAGRGMQMVEFSPPGDV

SEQ ID NO: 6899 - DNA, 960 bp, Sorghum bicolor
  misc_feature: Ceres ANNOT ID no. 6068772
  misc_feature: Encodes the peptide sequence at SEQ ID NO 6900
atgagagctgcatcctccacggtttaccctgtctaccttagtctccaccaccaccccaacaaccaccatgcttctttgcgtctctccagagcaaaccatgacaatacccacaaatgcacccagtcacccaaaattcttagacggtctctcttctccctacctgcctcatttcttctcctccacacatcctcctcccttgctgtagatgacacaaacacgccatccacctccacaatcgacaccacgattacagatcgcatcttcatggacttcagtgtctgtccaagctactttcgctcagacagacctctgggagccgagctttcctcatgccctgattctgagcctcttggtcgtgttgtctttggtctctatggtcggcttctccccgttactactgccaatttcaaagctacgtgtactgcagctgcatataggggcactcttgtccacaagctccttcaaggacagttttttgctgctggcagacaaggttctcggcgtgacaagggtgaggtcgagcctccctcgggccttgttaggaattctgagactgttaaccctaaagcattcgaattaaggcatacaaggcctggcacgctttccttatgccttggacagaatgatgatgatgatgacatcaagctcaaccctaattatcacaatgttgaattcttggttactacagggccaggaccctgtcccgagcttgatggccagaatattgtctttgggactgtattggaaggaatggatgttatcaccagcattgcaaccatacctacctacaaaccagctgaaagaatccgcctcttcaacgatttcgcacagctgattggagatgaaagggctcaaactgctcgggcaatgtggaaccgcccacttaagactgtatatatcagcgactgcggggaactgaaagtgaccaaacaatctctttcccctccaagcttgccatga

SEQ ID NO: 6900 - protein, 319 aa, Sorghum bicolor
  misc_feature: Ceres ANNOT ID no. 6068772
  misc_feature (105)..(306): Pfam Id: Pro_isomerase Pfam Desc: Cyclophilin type peptidyl-prolyl cis-trans isomerase/CLD
  misc_feature (113)..(261): NCBI GI: 3869176 NCBI Desc: cyclophilin [arthroderma benhamiae]
  misc_feature (113)..(273): NCBI GI: 27805451 NCBI Desc: peptidyl-prolyl cis-trans isomerase b precursor (ppiase b) (rotamase b) (cyclophilin b) (s-cyclophilin)
  misc_feature (115)..(271): NCBI GI: 74671259 NCBI Desc: peptidyl-prolyl cis-trans isomerase b precursor (ppiase b) (rotamase b)
  misc_feature (115)..(284): NCBI GI: 17223511 NCBI Desc: cyclophilin-like peptidyl prolyl cis-trans isomerase [aspergillus niger]
  misc_feature (115)..(257): NCBI GI: 112253395 NCBI Desc: cyclophilin-like protein [pfiesteria piscicida]
MRAASSTVYPVYLSLHHHPNNHHASLRLSRANHDNTHKCTQSPKILRRSLFSLPASFLLLHTSSSLAVDDTNTPSTSTIDTTITDRIFMDFSVCPSYFRSDRPLGAELSSCPDSEPLGRVVFGLYGRLLPVTTANFKATCTAAAYRGTLVHKLLQGQFFAAGRQGSRRDKGEVEPPSGLVRNSETVNPKAFELRHTRPGTLSLCLGQNDDDDDIKLNPNYHNVEFLVTTGPGPCPELDGQNIVFGTVLEGMDVITSIATIPTYKPAERIRLFNDFAQLIGDERAQTARAMWNRPLKTVYISDCGELKVTKQSLSPPSLP

SEQ ID NO: 6901 - DNA, 957 bp, Sorghum bicolor
  misc_feature: Ceres ANNOT ID no. 6068775
  misc_feature: Encodes the peptide sequence at SEQ ID NO 6902
atgcggcaccgcctgctccgccgcgcgatgccgatccctccgccgccgcaatctccccggacgccgggggtcgccggcgggcgtctcttcgcttcgctcccgctgccgccgccgctccagtctcgaagagaggtgcatgtttggtatcttttgcctgatgagttgaatgatgcctccctactgaagatgtacacggagctcctttccccttctgaaaggaagactgctttgtcaatgaacggggaaaagttgcagaaaggtgctgtgctgtcccgtgcactggtgcgcaccaccctctcgagatattgtaaagttgatccaagatcatttgagtttaagaaaaacaagtttggcaaacctgagatactgtggcaatctgatgacagcaggatggaatggcctttgcatttcaatatttcacacacatcttctttgattgcctgtggcataaccatggatgctcctattggcattgatgttgaagacaagaaacgaaagacagccaagaatattctatctcttgctcgccgttatttcaccccatctgaaattgattatctagctaaaattccagatcctgatggtcagcaaaaggagttcataaaactatggactcttaaagaagcatatgtaaaagctctcggaagggggttttcaggcgctcctttcaacaaattctcgatcatcttggcagcaaataacagaatcaaaatttctgtggcaccaaaagcattcaatgattctgactctagctgtgactgtctgtccgagaattggcaatttgcagttgctgagctaaatagttctcattacatggcaatctgtacagaggatgactcaacaagttcagattctggaaacggcagactgccactaggattgaaagtatggaagaccattccattcgttgaagatatacttgtttcgggaacagaagctgtaaaacttgtcagttga

SEQ ID NO: 6902 - protein, 318 aa, Sorghum bicolor
  misc_feature: Ceres ANNOT ID no. 6068775
  misc_feature (156)..(223): Pfam Id: ACPS Pfam Desc: 4'-phosphopantetheinyl transferase superfamily
  misc_feature (29)..(309): NCBI GI: 20147157 NCBI Desc: at3g11470/f24k9_14 [arabidopsis thaliana]
  misc_feature (29)..(309): NCBI GI: 79607890 NCBI Desc: magnesium ion binding / phosphopantetheinyltransferase/ transferase [arabidopsis thaliana]
  misc_feature (105)..(228): NCBI GI: 42568884 NCBI Desc: cop1-interacting protein-related [arabidopsis thaliana]
  misc_feature (104)..(309): NCBI GI: 79313183 NCBI Desc: magnesium ion binding / phosphopantetheinyltransferase/ transferase [arabidopsis thaliana]
  misc_feature (103)..(207): NCBI GI: 92879624 NCBI Desc: 4-phosphopantetheinyl transferase [medicago truncatula]
MRHRLLRRAMPIPPPPQSPRTPGVAGGRLFASLPLPPPLQSRREVHVWYLLPDELNDASLLKMYTELLSPSERKTALSMNGEKLQKGAVLSRALVRTTLSRYCKVDPRSFEFKKNKFGKPEILWQSDDSRMEWPLHFNISHTSSLIACGITMDAPIGIDVEDKKRKTAKNILSLARRYFTPSEIDYLAKIPDPDGQQKEFIKLWTLKEAYVKALGRGFSGAPFNKFSIILAANNRIKISVAPKAFNDSDSSCDCLSENWQFAVAELNSSHYMAICTEDDSTSSDSGNGRLPLGLKVWKTIPFVEDILVSGTEAVKLVS

SEQ ID NO: 6903 - DNA, 1200 bp, Sorghum bicolor
  misc_feature: Ceres ANNOT ID no. 6068780
  misc_feature: Encodes the peptide sequence at SEQ ID NO 6904
atgggtatccttgagagaatcaaggagattgaggccgagatggctcggactcagaaaaataaagcaacagaatatcatcttggacaactgaaggcaaaactagcaaagttgaggacacaactattagagcctccaaagggttccagtggaggtggagatggttttgaagtcacaaagtttgggcatggtcgcgttgcacttattggatttcccagtgttggaaagtcaactcttttaacgatgttgactgggacacattctgaagctgcatcatatgagttcacaacacttacttgtattcctggaattattcattacaacgacaccaaaatccaacttcttgatcttcctggtatcattgaaggagcctctgaaggcaaggggcgtggtaggcaggttattgctgttgcaaagtcatcagatcttgtgctgatggttctggatgcctcaaagagtgaaggacatcgccaaatattaactagagaactggaagctgttggactccgtcttaacaaaaggcctccccagatatacttcaaaaggaagaagactggtgggatttctttcaataccactgtgcctttgactcatattgatgagaagctctgctatcagattctgcatgagtacaaaattcataatgctgaggtgttattccgtgaagatgctactgtggatgatctcatcgatgtcatcgaaggaaatcgaaagtacatcaagtgtgtttacgtatataacaagattgatgttgttggtatcgatgacgtagataagcttgctcggcaaccaaattctctagttatcagctgcaatttgaagctgaacttggataggctactggcgagaatgtgggatgagatgggcctagtgagggtgtatacaaagccacagggtcagcagcctgatttcacagatccagttgttctttctactgacagaggtggttgtacagttgaggacttctgcaatcatatccatagaagtttgctcaaggatgtgaagtatgtgcttgtatggggaaccagtgcgagacactatccgcagcattgtggcctcagccatggtctccaagacgaggatgtcgtccagatagtaaagaagaaggaaaaggaagagggtgggcgaggccggttcaagtcgcacacgaacgcacctgatcggatatctgatagggtgaagaaagctcccctcaagacataa

SEQ ID NO: 6904 - protein, 399 aa, Sorghum bicolor
  misc_feature: Ceres ANNOT ID no. 6068780
  misc_feature (290)..(366): Pfam Id: TGS Pfam Desc: TGS domain
  misc_feature (63)..(174): Pfam Id: MMR_HSR1 Pfam Desc: GTPase of unknown function
  misc_feature (65)..(173): Pfam Id: Dynamin_N Pfam Desc: Dynamin family
  misc_feature (1)..(398): NCBI GI: 59958304 NCBI Desc: at1g17470 [arabidopsis thaliana]
  misc_feature (1)..(398): NCBI GI: 2058456 NCBI Desc: gtp-binding protein [arabidopsis thaliana]
  misc_feature (1)..(398): NCBI GI: 8778457 NCBI Desc: f1l3.17 [arabidopsis thaliana]
  misc_feature (1)..(398): NCBI GI: 2345148 NCBI Desc: developmentally regulated gtp binding protein [pisum sativum]
  misc_feature (1)..(367): NCBI GI: 49903487 NCBI Desc: developmentally regulated gtp binding protein 2 [xenopus tropicalis]
MGILERIKEIEAEMARTQKNKATEYHLGQLKAKLAKLRTQLLEPPKGSSGGGDGFEVTKFGHGRVALIGFPSVGKSTLLTMLTGTHSEAASYEFTTLTCIPGIIHYNDTKIQLLDLPGIIEGASEGKGRGRQVIAVAKSSDLVLMVLDASKSEGHRQILTRELEAVGLRLNKRPPQIYFKRKKTGGISFNTTVPLTHIDEKLCYQILHEYKIHNAEVLFREDATVDDLIDVIEGNRKYIKCVYVYNKIDVVGIDDVDKLARQPNSLVISCNLKLNLDRLLARMWDEMGLVRVYTKPQGQQPDFTDPVVLSTDRGGCTVEDFCNHIHRSLLKDVKYVLVWGTSARHYPQHCGLSHGLQDEDVVQIVKKKEKEEGGRGRFKSHTNAPDRISDRVKKAPLKT

SEQ ID NO: 6905 - DNA, 1971 bp, Sorghum bicolor
  misc_feature: Ceres ANNOT ID no. 6068782
  misc_feature: Encodes the peptide sequence at SEQ ID NO 6906
atggaggtggcgggggctcaggcccgcgcggttcccctcctgctccgccaccccgcgtccctgcggagctccgtatccgtctcctgcacgggctcccgccggagctgggcggcggcggcaacggcagagggggacgagacccgcggcttcgacaaggtgcccatggacacccccggcgcgtaccgcctggtggaccgggccaccggtcgcagcgtcatcgtatggggcggcaccgacgacggcgacgaggccgccattccgtccccggcggtgctctccaggaccaggaccaccgaccgccgcagcagccaaggtgttgggggaggtacaggcatcgggaatttcggcagattgaaggcacagaaaataaaatccttggtcacgaggtcagctcaccgcaagagggagagttctagtcgctcaagcactaaccggtctggtgaatcttctttcgatggctctggtgatgaagaggaaagctattttgagagaagaaagcctgtctcagactcagaacaccgcgcgaagctgagcagtgactacagaaacggaaggactcgaggcgcacattctctgacttctgttttgggccaatacagaggtgctgatgatacgggcttccctgcttcagaggctacttctggttccaaaggatggggtaatgttgccgatgttacttatggacggcagaatcagaagcaaagggagcctctaaatttccctcaaagaaaagggcctctggacagtgggtttttcagtcgcagaacttttaaggagattggctgcagtgacgaaattctagttgtgttgaggaattttgatttccctcgtccgtctcatatccaggctatggcatatggccctatcttggaggggaggagctgtgttattgctgatcaaagtgggtctggcaagacactggcatatctttgccctataatacaaaacttaaggagcgaagaagttcaggggctccataaatcatcccctaggaaccccagggtgatagtattgacccctactgctgaacttgcttctcaggtccttaataattgccggttgatatcaaaatctggggttccattcaggtctatggttgcaaccggaggatttcgacagaagacacagttagaaagcctcaaccaagagcttgatgtaattatagcaacaccaggccgattcttgtatctgcttcaggaaggctttgtgcaattagctaacctcagatgtgttgtgttggatgaagtggacattttatttggcgaagaaggttttgagcaagtgcttcatcagttgattactgttgcaccagtgacaacacaatatctttttgtgactgccactcttccccttgatatctacaacaaggttgttgaaacctttcctgactgtgaggttatcatgggacccggtgtccaccgaacaagctctcgtcttgaagagattcttgtggactgcagtggagatgataatgaagaaaagaatccagaaactgcattttcaaacaagaaatcagcacttttaaagattattgaggaatctcctgttcgcagaacaattattttctgcaacaagattgagacatgtagaaaggttgagaatgcgctgaggcgggttgacaggaaagcttcgcagatcaaagttctccccttccatgctgctttggatcaggcccagcgcatcacaaacatcaaggagttcctgaacaagcaaacggctgactccatgttccttgtgtgcacagatagggcatcgcggggcatcgactttgcgaacgtgaaccatgtggtgctctttgactacccccgcgacccaagcgagtacgtgcggcgcgttgggcggacggcccgtggtgcgtccggcaacggcaaggcattcgtgttcgcggtgggcaagcaggtgtccctggccaggagggtgatggagaggaacatgaaggggcacccgctgcacgacgtgccatgcgtctaa

SEQ ID NO: 6906 - protein, 656 aa, Sorghum bicolor
  misc_feature: Ceres ANNOT ID no. 6068782
  misc_feature (279)..(457): Pfam Id: DEAD Pfam Desc: DEAD/DEAH box helicase
  misc_feature (540)..(619): Pfam Id: Helicase_C Pfam Desc: Helicase conserved C-terminal domain
  misc_feature (1)..(656): NCBI GI: 115450203 NCBI Desc: os03g0108600 [oryza sativa (japonica cultivar-group)]
  misc_feature (257)..(486): NCBI GI: 88808729 NCBI Desc: dead/deah box helicase-like protein [synechococcus sp. wh 7805]
  misc_feature (256)..(530): NCBI GI: 126442203 NCBI Desc: dead/deah box helicase [burkholderia pseudomallei 668]
  misc_feature (256)..(530): NCBI GI: 52428915 NCBI Desc: atp-dependent rna helicase rhle [burkholderia mallei atcc 23344]
  misc_feature (256)..(530): NCBI GI: 67643786 NCBI Desc: cog0513: superfamily ii dna and rna helicases [burkholderia mallei gb8 horse 4]
MEVAGAQARAVPLLLRHPASLRSSVSVSCTGSRRSWAAAATAEGDETRGFDKVPMDTPGAYRLVDRATGRSVIVWGGTDDGDEAAIPSPAVLSRTRTTDRRSSQGVGGGTGIGNFGRLKAQKIKSLVTRSAHRKRESSSRSSTNRSGESSFDGSGDEEESYFERRKPVSDSEHRAKLSSDYRNGRTRGAHSLTSVLGQYRGADDTGFPASEATSGSKGWGNVADVTYGRQNQKQREPLNFPQRKGPLDSGFFSRRTFKEIGCSDEILVVLRNFDFPRPSHIQAMAYGPILEGRSCVIADQSGSGKTLAYLCPIIQNLRSEEVQGLHKSSPRNPRVIVLTPTAELASQVLNNCRLISKSGVPFRSMVATGGFRQKTQLESLNQELDVIIATPGRFLYLLQEGFVQLANLRCVVLDEVDILFGEEGFEQVLHQLITVAPVTTQYLFVTATLPLDIYNKVVETFPDCEVIMGPGVHRTSSRLEEILVDCSGDDNEEKNPETAFSNKKSALLKIIEESPVRRTIIFCNKIETCRKVENALRRVDRKASQIKVLPFHAALDQAQRITNIKEFLNKQTADSMFLVCTDRASRGIDFANVNHVVLFDYPRDPSEYVRRVGRTARGASGNGKAFVFAVGKQVSLARRVMERNMKGHPLHDVPCV

SEQ ID NO: 6907 - DNA, 690 bp, Sorghum bicolor
  misc_feature: Ceres ANNOT ID no. 6068783
  misc_feature: Encodes the peptide sequence at SEQ ID NO 6908
atggaaacgatgaagagccttctgaagccgaagccgacgccgcagcagcagctgcgcgagtggcagcgccgcctccgcaacgagggccgcaacatcgaccggcagatccgagatgtgcagagggaggagaagaaggtggagaaggccatcagggaggccgccaagcgcaacgacatgggatccgccaaggcgctggccaaggaggtggtgcagtcgaggaaggccgtcaaccgcctctacgagaacaaggcccagctcaactccatctccatgcaccttggcgaaatcgttgctactgctaggacagtaggccacttgtccaagagcaccgaagtgatgaaacttgtcaacaatctcatgaaagccccggacgttgcagccacaatgcaggaattcagcaaagagatgacaaaggctggtgtaatggaagaaatggtcaacgatgctttagattcgacgctggacaatgaggacatcgaggaggaaattgaagaggaggttgacaaggtcctcaccgcaatcgctggggagactgcctctgagctcccggatgctgttaggaaggaaaaggagaagatgaggcagccttcaacaagtgtacctgcggagagaactgctatagcagaggctgtcgatgatgatgatgagctagaccagataagggaaaggcttgccaaagtgaggtcatag

SEQ ID NO: 6908 - protein, 229 aa, Sorghum bicolor
  misc_feature: Ceres ANNOT ID no. 6068783
  misc_feature (20)..(190): Pfam Id: Snf7 Pfam Desc: Snf7
  misc_feature (1)..(226): NCBI GI: 115450199 NCBI Desc: os03g0108400 [oryza sativa (japonica cultivar-group)]
  misc_feature (10)..(229): NCBI GI: 51011408 NCBI Desc: vacuolar sorting protein vps24 [ixodes pacificus]
  misc_feature (10)..(229): NCBI GI: 125777470 NCBI Desc: ga22030-pa [drosophila pseudoobscura]
  misc_feature (14)..(229): NCBI GI: 108876555 NCBI Desc: neuroendocrine differentiation factor [aedes aegypti]
  misc_feature (10)..(229): NCBI GI: 21356025 NCBI Desc: cg9779-pa [drosophila melanogaster]
  misc_feature: The sequence is a functional homolog of SEQ ID NO. 288 in the 11/188,298 US application
METMKSLLKPKPTPQQQLREWQRRLRNEGRNIDRQIRDVQREEKKVEKAIREAAKRNDMGSAKALAKEVVQSRKAVNRLYENKAQLNSISMHLGEIVATARTVGHLSKSTEVMKLVNNLMKAPDVAATMQEFSKEMTKAGVMEEMVNDALDSTLDNEDIEEEIEEEVDKVLTAIAGETASELPDAVRKEKEKMRQPSTSVPAERTAIAEAVDDDDELDQIRERLAKVRS

SEQ ID NO: 6909 - DNA, 525 bp, Sorghum bicolor
  misc_feature: Ceres ANNOT ID no. 6068784
  misc_feature: Encodes the peptide sequence at SEQ ID NO 6910
atggttctaggcagcaatatttcctttcagaaaaccttgtatgaggttttttctgtgagtgaagatgctacatatgatgaaattcgtgcagcatacaggtctgctgcgctgaacacacatcctgataaagcacagacaactctcgagtcatctgtgccttccagtgagcaacaggaattttgtagtgtgcagaaagcatgggaaattctacgccatcctgcatctagagcagactatgataagcagctgcaatcatccagacagaatattgagatcattgcgtctgaaatcaaagtcggggatatgatcattgagagcaccgctgatactgtagagctgttgtacccatgcaggtgtggtgattattttttcatcacttcatgtcaacttagtgagatgggaattttcgtcagtggagatggagaagtagaactgcaggcgtctgattctgcatcagcttctgttgttcttggctgtggctcttgttctctcaagatacggttggttataaatgtacctcagtga

SEQ ID NO: 6910 - protein, 174 aa, Sorghum bicolor
  misc_feature: Ceres ANNOT ID no. 6068784
  misc_feature (12)..(80): Pfam Id: DnaJ Pfam Desc: DnaJ domain
  misc_feature (1)..(171): NCBI GI: 115476866 NCBI Desc: os08g0474600 [oryza sativa (japonica cultivar-group)]
  misc_feature (1)..(130): NCBI GI: 92868083 NCBI Desc: heat shock protein dnaj, n-terminal [medicago truncatula]
  misc_feature (1)..(140): NCBI GI: 116128056 NCBI Desc: ensangp00000017982 [anopheles gambiae str. pest]
  misc_feature (18)..(87): NCBI GI: 77454996 NCBI Desc: cg2911 [drosophila yakuba]
  misc_feature (14)..(102): NCBI GI: 125775699 NCBI Desc: ga15512-pa [drosophila pseudoobscura]
  misc_feature: Useful for making plants with altered protein content
  misc_feature: Useful for making plants with modulated drought sensitivity
  misc_feature: Useful for making plants with modulated seed size
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13491
  misc_feature: GREAT-hit functional homolog of the protein sequence given in SEQ ID NO 13493
MVLGSNISFQKTLYEVFSVSEDATYDEIRAAYRSAALNTHPDKAQTTLESSVPSSEQQEFCSVQKAWEILRHPASRADYDKQLQSSRQNIEIIASEIKVGDMIIESTADTVELLYPCRCGDYFFITSCQLSEMGIFVSGDGEVELQASDSASASVVLGCGSCSLKIRLVINVPQ

SEQ ID NO: 6911 - DNA, 1122 bp, Sorghum bicolor
  misc_feature: Ceres ANNOT ID no. 6068797
  misc_feature: Encodes the peptide sequence at SEQ ID NO 6912
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
atgaactgcctccagaacctgctcaaggagcctccaatcgtgggatccaggtcgatgaggcggccctctccgcttaatctggcgatggttcgcggcggcagtcgccgatcaaacaccgtcaaaactttgcaggcaccaggggcgtccacttccggtgccgagagcagcgccgtcgagatgggcaccgagaagtctgaagtgtacagcactaacatgacgcatgctatgggagcagcgttgacatatagacatgaacttggaatgaactacaatttcatacgcccagacttgattgtaggatcctgcttacagagcccacttgacgttgataagcttcggaagattggtgtaaaaactgtattctgcttgcagcaagattcagatcttgaatattttggagttgacatcggagccatccaagattattctctacaattcaaagatattatgcactgccgtgctgaaattagggattttgatgcttttgatttgcgattgaggcttcctgctgtggttagcaaattgcacaagcttgtcaactgtaatggcggtgtaacatatatacattgtactgctggacttggaagagctcctgctgttgcattggcttatatgttctggattcttgggtacagtctcaatgagggacatcagctgctgcagagtaaaagggcttgctttccgaagttggaagccattaagttggccactgctgacattctgacaggattatcaaaaaacacaatcactttaaagtgggaagatgatggttcttcctctgttgaaatttctgggctcgacattggctggggccagagaattcctttgacatatgatgaggagagaggagcttggtttcttgagaaagagttgcctgaaggacggtatgaatacaaatacatagtggatggcaagtggctatgcaacgagcatgagatgttgacgaaaccgaacgctgacggtcacgtgaacaactatgtccaggtctccagagacggtaccagtgacgaagagaaggagctaagggagcggttgactggtccagaccctgttctcacggacgaggaaaggctgatgatcagagagtacttggaacagtatgcggatgccggggagcgctag

SEQ ID NO: 6912 - protein, 373 aa, Sorghum bicolor
  misc_feature: Ceres ANNOT ID no. 6068797
  misc_feature (89)..(235): Pfam Id: DSPc Pfam Desc: Dual specificity phosphatase, catalytic domain
  misc_feature (1)..(370): NCBI GI: 82623389 NCBI Desc: protein tyrosine phosphatase-like [solanum tuberosum]
  misc_feature (1)..(369): NCBI GI: 14970762 NCBI Desc: protein tyrosine phosphatase [lycopersicon esculentum]
  misc_feature (1)..(370): NCBI GI: 11544663 NCBI Desc: ptpkis1 [arabidopsis thaliana]
  misc_feature (1)..(370): NCBI GI: 23505915 NCBI Desc: at3g52180/f4f15_290 [arabidopsis thaliana]
  misc_feature (1)..(272): NCBI GI: 79314780 NCBI Desc: phosphoprotein phosphatase/ protein tyrosine/serine/threonine phosphatase [arabidopsis thaliana]
  misc_feature: Up-regulated in root tissues in response to methyl jasmonate treatment
  misc_feature: Up-regulated in shoot tissues in response to methyl jasmonate treatment
  misc_feature: Up-regulated in shoot tissues in response to salicylic acid treatment
  misc_feature: The sequence is a functional homolog of SEQ ID NO. 473 in the 11/188,298 US application
MNCLQNLLKEPPIVGSRSMRRPSPLNLAMVRGGSRRSNTVKTLQAPGASTSGAESSAVEMGTEKSEVYSTNMTHAMGAALTYRHELGMNYNFIRPDLIVGSCLQSPLDVDKLRKIGVKTVFCLQQDSDLEYFGVDIGAIQDYSLQFKDIMHCRAEIRDFDAFDLRLRLPAVVSKLHKLVNCNGGVTYIHCTAGLGRAPAVALAYMFWILGYSLNEGHQLLQSKRACFPKLEAIKLATADILTGLSKNTITLKWEDDGSSSVEISGLDIGWGQRIPLTYDEERGAWFLEKELPEGRYEYKYIVDGKWLCNEHEMLTKPNADGHVNNYVQVSRDGTSDEEKELRERLTGPDPVLTDEERLMIREYLEQYADAGER

SEQ ID NO: 6913 - DNA, 801 bp, Sorghum bicolor
  misc_feature: Ceres ANNOT ID no. 6068810
  misc_feature: Encodes the peptide sequence at SEQ ID NO 6914
atgggagtgaacatgatgtcctggtcgatgaaggtggcgttggtggtggcgttggtgtttctggtgggtggcgcatggtgcggtcctcccaaggttgccccaggaaagaacatcacggccacctacggcagtgactggctggaagcaaaggcgacatggtacggcaagccgacgggcgccggccccgacgacaacggcggtgcgtgcgggtacaaggatgttaacaaggcccccttcaacagcatgggcgcgtgcggcaacctccccatcttcaaggacggcctcggctgcggctcatgctttgagatcaagtgcgacaagccggccgagtgctccggtgaggccgtggtggtgcacatcacggacatgaactacgagcaaattgccgcctaccacttcgacctggccggcaccgcatttggcgccatggccaagaagggcgaggaggagaagctgcgcaaggcgggcatcatcgacatgcagttccgccgggtcaagtgcaagtatggcgaaaaggtcaccttccacgtggagaaggggagcaaccccaactacctggcactgctggtcaagtatgtcgatggcgacggcgacgttgtgggggtggacatcaaggagaagggtggcgaggcgtaccagcccctcaagcactcctggggcgctatttggaggaaggacagcgacaagcccatcaagtttcccgtcactatccaaatcaccactgagggaggcaccaagaccgcctacgaagatgtcatccctgaaggttggaaggccgacaccacctacactgccaaataa

SEQ ID NO: 6914 - protein, 266 aa, Sorghum bicolor
  misc_feature: Ceres ANNOT ID no. 6068810
  misc_feature (173)..(254): Pfam Id: Pollen_allerg_1 Pfam Desc: Pollen allergen
  misc_feature (83)..(162): Pfam Id: DPBB_1 Pfam Desc: Rare lipoprotein A (RlpA)-like double-psi beta-barrel
  misc_feature (1)..(266): NCBI GI: 115502168 NCBI Desc: expansin-b11 precursor (zmexpb11) (beta-expansin-11) (pollen allergen zea m 1a) (pollen allergen zea m 1b)
  misc_feature (1)..(266): NCBI GI: 105969545 NCBI Desc: expb10 [zea mays]
  misc_feature (1)..(266): NCBI GI: 115502167 NCBI Desc: expansin-b10 precursor (zmexpb10) (beta-expansin-10) (pollen allergen zea m 1c)
  misc_feature (8)..(266): NCBI GI: 89892721 NCBI Desc: zea m 1 allergen [zea mays]
  misc_feature (17)..(266): NCBI GI: 89892723 NCBI Desc: zea m 1 allergen [zea mays]
  misc_feature: Useful for making plants with altered carbohydrate content
  misc_feature: Functional homolog of the protein sequence given in SEQ ID NO 13970
MGVNMMSWSMKVALVVALVFLVGGAWCGPPKVAPGKNITATYGSDWLEAKATWYGKPTGAGPDDNGGACGYKDVNKAPFNSMGACGNLPIFKDGLGCGSCFEIKCDKPAECSGEAVVVHITDMNYEQIAAYHFDLAGTAFGAMAKKGEEEKLRKAGIIDMQFRRVKCKYGEKVTFHVEKGSNPNYLALLVKYVDGDGDVVGVDIKEKGGEAYQPLKHSWGAIWRKDSDKPIKFPVTIQITTEGGTKTAYEDVIPEGWKADTTYTAK

SEQ ID NO: 6915 - DNA, 786 bp, Sorghum bicolor
  misc_feature: Ceres ANNOT ID no. 6068817
  misc_feature: Encodes the peptide sequence at SEQ ID NO 6916
atgtcgtggtcgatgcaggtggcggtggtggtggcgctggcgtttctggtgggcggcgcatggtgcggtcctcctaaggttgccccgggcaagaacatcacggccacctacggcagcgactggctggaagcgaaggcgacatggtacggcaagccgacgggcgccggccccgacgacaacggcggcgcgtgcgggtacaaggatgtgaacaaggcccccttcaacagcatgggcgcgtgtggcaacctccccatcttcaaggacggcctcggctgcggctcttgctttgagatcaagtgcaacaagccggccgagtgctctggtgaggccgtggtggtgcacatcacagacatgaactacgagcaaatcgccgcctaccacttcgatctggccggcacggcgttcggcgccatggccaagaagggcgaggaggagaagctgcgcaaggcgggcatcatcgacatgcagtttcgccgggtcaagtgcaagtacggcgaaaaggtcaccttccacgtggagaaggggagcaaccccaattacctggcattgctggtcaagtatgtcgatggtgacggtgacgttgtgggggtggacatcaaggagaagggtggcgacgcgtaccagtcccttaagcactcctggggcgctgtctggaggaaggacagcgacaagcccatcaagttccccgtcactgtccaaatcaccaccgagggaggcaccaagactgcctacgaagacgtcatccccgaaggctggaaggccgacaccacctacaccgccaaataa

SEQ ID NO: 6916 - protein, 261 aa, Sorghum bicolor
  misc_feature: Ceres ANNOT ID no. 6068817
  misc_feature (168)..(249): Pfam Id: Pollen_allerg_1 Pfam Desc: Pollen allergen
  misc_feature (78)..(157): Pfam Id: DPBB_1 Pfam Desc: Rare lipoprotein A (RlpA)-like double-psi beta-barrel
  misc_feature (3)..(261): NCBI GI: 115502168 NCBI Desc: expansin-b11 precursor (zmexpb11) (beta-expansin-11) (pollen allergen zea m 1a) (pollen allergen zea m 1b)
  misc_feature (3)..(261): NCBI GI: 105969545 NCBI Desc: expb10 [zea mays]
  misc_feature (3)..(261): NCBI GI: 89892721 NCBI Desc: zea m 1 allergen [zea mays]
  misc_feature (3)..(261): NCBI GI: 115502167 NCBI Desc: expansin-b10 precursor (zmexpb10) (beta-expansin-10) (pollen allergen zea m 1c)
  misc_feature (12)..(261): NCBI GI: 89892723 NCBI Desc: zea m 1 allergen [zea mays]
  misc_feature: Useful for making plants with altered cell wall content and/or composition
  misc_feature: Functional homolog of the protein sequence encoded by LOCUS at1g65680
  misc_feature: Useful for making plants with altered carbohydrate content
  misc_feature: Functional homolog of the protein sequence given in SEQ ID NO 13970
MSWSMQVAVVVALAFLVGGAWCGPPKVAPGKNITATYGSDWLEAKATWYGKPTGAGPDDNGGACGYKDVNKAPFNSMGACGNLPIFKDGLGCGSCFEIKCNKPAECSGEAVVVHITDMNYEQIAAYHFDLAGTAFGAMAKKGEEEKLRKAGIIDMQFRRVKCKYGEKVTFHVEKGSNPNYLALLVKYVDGDGDVVGVDIKEKGGDAYQSLKHSWGAVWRKDSDKPIKFPVTVQITTEGGTKTAYEDVIPEGWKADTTYTAK

SEQ ID NO: 6917 - DNA, 786 bp, Sorghum bicolor
  misc_feature: Ceres ANNOT ID no. 6068818
  misc_feature: Encodes the peptide sequence at SEQ ID NO 6918
atgtcgtggtcgatgcaggtggtgttggtggtggcgctggcgtttttggtgggtggtgcatggtgcggtcctcccaaggttgccccgggcaagaacatcacggccacctacggcagcgactggctggaagcgaaggcgacatggtacggcaagccgacgggcgccggccccgacgacaacggcggcgcgtgcgggtacaaggatgtgaacaaggcccccttcaacagcatgggcgcgtgcggcaacctccccatcttcaaagacggcctcggctgtggctcctgctttgagatcaagtgcgacaagccagccgagtgctccggcgaggctgtggtggtgcacatcacggacatgaactacgagcaaatcgccgcctaccacttcgacctcgccggcacggcattcggtgccatggccaagaagggcgaggaggagaagctgcgcaaggcgggcatcatcgacatgcaattccgccgggtcaagtgcaagtacggtgaaaaggtcaccttccacgtggagaaggggagcaaccccaactacctggcattgctggtcaagtatgtcgatggcgacggtgacgttgtgggggtggacatcaaggagaagggtggcgacgcttaccagcccctcaagcactcctggggcgctgtttggaggaaggacagcgacaagcccatcaagttccccgtcactgtccaaatcaccaccgagggaggcaccaagaccgcctacgaagacgtcatccccgaaggatggaaggccgacaccacgtacaccgccaaataa

SEQ ID NO: 6918 - protein, 261 aa, Sorghum bicolor
  misc_feature: Ceres ANNOT ID no. 6068818
  misc_feature (168)..(249): Pfam Id: Pollen_allerg_1 Pfam Desc: Pollen allergen
  misc_feature (78)..(157): Pfam Id: DPBB_1 Pfam Desc: Rare lipoprotein A (RlpA)-like double-psi beta-barrel
  misc_feature (3)..(261): NCBI GI: 115502168 NCBI Desc: expansin-b11 precursor (zmexpb11) (beta-expansin-11) (pollen allergen zea m 1a) (pollen allergen zea m 1b)
  misc_feature (3)..(261): NCBI GI: 105969545 NCBI Desc: expb10 [zea mays]
  misc_feature (3)..(261): NCBI GI: 89892721 NCBI Desc: zea m 1 allergen [zea mays]
  misc_feature (3)..(261): NCBI GI: 115502167 NCBI Desc: expansin-b10 precursor (zmexpb10) (beta-expansin-10) (pollen allergen zea m 1c)
  misc_feature (12)..(261): NCBI GI: 89892723 NCBI Desc: zea m 1 allergen [zea mays]
  misc_feature: Useful for making plants with altered cell wall content and/or composition
  misc_feature: Functional homolog of the protein sequence encoded by LOCUS at1g65680
  misc_feature: Useful for making plants with altered carbohydrate content
  misc_feature: Functional homolog of the protein sequence given in SEQ ID NO 13970
MSWSMQVVLVVALAFLVGGAWCGPPKVAPGKNITATYGSDWLEAKATWYGKPTGAGPDDNGGACGYKDVNKAPFNSMGACGNLPIFKDGLGCGSCFEIKCDKPAECSGEAVVVHITDMNYEQIAAYHFDLAGTAFGAMAKKGEEEKLRKAGIIDMQFRRVKCKYGEKVTFHVEKGSNPNYLALLVKYVDGDGDVVGVDIKEKGGDAYQPLKHSWGAVWRKDSDKPIKFPVTVQITTEGGTKTAYEDVIPEGWKADTTYTAK

SEQ ID NO: 6919 - DNA, 1212 bp, Sorghum bicolor
  misc_feature: Ceres ANNOT ID no. 6068819
  misc_feature: Encodes the peptide sequence at SEQ ID NO 6920
  misc_feature: Up-regulated in shoot tissues in response to salicylic acid treatment
atggagctccgcctcgcctcccgcggcgccctttcggccgctccgccgctttccggctgcttgtcgcggcactcgctctcgccgtggctcaagatccagaaccacatttatccgatgccaagtctctgttacaaggttcgtaccacggcaaaatgccatgcttctatggcaacaagttacgtggaaacatcagaggtcactgatttggactgggaaaaccttggctttggcctcatcgagactgactttatgtatgttgcaaaatgtggacctgatggaatcttttccaaaggtgaagtcctaccttttggtcctatagcactgagtccttctgctggagtcttaaattatggacagggattgtttgaaggcctaaaagcatataggaaagctgatgggtccatccttctatttcgtccggaggagaatgctataaggatgataagtggtgcagagagaatgtgtatgcctgctccaactgttgagcaattcgttgatgctgttaaacaaactgttttggcaaataaaagatgggtgcctcctactggtaaaggttccctgtatatcaggccactcctaataggaagcggtgctgttcttggtcttgcacctgctcctgagtatagctttatcatttttgtatcccctgttgggaattatttcaaggaaggtttatctcctatcaatttgattgttgaggagaaatttcaccgtgccagccctggtggaactggaggcgtgaaaaccattggaaactatgcctcggtactgagagcgcaaaaggttgcaaaggggaaaggatattctgatgtcctttatttggatgctgttcatgacaaatatcttgaagaagtctcttcctgcaatatttttgttgtgaaagacaatgttatctctactcctgccattaagggaacaatactgcctggtataacaaggaaaagtatcattgaagttgctcagagcaaaggcttcaaggttgaggagcgcctggtgtcagtagatgagttgcttaatgctgatgaagttttctgcacggggactgctgttgtggtgtcacctgtagggagtgttacatatatggggaaaagggcggaatatggcaaccaaggagtcggtgtcgtgtctcagcaactatacaagtcacttacaagcctccagatgggcaatgttgaggactggatgggttggaccgtgcaactgaatcagtag

SEQ ID NO: 6920 - protein, 403 aa, Sorghum bicolor
  misc_feature: Ceres ANNOT ID no. 6068819
  misc_feature (97)..(384): Pfam Id: Aminotran_4 Pfam Desc: Aminotransferase class IV
  misc_feature (6)..(402): NCBI GI: 9843665 NCBI Desc: branched-chain amino acid transaminase 5 [arabidopsis thaliana]
  misc_feature (6)..(402): NCBI GI: 111074416 NCBI Desc: at5g65780 [arabidopsis thaliana]
  misc_feature (45)..(402): NCBI GI: 10177336 NCBI Desc: branched-chain amino acid aminotransferase [arabidopsis thaliana]
  misc_feature (51)..(402): NCBI GI: 20453389 NCBI Desc: at3g49680/t16k5_30 [arabidopsis thaliana]
  misc_feature (51)..(402): NCBI GI: 21593211 NCBI Desc: branched-chain-amino-acid transaminase-like protein [arabidopsis thaliana]
  misc_feature (6)..(402): SWISSPROT Homolog: EC 2.6.1.42 Branched-chain-amino-acid aminotransferase 5, chloroplast precursor
  misc_feature: Useful for making plants with modulated nitrogen use efficiency
  misc_feature: Functional homolog of the protein sequence given in SEQ ID NO 13131
  misc_feature: Up-regulated in shoot tissues in response to salicylic acid treatment
  misc_feature: The sequence is a functional homolog of SEQ ID NO. 504 in the 11/188,298 US application
MELRLASRGALSAAPPLSGCLSRHSLSPWLKIQNHIYPMPSLCYKVRTTAKCHASMATSYVETSEVTDLDWENLGFGLIETDFMYVAKCGPDGIFSKGEVLPFGPIALSPSAGVLNYGQGLFEGLKAYRKADGSILLFRPEENAIRMISGAERMCMPAPTVEQFVDAVKQTVLANKRWVPPTGKGSLYIRPLLIGSGAVLGLAPAPEYSFIIFVSPVGNYFKEGLSPINLIVEEKFHRASPGGTGGVKTIGNYASVLRAQKVAKGKGYSDVLYLDAVHDKYLEEVSSCNIFVVKDNVISTPAIKGTILPGITRKSIIEVAQSKGFKVEERLVSVDELLNADEVFCTGTAVVVSPVGSVTYMGKRAEYGNQGVGVVSQQLYKSLTSLQMGNVEDWMGWTVQLNQ

SEQ ID NO: 6921 - DNA, 1290 bp, Sorghum bicolor
  misc_feature: Ceres ANNOT ID no. 6068835
  misc_feature: Encodes the peptide sequence at SEQ ID NO 6922
atgccgccggtgacgccggggcaagcgaccctcatcctggaccacgtcctgggcgacccctcgctccccgccgctgtcgccaaagcgctcctcgccgctctcccccatccctccgacccgaccccgcgcctctgccgcgcggtcgtcctccgcgccctcgccgcagaccccgtctccgaaacctctctccaaaacctccacttcctggcctcgctaaccgcctccccctccgccgccgcctcccgcatcgccaccgcccacatagccgtcgcggcattcctcgcggcctccgcacccgacttcgatgccgctgccatgaagctcttcgagcgccccagcggccgcgtgcgccgcgcggtcgacgagggaggtccgctcgcctccgatgttgccatggccacagtggaccagttcgaggccgccgtcggcaactcctcctctcagaccatcctcaggggcctgtggggcaaccgggccgccgcggaggaccgggtcagggacctcgtcgccgccgaatgggccgcgattgggccgtcgaagctcgtgacggcggctgagcggatcgtcggggatggggccctcgagacatggcgtgccgcggatgaggtcacccgtgccaagttacgcatcttggctggggaagaaaaaacccgcgagattcttgccaaactcgaagaaacaacctccagcgcaaatccaatctcaacaccagcttttgagaagatgatcgacgcgctcaaaacaagctgtgctgacctccacagtgttgtggaggatccacttccagctgccaaggcagttgcagatgaggtattggctgcaaggatggataaaggagttagcttgaatgctgaagaattaggaggtcagccaacagcttgtggtgctgcaggcccgagtactcttaatgataaagaccatggtccaagtagaggcaaacgtcagaaccttatggatcggaacccaacagcacggacctctcagtgggacgattcacctgatcttgaggggtcagaatcatcatcacccagactgcaattgcctagcccaaggagaataccaccttctcctttgccaccgccagaaaacaaaagtaatcgcagaagggcaaggaagtggagcatgtttgaagaagaaacactgagaaagggtgttgaacagtatggtatgggtaactggaagggtattttagataacaatcctgatgtttttatgggcagaacaccggtggacttgaaggataagtggaggaatatgaaacggttgggctaccagcagccaagagcgtaa

SEQ ID NO: 6922 - protein, 429 aa, Sorghum bicolor
  misc_feature: Ceres ANNOT ID no. 6068835
  misc_feature (370)..(420): Pfam Id: Myb_DNA-binding Pfam Desc: Myb-like DNA-binding domain
  misc_feature (1)..(419): NCBI GI: 54111435 NCBI Desc: terminal acidic sant 1 [zea mays]
  misc_feature (1)..(421): NCBI GI: 40388419 NCBI Desc: anther indehiscence1 [oryza sativa (japonica cultivar-group)]
  misc_feature (367)..(419): NCBI GI: 56404263 NCBI Desc: terminal acidic sant 1 [zea mays]
  misc_feature (304)..(355): NCBI GI: 56404262 NCBI Desc: terminal acidic sant 1 [zea mays]
  misc_feature (205)..(423): NCBI GI: 5032169 NCBI Desc: telomeric repeat binding factor 2 [homo sapiens]
MPPVTPGQATLILDHVLGDPSLPAAVAKALLAALPHPSDPTPRLCRAVVLRALAADPVSETSLQNLHFLASLTASPSAAASRIATAHIAVAAFLAASAPDFDAAAMKLFERPSGRVRRAVDEGGPLASDVAMATVDQFEAAVGNSSSQTILRGLWGNRAAAEDRVRDLVAAEWAAIGPSKLVTAAERIVGDGALETWRAADEVTRAKLRILAGEEKTREILAKLEETTSSANPISTPAFEKMIDALKTSCADLHSVVEDPLPAAKAVADEVLAARMDKGVSLNAEELGGQPTACGAAGPSTLNDKDHGPSRGKRQNLMDRNPTARTSQWDDSPDLEGSESSSPRLQLPSPRRIPPSPLPPPENKSNRRRARKWSMFEEETLRKGVEQYGMGNWKGILDNNPDVFMGRTPVDLKDKWRNMKRLGYQQPRA

SEQ ID NO: 6923 - DNA, 1875 bp, Sorghum bicolor
  misc_feature: Ceres ANNOT ID no. 6068836
  misc_feature: Encodes the peptide sequence at SEQ ID NO 6924
atgctggaggagctgctcatcttcacccggggcggcctcatcctctggtcgtcctgccgggctctcggcgccgctgccctcaagggctcccccatcgacgccctcatccgctcctgcctcctcgaggagcgctctgccgacgccagcttctcccaggacaactacgccctcaagtggaccttccacaacgaccttggccttgtcttcgtcgccgtctaccagaagatactccacctactctacgtcgacgacctcctcgccgctgtccgcagggagttctcccagatttacgaccccaaacgcacctcctacgatgactttggggacatctttcgccagctccatcgtgaggctgaggcgcgcgccgaggagatgaagaagtccaagcaggccctctcgtcccgtccacagcctgccctctcccagaagaaggttggtcccaagggccgccgtggcgattcccacggtgctgctgccaacaagggtggctctggtgccaaggatgactctgatggcgacgactctggaaacaaggaccagaacactctggtgaatggtgccttcaagggccaagagaatggtgtccgtaaggagaattctctcgcccgccctgttgttgttaagggaaaggagaatggaggtcccaaggataatggggccttcgatgtaagtaaactacagaagctacggaccaacaaaaagaatgttgccgctgacaatggaaccaagaagctgactaaacctgacacaaagaagaaagggaagcaagacagggtgtgggacgacaaaccttccaacaagaagctggattttacagacccagctgatgagagaggggacgaggtgacagacaatgtggcggtcattgagggagaaagcatgatggataaggatgaggatctgagcagcgacagtgaggacgaagaggtggaagatggacccaaaaagaaaggatggttctcatcaatgtttcagagtattgctggtaacaatgtattggagaagtctgatctgcagcctgcgctcaaagctctcaaagataggctgatggcaaagaatgtggcagaggaaattgcagagaagctttgtgaatctgttgcagctagccttgagggcaaaaagctagggtctttcaccagaatatcatctacagtccagacagctatggaggatgctcttcttcggattttgaccccaaggcgctctattgacatactgagggatgtgcacgctgctaaggagcgtgggaggccatatgtcattgttttcgttggggtgaatggagttggcaaatccaccaatcttgcaaaggttgcttattggcttcttcagcataacctcagtgtaacacttgcagcatgtgacaccttcagatctggtgctgttgagcagctgagaactcatgctaggaggcttcagatacctatatttgagaagggttatgagaaagatccagcagttgtagcgagggaggctattcaggaagcaacccggaacaaatcagatgttgttttggttgacactgctggacgtatgcaggacaatgaaccactcatgagggcactctccaagctaatcaatctcaatagcccagatctagttttatttgttggagaagcattggttggaaatgatgctgtggatcagctcactaaatttaaccagaaattagcagacctatctgctgttcctacagctagattgattgatggtatcctgctcactaagtttgacaccatcgatgacaaggttggagcagcactttccatggtctacatatctggagctccagtcatgttcgtcggctgtggtcagtcctacacggacctgaagaagctgaacgtgaaatccatcgtgaagaccctcctgaagtga

SEQ ID NO: 6924 - protein, 624 aa, Sorghum bicolor
  misc_feature: Ceres ANNOT ID no. 6068836
  misc_feature (417)..(624): Pfam Id: SRP54 Pfam Desc: SRP54-type protein, GTPase domain
  misc_feature (27)..(314): Pfam Id: SRP-alpha_N Pfam Desc: Signal recognition particle, alpha subunit, N-terminal
  misc_feature (1)..(624): NCBI GI: 92895775 NCBI Desc: gtp-binding signal recognition particle srp54, g-domain [medicago truncatula]
  misc_feature (1)..(624): NCBI GI: 22137194 NCBI Desc: at4g30600/f17i23_60 [arabidopsis thaliana]
  misc_feature (315)..(624): NCBI GI: 34581773 NCBI Desc: signal recognition particle receptor protein [cucumis sativus]
  misc_feature (289)..(624): NCBI GI: 54643816 NCBI Desc: ga15385-pa [drosophila pseudoobscura]
  misc_feature (289)..(624): NCBI GI: 24641198 NCBI Desc: cg2522-pa [drosophila melanogaster]
MLEELLIFTRGGLILWSSCRALGAAALKGSPIDALIRSCLLEERSADASFSQDNYALKWTFHNDLGLVFVAVYQKILHLLYVDDLLAAVRREFSQIYDPKRTSYDDFGDIFRQLHREAEARAEEMKKSKQALSSRPQPALSQKKVGPKGRRGDSHGAAANKGGSGAKDDSDGDDSGNKDQNTLVNGAFKGQENGVRKENSLARPVVVKGKENGGPKDNGAFDVSKLQKLRTNKKNVAADNGTKKLTKPDTKKKGKQDRVWDDKPSNKKLDFTDPADERGDEVTDNVAVIEGESMMDKDEDLSSDSEDEEVEDGPKKKGWFSSMFQSIAGNNVLEKSDLQPALKALKDRLMAKNVAEEIAEKLCESVAASLEGKKLGSFTRISSTVQTAMEDALLRILTPRRSIDILRDVHAAKERGRPYVIVFVGVNGVGKSTNLAKVAYWLLQHNLSVTLAACDTFRSGAVEQLRTHARRLQIPIFEKGYEKDPAVVAREAIQEATRNKSDVVLVDTAGRMQDNEPLMRALSKLINLNSPDLVLFVGEALVGNDAVDQLTKFNQKLADLSAVPTARLIDGILLTKFDTIDDKVGAALSMVYISGAPVMFVGCGQSYTDLKKLNVKSIVKTLLK

SEQ ID NO: 6925 - DNA, 426 bp, Sorghum bicolor
  misc_feature: Ceres ANNOT ID no. 6068843
  misc_feature: Encodes the peptide sequence at SEQ ID NO 6926
atgatgagcttccggccggctgctgcttccctgctggtcctgatgttggtggtcgtcggcagcagcgaggtcgcggcgtgcggcagctgcccgacaccaccatcatctcctcctccaccgccgcccagcagcggcggcacgccgtgccctccgccgccgtccagctccggtaagtgccccaagaacgcgctgaagctgggcgtgtgcgccaacgtgctgggcctcgtcaaggtctccatcggcaaggtgcccaccgactcgtgctgcccgctgctggacgggctcgccgacctggaggccgccgtctgcctctgcaccgcgctcaaggccaacgtgctcggcatcaacctcgacgtccccgtcaagctcaccttgctccttaactactgcggcaagagcgtccccgagggcttcgtctgcgcctaa

SEQ ID NO: 6926 - protein, 141 aa, Sorghum bicolor
  misc_feature: Ceres ANNOT ID no. 6068843
  misc_feature (59)..(140): Pfam Id: Tryp_alpha_amyl Pfam Desc: Protease inhibitor/seed storage/LTP family
  misc_feature (7)..(141): NCBI GI: 4240033 NCBI Desc: zmgr1a [zea mays]
  misc_feature (7)..(141): NCBI GI: 4240035 NCBI Desc: zmgr1b [zea mays]
  misc_feature (2)..(141): NCBI GI: 407410 NCBI Desc: 14 kda polypeptide [catharanthus roseus]
  misc_feature (2)..(141): NCBI GI: 4454097 NCBI Desc: hybrid proline-rich protein [catharanthus roseus]
  misc_feature (8)..(140): NCBI GI: 58578282 NCBI Desc: extensin-like protein [capsicum chinense]
  misc_feature: Useful for making plants with modulated oxidative stress sensitivity
  misc_feature: Functional homolog of the protein sequence given in SEQ ID NO 13086
  misc_feature: Useful for making plants with modulated biomass
  misc_feature: Useful for making plants with modulated flowering time
  misc_feature: Functional homolog of the protein sequence given in SEQ ID NO 13584
  misc_feature: Useful for making plants with modulated oxidative stress sensitivity
  misc_feature: Functional homolog of the protein sequence given in SEQ ID NO 13086
  misc_feature: Useful for making plants with modulated salt sensitivity
  misc_feature: Functional homolog of the protein sequence given in SEQ ID NO 13766
MMSFRPAAASLLVLMLVVVGSSEVAACGSCPTPPSSPPPPPPSSGGTPCPPPPSSSGKCPKNALKLGVCANVLGLVKVSIGKVPTDSCCPLLDGLADLEAAVCLCTALKANVLGINLDVPVKLTLLLNYCGKSVPEGFVCA

SEQ ID NO: 6927 - DNA, 528 bp, Sorghum bicolor
  misc_feature: Ceres ANNOT ID no. 6068851
  misc_feature: Encodes the peptide sequence at SEQ ID NO 6928
atggcgaagaaagtggccttggtggcctcgctgctggccctgaacctcctcttgttcggtttcgccgacgcatgtggctgcaggtgcggcggctcctgccctagtccaccaggcggtggtggcgggggaggtggaggcgggggaggcggaggatctggtggtggtgggagcggaggcggcggagggagcggtgggggcggcagtggtggaggagggagcggcggaggaggcggcggcggcggcggcggcggcggcgggacgcgcggtcgttgccctgtggacacgctgaagttgggcgtgtgcgccaacgtgctgaacgggctgatcaacgtgaacctggggacaccgccgaggacgccgtgctgcacgctgatccaggggctggcggaccttgaggcggcggtgtgtctctgcaccgcgctgcgagccaacatcctgggcatcaacctcaacctccccatcaacctcagcctcctcgtcaactactgcggcaggcgcgtcccctcgggattccagtgctcctcctga

SEQ ID NO: 6928 - protein, 175 aa, Sorghum bicolor
  misc_feature: Ceres ANNOT ID no. 6068851
  misc_feature (91)..(173): Pfam Id: Tryp_alpha_amyl Pfam Desc: Protease inhibitor/seed storage/LTP family
  misc_feature (1)..(91): Pfam Id: GRP Pfam Desc: Glycine rich protein family
  misc_feature (2)..(174): NCBI GI: 21693573 NCBI Desc: extensin-like protein [glycine max]
  misc_feature (1)..(173): NCBI GI: 1498157 NCBI Desc: nt16 polypeptide [nicotiana tabacum]
  misc_feature (30)..(173): NCBI GI: 1166450 NCBI Desc: tfm5 [lycopersicon esculentum]
  misc_feature (1)..(173): NCBI GI: 7959089 NCBI Desc: glycine-rich protein [nicotiana tabacum]
  misc_feature (1)..(165): NCBI GI: 2852377 NCBI Desc: hairy root 4 [nicotiana tabacum]
  misc_feature: Bushy plant with varying petiole angles, abnormal phyllotaxy, leafnumber higher than wild-type
  misc_feature: The plant flowers significantly late compared to wild-type.
  misc_feature: Useful for making plants with modulated biomass
  misc_feature: Useful for making plants with modulated flowering time
  misc_feature: Functional homolog of the protein sequence given in SEQ ID NO 13584
MAKKVALVASLLALNLLLFGFADACGCRCGGSCPSPPGGGGGGGGGGGGGGSGGGGSGGGGGSGGGGSGGGGSGGGGGGGGGGGGGTRGRCPVDTLKLGVCANVLNGLINVNLGTPPRTPCCTLIQGLADLEAAVCLCTALRANILGINLNLPINLSLLVNYCGRRVPSGFQCSS

SEQ ID NO: 6929 - DNA, 414 bp, Sorghum bicolor
  misc_feature: Ceres ANNOT ID no. 6068862
  misc_feature: Encodes the peptide sequence at SEQ ID NO 6930
atggcggcgtcgagaggagcggccgcggcgctggtggtgctgctcgccgcagtcaattgctttgcgctgcaagcgtcggcgcactacaccagctgccctccgccgccgcctccaccgccatgccctccggcggccccaagcagcggcggcggcgtggggtgccatcgggacgcgctcaagctaggcgtctgcgccaacgtgctgggcctcatcaaggccaaggtggggctgccgcctacggagccctgctgcccgctgttggacggcctcgtcgacctggaggccgccgtctgcctctgcactgccatcaaggccaacgtgctgggcatccacctcaacctccccatcgacctcgccctcgtcctcaaccactgcggcaagaccgcccccaaaggcttccactgcacccactaa

SEQ ID NO: 6930 - protein, 137 aa, Sorghum bicolor
  misc_feature: Ceres ANNOT ID no. 6068862
  misc_feature (54)..(135): Pfam Id: Tryp_alpha_amyl Pfam Desc: Protease inhibitor/seed storage/LTP family
  misc_feature (7)..(135): NCBI GI: 39748094 NCBI Desc: lipid transfer protein-like protein [oryza sativa (japonica cultivar-group)]
  misc_feature (1)..(135): NCBI GI: 124484377 NCBI Desc: extensin like protein [ipomoea nil]
  misc_feature (34)..(135): NCBI GI: 58578282 NCBI Desc: extensin-like protein [capsicum chinense]
  misc_feature (47)..(135): NCBI GI: 21693573 NCBI Desc: extensin-like protein [glycine max]
  misc_feature (9)..(135): NCBI GI: 4240033 NCBI Desc: zmgr1a [zea mays]
  misc_feature: Useful for making plants with modulated biomass
  misc_feature: Useful for making plants with modulated flowering time
  misc_feature: Functional homolog of the protein sequence given in SEQ ID NO 13584
  misc_feature: Useful for making plants with modulated oxidative stress sensitivity
  misc_feature: Functional homolog of the protein sequence given in SEQ ID NO 13086
  misc_feature: Useful for making plants with modulated salt sensitivity
  misc_feature: Functional homolog of the protein sequence given in SEQ ID NO 13766
MAASRGAAAALVVLLAAVNCFALQASAHYTSCPPPPPPPPCPPAAPSSGGGVGCHRDALKLGVCANVLGLIKAKVGLPPTEPCCPLLDGLVDLEAAVCLCTAIKANVLGIHLNLPIDLALVLNHCGKTAPKGFHCTH

SEQ ID NO: 6931 - DNA, 2349 bp, Sorghum bicolor
  misc_feature: Ceres ANNOT ID no. 6068878
  misc_feature: Encodes the peptide sequence at SEQ ID NO 6932
atgagtggtgctccaaagaggttgcacgaggagggtagccacaccacgccagcaaaacggcctttggatgacagcagcttgtattcgagtcctgggaaagttattcagtccagtggcagtgatttccatagttcttttgaacatgatggtagatttgcaaaaatccaacgtgtggagcctcgtgatgataagagaccatccctaacacatcggatgcctgttagctccaccaactttgctgaccaccccatctcgtctgacagcagattagaatcaaagcaaaataaagatgcaagggacactaaggcagatgatcatgagacaaaagctgatgctagggatgtctatagtgattcaaggattgaaattcaggctaataaaattcagggtgatgtaaaggtagacaagagagcagatcaaagcgaaataaaggctgacaggaggggccatcctgattacaaaggtgacatcaaatttgacaaggattgtcatcctactgttccaacaaacataggctggaaggacaacacagaacataggggtaaaagatattttgaacagccagctgataatgtggatggccatttgactttgccccgtcctagtttacaaggtactgatgaaactctcaaatttccaatttctgtggaagaacgtaaatccaaggatgcacatgaatctgctggtgacaacaaagctgaaccaagaagcgaagataaattcagagacaaggaccggaaaaggaaggatgagaagcatagggactttggtgcaagagaaggtgatagaaatgatcgtcggaccggtgtacagctcagtggtagtggtgttgagcgaagagaaatgcaaattagagatgctgacaaatgggacagggaaagaaaagattccctgagagacaaggaagacaatgatagggggaaggattctgctcggaaagattcatctgtagtaattgagaaggataacactacactggaaaaggcttcatctgatggagctgttaagagtgctgagcatgggaatacagcaacagaatccaaggcacctaagcatgatttatggaatgctcatgatagggatcctaaggacaagaaaagagagaaagatgtggaagcaggggacaggcatgaacaaagaagaatatataatgtcaaggaatcagatggtaatggcaccgaaggaggtatggagaaagataaagaagtttctggaagtttccaacgcaggagggtggtgcgaccaaggggaggtagtcaagcatctcagcgtgaacctcgatttcgatccagaatgcatgatggtgaaggtcttctcttcattgcaggtaagtctgaggtgtctgccattgtttacaaagctggggagtgcatgcaggagctgctgaaatcatggacagagttcagtgcaactcaggatgctacaaacgctgaaagtctacagaatggtcctgcccttgaaattcgaatacctgcggaatttgttacttccactaatcgtcaagtaaagggtgctcagctttggggaacagatatttatacaaatgattcagatcttgtggctgtgctaatgcatactggttactgctcccctacatcctcccctcccccatctgccatccaagagcttcgtgcaaccgttcgagttctaccaccacaagagagttatacttcaacattgaggaacaatgtgcgttcacgtgcttggggtgctgggattggttgtagctttcagatagaacgctgctgcattgttaagaaaggtggtggcaccattgacctcgagcctcgccttagccacacatcagctgtggaacctactcttgctccagttgtggttgagcgtacaatgacgacaagagctgcagcttccaatgctttgcgtcaacaaagatttgtccgtgaagtgactatacagtataatctctgcaatgagccatggttaaaatatagtataagcattgtggcagacaagggattgaaaaagtctctttatacttctgctagactgaagaaaggagaagtcatatatttagagacacacttcgatagtggagagaagcctcgtattgttgaagcagaagcggagaaacaccagagcggcagtcaccactcacaaaatggtgacagacgcgagcatgaattacgggatgtgttccgatggtcccgttgtaagaaggccatgcctgagagtgccatgcgctccatcggtatcccgctaccagcagaccagcttgaggtgttgcaggataacctagaatgggaggacgtgcagtggtcgcagaccagcgtctgggtggctgggaaggagcatcccctcgctcgagtgcacttcctctcggagaactag

SEQ ID NO: 6932 - protein, 782 aa, Sorghum bicolor
  misc_feature: Ceres ANNOT ID no. 6068878
  misc_feature (486)..(570): Pfam Id: Rxt3 Pfam Desc: Histone deacetylation protein Rxt3
  misc_feature (1)..(782): NCBI GI: 115472061 NCBI Desc: os07g0477500 [oryza sativa (japonica cultivar-group)]
  misc_feature (68)..(381): NCBI GI: 44980951 NCBI Desc: abr064wp [eremothecium gossypii]
  misc_feature (68)..(381): NCBI GI: 45185293 NCBI Desc: abr064wp [eremothecium gossypii]
  misc_feature (9)..(404): NCBI GI: 37575431 NCBI Desc: starmaker [danio rerio]
  misc_feature (9)..(404): NCBI GI: 125858062 NCBI Desc: stm protein [danio rerio]
MSGAPKRLHEEGSHTTPAKRPLDDSSLYSSPGKVIQSSGSDFHSSFEHDGRFAKIQRVEPRDDKRPSLTHRMPVSSTNFADHPISSDSRLESKQNKDARDTKADDHETKADARDVYSDSRIEIQANKIQGDVKVDKRADQSEIKADRRGHPDYKGDIKFDKDCHPTVPTNIGWKDNTEHRGKRYFEQPADNVDGHLTLPRPSLQGTDETLKFPISVEERKSKDAHESAGDNKAEPRSEDKFRDKDRKRKDEKHRDFGAREGDRNDRRTGVQLSGSGVERREMQIRDADKWDRERKDSLRDKEDNDRGKDSARKDSSVVIEKDNTTLEKASSDGAVKSAEHGNTATESKAPKHDLWNAHDRDPKDKKREKDVEAGDRHEQRRIYNVKESDGNGTEGGMEKDKEVSGSFQRRRVVRPRGGSQASQREPRFRSRMHDGEGLLFIAGKSEVSAIVYKAGECMQELLKSWTEFSATQDATNAESLQNGPALEIRIPAEFVTSTNRQVKGAQLWGTDIYTNDSDLVAVLMHTGYCSPTSSPPPSAIQELRATVRVLPPQESYTSTLRNNVRSRAWGAGIGCSFQIERCCIVKKGGGTIDLEPRLSHTSAVEPTLAPVVVERTMTTRAAASNALRQQRFVREVTIQYNLCNEPWLKYSISIVADKGLKKSLYTSARLKKGEVIYLETHFDSGEKPRIVEAEAEKHQSGSHHSQNGDRREHELRDVFRWSRCKKAMPESAMRSIGIPLPADQLEVLQDNLEWEDVQWSQTSVWVAGKEHPLARVHFLSEN

SEQ ID NO: 6933 - DNA, 753 bp, Sorghum bicolor
  misc_feature: Ceres ANNOT ID no. 6068881
  misc_feature: Encodes the peptide sequence at SEQ ID NO 6934
atggcggaggatgctacgagcagccacccgtcacgctacgtcaagctcaccaaggaccaggacgcccccaccgaggacatccgccccggcgagctcaaccagccagtccacgtcccgcagctcgaaggccggaggtgcagcgagtgcggccaggtcctgcccgagagctacgagccgcccgccgacgagccctggaccaccgggatcttcggatgcaccgatgaccctgagacctgccgaactgggttgttttgcccttgcgtgctgtttgggcgcaacgtcgaggctcttagggaggacatcccttggacaactccttgcgtgtgccatgctgtgtttgttgaaggagggatcacactggcgattctgacagcaatatttcatggtgttgatccaaggagttcattcctgattggagaaggtctggtgttcagttggtggttatgtgctacctatactggcatcttccgccaggaacttcagaggaaatatcatctcaagaactcaccgtgtgacccatgcatggtccactgctgcttgcactggtgtgccaactgccaggagcatcgcgagaggaggggacggctggcagagaacaatgccgtgcccatgactgttgtgaacccacctccaattcaagagatgagcatgtcagagaaccgtggtcctgctgccctggagaacggagcaggcaacgctgagcgtgaagcagagaagagtgagcacgatgatgtcgaggtcattcctctatag

SEQ ID NO: 6934 - protein, 250 aa, Sorghum bicolor
  misc_feature: Ceres ANNOT ID no. 6068881
  misc_feature (65)..(192): Pfam Id: PLAC8 Pfam Desc: PLAC8 family
  misc_feature (130)..(195): NCBI GI: 144924422 NCBI Desc: uncharacterized cys-rich domain [medicago truncatula]
  misc_feature (142)..(191): NCBI GI: 4105794 NCBI Desc: pgps/d12 [petunia x hybrida]
  misc_feature (149)..(195): NCBI GI: 115458794 NCBI Desc: os04g0461600 [oryza sativa (japonica cultivar-group)]
  misc_feature (65)..(90): NCBI GI: 123349225 NCBI Desc: uncharacterized cys-rich domain containing protein [trichomonas vaginalis g3]
  misc_feature (65)..(166): NCBI GI: 115435854 NCBI Desc: os01g0267400 [oryza sativa (japonica cultivar-group)]
MAEDATSSHPSRYVKLTKDQDAPTEDIRPGELNQPVHVPQLEGRRCSECGQVLPESYEPPADEPWTTGIFGCTDDPETCRTGLFCPCVLFGRNVEALREDIPWTTPCVCHAVFVEGGITLAILTAIFHGVDPRSSFLIGEGLVFSWWLCATYTGIFRQELQRKYHLKNSPCDPCMVHCCLHWCANCQEHRERRGRLAENNAVPMTVVNPPPIQEMSMSENRGPAALENGAGNAEREAEKSEHDDVEVIPL

SEQ ID NO: 6935 - DNA, 1617 bp, Sorghum bicolor
  misc_feature: Ceres ANNOT ID no. 6068889
  misc_feature: Encodes the peptide sequence at SEQ ID NO 6936
atggcgataggtggcttcgtggatgcccctgccgctgccgccggcgccgactacggtggccgcgtgacttccttcgtggtgctctcctgcatcgtggccggcagcggtggcatcctcttcggctatgacctcggcatctcaggtggggttacgtcgatggagtcgttcctgagaaagttcttcccggatgtgtaccaccagatgaaaggagacaaggacgtcagcaactactgccgcttcgacagcgagctcctcaccgtcttcacctcgtctctctacgtcgccggcctcgtcgccacgctcttcgcctcctccgtcaccaggaggttcggccgccgcacctccatactcatcggcggcactgtcttcgtcctcggctccgtcttcggcggggcagccgtcaacgtatacatgctcctcctcaacaggatcctccttggtataggcctcggcttcaccaaccagtcgattccactgtacctatcagagatggcgccaccgcagtaccgtggggcaatcaacaatggctttgagctctgcatcagcatcggcatcctcatcgcgaacctcatcaactacggcgtggagaagatcgccggtggatggggctggaggctgtctctgtccctggccgccgtgccggccgcgttcctgaccgtcggcgcgatcttcctgcccgagacgcccagcttcataatccaacgcggcggcgggggcggcgacatcgacgaggcaaggctgctgctgcagaggctgcgtggcacgaccagggtccagaaagagctcgacgatctggtgtccgcggctagcgaggcgtcgaggacgacggcaacccggcggccgttccggaacatactgaggagcaagtacaggccgcagctggtgatagcgctgctggttcccttcttcaaccaggtgacgggcatcaacgtcatcaacttctacgcgccggtcatgttccggaccatcgggctcaaggagagcgcgtcgctcatgtcggcggtggtgacgcgcgtctgcgcgacggccgccaacgtggtggccatggtggtggtggacaggttcgggcggcggaagctcttgctggtgggcggcgtccagatgatcctgtcgcaggtgatggtgggggcggtgctggcggccaagttcaaggaccacggagggatggacaaggagtacgcgtacctggtcctggtcatcatgtgcgtcttcgtcgcgggcttcgcctggtcctggggccctctcacgtacctggtgcccaccgagatctgcccgctggagatcaggtcggcggggcagagcatcgtcatcgccgtcatcttcttcgtgacgttcctcatcggccagaccttcctggcgatgctgtgccatctcaagttcgggaccttcttcctcttcggcggatgggtgtgcgtcatgacgctcttcgtgtatttcttcctgccggagacgaagcagctgcccatggagcagatggagcaggtctggaggacccactggttttggaaaaggattgcagatgcagatgcagatgcaggggaggaagaagagcaaggccaaaggagacccagacccagaggagaggcagcaggaaccatagctctgtccgccacatag

SEQ ID NO: 6936 - protein, 538 aa, Sorghum bicolor
  misc_feature: Ceres ANNOT ID no. 6068889
  misc_feature (29)..(496): Pfam Id: Sugar_tr Pfam Desc: Sugar (and other) transporter
  misc_feature (44)..(448): Pfam Id: MFS_1 Pfam Desc: Major Facilitator Superfamily
  misc_feature (15)..(510): NCBI GI: 467319 NCBI Desc: hexose carrier protein
  misc_feature (1)..(513): NCBI GI: 50953794 NCBI Desc: monosaccharide transport protein 1 [zea mays]
  misc_feature (15)..(517): NCBI GI: 33694268 NCBI Desc: monosaccharide transporter 6 [oryza sativa (japonica cultivar-group)]
  misc_feature (4)..(513): NCBI GI: 11991114 NCBI Desc: monosaccharide transporter 3 [oryza sativa]
  misc_feature (10)..(521): NCBI GI: 68271836 NCBI Desc: hexose transporter 1 [juglans regia]
  misc_feature: The sequence is a functional homolog of SEQ ID NO. 488 in the 11/188,298 US application
  misc_feature: The sequence is a functional homolog of SEQ ID NO. 449 in the 11/188,298 US application
  misc_feature: The sequence is a functional homolog of SEQ ID NO. 331 in the 11/188,298 US application
MAIGGFVDAPAAAAGADYGGRVTSFVVLSCIVAGSGGILFGYDLGISGGVTSMESFLRKFFPDVYHQMKGDKDVSNYCRFDSELLTVFTSSLYVAGLVATLFASSVTRRFGRRTSILIGGTVFVLGSVFGGAAVNVYMLLLNRILLGIGLGFTNQSIPLYLSEMAPPQYRGAINNGFELCISIGILIANLINYGVEKIAGGWGWRLSLSLAAVPAAFLTVGAIFLPETPSFIIQRGGGGGDIDEARLLLQRLRGTTRVQKELDDLVSAASEASRTTATRRPFRNILRSKYRPQLVIALLVPFFNQVTGINVINFYAPVMFRTIGLKESASLMSAVVTRVCATAANVVAMVVVDRFGRRKLLLVGGVQMILSQVMVGAVLAAKFKDHGGMDKEYAYLVLVIMCVFVAGFAWSWGPLTYLVPTEICPLEIRSAGQSIVIAVIFFVTFLIGQTFLAMLCHLKFGTFFLFGGWVCVMTLFVYFFLPETKQLPMEQMEQVWRTHWFWKRIADADADAGEEEEQGQRRPRPRGEAAGTIALSAT

SEQ ID NO: 6937 - DNA, 999 bp, Sorghum bicolor
  misc_feature: Ceres ANNOT ID no. 6068891
  misc_feature: Encodes the peptide sequence at SEQ ID NO 6938
atgcggagaacagccgccgctgccctcgttttcattcccctcctcgctgcggcggtgcagacctcctccctgcccttcatcgtcctgcacgggattggggaccagtgcgccaaccatggcgtcgccaagttcactaaacttctcgccggttggtccggctccgacggtcactgcctagagatcggcagaggaacatgggactcttgggtcatgcctcttcaacaacaggctgatatcatctgcaacaaggtcaaggaaatgaaacaactgagagacggctacaacatagttggtctgtctcagggaaacttgattggtcgagcagtagttgagtattgtgatgatggaccgccggtcaagaacttcatctctcttggaggtcctcatgctggtaccgcttctgtgccgctttgtggttctggtattttgtgcattcttgttgacgctctgatcaaattggagatctactcagactatgtgcaggaacatcttgcacctagtggctacctcaaaatcccaactgatatggcagattatctgaagagttgcaggtttcttccaaaacttaacaatgagattccagaaaaaagaaatgccacctacaaggaaaggtttagcagcttagagaatttggttctgatcatgtttcaggatgatgcagtcctgatacctcgagaaacagcatggttcggttactaccctgatggagcctttgatcctgttctaccacctcagaagacgaagctgtatgaggaagactggatcggtttgaagacactggataaagcagggcgggtgaagtttgtgtctgtggcgggaggtcacctcggcatctccaaaagtgacatgaagaagtacattgtgccttacctgacaagcaaagcatcggtgaagaccctcctccggtggagcctttctgatttgctaggtggcacttggcacgctgcgctggggctgatggagggtgatggtgctgtgcttgattcgccatcgtcgtga

SEQ ID NO: 6938 - protein, 332 aa, Sorghum bicolor
  misc_feature: Ceres ANNOT ID no. 6068891
  misc_feature (21)..(292): Pfam Id: Palm_thioest Pfam Desc: Palmitoyl protein thioesterase
  misc_feature (7)..(273): NCBI GI: 115483454 NCBI Desc: os10g0563000 [oryza sativa (japonica cultivar-group)]
  misc_feature (8)..(328): NCBI GI: 21593393 NCBI Desc: palmitoyl-protein thioesterase precursor-like [arabidopsis thaliana]
  misc_feature (1)..(302): NCBI GI: 8809616 NCBI Desc: palmitoyl-protein thioesterase precursor-like [arabidopsis thaliana]
  misc_feature (6)..(296): NCBI GI: 89257472 NCBI Desc: palmitoyl protein thioesterase family protein [brassica oleracea]
  misc_feature (1)..(291): NCBI GI: 89257655 NCBI Desc: palmitoyl protein thioesterase family protein [brassica oleracea]
MRRTAAAALVFIPLLAAAVQTSSLPFIVLHGIGDQCANHGVAKFTKLLAGWSGSDGHCLEIGRGTWDSWVMPLQQQADIICNKVKEMKQLRDGYNIVGLSQGNLIGRAVVEYCDDGPPVKNFISLGGPHAGTASVPLCGSGILCILVDALIKLEIYSDYVQEHLAPSGYLKIPTDMADYLKSCRFLPKLNNEIPEKRNATYKERFSSLENLVLIMFQDDAVLIPRETAWFGYYPDGAFDPVLPPQKTKLYEEDWIGLKTLDKAGRVKFVSVAGGHLGISKSDMKKYIVPYLTSKASVKTLLRWSLSDLLGGTWHAALGLMEGDGAVLDSPSS

SEQ ID NO: 6939 - DNA, 2928 bp, Sorghum bicolor
  misc_feature: Ceres ANNOT ID no. 6068893
  misc_feature: Encodes the peptide sequence at SEQ ID NO 6940
atggacgccaacgccaatgccctcggcatggacgccatcaccaacgaaaccgtcgacctggagcatatccctgtggaggaggtcttcgagcacctcaaatgcacccgcgacggcctcacctccgccgctgcccaggagaggatcgacgcctttggctacaacaagctggaagagaagcaggaaagcaaagtgctcaaattcctgggcttcatgtggaaccccctttcctgggtcatggaggcggcagccataatggctatcgcccttgctcatagcgggagagacttgagaggaaagaaaatgagcatagactaccatgactttgtcggaattatgttactgctcattatcaattccaccattagcttcatagaggaaaacaatgccggcaatgctgctgctgcgcttatggcccgcctcgcaccaaaatccaaggttttgcgtgatggaacctggagtgaaatggacgcgtctttgttggtgccaggtgacataatcagcattaaacttggagacatcattccagcagacgcgcgtcttctggagggagatcctctgaaaattgatcagtctgcacttacgggagaatcgctacctgtaaccaagcaacctggtgacgggatctactctggttcaacctgtaagcaaggtgaaatagaagcagttgttattgccactggaatacatactttctttggaaaagcagctcatctcgtcgagtcaactactcatgttggccactttcagaaggttctcacatcaatcggaaacttctgtatttgctcaattgctgctggaatgactattgagttaattgtgatgtacgctattcataaaaaaggataccgtcagattgttgataacctcctagtgctgcttattggaggaattccaattgccatgcccacggttctttctgtcactatggctattggagcacacaaactagcgcagcagggtgctattacaaagaggatgaccgccatagaagaaatggctggaatggatgtcctttgtagcgacaaaacaggaactctgacactcaacaaactaaatgttgacaagaatttaattgaggtttttgctagaggcatggagaaggatgacgttgtcttaatggccgcaagagcttctagactagagaatcaagatgctattgattttgctattgtttcgatgttgccagatccgaaagaggcacgtgccggcattcaagaacttcatttcctcccattcaatccaactgacaagagaacagcactcacatacttagacgctgggggtaaaatgcacagggttagcaaaggcgctcctgaacagatcctgaatctagcatcgaacaagtctgagattgaaaggaaggtccatcatgctattggcaattatgcagagagagggctacgatcgcttgctgttgcctatcaggtggaagtacctgaagggactaaggaaggtcctggtgggccttggcaatttattggtcttctcccactctttgatcctcctcgccatgacagtgctgaaactatacgcagagctcttgaccttggagtcagtgtaaaaatgattacaggtgatcagttggctatagctaaggagactggccggagactaggaatgggcacaaacatgtatccttcttcatcattgctgggtgacaaaaaaggcgacattgcagttctaccagtggatgagttgattgaacaagcggatgggtttgctggagttttcccagagcacaaatatgagattgtgcagaggttgcaagccagaaagcacatatgtgggatgactggagatggagttaatgatgcacctgctctgaagatagcagatattggtattgctgtggctgatgctactgatgctgctcgaggtgcttctgatatagttctgacggaacctggattgagtgtgatcatcagtgctgtactaaccagtcgggcaattttccaaagaatgaaaaattatactatatatgctgtgtctataaccatacgtattgtgcttggctttttgctcttggcatgcttttggaagtttgacttccctccgatgctggttcttgtgatagctattctgaacgatggaaccattatgactatatccaaagacaaggtgaggccatctccccatccagacagttggaagctagctgagatatttgcaactggagtgatcattggggcgtatttggctgtaaccacggtgctgttcttttgggcaatttacaatacggatttttttgtgagggttttccatgttagaagtctgaaaaggatggaacaaactggaaacaaccaggatctatatgccgacaacatggagaggttggcctctgcagtgtaccttcaagtgagcaccattagccaggcgttgatatttgtgacgaggtcgaggggctggtccttcatggagaggcctggcctgctgctgatgggggcattcgtgatagctcagctgatcgcttctgtgctggcggccatggtgagctgggagcttgcgggcatcaaaggcatcgggtgggggtggaccggcgtgatctggctgtacaacctcgtggtgtacctgctgctggacccgatcaagttcgcggtgcgatacgggctgagcggcaaggcctggaacctggtgatcgaccacaaggtggccttcacgaaccgcaaggactttgggaaggaggcccgggaggcggcgtgggcgcaccagcagcgtacgctgcatgggttggagagcgcgggggcccctgggtcgagccgggagaaagcggcgtcggtggagctggggcagatggcggaggacgcccggcggcgcgcggagatcaccaggctgcgggagctgcacaccctcaagggcaaggtggaatcggtagtgaagctcaaagggctggacctggaggacatcaacaaccagcactacacggtgtga

SEQ ID NO: 6940 - protein, 975 aa, Sorghum bicolor
  misc_feature: Ceres ANNOT ID no. 6068893
  misc_feature (110)..(331): Pfam Id: E1-E2_ATPase Pfam Desc: E1-E2 ATPase
  misc_feature (11)..(91): Pfam Id: Cation_ATPase_N Pfam Desc: Cation transporter/ATPase, N-terminus
  misc_feature (335)..(621): Pfam Id: Hydrolase Pfam Desc: haloacid dehalogenase-like hydrolase
  misc_feature (5)..(945): NCBI GI: 20302445 NCBI Desc: plasma membrane h+-atpase [oryza sativa (japonica cultivar-group)]
  misc_feature (8)..(975): NCBI GI: 7378769 NCBI Desc: h+-atpase [medicago truncatula]
  misc_feature (8)..(975): NCBI GI: 7378771 NCBI Desc: h+-atpase [medicago truncatula]
  misc_feature (10)..(975): NCBI GI: 6759599 NCBI Desc: plasma membrane h+ atpase [prunus persica]
  misc_feature (10)..(975): NCBI GI: 114332 NCBI Desc: plasma membrane atpase 1 (proton pump 1)
  misc_feature (10)..(975): SWISSPROT Homolog: EC 3.6.3.6 Plasma membrane ATPase 1
MDANANALGMDAITNETVDLEHIPVEEVFEHLKCTRDGLTSAAAQERIDAFGYNKLEEKQESKVLKFLGFMWNPLSWVMEAAAIMAIALAHSGRDLRGKKMSIDYHDFVGIMLLLIINSTISFIEENNAGNAAAALMARLAPKSKVLRDGTWSEMDASLLVPGDIISIKLGDIIPADARLLEGDPLKIDQSALTGESLPVTKQPGDGIYSGSTCKQGEIEAVVIATGIHTFFGKAAHLVESTTHVGHFQKVLTSIGNFCICSIAAGMTIELIVMYAIHKKGYRQIVDNLLVLLIGGIPIAMPTVLSVTMAIGAHKLAQQGAITKRMTAIEEMAGMDVLCSDKTGTLTLNKLNVDKNLIEVFARGMEKDDVVLMAARASRLENQDAIDFAIVSMLPDPKEARAGIQELHFLPFNPTDKRTALTYLDAGGKMHRVSKGAPEQILNLASNKSEIERKVHHAIGNYAERGLRSLAVAYQVEVPEGTKEGPGGPWQFIGLLPLFDPPRHDSAETIRRALDLGVSVKMITGDQLAIAKETGRRLGMGTNMYPSSSLLGDKKGDIAVLPVDELIEQADGFAGVFPEHKYEIVQRLQARKHICGMTGDGVNDAPALKIADIGIAVADATDAARGASDIVLTEPGLSVIISAVLTSRAIFQRMKNYTIYAVSITIRIVLGFLLLACFWKFDFPPMLVLVIAILNDGTIMTISKDKVRPSPHPDSWKLAEIFATGVIIGAYLAVTTVLFFWAIYNTDFFVRVFHVRSLKRMEQTGNNQDLYADNMERLASAVYLQVSTISQALIFVTRSRGWSFMERPGLLLMGAFVIAQLIASVLAAMVSWELAGIKGIGWGWTGVIWLYNLVVYLLLDPIKFAVRYGLSGKAWNLVIDHKVAFTNRKDFGKEAREAAWAHQQRTLHGLESAGAPGSSREKAASVELGQMAEDARRRAEITRLRELHTLKGKVESVVKLKGLDLEDINNQHYTV

SEQ ID NO: 6941 - DNA, 2979 bp, Sorghum bicolor
  misc_feature: Ceres ANNOT ID no. 6068914
  misc_feature: Encodes the peptide sequence at SEQ ID NO 6942
atgcttgctttcgaggagcaggtggtggcggacctggtggaggatccgaacggaggtctggtggtgctctcctcgggcctccctctggcctccctcgccgctaccctcctcctctatctccaccaggcccccggcgacgcggcggggggaggatgtctcctcgtcctctccgcccccgattccctcaaggcccggatccgccgccgcctccaagaaaagatgcaggttcacgacgtgcctcctgacctccaagcgcagcagcgcgcctccctctacgcctcgggcgctgctctcttcctctccccccgcgccctcgccgccgacctcctcacctcccgcctcctcccctcccgcgtccgggccctactcctcctctccgcccaccgctccaccgatacctcctccgacgccttcatcgcccgcctcctccgccagcgcaatcttgtccccgtctacgccttctccgactgccctcatgccatggtcgccggtttctccaaggccgagcgcaccatgaagagcctctacgtccgccgcctccacctctggccccgcttccacgttctcgccgcggccgacctggaacgcgccccgcctgacgtcgtagacgttcgcgtgcccatgacgccgcccatgagggggatccaggctgccgtcctcgctaccatggacgcttgcctcaaggagcttaggcgcaccaacaaggtggatgtcgaggacctcaccgtcgacaagggcctcttcaagtctttcgatgagatcgtccggaggcagctcgaccccatctggcatactcttgggaagaagacaaagcagcttgtggctgacctcaggacgctacgcaaactgcttgattacctcgtcaggtacgatgctgttacatacttgaagtaccttgacacattgagagtgtcagaaggtgtgcgatcagtttggatacttgctgactcaagccataagatatttgagcttgcaaaaaggcgcgtttaccaggcagtgagaacagatggtgctaaggttagcatggataataagggcacaccaacaaagaagaggaaagtggcacataatactaccaagaaaggaaaagaaaccgaaaatgaagactccacagtaggtagggacaacactcagaaggttaatactgatgtgggcattgtattggaagaggttctggaggaggcaccgaaatggaaagtgttatgggaattgttgcaagagatagcagaagaacagatgaagagcgatgccgggaatgtgcatgatgaagacaaaagtgatgaacatggcatagttttggtaacatgtaaagatgagcgcacgtgcttgcagctgcaggaatgcatattaaaaggcccctgtcaggttatgcgagaagagtgggagaagtatttgattgggaaagctgagctgcatggattgaataagaagaacaagagaaaatctgagcaaccaaaaggggttggtgttctggatggtgaagttcaaatgggatctagtgagagtgtgggtccggttagcattagcaaactcgaaactaatgccttatttgctgctgcctgtgaattaagaaatatatcaaatgaagcagatgtcaatggtggctcaaatagcagctgcagcacgaaggggctagcaaggggaaaagcaaaagggaaaccaaagaaaaccactgcaaagagacaagccagcaatcgaaaaaataaaagtaaggggggaaatgacattaggcaagctaccgatctggattctgaagttcaatcaggcaaaacagatgaacaggctgagattgatgcttctaaggtgtccgcatatgatgcttccgtgtcagcctctacttctaatgataaatttaaccattcatctgctctcagaaactcggcaaacggcaagccactacctcctgtgcagtttcatgctctagacagtgaccagcacgtgcttgatgtatggaagccatctgttattattgtttatcatccagatattacctttgtaagagaaattgaagtatacaaggcagaaaactcatcaaagaagttaaaagtttacttccttttttatgaagattccactgaggtgcaaaaatttgagtccagcattcgacgggaaaatgaagcatttgaatctttgatcagacagaagtccctgatgatgatacctgttgatcaggatggccattgcattggaccaactgttgcaaatgaaccagaacctcttttatgtcagaactcaatcacaagaaaggcaggtggtaaaaaggcacctgagaaggagatgcaggttattgtagacatgagagagttcatgagcagccttccgaatgtattacatcagaaaggtatccgaatagtaccggtcacccttgaagttggtgactatgttctctctccttcgatctgtgttgagcggaaaagtatcgcagacttgttccaaagctttgcttctggtcgtctgtacaatcaggttgagacaatggcacgttactacaagatcccggttctcctcatcgagttctcacaagataagagcttttcctttcagtctgcaaatgagatcggggatgacgtctctccgaccaacattatctcaaagctttcgctgctagtgcttcattttcctcggcttcgcataatctggtcacgcagcttgcatgctacagcagaaatatttatgtcactgaaaacaaaccaggatgaacctgatgagaaaaaggcaacaagagttggcgtgccctctgaggatggaatcgtggaggatgatgtgaggtctgaaaattacaacacaccagccattgagttcttaagaaggcttcctggggtgacggattccaactaccgagcaatcatggatggatgcaatagcttggccgacctggccctgcttccggtggaaaggttgggggagctaatgggcggtcagaaggctgcacggacgctcaaggagtttctggatgccaagtgcccaaccatgctgtag

SEQ ID NO: 6942 - protein, 992 aa, Sorghum bicolor
  misc_feature: Ceres ANNOT ID no. 6068914
  misc_feature (761)..(841): Pfam Id: ERCC4 Pfam Desc: ERCC4 domain
  misc_feature (1)..(992): NCBI GI: 140058339 NCBI Desc: ercc4; ruva domain 2-like [medicago truncatula]
  misc_feature (538)..(992): NCBI GI: 22655254 NCBI Desc: repair endonuclease [arabidopsis thaliana]
  misc_feature (538)..(992): NCBI GI: 8926611 NCBI Desc: 5' repair endonuclease [arabidopsis thaliana]
  misc_feature (536)..(984): NCBI GI: 49903420 NCBI Desc: ercc4-prov protein [xenopus laevis]
  misc_feature (531)..(984): NCBI GI: 7657064 NCBI Desc: excision repair cross-complementing rodent repair deficiency, complementation group 4 [mus musculus]
MLAFEEQVVADLVEDPNGGLVVLSSGLPLASLAATLLLYLHQAPGDAAGGGCLLVLSAPDSLKARIRRRLQEKMQVHDVPPDLQAQQRASLYASGAALFLSPRALAADLLTSRLLPSRVRALLLLSAHRSTDTSSDAFIARLLRQRNLVPVYAFSDCPHAMVAGFSKAERTMKSLYVRRLHLWPRFHVLAAADLERAPPDVVDVRVPMTPPMRGIQAAVLATMDACLKELRRTNKVDVEDLTVDKGLFKSFDEIVRRQLDPIWHTLGKKTKQLVADLRTLRKLLDYLVRYDAVTYLKYLDTLRVSEGVRSVWILADSSHKIFELAKRRVYQAVRTDGAKVSMDNKGTPTKKRKVAHNTTKKGKETENEDSTVGRDNTQKVNTDVGIVLEEVLEEAPKWKVLWELLQEIAEEQMKSDAGNVHDEDKSDEHGIVLVTCKDERTCLQLQECILKGPCQVMREEWEKYLIGKAELHGLNKKNKRKSEQPKGVGVLDGEVQMGSSESVGPVSISKLETNALFAAACELRNISNEADVNGGSNSSCSTKGLARGKAKGKPKKTTAKRQASNRKNKSKGGNDIRQATDLDSEVQSGKTDEQAEIDASKVSAYDASVSASTSNDKFNHSSALRNSANGKPLPPVQFHALDSDQHVLDVWKPSVIIVYHPDITFVREIEVYKAENSSKKLKVYFLFYEDSTEVQKFESSIRRENEAFESLIRQKSLMMIPVDQDGHCIGPTVANEPEPLLCQNSITRKAGGKKAPEKEMQVIVDMREFMSSLPNVLHQKGIRIVPVTLEVGDYVLSPSICVERKSIADLFQSFASGRLYNQVETMARYYKIPVLLIEFSQDKSFSFQSANEIGDDVSPTNIISKLSLLVLHFPRLRIIWSRSLHATAEIFMSLKTNQDEPDEKKATRVGVPSEDGIVEDDVRSENYNTPAIEFLRRLPGVTDSNYRAIMDGCNSLADLALLPVERLGELMGGQKAARTLKEFLDAKCPTML

SEQ ID NO: 6943 - DNA, 909 bp, Sorghum bicolor
  misc_feature: Ceres ANNOT ID no. 6068943
  misc_feature: Encodes the peptide sequence at SEQ ID NO 6944
atggcccagaagaccatcgctgagttctcgtccccgtcagctgactttgtcgctaccatcccgaacctgaacttaggcgatgcgacctttgagctcaagcctacactgatcaacatggtgtgcaacactttcaccatcaagaacgtcacggcggacgccatccgccttcgccttttcccattatcactcttggggaagacaaagcagtggttctacgccaacaagagcgaagtgacaacttgggccaagtgtgccaatgctttccacaagaagttcttcccagcgggcaagaccagtgccctgcgtggtaagatttcgagcttccaacaacagtctgacaagacgattcgtgaagcatgtgtcaacacatgggaacgtctcaatgagtacattcacgcctatcctcatcatgggatagacgaatggctcattattcaaggtttgtaccatgggctgaccggcatggcccgtagtcaacttgatgcctcagctagaggggcattcttgcaaaaaaatgtcaaggatgccaaggacctcattgaaaagatggtcatcaaccaaggatggaatgaggagcgcctccagccgaagaagagaggtgtccacaccctcaatgaggtatgcggaggagatgatcactcgggcaataactgccccgagacccatgagaaggtgaactacatcaacaacaacttcaacaacgggaacaagccccaacaacaacaatggagttcacgccccttctaccaaggccaagatcttgtgctacgccaaactaaaattaatgatagtatcaataagagaattgagcctaatgacaagatcctagaaagcctttgtgagaaaatggacagctttaattctgccattaagaatcaattgaactttaataaaatgttagaaacatag

SEQ ID NO: 6944 - protein, 302 aa, Sorghum bicolor
  misc_feature: Ceres ANNOT ID no. 6068943
  misc_feature (57)..(154): Pfam Id: Retrotrans_gag Pfam Desc: Retrotransposon gag protein
  misc_feature (27)..(251): NCBI GI: 58532094 NCBI Desc: osjnba0085c10.7 [oryza sativa (japonica cultivar-group)]
  misc_feature (40)..(206): NCBI GI: 38347309 NCBI Desc: osjnba0042f21.11 [oryza sativa (japonica cultivar-group)]
  misc_feature (27)..(206): NCBI GI: 38605824 NCBI Desc: osjnba0011k22.15 [oryza sativa (japonica cultivar-group)]
  misc_feature (1)..(207): NCBI GI: 21742520 NCBI Desc: osjnbb0069n01.18 [oryza sativa (japonica cultivar-group)]
  misc_feature (1)..(146): NCBI GI: 38605787 NCBI Desc: osjnbb0045p24.1 [oryza sativa (japonica cultivar-group)]
MAQKTIAEFSSPSADFVATIPNLNLGDATFELKPTLINMVCNTFTIKNVTADAIRLRLFPLSLLGKTKQWFYANKSEVTTWAKCANAFHKKFFPAGKTSALRGKISSFQQQSDKTIREACVNTWERLNEYIHAYPHHGIDEWLIIQGLYHGLTGMARSQLDASARGAFLQKNVKDAKDLIEKMVINQGWNEERLQPKKRGVHTLNEVCGGDDHSGNNCPETHEKVNYINNNFNNGNKPQQQQWSSRPFYQGQDLVLRQTKINDSINKRIEPNDKILESLCEKMDSFNSAIKNQLNFNKMLET

SEQ ID NO: 6945 - DNA, 1146 bp, Sorghum bicolor
  misc_feature: Ceres ANNOT ID no. 6068976
  misc_feature: Encodes the peptide sequence at SEQ ID NO 6946
atggcgtcgtcatcgagggcgacgtcgtcgcgccgttccgtcttcgacgccgcctacatccgctcggagttttctgcggctggcatctccggccacttcatccctctcatctggaagtacgtacttcagaaccctaggtgcagcgacctggatggcgtcccgtcgctgccggcggccgcgtacgcgctcctccggcagaagttccggccgaccacgtcgacgctaaccgctgccgcggactccaaggaccgcaccacgaccaagctcctcatctccctgcagaatggagagtctgtagaggcagtggtcatgcgatatgacacacgactggggaagtatgatggaaagcctcggcctggtggactgcgctcaaccctttgtgtgtcatcacaggttgggtgcaagatgggctgtagattctgtgctactggaacaatgggcttcaaaagcaatctgtcttctggagaaattatagagcagctggtccatgcatcccgctattctcagatccgaaatgttgttttcatgggaatgggggagccgatgaacaactataatgctttggttgaagcaatcggagtgtttacaggatctcctttccagctttcacctaagagaattactgtatctactgtcggaatcattcatggaatcaacaagttcaatgcagatcttccaaaggtgaatttagctgtgtcattgcatgctcctgaccaagatatacgctgtcagataatgcctgctgcacgtgcctttcctttagtaaagttaatgaacgcgctgcagtcctatcaaaatgagagcaaacagaccatctttattgagtacattatgcttgatggagttaacgatcaggaggagcatgctcatcagcttggtaaactgcttgaaacgttcaaagcggttgtcaatctaataccattcaatccaattgggtcattaagcaatttcaagacaagcagtgaccaaaatgtgaagaagttccaaaaggttctaaaaggcatctaccacatcagaaccactgttcgccagcagatgggtcaagacatagctggtgcttgtggccagttggtggttagcctcccagatgaaagatcagctggtggagcaaccctgttgtcagacatcgaagaccttcggatctga

SEQ ID NO: 6946 - protein, 381 aa, Sorghum bicolor
  misc_feature: Ceres ANNOT ID no. 6068976
  misc_feature (128)..(293): Pfam Id: Radical_SAM Pfam Desc: Radical SAM superfamily
  misc_feature (123)..(264): NCBI GI: 46226740 NCBI Desc: conserved protein with transmembrane region at c-terminus [cryptosporidium parvum]
  misc_feature (80)..(358): NCBI GI: 116751471 NCBI Desc: radical sam domain protein [syntrophobacter fumaroxidans mpob]
  misc_feature (49)..(367): NCBI GI: 121998570 NCBI Desc: radical sam enzyme, cfr family [halorhodospira halophila sl1]
  misc_feature (37)..(366): NCBI GI: 108760323 NCBI Desc: radical sam enzyme, cfr family [myxococcus xanthus dk 1622]
  misc_feature (123)..(364): NCBI GI: 118602407 NCBI Desc: radical sam enzyme, cfr family [candidatus ruthia magnifica str. cm (calyptogena magnifica)]
MASSSRATSSRRSVFDAAYIRSEFSAAGISGHFIPLIWKYVLQNPRCSDLDGVPSLPAAAYALLRQKFRPTTSTLTAAADSKDRTTTKLLISLQNGESVEAVVMRYDTRLGKYDGKPRPGGLRSTLCVSSQVGCKMGCRFCATGTMGFKSNLSSGEIIEQLVHASRYSQIRNVVFMGMGEPMNNYNALVEAIGVFTGSPFQLSPKRITVSTVGIIHGINKFNADLPKVNLAVSLHAPDQDIRCQIMPAARAFPLVKLMNALQSYQNESKQTIFIEYIMLDGVNDQEEHAHQLGKLLETFKAVVNLIPFNPIGSLSNFKTSSDQNVKKFQKVLKGIYHIRTTVRQQMGQDIAGACGQLVVSLPDERSAGGATLLSDIEDLRI

SEQ ID NO: 6947 - DNA, 471 bp, Sorghum bicolor
  misc_feature: Ceres ANNOT ID no. 6070912
  misc_feature: Encodes the peptide sequence at SEQ ID NO 6948
atggactatacgaatttgcggcgccagatcatctccatgaagaaaagcctcttcgatcagggatacctggatgagcagtttaatcagctggaagagctgcaggatgattcaagccccaattttgttgaggaagttgtggctttgttcttcaaggattcatcaagactgctgacgaacatagagcaagcactcattggcgcactgaggatgaagaatgagtgctccatgtttaaggcccactgcaacgacaggaatctggaagggtaccgtacacttgacgactcttcctcctctatacctgcatctcattctttgcttctgcatctcattccatggctcacactcagatgccgccggtcactccagaagatgaagagggagcatgccactctgaagcagaagctggagacatattttcatttgctgaggcaagtcggtcctccagaacgcgcggtgaattcatggaagtaa

SEQ ID NO: 6948 - protein, 156 aa, Sorghum bicolor
  misc_feature: Ceres ANNOT ID no. 6070912
  misc_feature (17)..(147): NCBI GI: 115439883 NCBI Desc: os01g0743800 [oryza sativa (japonica cultivar-group)]
  misc_feature (6)..(139): NCBI GI: 9279718 NCBI Desc: histidine-containing phosphotransfer protein-like [arabidopsis thaliana]
  misc_feature (6)..(64): NCBI GI: 9280641 NCBI Desc: f21b7.5 [arabidopsis thaliana]
  misc_feature (21)..(64): NCBI GI: 115462463 NCBI Desc: os05g0186100 [oryza sativa (japonica cultivar-group)]
  misc_feature (9)..(64): NCBI GI: 6009622 NCBI Desc: histidine-containing phosphotransfer protein [zea mays]
  misc_feature: The sequence is a functional homolog of SEQ ID NO. 465 in the 11/188,298 US application
MDYTNLRRQIISMKKSLFDQGYLDEQFNQLEELQDDSSPNFVEEVVALFFKDSSRLLTNIEQALIGALRMKNECSMFKAHCNDRNLEGYRTLDDSSSSIPASHSLLLHLIPWLTLRCRRSLQKMKREHATLKQKLETYFHLLRQVGPPERAVNSWK

SEQ ID NO: 6949 - DNA, 1380 bp, Sorghum bicolor
  misc_feature: Ceres ANNOT ID no. 6070929
  misc_feature: Encodes the peptide sequence at SEQ ID NO 6950
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
atggtggcggcggcggcggagcgggtggtggcggagctccgcgaggcgtgcgcggcgccggcggcgcggctgaacgaggtggcggcggccatggaggcggagatgcgcgcggggctgcgcgaggagggcggcagcaagatcaagatgatcatctcctacgtcgacaatctccccaccgggaacgaagagggtgtcttctatgccttggatctgggcggaacaaacttccgcgtcctgcgcgtgcacctggcggggaaagacaagcgtgtcgccaagcgagagtccaaggaggtgtccatccctcctcacctcatgtcaggcaacgcttcggagctgttcggttttatcgcttcggcgttagccaagtacatcgcgagtgaagaagggcacagcaatgtgtttgatgatgacaagcagagagagcttgggttcacattctctttccctgtccgacaaacttcgattgcatcaggcacgctcatcaagtggaccaaggcattctcgatcgatgacgctgtaggtgaggatgttgtcgctgagctgcagacggccatggagaagcaaggcgtcgacatgcgtgtagctgcactgatcaatgataccgttgggacactggccgcgggtcggtacaatgatgaggatgtagtcattggtgtgatattaggtactggctcaaatgccgcgtacgttgaagaggcaagcgccataccgaagttggagggcgagttacccaaatcagggaacatggtgataaacacagaatggggtaacttcgactcgtcctgcctcccaatcacagaatatgatgaagccttagatgaggaaagcttaaacccaggggaacagatcttcgagaagttgatttcgggaatgtatcttggcgaaattgtaaggagggtgctgcttaaaatcgcatcacagtcttcaatcttcggcaatgtcagccacactttgctcaaaactcgcttcattctgaggactccggatatctctgcaatgcaccatgacgatacgcctgacctgagaatcgtggctcagaaactggccgacaacctcaagatcatggacacatccttggatacaaggaagatggtcgtcgagatctgtgacatcgtcaccagcaggtctgcccggctggccgcggcagggatcgttgggatcctcaggaagatagggagagcagtgcccggcgacgagcgccggtccgtcgtcgccatcgacggcggcctgtttgagcactacgccgagttcaggaagtgcctggagagcacgctggtggagctgctcggggaggaggcgtcgaagtcgttggtggtgaagctcaccaaggacgggtctggcctcggagccgccctgatcgcagctgctcagtcccagtaa

SEQ ID NO: 6950 - protein, 459 aa, Sorghum bicolor
  misc_feature: Ceres ANNOT ID no. 6070929
  misc_feature (214)..(459): Pfam Id: Hexokinase_2 Pfam Desc: Hexokinase
  misc_feature (4)..(212): Pfam Id: Hexokinase_1 Pfam Desc: Hexokinase
  misc_feature (4)..(459): NCBI GI: 110808554 NCBI Desc: hexokinase-7 (hexokinase-6)
  misc_feature (4)..(459): NCBI GI: 62130764 NCBI Desc: hexokinase 6 [oryza sativa (japonica cultivar-group)]
  misc_feature (4)..(459): NCBI GI: 73918015 NCBI Desc: hexokinase 7 [oryza sativa (japonica cultivar-group)]
  misc_feature (1)..(459): NCBI GI: 110808555 NCBI Desc: hexokinase-8 (hexokinase-4)
  misc_feature (1)..(459): NCBI GI: 115435012 NCBI Desc: os01g0190400 [oryza sativa (japonica cultivar-group)]
  misc_feature (4)..(459): SWISSPROT Homolog: EC 2.7.1.1 Hexokinase-7
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
  misc_feature: The sequence is a functional homolog of SEQ ID NO. 321 in the 11/188,298 US application
MVAAAAERVVAELREACAAPAARLNEVAAAMEAEMRAGLREEGGSKIKMIISYVDNLPTGNEEGVFYALDLGGTNFRVLRVHLAGKDKRVAKRESKEVSIPPHLMSGNASELFGFIASALAKYIASEEGHSNVFDDDKQRELGFTFSFPVRQTSIASGTLIKWTKAFSIDDAVGEDVVAELQTAMEKQGVDMRVAALINDTVGTLAAGRYNDEDVVIGVILGTGSNAAYVEEASAIPKLEGELPKSGNMVINTEWGNFDSSCLPITEYDEALDEESLNPGEQIFEKLISGMYLGEIVRRVLLKIASQSSIFGNVSHTLLKTRFILRTPDISAMHHDDTPDLRIVAQKLADNLKIMDTSLDTRKMVVEICDIVTSRSARLAAAGIVGILRKIGRAVPGDERRSVVAIDGGLFEHYAEFRKCLESTLVELLGEEASKSLVVKLTKDGSGLGAALIAAAQSQ

SEQ ID NO: 6951 - DNA, 762 bp, Sorghum bicolor
  misc_feature: Ceres ANNOT ID no. 6070943
  misc_feature: Encodes the peptide sequence at SEQ ID NO 6952
atggcgagagaattgaaggaagatgaacagtacattgcttattttgctatgtatctagaaaagccaaggtactacaaatcacttccacctataagcaaggcatatgggacattgtgtttccttaccaccgtgctagttcggctccatatcgtggatgggggttttcttgtattatattacccttgggtgtttaagaagtttcaggtatggaggctatttacaagtttcatctttctgggaccattttccataaacttcggtattcgccttctgatgatagcaaggtatggtgtcatgctggaaaagggagcatttgatagacgcactgcagatttcttgtggatgatgatatttggtgccatctcactattggtggtgtctgttattcccctattaaatacttatacattgggagtacctatggtcaacatgcttgtttatgtctggagccgagagaatccgaatgctcagataaatatatatggtcttgtccaattgagggcattttatcttccatgggttatgctcttattggatgtgatatttgggtcaccattaatgggtggccttctgggtatcatggttggacatctatactacttctttgcagtgttgcaccctcttgccaccggaaagaactacctcaagactccgaaatgggtaataggggtgcaagccaacgctcctgtcaggccgcaagctaacggcaacaccgggactggtgccttcagaggaagaagctatagactcaatcaagattga

SEQ ID NO: 6952 - protein, 253 aa, Sorghum bicolor
  misc_feature: Ceres ANNOT ID no. 6070943
  misc_feature (28)..(219): Pfam Id: DER1 Pfam Desc: Der1-like family
  misc_feature (24)..(252): NCBI GI: 64501080 NCBI Desc: derlin1-2 [zea mays]
  misc_feature (24)..(252): NCBI GI: 64500907 NCBI Desc: derlin1-1 [zea mays]
  misc_feature (24)..(252): NCBI GI: 114152801 NCBI Desc: derlin-1 (der1-like protein 1) (osderlin 1-1) (18 kda cold-induced protein)
  misc_feature (24)..(156): NCBI GI: 64501045 NCBI Desc: derlin1-1 [zea mays]
  misc_feature (25)..(229): NCBI GI: 109451872 NCBI Desc: derl3 [synthetic construct]
MARELKEDEQYIAYFAMYLEKPRYYKSLPPISKAYGTLCFLTTVLVRLHIVDGGFLVLYYPWVFKKFQVWRLFTSFIFLGPFSINFGIRLLMIARYGVMLEKGAFDRRTADFLWMMIFGAISLLVVSVIPLLNTYTLGVPMVNMLVYVWSRENPNAQINIYGLVQLRAFYLPWVMLLLDVIFGSPLMGGLLGIMVGHLYYFFAVLHPLATGKNYLKTPKWVIGVQANAPVRPQANGNTGTGAFRGRSYRLNQD

SEQ ID NO: 6953 - DNA, 783 bp, Sorghum bicolor
  misc_feature: Ceres ANNOT ID no. 6070960
  misc_feature: Encodes the peptide sequence at SEQ ID NO 6954
atggcgctccagctcctccgccatgcgctggtgtcgctgctggtggtggccgttcacgcggccggcgcgacgcgcgcgggcggcgacatgcaccacctgcagatggtgacctccaccgccggcacggcgcgcgcggtggcgtcgtgcgcgagctggcggctcggtgtggagaccaacaacatccgggactggtacagcatccccgccgagtgccggagctacgtccgcgactacatgtacggcgacctgttcaggcaggactgcgcggtggtggcaggcgaggccgccgcctacgccgaggggctcgagctcgccggcgacggggaagaggtgtgggtgttcgacgtcgacgacaccaccctcaccaacctcccctactacgccgacaccggcttcggggctgagccgtacaacgccacctacttcgacgagtacgtggcgaacgcgacggcgccggcgctgccggaggtgctggagctgtacgagaagctgctgtcgctgggcatcaaggtggtgttcatcaccggcaggcacgacgacgaggaggcggccaccgtcaagaacctccgcagcgccggctaccacacctgggagaagcttgtgctcaagccgtcgtccctgggctcgtcggtggtgccgtacaagtccggcgagcggcagaagctggtggacgccgggtaccgcatcgtgggcaacatgggcgaccagtggagcgacctcaccggcgcgccggagggcgaccgcaccttcaaggtgcccgaccccatgtactacgttggctga

SEQ ID NO: 6954 - protein, 260 aa, Sorghum bicolor
  misc_feature: Ceres ANNOT ID no. 6070960
  misc_feature (35)..(260): Pfam Id: Acid_phosphat_B Pfam Desc: HAD superfamily, subfamily IIIB (Acid phosphatase)
  misc_feature (11)..(259): NCBI GI: 3341443 NCBI Desc: acid phosphatase [glycine max]
  misc_feature (81)..(260): NCBI GI: 115462503 NCBI Desc: os05g0192100 [oryza sativa (japonica cultivar-group)]
  misc_feature (49)..(259): NCBI GI: 28375516 NCBI Desc: acid phosphatase [lycopersicon esculentum]
  misc_feature (30)..(260): NCBI GI: 92877929 NCBI Desc: plant acid phosphatase [medicago truncatula]
  misc_feature (49)..(259): NCBI GI: 445113 NCBI Desc: acid phosphatase 1
MALQLLRHALVSLLVVAVHAAGATRAGGDMHHLQMVTSTAGTARAVASCASWRLGVETNNIRDWYSIPAECRSYVRDYMYGDLFRQDCAVVAGEAAAYAEGLELAGDGEEVWVFDVDDTTLTNLPYYADTGFGAEPYNATYFDEYVANATAPALPEVLELYEKLLSLGIKVVFITGRHDDEEAATVKNLRSAGYHTWEKLVLKPSSLGSSVVPYKSGERQKLVDAGYRIVGNMGDQWSDLTGAPEGDRTFKVPDPMYYVG

SEQ ID NO: 6955 - DNA, 435 bp, Sorghum bicolor
  misc_feature: Ceres ANNOT ID no. 6070966
  misc_feature: Encodes the peptide sequence at SEQ ID NO 6956
atgcctgacggggacgttgatgagattatgccagatcagagcaggaccaccactaagccgtacaacgcaacgagcttcaacgagtacgtgctggaggggagcgcgccggtgctgccggagtcgcagcggctcttcaagaagctcatctcgctcggcatcaagccggtgttcctgacggggcgcaccgaggaccagagggccatcaccgtcaccaacctccgccgccagggctactccggctggatggacctgctgctcaagcccgtcgggctcaaggccaccgccatcgcctacaagtccggcgagcggcagaagctgcaggacgccgggtacgtcatcgtcggcaacatcggcgaccagtggagcgacatcctgggcgcgccggagggtgctcgcaccttcaagctgcctgaccccctctactacattggctaa

SEQ ID NO: 6956 - protein, 144 aa, Sorghum bicolor
  misc_feature: Ceres ANNOT ID no. 6070966
  misc_feature (1)..(144): Pfam Id: Acid_phosphat_B Pfam Desc: HAD superfamily, subfamily IIIB (Acid phosphatase)
  misc_feature (21)..(144): NCBI GI: 115462503 NCBI Desc: os05g0192100 [oryza sativa (japonica cultivar-group)]
  misc_feature (15)..(140): NCBI GI: 115462491 NCBI Desc: os05g0188900 [oryza sativa (japonica cultivar-group)]
  misc_feature (21)..(143): NCBI GI: 3341443 NCBI Desc: acid phosphatase [glycine max]
  misc_feature (21)..(143): NCBI GI: 169898 NCBI Desc: 28 kda protein [glycine max]
  misc_feature (21)..(143): NCBI GI: 41400345 NCBI Desc: vegetative storage protein [glycine falcata]
  misc_feature: The plant flowers significantly late compared to wild-type.
  misc_feature: Useful for making plants with modulated flowering time
  misc_feature: Functional homolog of the protein sequence given in SEQ ID NO 13562
MPDGDVDEIMPDQSRTTTKPYNATSFNEYVLEGSAPVLPESQRLFKKLISLGIKPVFLTGRTEDQRAITVTNLRRQGYSGWMDLLLKPVGLKATAIAYKSGERQKLQDAGYVIVGNIGDQWSDILGAPEGARTFKLPDPLYYIG

SEQ ID NO: 6957 - DNA, 1164 bp, Sorghum bicolor
  misc_feature: Ceres ANNOT ID no. 6071013
  misc_feature: Encodes the peptide sequence at SEQ ID NO 6958
atgaccaccgaccgtctcctccactttctccgagcgccgacaggctctccggctgcggcccctacccgcgcggctcgccggggtcctctacaggcgcagggcgtccacttctgtcagggagctgcggtgatgcggcgcgcgtccctgtcctgctcgggcactagctctggccgggaggggggactgacgtacaaggatgctggcgtggacatagacgccggcgccgagctcgtgcgccgcatcgccaagatggcacccgggattggcggcttcggcggtctcttcccctacaatgacgattatcttgttggtagcaccgacggggtggggacaaagctgaagcttgctttcgaaactggcattcatgacacaatcggcattgacctggtggcaatgagcgtcaatgacattgtaactttaggtgcaaaaccattgttcttcctagattactatgcgacgagcaagcttgatgttgatcttgcagagaaggttatcaaggggattagggatgggtgtgaacaatcagattgtgctctcctaggaggggagacagcagaaatgcctggtttctatgcagagggtgaatatgatctaagtggttttgctgtgggtgttgtgaagaaggataaagtcattgacggaaaaaacattgttaagggagatgtccttataggtcttccttccagtggggttcattctaatgggttctctcttgttagaagggtactggagaaaagcggactttccttgagtgaccagctcccaagaaatgatggcataacaactactgttggtgaagctctaatggcaccaactgtcatctatgttaagcaggtgcttgagattattaagaaaggtggtgtgaaaggactagcccacatcactggtggtggttttactgacaatatcccaagagtatttccttctggactcggggcaaagatttttactgggtcatgggaagtgcctcctgtcttcaactggcttcaacaggctggaaacattgatgatgcagagatgcggcgaacattcaatatgggaattggaatggttcttgtggtaagcagagagtcagcggacagaattatcgaagacacccatgggtcaaatcatgcttatcacattggagaggtgatcgagggtgacggggttcagtatgtctga

SEQ ID NO: 6958 - protein, 387 aa, Sorghum bicolor
  misc_feature: Ceres ANNOT ID no. 6071013
  misc_feature (60)..(207): Pfam Id: AIRS Pfam Desc: AIR synthase related protein, N-terminal domain
  misc_feature (218)..(387): Pfam Id: AIRS_C Pfam Desc: AIR synthase related protein, C-terminal domain
  misc_feature (48)..(386): NCBI GI: 37983566 NCBI Desc: 5'-aminoimidazole ribonucleotide synthetase [solanum tuberosum]
  misc_feature (61)..(386): NCBI GI: 1709925 NCBI Desc: phosphoribosylformylglycinamidine cyclo-ligase, chloroplast precursor (airs) (phosphoribosyl-aminoimidazole synthetase) (air synthase)
  misc_feature (62)..(386): NCBI GI: 22655452 NCBI Desc: at3g55010/t15c9_10 [arabidopsis thaliana]
  misc_feature (62)..(343): NCBI GI: 541885 NCBI Desc: phosphoribosylformylglycinamidine cyclo-ligase (ec 6.3.3.1) precursor - arabidopsis thaliana
  misc_feature (62)..(383): NCBI GI: 114844769 NCBI Desc: phosphoribosylformylglycinamidine cyclo-ligase [thermoanaerobacter ethanolicus x514]
  misc_feature (61)..(386): SWISSPROT Homolog: EC 6.3.3.1 Phosphoribosylformylglycinamidine cyclo-ligase, chloroplast/mitochondrialprecursor
MTTDRLLHFLRAPTGSPAAAPTRAARRGPLQAQGVHFCQGAAVMRRASLSCSGTSSGREGGLTYKDAGVDIDAGAELVRRIAKMAPGIGGFGGLFPYNDDYLVGSTDGVGTKLKLAFETGIHDTIGIDLVAMSVNDIVTLGAKPLFFLDYYATSKLDVDLAEKVIKGIRDGCEQSDCALLGGETAEMPGFYAEGEYDLSGFAVGVVKKDKVIDGKNIVKGDVLIGLPSSGVHSNGFSLVRRVLEKSGLSLSDQLPRNDGITTTVGEALMAPTVIYVKQVLEIIKKGGVKGLAHITGGGFTDNIPRVFPSGLGAKIFTGSWEVPPVFNWLQQAGNIDDAEMRRTFNMGIGMVLVVSRESADRIIEDTHGSNHAYHIGEVIEGDGVQYV

SEQ ID NO: 6959 - DNA, 1200 bp, Sorghum bicolor
  misc_feature: Ceres ANNOT ID no. 6071020
  misc_feature: Encodes the peptide sequence at SEQ ID NO 6960
atgatgatgatgggagagggagcttacgcgccgccgtggcagcagtcaccggcggccagcatggacgcggatgaggcggcgtcgccgtacgccctcctggcggcgctgcagcattacctgccgtccaacgaggtgtcggcggcggcggcgccgtacgacgaggacgacgaggaggcggccctggcggccggggtggacgcgtacgcctgcgacgagttccggatgtacgagttcaaggtgcggcggtgctcccgcgggcggagccacgactggacggactgcccctacgcgcacccgggggagaaagcccggcgccgcgacccgcggcggtaccactactccggcgcggcgtgcccggacttccgcaagggcgggtgcaagcgcggcgacgcgtgcgagtacgcgcacggggtgttcgagtgctggctccacccgtcccgctaccgcacgcagccctgcaaggacggcaccggctgccgccgccgcgtctgcttcttcgcgcacacgccggaccagctccgcgtcctgccgcagcagcagcagtccagcccgaggggcgcgtcggcggcgtcgccgctggccgagtcgtacgacggctcgccgctccgacggcaggcgttcgagagctacctcaccaagagcggcatgatcatgtcgtcgtcgccgaccagcacgctcgtctcgccgccgaggtcgccgccgtcggagtcgtccccgccaatgtcgccggacgctctccgccgcgggtcgtggccgggcgtcggctcgcccgtcaacgaggtgctcgcctcgctgcgccagctccgcctcggcgcgggcggaggctcgccgaggtcagccccatccagcgggtcgtcgttcttggccggcggcagcggcggcggctacccgttcgggtccccaaagtcaccggcggctgggctgtacagtctcccgtccacgccgacctgtaggccgtccccggtgacggtgaccaccgcctccggcgccaccatcatgaccgtggaccgcctcaacctcggactcatcggcgacgaggaagagccggtcatggagagggtcgagtccggcagagccctccgcgagaaggtgttcgagcggctcagcaaagaagccaccgtgcccaacgacaccgccgcctccgccaacgttgagggagcagctccggatgtcggctgggtctccgacctcatcaactga

SEQ ID NO: 6960 - protein, 399 aa, Sorghum bicolor
  misc_feature: Ceres ANNOT ID no. 6071020
  misc_feature (113)..(138): Pfam Id: zf-CCCH Pfam Desc: Zinc finger C-x8-C-x5-C-x3-H type (and similar)
  misc_feature (1)..(382): NCBI GI: 115435036 NCBI Desc: os01g0192000 [oryza sativa (japonica cultivar-group)]
  misc_feature (9)..(332): NCBI GI: 92893962 NCBI Desc: zinc finger, ccch-type [medicago truncatula]
  misc_feature (66)..(243): NCBI GI: 92887662 NCBI Desc: zinc finger, ccch-type [medicago truncatula]
  misc_feature (68)..(281): NCBI GI: 140039408 NCBI Desc: zinc finger, ccch-type [medicago truncatula]
  misc_feature (8)..(270): NCBI GI: 124360202 NCBI Desc: zinc finger, ccch-type [medicago truncatula]
  misc_feature: Useful for making plants with modulated flowering time
  misc_feature: Functional homolog of the protein sequence given in SEQ ID NO 13971
  misc_feature: Useful for making plants with modulated nitrogen use efficiency
  misc_feature: Functional homolog of the protein sequence given in SEQ ID NO 13972
MMMMGEGAYAPPWQQSPAASMDADEAASPYALLAALQHYLPSNEVSAAAAPYDEDDEEAALAAGVDAYACDEFRMYEFKVRRCSRGRSHDWTDCPYAHPGEKARRRDPRRYHYSGAACPDFRKGGCKRGDACEYAHGVFECWLHPSRYRTQPCKDGTGCRRRVCFFAHTPDQLRVLPQQQQSSPRGASAASPLAESYDGSPLRRQAFESYLTKSGMIMSSSPTSTLVSPPRSPPSESSPPMSPDALRRGSWPGVGSPVNEVLASLRQLRLGAGGGSPRSAPSSGSSFLAGGSGGGYPFGSPKSPAAGLYSLPSTPTCRPSPVTVTTASGATIMTVDRLNLGLIGDEEEPVMERVESGRALREKVFERLSKEATVPNDTAASANVEGAAPDVGWVSDLIN

SEQ ID NO: 6961 - DNA, 993 bp, Sorghum bicolor
  misc_feature: Ceres ANNOT ID no. 6071050
  misc_feature: Encodes the peptide sequence at SEQ ID NO 6962
atggcggaatctagcgggtacgggtccgtgtcggtggacgtcgagcggatctccttcggcggcaaggagcatcttgtgaggacgagatgtggttctgtaaccgttgctgtgtatggagacgaggacaagcctgcgcttgtaacatacccggatgtaggtctgaattacatgtcctgtttccaaggattgttcttctgcccggaagctgcgtctttgctgctccacaatttctgcatctaccacatcaatcctcaggggcacgagttgggagcagctccgatatcatcagatgttccggtgccaactgtggatgatctcgctgatcaagttgcagatgtgcttgatttcttcagtttaggatctgtgatgtgccttggtgtcacggctggtgcatatgttctcactctctttgcgacgaaatatcgggagagggtaataggactgatgctggtttcccctctgtgcaaagccccatcgtggagcgaatggctgtataataaagtattgttaaatttgctttattattacgggactcaaggcctggtcaaggagtgcttgcttcaacgttactttagcaagttacttgatgagaagcagagtgaaaatatttggcggtttcttcactcaataaatgagaggcatgacttaacaaattcattaaagaagctgcaatgccgcacgctaatttttgtcggcgagaactcagagttccatgaggatgctatccatatgaccacaaaactggaccgcagatactgtgcactagttgaggtgcaggattgtggctcccttgtgaccgaggaacagccttatgcgatgctgatgccaatggagtacttccttatgggatatggactttatagaccgtatcagctaagcagcagcccacgaagtccactaagtccatgctgtataccgcctgagctgctatctcctgagagtatgggtgtgaagctgaagccgataaagactcgggttgctatcaatttctaa

SEQ ID NO: 6962 - protein, 330 aa, Sorghum bicolor
  misc_feature: Ceres ANNOT ID no. 6071050
  misc_feature (23)..(288): Pfam Id: Ndr Pfam Desc: Ndr family
  misc_feature (4)..(193): NCBI GI: 21593137 NCBI Desc: pollen specific protein sf21 [arabidopsis thaliana]
  misc_feature (1)..(193): NCBI GI: 13605684 NCBI Desc: at5g11790/t22p22_180 [arabidopsis thaliana]
  misc_feature (23)..(193): NCBI GI: 145329178 NCBI Desc: ndr family protein [arabidopsis thaliana]
  misc_feature (9)..(224): NCBI GI: 140046309 NCBI Desc: ndr [medicago truncatula]
  misc_feature (1)..(193): NCBI GI: 2655926 NCBI Desc: sf21 [helianthus annuus]
MAESSGYGSVSVDVERISFGGKEHLVRTRCGSVTVAVYGDEDKPALVTYPDVGLNYMSCFQGLFFCPEAASLLLHNFCIYHINPQGHELGAAPISSDVPVPTVDDLADQVADVLDFFSLGSVMCLGVTAGAYVLTLFATKYRERVIGLMLVSPLCKAPSWSEWLYNKVLLNLLYYYGTQGLVKECLLQRYFSKLLDEKQSENIWRFLHSINERHDLTNSLKKLQCRTLIFVGENSEFHEDAIHMTTKLDRRYCALVEVQDCGSLVTEEQPYAMLMPMEYFLMGYGLYRPYQLSSSPRSPLSPCCIPPELLSPESMGVKLKPIKTRVAINF

SEQ ID NO: 6963 - DNA, 1167 bp, Sorghum bicolor
  misc_feature: Ceres ANNOT ID no. 6071077
  misc_feature: Encodes the peptide sequence at SEQ ID NO 6964
atggctctcggcggcctcgtcggccagttcttggccagcagcaatgagcttatggtggcgtcgctctcggccgtgagctgcgcggacgaggtgcaggaggagggtgcggagggggcggggtgccgtgacgacgccgcggcgctgcggctcaaggaggtggccatggcggcgatcctggtggccggggtgctcggcgtcggccttccgctcgtgggccggaagcgccgcgcgatgcgcacggacagcgccgcgttcctggcggccaaggcgttcgccgccggggtcatcctggccacggggttcgtccacatgctccacgacgccgggaccgcgctgtccagcccgtgcctccccgccgtgccgtggcggcggttcccggtccccgggttcgtcgccatggccgccgcgctcgccacgctcgtgctcgacttcctcgccaccaggttctacgaggccaagcaccgcgacgaggccgcgcgcgtcaaggcagccgccgctgccgcgctcgttgcgacgacctcctctgcgagcgacgaggacatcaccgtgctcaccgtcgacgctgaggacgaacgcaaggcaccgctgttgcaaacgcactgccatggacacggacacggacacagccacagccatgggcatgagctcgtgcaggtagtgggcagcgaggcggaggtgtcggcacatgtccgctccatcgtcgtgtcacagatactggagatggggattgtgtcacactctgtgatcatcggattgtcactgggagtgtcacggagcccatgcacaatcaggccacttgtcgcagcgcttgcattccaccagttctttgaggggtttgcactaggtggctgcattgctcaggcacaattcaagaacctttcggcaattctaatggcatctttctttgccatcacaacaccggcaggaatagctgctggggcaggcttgaccacattctacaatcccaatagcccaagggctcttgtggttgagggcattcttgactcggtgtcggctggcatcctcatatacatgtcgctagtggatctcatcgcagcagatttcttgggtggaaagatgacaggatccctgcgacagcaagtggtggcatacatcgcattgttcctcggtgcgctctcgatgtcatcacttgcaatatgggcttga

SEQ ID NO: 6964 - protein, 388 aa, Sorghum bicolor
  misc_feature: Ceres ANNOT ID no. 6071077
  misc_feature (48)..(385): Pfam Id: Zip Pfam Desc: ZIP Zinc transporter
  misc_feature (8)..(388): NCBI GI: 89994167 NCBI Desc: zinc transporter protein zip7 [hordeum vulgare]
  misc_feature (199)..(388): NCBI GI: 60592737 NCBI Desc: zip family metal transporter [thlaspi japonicum]
  misc_feature (34)..(388): NCBI GI: 14582255 NCBI Desc: zip-like zinc transporter [thlaspi caerulescens]
  misc_feature (34)..(388): NCBI GI: 42493205 NCBI Desc: zn and cd transporter [thlaspi caerulescens]
  misc_feature (34)..(388): NCBI GI: 7381054 NCBI Desc: zn and cd transporter znt1 [thlaspi caerulescens]
MALGGLVGQFLASSNELMVASLSAVSCADEVQEEGAEGAGCRDDAAALRLKEVAMAAILVAGVLGVGLPLVGRKRRAMRTDSAAFLAAKAFAAGVILATGFVHMLHDAGTALSSPCLPAVPWRRFPVPGFVAMAAALATLVLDFLATRFYEAKHRDEAARVKAAAAAALVATTSSASDEDITVLTVDAEDERKAPLLQTHCHGHGHGHSHSHGHELVQVVGSEAEVSAHVRSIVVSQILEMGIVSHSVIIGLSLGVSRSPCTIRPLVAALAFHQFFEGFALGGCIAQAQFKNLSAILMASFFAITTPAGIAAGAGLTTFYNPNSPRALVVEGILDSVSAGILIYMSLVDLIAADFLGGKMTGSLRQQVVAYIALFLGALSMSSLAIWA

SEQ ID NO: 6965 - DNA, 1143 bp, Sorghum bicolor
  misc_feature: Ceres ANNOT ID no. 6071081
  misc_feature: Encodes the peptide sequence at SEQ ID NO 6966
atgccgctccaccaccccaagcaccgccaccacgacgacgacctcctcccctaccgccgctccgatgatgaggccaagccgcggcggccctacacccccaccttcccctcctcccccgcctccgctaaccgcctcctcctcttcttcgccgtcgcctgcctcgccctcgccgccgcctccttcgccttcgccatctccaccagccgtaaccgccagcccctgccgcagcctccgcctactgtcgccttccgctgcggacgcgccgaggactcgctccgctccttcctagcggcctcctcgcacggcaacttctccgccagcgacagggagaaggtgctcgctgtcgttggcgtacacacggagcacggcaacatctccgctgcccgacgcgctgcgctccgcgctacctggttcccgcccaaccccgaaggcatcccatttcttctgtattgcagtttagaacatggaactggattgtcttttaggtttgtcactagacggccaaaggacaaagataaaatggaagatcttcagaaagaggcggatacttatcatgactttttgtttattgatgctgatgaggacacaaagcccccacagaagatgttagcatttttcaaagcagcttaccacatgttcaatgcagaattctatgtcaaagctaatgatgatatctacctgcgcccagatagacttgctgctcttcttgcaaaagaaagagctcagcacaagacatacattggttgcatgaagaagggaccagttgtcaatgatccaaatatgaaatggtacgaaagttcttgggaacttttgggtaacgagtacttcatgcatgcttctggttcactatatgctctttcttctgaggtggttgaagctctagctactacaaagagtgatagcttaaggatgtttgattacgaagatgttacagtcggcgcatggatgcttgctatgaatgtaaagcatgaagacaacagagcaatgtgtgattcaatatgcactcctacctccattgctgtatgggacagtaagaaatgttcaggtacttgtaacatagctgacaaaataaagcagctccataacaccactgtgtgctcaaagagcccaacgttgccacctgaggtggaggaggaagaatag

SEQ ID NO: 6966 - protein, 380 aa, Sorghum bicolor
  misc_feature: Ceres ANNOT ID no. 6071081
  misc_feature (128)..(327): Pfam Id: Galactosyl_T Pfam Desc: Galactosyltransferase
  misc_feature (26)..(375): NCBI GI: 52421269 NCBI Desc: at2g26100 [arabidopsis thaliana]
  misc_feature (96)..(377): NCBI GI: 7769857 NCBI Desc: f12m16.19 [arabidopsis thaliana]
  misc_feature (174)..(378): NCBI GI: 22553074 NCBI Desc: beta 1,3-glycosyltransferase-like protein iii [oryza sativa]
  misc_feature (109)..(361): NCBI GI: 21553519 NCBI Desc: avr9 elicitor response-like protein [arabidopsis thaliana]
  misc_feature (109)..(361): NCBI GI: 7269547 NCBI Desc: avr9 elicitor response like protein [arabidopsis thaliana]
MPLHHPKHRHHDDDLLPYRRSDDEAKPRRPYTPTFPSSPASANRLLLFFAVACLALAAASFAFAISTSRNRQPLPQPPPTVAFRCGRAEDSLRSFLAASSHGNFSASDREKVLAVVGVHTEHGNISAARRAALRATWFPPNPEGIPFLLYCSLEHGTGLSFRFVTRRPKDKDKMEDLQKEADTYHDFLFIDADEDTKPPQKMLAFFKAAYHMFNAEFYVKANDDIYLRPDRLAALLAKERAQHKTYIGCMKKGPVVNDPNMKWYESSWELLGNEYFMHASGSLYALSSEVVEALATTKSDSLRMFDYEDVTVGAWMLAMNVKHEDNRAMCDSICTPTSIAVWDSKKCSGTCNIADKIKQLHNTTVCSKSPTLPPEVEEEE

SEQ ID NO: 6967 - DNA, 675 bp, Sorghum bicolor
  misc_feature: Ceres ANNOT ID no. 6071106
  misc_feature: Encodes the peptide sequence at SEQ ID NO 6968
atggccgacgctctcctccttccgcgccgcttcctcgcgccgtcgccagccgcatccggcgtctcttcatccgcctcttcgtccccgccgtgctgttgggtgctgtcggcgcccggctccccgcggcgggcgcgcctggcggccgctcacccgcaaccccggcctcgccggctcactcgatacaagacttatgcagcagagccaaagagtggtgagcaaccgaaatggtgggagaaaaatgctggaccaaacatgattgacatccactccacggtggagttcttggatgcacttagagatgctggagacaggcttgttattgttgagttctacgggacctggtgcggttcatgcagggctctctttccaaggctctgccggacagctttggagaaccctgatatattgtttctaaaagtgaattttgatgaaaacaaacctatgtgcaaacgactgaatgtcaaagttcttccttccttccatttttaccgtggagctgatgggctactggtggctttctcctgttccttagctaagtttcaaaagctgaaggatgccattgcaatgcacaacactgctcgttgcagcattggtccacctgttggagttggcgatgttgacttgctggatagcacgagccctcaagagaaacctgcagaagctagtccacggtag

SEQ ID NO: 6968 - protein, 224 aa, Sorghum bicolor
  misc_feature: Ceres ANNOT ID no. 6071106
  misc_feature (87)..(190): Pfam Id: Thioredoxin Pfam Desc: Thioredoxin
  misc_feature (41)..(221): NCBI GI: 92869615 NCBI Desc: thioredoxin domain 2 [medicago truncatula]
  misc_feature (26)..(199): NCBI GI: 18417441 NCBI Desc: thioredoxin family protein [arabidopsis thaliana]
  misc_feature (26)..(199): NCBI GI: 21554313 NCBI Desc: thioredoxin-like protein [arabidopsis thaliana]
  misc_feature (72)..(196): NCBI GI: 4973258 NCBI Desc: thioredoxin-like 2 [arabidopsis thaliana]
  misc_feature (26)..(182): NCBI GI: 7269866 NCBI Desc: thioredoxin-like protein [arabidopsis thaliana]
MADALLLPRRFLAPSPAASGVSSSASSSPPCCWVLSAPGSPRRARLAAAHPQPRPRRLTRYKTYAAEPKSGEQPKWWEKNAGPNMIDIHSTVEFLDALRDAGDRLVIVEFYGTWCGSCRALFPRLCRTALENPDILFLKVNFDENKPMCKRLNVKVLPSFHFYRGADGLLVAFSCSLAKFQKLKDAIAMHNTARCSIGPPVGVGDVDLLDSTSPQEKPAEASPR

SEQ ID NO: 6969 - DNA, 1812 bp, Sorghum bicolor
  misc_feature: Ceres ANNOT ID no. 6071133
  misc_feature: Encodes the peptide sequence at SEQ ID NO 6970
  misc_feature: Up-regulated in shoot tissues in response to salicylic acid treatment
atggacgacggcgacagtgccgtccggagcgtcgacaaggccggcgccgccccgggcgacgacggcagcgcgacaccgctaccggagacggttcaaattggtaattcgcctacttacagacttgacagaaagcttggaaagggaggatttgggcaagtatatgttggtcgccgtatttcctctcctagtgttagtgacaggatgcccggtgcaaatgctttagaggttgcaatcaaatttgaacatcggaccagcaaaggttgcaactatggtgctccttatgagtggcaagtttacaacactcttagtggaattcatggcgtaccaagagtacactacaaagggaagcaaggagagtattatatcatgattatggacatgttggggccaagcctatgggatgtttggaataataactctcactctatgtctgttgaaatggtggcttgcattgctatagaagcaatttccatactggagaagatgcactcaaaagggtacgtccatggagatgtaaaacctgaaaactttttgcttggacctccaggcaccctagaagagaagaaactttttcttgttgaccttggtttagccaccagatggaaagacactggtacaggagagcatgttgaatatgatcaaaggcctgatgtcttcagaggaactgttcggtatgctagcgtgcatgctcatttggggagaactggaagcaggagggatgacctggaatctcttgcctacacacttgtatttcttctgcgtggtcgccttccttggcaaggataccagggggagaacaaaggtttccttgtctgcaagaaaaagatggcaacttctccggaatctctgtgttgcttttgcccacaacctttccgacaatttattgagtatgttgtgaacttaaagtttgatgaagaaccaaactatgcaaagtgcatctctctttttgatggcattgttggtccaaacccagacataaggccaatcaatacagatggtgctcagaaggtaggccagaagagaggtcgccttatgatggaggaagatgatgatgagcagcccaaaaagaagattaggatgggaatgcctgcgacccaatggattagtgtttacaatgccaggcggcctatgaaacagaggtatcactacaatgttgcagacagcaggttagctcagcacatttcaaagggaaatgaagatggcttgtttataagctctgtcgcctcttgttcaaatctgtgggctttgataatggatgctggcactggatttacttctcaagtatatgaactttctccatattttcttcacaaggaatggataatggagcaatgggagaagaacttctatattactgccctagcaggggcaaacaatggcagttcactagtggtcatgtcgagaggaacacaatatgcccagcaatcctacaaagtaagcgactcattccctttcaagtggataaacaaaaagtggaaggagggtttttatgttactgctatggccacagcaggaagtcggtgggcagtggtcatgtctcggaattctggcttttcggcacaggttgtcgagcttgatttcttgtatccaagtgagggtatccatcgacgctgggataatggatttcgcatcacagctactgcagctacatgggatcaggcagcgtttatcttgagcatccccaaaaggaaacctgctgacgaaacacaggaaaccctaagaacgtctgctttccccagccagcatgtgaaggacaaatgggcgaaaaatctctacttagcttccatttgctatggaagaacagtgtcatga

SEQ ID NO: 6970 - protein, 603 aa, Sorghum bicolor
  misc_feature: Ceres ANNOT ID no. 6071133
  misc_feature (39)..(316): Pfam Id: Pkinase Pfam Desc: Protein kinase domain
  misc_feature (1)..(603): NCBI GI: 115462563 NCBI Desc: os05g0200500 [oryza sativa (japonica cultivar-group)]
  misc_feature (1)..(603): NCBI GI: 115439889 NCBI Desc: os01g0744300 [oryza sativa (japonica cultivar-group)]
  misc_feature (12)..(603): NCBI GI: 115435096 NCBI Desc: os01g0198200 [oryza sativa (japonica cultivar-group)]
  misc_feature (1)..(603): NCBI GI: 30682888 NCBI Desc: protein kinase family protein [arabidopsis thaliana]
  misc_feature (1)..(603): NCBI GI: 42570917 NCBI Desc: protein kinase family protein [arabidopsis thaliana]
  misc_feature: Up-regulated in shoot tissues in response to salicylic acid treatment
  misc_feature: The sequence is a functional homolog of SEQ ID NO. 399 in the 11/188,298 US application
  misc_feature: The sequence is a functional homolog of SEQ ID NO. 332 in the 11/188,298 US application
  misc_feature: The sequence is a functional homolog of SEQ ID NO. 310 in the 11/188,298 US application
  misc_feature: The sequence is a functional homolog of SEQ ID NO. 441 in the 11/188,298 US application
  misc_feature: The sequence is a functional homolog of SEQ ID NO. 340 in the 11/188,298 US application
MDDGDSAVRSVDKAGAAPGDDGSATPLPETVQIGNSPTYRLDRKLGKGGFGQVYVGRRISSPSVSDRMPGANALEVAIKFEHRTSKGCNYGAPYEWQVYNTLSGIHGVPRVHYKGKQGEYYIMIMDMLGPSLWDVWNNNSHSMSVEMVACIAIEAISILEKMHSKGYVHGDVKPENFLLGPPGTLEEKKLFLVDLGLATRWKDTGTGEHVEYDQRPDVFRGTVRYASVHAHLGRTGSRRDDLESLAYTLVFLLRGRLPWQGYQGENKGFLVCKKKMATSPESLCCFCPQPFRQFIEYVVNLKFDEEPNYAKCISLFDGIVGPNPDIRPINTDGAQKVGQKRGRLMMEEDDDEQPKKKIRMGMPATQWISVYNARRPMKQRYHYNVADSRLAQHISKGNEDGLFISSVASCSNLWALIMDAGTGFTSQVYELSPYFLHKEWIMEQWEKNFYITALAGANNGSSLVVMSRGTQYAQQSYKVSDSFPFKWINKKWKEGFYVTAMATAGSRWAVVMSRNSGFSAQVVELDFLYPSEGIHRRWDNGFRITATAATWDQAAFILSIPKRKPADETQETLRTSAFPSQHVKDKWAKNLYLASICYGRTVS

SEQ ID NO: 6971 - DNA, 2040 bp, Sorghum bicolor
  misc_feature: Ceres ANNOT ID no. 6071170
  misc_feature: Encodes the peptide sequence at SEQ ID NO 6972
atggcggccgcagaggagaatagctcgctgttcctgattttcatcctcaccatgatcgcgctgcccctcgtgccctacacgatcctgcgtctgtgtcgcgctgcttccgagaaggccaagaccatccactgccgctgctcgggttgccaccgctccggcaagtaccgcaagtcgatctacaagaggatatccaacttctccacgtgcagtaacctaaccatcgttctgctctggattgttatgatattcctggtttactacataaagcatgttagccgtgaggtccaagtttttgagcctttcagtattcttggactggaatctggggcatctgaatctgagatcaagaaatcatataggaggctttctattcagtaccatcctgataaaaatcctgatccagaggctcataagtacttcgttgaatatatatccaaggcatatcaagcattaactgatcctatatctcgcgagaattatgagaaatatggtcaccctgatgggcggcaggggatgcaaatgggcattgctttgcccaagtttttactaaatattgatggtgcatctggtgggataatgcttcttggaatagtcgggttttgtatattattgcctttgatgatagctgttatttatttgtcaagatcgtcaaaatataccgggaactatgtcatgcatcaaacactgtccacttactactactttatgaagccatctcttgctccaagcaaagttatggatgtcttcatcaaggctgccgaatatatggagatgccagttcgacgcagtgatgatgaacccctgcaaaaattgtttgtagctgttagaagtgagttaaatctggacttaaagaacattaagacagaacaagcaaaattctggaagcagcatccatcactagtaaaggcgcatctcacgtgtgagtcattttctttgaccccagcacttcttaaagattacagacatatgcttgaacttgcacctcgtcttctggaagaacttgttaagattgcagttctaccaaggaatccccatggttttggatggctccggcctgcaattggtgttattgagctttctcaaaatattgtccaggctgtaccactaagtgcacgaaaagctagtggaggtaactcggaaggaatagcacctttcttgcagcttccgcatttcacagaagcaactgtgaaaaagattgctcgtaagaaaatccgtgccttccaagaactttgtgacatgtctgtggaggatcgtgctgcattgctcacacaagttgctgggctttctgaagaacaagcccgcgatgtggagcttgtcctggagatgattccttctattgaagtagacattaaatgcgagactgaaggtgaagagggcattcaagagggtgatgtggtgacaatgtatgcttgggtctcactacaacggcgtaatggacttactgctgctcttccccattgtcccaacttcccgttccacaaggaagaaaacttctggctgcttctagctgatgtggcatctaatgatgtctggttgtcacagaaagtcagcttcatggatgaggccactgccataactgcagcatcaaaagctatacaagagacccaggaagcactaggtgcaagtgcaaaggaaataggaaatgcagttaaggaggcagttgacagggtgaagaaaggcagtaggctggtaatgggcaagttccaagccccagcagagggtactcacaacctcacctctttttgtttgtgcgactgttggataggctgtgacaccaagaccagcttcaagctcaaggtgctgaagcgcagccgtgctggaacaagaggccatgtgcctgaagaagggccagcggcagccacagaggatggtattgaggaggaagaggaggaagaggaagaggagtatgatgactatgagagcgagtacagtgatgacgaggaggacgacaagaacaaggggaaagggaaggggaaggtcgtgaacggatcggcccatcaaggggctgaatctgatatagattcaggcagcgatgagtga

SEQ ID NO: 6972 - protein, 679 aa, Sorghum bicolor
  misc_feature: Ceres ANNOT ID no. 6071170
  misc_feature (99)..(161): Pfam Id: DnaJ Pfam Desc: DnaJ domain
  misc_feature (205)..(598): Pfam Id: Sec63 Pfam Desc: Sec63 Brl domain
  misc_feature (1)..(679): NCBI GI: 116308927 NCBI Desc: osigba0125j07.5 [oryza sativa (indica cultivar-group)]
  misc_feature (1)..(679): NCBI GI: 144923182 NCBI Desc: heat shock protein dnaj; sec63 [medicago truncatula]
  misc_feature (1)..(672): NCBI GI: 18415642 NCBI Desc: dnaj heat shock n-terminal domain-containing protein / sec63 domain-containing protein [arabidopsis thaliana]
  misc_feature (10)..(520): NCBI GI: 145344537 NCBI Desc: iisp family transporter: translocation protein sec63-like protein [ostreococcus lucimarinus cce9901]
  misc_feature (5)..(478): NCBI GI: 116132232 NCBI Desc: ensangp00000017941 [anopheles gambiae str. pest]
MAAAEENSSLFLIFILTMIALPLVPYTILRLCRAASEKAKTIHCRCSGCHRSGKYRKSIYKRISNFSTCSNLTIVLLWIVMIFLVYYIKHVSREVQVFEPFSILGLESGASESEIKKSYRRLSIQYHPDKNPDPEAHKYFVEYISKAYQALTDPISRENYEKYGHPDGRQGMQMGIALPKFLLNIDGASGGIMLLGIVGFCILLPLMIAVIYLSRSSKYTGNYVMHQTLSTYYYFMKPSLAPSKVMDVFIKAAEYMEMPVRRSDDEPLQKLFVAVRSELNLDLKNIKTEQAKFWKQHPSLVKAHLTCESFSLTPALLKDYRHMLELAPRLLEELVKIAVLPRNPHGFGWLRPAIGVIELSQNIVQAVPLSARKASGGNSEGIAPFLQLPHFTEATVKKIARKKIRAFQELCDMSVEDRAALLTQVAGLSEEQARDVELVLEMIPSIEVDIKCETEGEEGIQEGDVVTMYAWVSLQRRNGLTAALPHCPNFPFHKEENFWLLLADVASNDVWLSQKVSFMDEATAITAASKAIQETQEALGASAKEIGNAVKEAVDRVKKGSRLVMGKFQAPAEGTHNLTSFCLCDCWIGCDTKTSFKLKVLKRSRAGTRGHVPEEGPAAATEDGIEEEEEEEEEEYDDYESEYSDDEEDDKNKGKGKGKVVNGSAHQGAESDIDSGSDE

SEQ ID NO: 6973 - DNA, 852 bp, Sorghum bicolor
  misc_feature: Ceres ANNOT ID no. 6071209
  misc_feature: Encodes the peptide sequence at SEQ ID NO 6974
atgcacatccgagaagagcaagctatgccatcaacagtgacaggcatcatggtgtcgaccctgacttcggcggggctgaagctgaaggagccggcgacgatgtcccctggtggctccgcgtcggttgctgctggatttgggtctgctgcagagaggaacaacggcaggggcaagggcaagactgagatcaagcgcatcgagaacacgaccaacaggcaggtgaccttctgcaagcgccgcaacggcctcctcaagaaggcgtacgagctctccgtgctctgcgacgccgaggtcgcgctcatcgtcttctccagccgcggccgcctctacgagtactccaacaacagcgtgaaggccaccattgagaggtacaagaaggcaaacagtgacaactccagcgctgctggtacgattgcagaggtcacgattcagcactacaagcaggaatctgctaggctgaggcagcagatcactaacttgcagaactccaacagggccctgataggtgatatcacaaccatgagccccaaggacctcaaacacctggagactaggttagacaaagcacttggaaagattagagcaagaaaggaaatggagttgcagaatgacaacttgtacttaaggagcagggttgatgagaatgaaagggcacaacagacagtgaacatgatgggggcgccatcgacaagtgattatcagcagcagggttttattccttatgacccaataaggagcttcctgcagttcaacatcatgcagcagcctcagttttactcccagcaggaggaccggaaagacttcaacctagatcatttggtgaatgtccaacttgatttagtgactcgttag

SEQ ID NO: 6974 - protein, 283 aa, Sorghum bicolor
  misc_feature: Ceres ANNOT ID no. 6071209
  misc_feature (64)..(114): Pfam Id: SRF-TF Pfam Desc: SRF-type transcription factor (DNA-binding and dimerisationdomain)
  misc_feature (129)..(214): Pfam Id: K-box Pfam Desc: K-box region
  misc_feature (1)..(269): NCBI GI: 309574 NCBI Desc: homologue of arabidopsis gene agamous
  misc_feature (1)..(271): NCBI GI: 91207156 NCBI Desc: mads-box transcription factor 58 (osmads58)
  misc_feature (1)..(271): NCBI GI: 83582645 NCBI Desc: transcription factor osmads58 [oryza sativa (japonica cultivar-group)]
  misc_feature (39)..(269): NCBI GI: 24636577 NCBI Desc: mads box transcription factor [triticum aestivum]
  misc_feature (57)..(269): NCBI GI: 19698538 NCBI Desc: agamous-like protein 2 hvag2 [hordeum vulgare subsp. vulgare]
  misc_feature: Abnormal phyllotaxy, leaf number higher than wild-type
  misc_feature: The plant flowers significantly earllier than wild-type.
  misc_feature: The sequence is a functional homolog of SEQ ID NO 14 in the 10/666,642US patent application
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 12958
  misc_feature: The sequence is a functional homolog of SEQ ID NO 14 in the 20070033671 US patent application
  misc_feature: Useful for biocontainment applications
  misc_feature: Functional homolog of the protein sequence given in SEQ ID NO 13973
  misc_feature: The sequence is a functional homolog of SEQ ID NO 14 in the 10/666,642 US patent application
  misc_feature: Useful for making plants with altered alkaloid content
  misc_feature: Useful for making plants with altered lignin content
  misc_feature: Useful for making plants with modulated biomass
  misc_feature: Useful for making plants with modulated flowering time
  misc_feature: Functional homolog of the protein sequence given in SEQ ID NO 13528
  misc_feature: The sequence is a functional homolog of SEQ ID NO 32 in the 10/666,642 US patent application
  misc_feature: Useful for making plants with altered terpenoid content
  misc_feature: Functional homolog of the protein sequence given in SEQ ID NO 13438
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 1701 in the 10/412,699 US patent application
  misc_feature: The sequence is a functional homolog of SEQ ID NO 1965 in the 10/412,699 US patent application
  misc_feature: The sequence is a functional homolog of SEQ ID NO 1967 in the 10/412,699 US patent application
  misc_feature: The sequence is a functional homolog of SEQ ID NO 1963 in the 10/412,699 US patent application
  misc_feature: The sequence is a functional homolog of SEQ ID NO 1949 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO. 273 in the 11/188,298 US application
  misc_feature: The sequence is a functional homolog of SEQ ID NO. 361 in the 11/188,298 US application
  misc_feature: The sequence is a functional homolog of SEQ ID NO. 359 in the 11/188,298 US application
  misc_feature: The sequence is a functional homolog of SEQ ID NO. 518 in the 11/188,298 US application
  misc_feature: The sequence is a functional homolog of SEQ ID NO. 420 in the 11/188,298 US application
  misc_feature: The sequence is a functional homolog of SEQ ID NO. 377 in the 11/188,298 US application
MHIREEQAMPSTVTGIMVSTLTSAGLKLKEPATMSPGGSASVAAGFGSAAERNNGRGKGKTEIKRIENTTNRQVTFCKRRNGLLKKAYELSVLCDAEVALIVFSSRGRLYEYSNNSVKATIERYKKANSDNSSAAGTIAEVTIQHYKQESARLRQQITNLQNSNRALIGDITTMSPKDLKHLETRLDKALGKIRARKEMELQNDNLYLRSRVDENERAQQTVNMMGAPSTSDYQQQGFIPYDPIRSFLQFNIMQQPQFYSQQEDRKDFNLDHLVNVQLDLVTR

SEQ ID NO: 6975 - DNA, 1449 bp, Sorghum bicolor
  misc_feature: Ceres ANNOT ID no. 6071223
  misc_feature: Encodes the peptide sequence at SEQ ID NO 6976
atggatgctactgcaacagatctgcaaagggctgaggaatttaaacttaaggcgaatgatgccttcaaggcaaacaagttctctcaggctatagagctttacagtcaagccattgagctgaatagttcgaatgcagtttactgggcaaaccgtgcatttgcacacacaaaattagaggaatacggaagtgctgtgcaggatgctacgaaagccatcgaaattgatcctagatattcaaaaggttattatagacgtggcgcagcgtatcttgccatgggaaagttcaaggaagccctaaaggattttcagcaggttaaaaaaatctgtccgaatgatccagacgctacaagaaagttgaaagagtgtgagaaagctgtccaaaaaatccgttttgaagaagcaatttctgttggagatgctgagaggggctccgtggcagactccatcgactaccatatcatagaagtagagccacactacgcgggaccaagaattgatggcgaagaaataacgatagattttgtcaaagcaatgttggatgaatttaagaagcagaaatgcatacataaaagatatgcttatcagattgttctaaaaaccttggatttgctacgttcgatgccttcccttgttgatgtgaatgttccaaacggtgggcattttacagtttgcggtgatgtgcatggtcagtactttgatttgctcaacatatttgacctcaatgggcttccctcagaagaaaatccttacctcttcaatggtgattttgtggacagaggatctttctctgttgaagtcatactcacgctttttgctttcaagtgcctctatccaaaagctatgtaccttgcaagaggaaatcatgaaagcaagagcatgaacaaaatatatggctttgagggggaagtgaggtcaaaactgggcgaaaagtttgttgaactttttgctgaagtcttttgttggttacctcttgcgcatgtcatcaacaacaaggtctttgtggttcatggagggctatttagtgttgatggggtgaaactttcagacatcaggtccattgatcgtttctgtgaaccacctgaagaaggtctaatgtgtgaactactatggagtgaccctcagcctcagcttggaagaggtccaagcaaacgtggtgttgctctttcctttggcgcagatgtgactaagaagtttctacaggaaaataacctggatcttattgtccggtcccatgaagtaaaggatgaaggccatgaaattgaacatgatgggaagcttataacagtcttctctgcgcctaattactgtgaccagatgggcaacaagggtgcatttattcgcttcacagctccagaaatgaaaccagatattgttactttctcagctgtgccacaccctgatgtgaggccgatggcgtatgcaaataacttcctcaggatgtttcaatga

SEQ ID NO: 6976 - protein, 482 aa, Sorghum bicolor
  misc_feature: Ceres ANNOT ID no. 6071223
  misc_feature (118)..(213): Pfam Id: PPP5 Pfam Desc: PPP5
  misc_feature (219)..(415): Pfam Id: Metallophos Pfam Desc: Calcineurin-like phosphoesterase
  misc_feature (45)..(78): Pfam Id: TPR_1 Pfam Desc: Tetratricopeptide repeat
  misc_feature (79)..(112): Pfam Id: TPR_1 Pfam Desc: Tetratricopeptide repeat
  misc_feature (11)..(44): Pfam Id: TPR_1 Pfam Desc: Tetratricopeptide repeat
  misc_feature (79)..(112): Pfam Id: TPR_2 Pfam Desc: Tetratricopeptide repeat
  misc_feature (11)..(44): Pfam Id: TPR_2 Pfam Desc: Tetratricopeptide repeat
  misc_feature (45)..(78): Pfam Id: TPR_2 Pfam Desc: Tetratricopeptide repeat
  misc_feature (1)..(481): NCBI GI: 24954813 NCBI Desc: type 5 serine/threonine phosphatase 55 kda isoform [lycopersicon esculentum]
  misc_feature (154)..(481): NCBI GI: 28141085 NCBI Desc: type 5 protein serine/threonine phosphatase 62 kda isoform [lycopersicon esculentum]
  misc_feature (155)..(481): NCBI GI: 79324899 NCBI Desc: pp5 [arabidopsis thaliana]
  misc_feature (8)..(480): NCBI GI: 60654849 NCBI Desc: protein phosphatase 5 catalytic subunit [synthetic construct]
  misc_feature (8)..(480): NCBI GI: 897761 NCBI Desc: protein phosphatase 5 [homo sapiens]
  misc_feature (8)..(480): SWISSPROT Homolog: EC 3.1.3.16 Serine/threonine-protein phosphatase 5
MDATATDLQRAEEFKLKANDAFKANKFSQAIELYSQAIELNSSNAVYWANRAFAHTKLEEYGSAVQDATKAIEIDPRYSKGYYRRGAAYLAMGKFKEALKDFQQVKKICPNDPDATRKLKECEKAVQKIRFEEAISVGDAERGSVADSIDYHIIEVEPHYAGPRIDGEEITIDFVKAMLDEFKKQKCIHKRYAYQIVLKTLDLLRSMPSLVDVNVPNGGHFTVCGDVHGQYFDLLNIFDLNGLPSEENPYLFNGDFVDRGSFSVEVILTLFAFKCLYPKAMYLARGNHESKSMNKIYGFEGEVRSKLGEKFVELFAEVFCWLPLAHVINNKVFVVHGGLFSVDGVKLSDIRSIDRFCEPPEEGLMCELLWSDPQPQLGRGPSKRGVALSFGADVTKKFLQENNLDLIVRSHEVKDEGHEIEHDGKLITVFSAPNYCDQMGNKGAFIRFTAPEMKPDIVTFSAVPHPDVRPMAYANNFLRMFQ

SEQ ID NO: 6977 - DNA, 1917 bp, Sorghum bicolor
  misc_feature: Ceres ANNOT ID no. 6071312
  misc_feature: Encodes the peptide sequence at SEQ ID NO 6978
atgagcggcacctcggggcccctcccctactcgatgcgcgatgtgggcgctggcggcgcctacaacaacgccaagttccgccaccggtctcgactcaagtccttggctactaacagcagcaaataccgttgtggaaagttcactgttggtaaattcttgagtctgttgatggtttctggcttattgtacttatttctgcacaaaggctcagagggtattgtatccagtgagctacatggcaaagaagtacagaataaaaacgtcaggagagctcccaatatacgcagattctggagaaaaccaccaaggctgcccccacgcctccctccaaatgaaatctacaaaaataattctctgcttcagcagtctccatctgagtggacatccaggcagaagaaagttaaagaagcatttgaacatgcatggtccggttaccaaaagtatgcaatgggttatgatgagcttatgcctctgagccacagaggcacagatgggttaggtggtctaggagctactattgtggattctctggacactgcgataataatgggtgctgatgatgttgtttctgaagcatcaaaatggattgaagacaacctaatgcaaagaatcagtgagaaagggcaggttaacttattcgagactaccatccgtgtcttgggagggcttcttagtgcataccatttgagtggtggtcatcatccaggggcaggtgactccggagtaccagtaacatataaaaaggctaatccagagcgacttttggaagtttcaaaggatttagccgacaggttattattggcttttacatcaagcccaacagctatacctttaagtgatgttatacttcgtgaccacactgcacatgcagcccctgatggcttaagcagcacttcagaggcttcaacgttgcaactagagttcagttacctcagcaaagtatcaggggatcctaagtatgacagggaagcaatgaaggtgttagagcatatgcatacactcccaaaggtggagggtctggtgcctatttacatcaacccctcctctggtcaatttagtggtgagaatattcgattaggatctcgaggggacagttattatgagtatctgctaaaagtgtgggttcagcaagaggaatatcgtgacagtagtttgaagtatctatttgaaatgtatactgaagcaatgagaggggtcaagcatcttcttgttcggaaaactgttccaaatgggttggtatttgttggggaacttccatctggacaaaatggtgggtttagtcctaaaatggatcacctggtgtgttttcttcctggtacccttgctcttggtgcaactaaaggtatcacaaagagaaaagctcttgaaagtaacttgttaactgatgaagataaagaaaatctccagcttgctgaagatcttgccaaaacatgtgttgagatgtactttgtgacctctaccggccttgctcctgaaatagcttatttccacattgagggtgatacagaaggggggcctgatggtgggaataaaagctccaagtatatcaatgatatcataataaaaccacttgaccgtcacaatcttctacgcccagagactgtggaatcactatttgttttgtatagaatcacagaggatcccaagtatagggagtggggttggcagatctttcaggcttttgagaagtacacaaaagttgattctggtggttacacatcattggatgatgtcacaagcctacctccttctacaagagataaaatggaaactttcttccttggagaaacattgaagtatttgtatttgctgtttgatgaaaacaatacccttcccctagataagtatgtattcaatacagaggcccatcctcttccagttatgcggtctgcagaacgggcttcacattctgtgtag

SEQ ID NO: 6978 - protein, 638 aa, Sorghum bicolor
  misc_feature: Ceres ANNOT ID no. 6071312
  misc_feature (137)..(627): Pfam Id: Glyco_hydro_47 Pfam Desc: Glycosyl hydrolase family 47
  misc_feature (3)..(638): NCBI GI: 115462619 NCBI Desc: os05g0209100 [oryza sativa (japonica cultivar-group)]
  misc_feature (466)..(631): NCBI GI: 13879340 NCBI Desc: e430019h13rik protein [mus musculus]
  misc_feature (467)..(631): NCBI GI: 61680321 NCBI Desc: chain a, crystal structure of human class i alpha-1,2-mannosidase in complex with thio-disaccharide substrate analogue
  misc_feature (467)..(631): NCBI GI: 13096546 NCBI Desc: chain a, crystal structure of human class i alpha1,2-mannosidase in complex with kifunensine
  misc_feature (467)..(627): NCBI GI: 13096544 NCBI Desc: chain a, crystal structure of human class i alpha1,2-mannosidase
  misc_feature: Useful for making plants with altered carbohydrate content
  misc_feature: Functional homolog of the protein sequence given in SEQ ID NO 13974
MSGTSGPLPYSMRDVGAGGAYNNAKFRHRSRLKSLATNSSKYRCGKFTVGKFLSLLMVSGLLYLFLHKGSEGIVSSELHGKEVQNKNVRRAPNIRRFWRKPPRLPPRLPPNEIYKNNSLLQQSPSEWTSRQKKVKEAFEHAWSGYQKYAMGYDELMPLSHRGTDGLGGLGATIVDSLDTAIIMGADDVVSEASKWIEDNLMQRISEKGQVNLFETTIRVLGGLLSAYHLSGGHHPGAGDSGVPVTYKKANPERLLEVSKDLADRLLLAFTSSPTAIPLSDVILRDHTAHAAPDGLSSTSEASTLQLEFSYLSKVSGDPKYDREAMKVLEHMHTLPKVEGLVPIYINPSSGQFSGENIRLGSRGDSYYEYLLKVWVQQEEYRDSSLKYLFEMYTEAMRGVKHLLVRKTVPNGLVFVGELPSGQNGGFSPKMDHLVCFLPGTLALGATKGITKRKALESNLLTDEDKENLQLAEDLAKTCVEMYFVTSTGLAPEIAYFHIEGDTEGGPDGGNKSSKYINDIIIKPLDRHNLLRPETVESLFVLYRITEDPKYREWGWQIFQAFEKYTKVDSGGYTSLDDVTSLPPSTRDKMETFFLGETLKYLYLLFDENNTLPLDKYVFNTEAHPLPVMRSAERASHSV

SEQ ID NO: 6979 - DNA, 813 bp, Sorghum bicolor
  misc_feature: Ceres ANNOT ID no. 6071645
  misc_feature: Encodes the peptide sequence at SEQ ID NO 6980
atggcgcagcagcagctgctcctcctccccgcccctcccagaaccttcttgaagcccctctcctctcccttcctctcctccctcccccggcgccacctcgtccccgtctcagcagttcgcgtggcacccgccgtccggcggggcctgctccaatacgcgacgaagcgttcaggtttggttgaagagctggagatcgccagggacaagcaaccgcggagcaggcgcgccaatggcatcttctggatcttgctgctcaatttcggcatctacgtggccgaccacttgctccagatacgacaaataaaatcactgtacctgtatcatgcattccctacatggttccagtttgtgacatcaacattttgccatgccaattggaatcatctttcaagcaatttattctttgtgtatatctttggaaaacttgttgaggaggaagagggtaactttgctctgtggatgtcttacattttgactggtgctggggcgaacttgatttcatggttggttcttccaacatcctctgtgtcacttggagcatctggtgctgtttttggccttttcaccattagtgttctagttaagatgtcatgggattggagaaagattcttgaggtgcttatcctgggacaatttgttgttgacaaggtcatggaagcagcacgtgcaacaacaatcacagggcaatcgtttcaagtgaacaacattgctcatgtatcaggtgctttgataggtgctgcgttggtgtttctggtcagcagaatccctttttcatccaatgatgataatcccaaggcaacaaaaagagagtaa

SEQ ID NO: 6980 - protein, 270 aa, Sorghum bicolor
  misc_feature: Ceres ANNOT ID no. 6071645
  misc_feature (106)..(257): Pfam Id: Rhomboid Pfam Desc: Rhomboid family
  misc_feature (77)..(251): NCBI GI: 57637732 NCBI Desc: rhomboid family protein [staphylococcus epidermidis rp62a]
  misc_feature (77)..(252): NCBI GI: 88195357 NCBI Desc: rhomboid family protein [staphylococcus aureus subsp. aureus nctc 8325]
  misc_feature (80)..(213): NCBI GI: 119513449 NCBI Desc: rhomboid-like protein [nodularia spumigena ccy9414]
  misc_feature (77)..(252): NCBI GI: 87160848 NCBI Desc: peptidase, rhomboid family [staphylococcus aureus subsp. aureus usa300]
  misc_feature (77)..(252): NCBI GI: 82751152 NCBI Desc: probable membrane protein [staphylococcus aureus rf122]
MAQQQLLLLPAPPRTFLKPLSSPFLSSLPRRHLVPVSAVRVAPAVRRGLLQYATKRSGLVEELEIARDKQPRSRRANGIFWILLLNFGIYVADHLLQIRQIKSLYLYHAFPTWFQFVTSTFCHANWNHLSSNLFFVYIFGKLVEEEEGNFALWMSYILTGAGANLISWLVLPTSSVSLGASGAVFGLFTISVLVKMSWDWRKILEVLILGQFVVDKVMEAARATTITGQSFQVNNIAHVSGALIGAALVFLVSRIPFSSNDDNPKATKRE

SEQ ID NO: 6981 - DNA, 471 bp, Sorghum bicolor
  misc_feature: Ceres ANNOT ID no. 6071866
  misc_feature: Encodes the peptide sequence at SEQ ID NO 6982
atggcttctagggctaggcttttcaaagagtataaggaggtacagagagagaaatcagctgatcctgatatccagttgatttgtgatgattcaaacatattcaaatggactgctctcatcaagggaccctcagagactccttatgaaggtggtgtcttccagcttgcctttgctatcccggagcaatatcctctactacctccccaagttcgatttctgaccaaaattttccacccaaacgtgcatttcaagactggtgaaatttgcttggatatcttgaagaatgcatggagccctgcatggaccctccaatctgtttgtagggctataattgcattgatggctcatccagagccagacagtccacttaactgtgactcaggcaatcttctacgatccggtgacatcagaggctttcaatcgatggcaaaaatgtatacaaaacttgctgcaatgccaaagaaaagctaa

SEQ ID NO: 6982 - protein, 156 aa, Sorghum bicolor
  misc_feature: Ceres ANNOT ID no. 6071866
  misc_feature (6)..(147): Pfam Id: UQ_con Pfam Desc: Ubiquitin-conjugating enzyme
  misc_feature (6)..(152): NCBI GI: 34391431 NCBI Desc: ubiquitin-conjugating enzyme e2 [pavlova lutheri]
  misc_feature (3)..(147): NCBI GI: 84995670 NCBI Desc: ubiquitin-conjugating enzyme e2 [theileria annulata strain ankara]
  misc_feature (30)..(152): NCBI GI: 83317370 NCBI Desc: ubiquitin-conjugating enzyme e2 [plasmodium yoelii yoelii str. 17xnl]
  misc_feature (30)..(152): NCBI GI: 23491070 NCBI Desc: probable ubiquitin-conjugating enzyme e2-17 kda [plasmodium yoelii yoelii]
  misc_feature (3)..(154): NCBI GI: 89304667 NCBI Desc: ubiquitin-conjugating enzyme family protein [tetrahymena thermophila sb210]
  misc_feature: The sequence is a functional homolog of SEQ ID NO. 431 in the 11/188,298 US application
MASRARLFKEYKEVQREKSADPDIQLICDDSNIFKWTALIKGPSETPYEGGVFQLAFAIPEQYPLLPPQVRFLTKIFHPNVHFKTGEICLDILKNAWSPAWTLQSVCRAIIALMAHPEPDSPLNCDSGNLLRSGDIRGFQSMAKMYTKLAAMPKKS

SEQ ID NO: 6983 - DNA, 1080 bp, Sorghum bicolor
  misc_feature: Ceres ANNOT ID no. 6071873
  misc_feature: Encodes the peptide sequence at SEQ ID NO 6984
atgttgggcatgcgccggatgttttccggcatctcgctgcatctgcagcagctgctgctgctcctcgcggtgtgttgctccacaggcgtcgtcgtccgtgctgccgtccagcagagcacggcgaggtccatccagatggtaaaccggtgtgggccgttcctcggcgtcgtcgtgcccaacgccttcgagatggaaccgctgctgcagtcgcccagtttctcgccggcgaaaggtctgccgccttacctcgacgtcgcaggaaggagatttcgctttggcatcatcagggagcagaaggttgtcattgtcatgacaggccttgccatgctcaactccggggtgaccacccaactcctcctcactctcttcgacgtgaagggaatcgtgcacttcggcatcgccgggaacgctgaccctaaccgacagattggcgatgtcgctgtgccacggtactgggctcacaccggcctttggaactggcagcgctatggcgatggaccagacaaggagctcgccttggaatccaacggtgactacaccaggaaactcggcaagctcaacttcacagactacagcgttgacaagaacgcccgcggctccgacggcaacctgctcaacagcgtgtggtaccaaccggaggaggtgttcccagtgaacggcacgcccgaggtccgcggacacgagttctgggtccccgtcgatggctactactacgacctcttgcggaagctggaggggctcaagcttgaaggctgcgtcaacggcacaaacaacacgacgtgcctgcctcggccgccggtggtcgccatggtggagcacgggtgcagcgccagcgtgttcgtcgacaacgccgcgtaccgggagttcctgagatccaggctcggcgtcacggccattgacatggagacggccgctgtcgcgcttgtggcgctgcagcagggggcaccgttcatcgcaataagggcgctctccgacctagccggcggtggctcggcacagtctaacgaagcaggagtgttcgcgccactggcggcccagaacgcggtgacggtggccgtcgaattcatatccctcttataa

SEQ ID NO: 6984 - protein, 359 aa, Sorghum bicolor
  misc_feature: Ceres ANNOT ID no. 6071873
  misc_feature (18)..(359): NCBI GI: 145348229 NCBI Desc: catalytic [arabidopsis thaliana]
  misc_feature (64)..(359): NCBI GI: 115435464 NCBI Desc: os01g0229800 [oryza sativa (japonica cultivar-group)]
  misc_feature (174)..(359): NCBI GI: 12658404 NCBI Desc: vegetative storage protein pni288 [populus balsamifera subsp. trichocarpa x populus deltoides]
  misc_feature (34)..(293): NCBI GI: 55776199 NCBI Desc: bark protein-like protein [thuja occidentalis]
  misc_feature (230)..(359): NCBI GI: 16126505 NCBI Desc: phosphorylase family protein [caulobacter crescentus cb15]
MLGMRRMFSGISLHLQQLLLLLAVCCSTGVVVRAAVQQSTARSIQMVNRCGPFLGVVVPNAFEMEPLLQSPSFSPAKGLPPYLDVAGRRFRFGIIREQKVVIVMTGLAMLNSGVTTQLLLTLFDVKGIVHFGIAGNADPNRQIGDVAVPRYWAHTGLWNWQRYGDGPDKELALESNGDYTRKLGKLNFTDYSVDKNARGSDGNLLNSVWYQPEEVFPVNGTPEVRGHEFWVPVDGYYYDLLRKLEGLKLEGCVNGTNNTTCLPRPPVVAMVEHGCSASVFVDNAAYREFLRSRLGVTAIDMETAAVALVALQQGAPFIAIRALSDLAGGGSAQSNEAGVFAPLAAQNAVTVAVEFISLL

SEQ ID NO: 6985 - DNA, 750 bp, Sorghum bicolor
  misc_feature: Ceres ANNOT ID no. 6072030
  misc_feature: Encodes the peptide sequence at SEQ ID NO 6986
atgtcgcccccactcgagctcgactacataggcctctcgccgcagccggccgccgccgccgccgccgccgatgccgacgacgacctgaagggtaccgagctccgcctcggtctgccagggtccgggtcgccggaccgccgtgtcgcggctgccaccgctaccaccctggagctgctcccggccaagggcgccaagcgcgggttttctgacgaggcgcccccgccatctcccgctgccgctgccgggaagggaaagaaggtggcggaagaggaggacgacgacaagaaggttgcagcgacgccgcagccggccgcaaaagctcaggtggtgggatggccaccaatccgcagctaccgcaagaacacgatggctaccacccagctgaagggtagcaaggaggatactgaggccaagcagggccagggattcctgtacgtcaaggtcagcatggatggcgcgccgtacctgaggaagattgacctcaagacttacaagaactacaaggacctgtctactgcgcttgagaagatgttcagtggcttcagtactggcaaggatggcttatctgagtaccgcaaggatggtgaatatgttttgacttatgaggacaaggatggagattggatgcttgtcggcgatgtaccatgggagatgttcgctgactcttgccgcaggctcaggatcatgaaaggatcagatgcaattggacttgctccaagggcagctgataagtccaagaaccgcaactag

SEQ ID NO: 6986 - protein, 249 aa, Sorghum bicolor
  misc_feature: Ceres ANNOT ID no. 6072030
  misc_feature (28)..(241): Pfam Id: AUX_IAA Pfam Desc: AUX/IAA family
  misc_feature (1)..(249): NCBI GI: 75226278 NCBI Desc: auxin-responsive protein iaa17 (indoleacetic acid-induced protein 17)
  misc_feature (1)..(249): NCBI GI: 75251160 NCBI Desc: auxin-responsive protein iaa3 (indoleacetic acid-induced protein 3)
  misc_feature (103)..(249): NCBI GI: 92872146 NCBI Desc: aux/iaa protein [medicago truncatula]
  misc_feature (103)..(249): NCBI GI: 29465672 NCBI Desc: aux/iaa protein [vitis vinifera]
  misc_feature (58)..(249): NCBI GI: 6136832 NCBI Desc: aux/iaa protein [cucumis sativus]
  misc_feature: The sequence is a functional homolog of SEQ ID NO 1149 in the 10/412,699US patent application
  misc_feature: The sequence is a functional homolog of SEQ ID NO 290 in the 10/412,699US patent application
  misc_feature: The sequence is a functional homolog of SEQ ID NO 656 in the 11/479,226US patent application
  misc_feature: The sequence is a functional homolog of SEQ ID NO 660 in the 10/666,642US patent application
  misc_feature: The sequence is a functional homolog of SEQ ID NO 671 in the 11/479,226US patent application
  misc_feature: The sequence is a functional homolog of SEQ ID NO 674 in the 11/479,226US patent application
  misc_feature: The sequence is a functional homolog of SEQ ID NO 736 in the 10/374,780US patent application
  misc_feature: The sequence is a functional homolog of SEQ ID NO 737 in the 10/374,780US patent application
  misc_feature: The sequence is a functional homolog of SEQ ID NO 738 in the 10/374,780US patent application
  misc_feature: The sequence is a functional homolog of SEQ ID NO 739 in the 10/374,780US patent application
  misc_feature: The sequence is a functional homolog of SEQ ID NO 742 in the 10/374,780US patent application
  misc_feature: The sequence is a functional homolog of SEQ ID NO 890 in the 10/412,699US patent application
  misc_feature: Useful for making plants with modulated growth and phenotype characteristics
  misc_feature: The sequence is a functional homolog of SEQ ID NO 1149 in the 20040045049 US patent application
  misc_feature: The sequence is a functional homolog of SEQ ID NO 290 in the 20040045049 US patent application
  misc_feature: The sequence is a functional homolog of SEQ ID NO 890 in the 20040045049 US patent application
  misc_feature: The sequence is a functional homolog of SEQ ID NO 736 in the 20060162006 US patent application
  misc_feature: The sequence is a functional homolog of SEQ ID NO 737 in the 20060162006 US patent application
  misc_feature: The sequence is a functional homolog of SEQ ID NO 738 in the 20060162006 US patent application
  misc_feature: The sequence is a functional homolog of SEQ ID NO 739 in the 20060162006 US patent application
  misc_feature: The sequence is a functional homolog of SEQ ID NO 656 in the 20070022495 US patent application
  misc_feature: The sequence is a functional homolog of SEQ ID NO 671 in the 20070022495 US patent application
  misc_feature: The sequence is a functional homolog of SEQ ID NO 660 in the 20070033671 US patent application
  misc_feature: Useful for making plants with altered alkaloid content
  misc_feature: Functional homolog of the protein sequence given in SEQ ID NO 13611
  misc_feature: The sequence is a functional homolog of SEQ ID NO 2002 in the 10/374,780 US patent application
  misc_feature: The sequence is a functional homolog of SEQ ID NO 644 in the 11/479,226 US patent application
  misc_feature: Useful for making plants with altered terpenoid content
  misc_feature: Functional homolog of the protein sequence given in SEQ ID NO 13610
  misc_feature: The sequence is a functional homolog of SEQ ID NO 648 in the 11/479,226 US patent application
  misc_feature: The sequence is a functional homolog of SEQ ID NO 636 in the 11/479,226 US patent application
  misc_feature: The sequence is a functional homolog of SEQ ID NO 290 in the 10/412,699 US patent application
  misc_feature: The sequence is a functional homolog of SEQ ID NO 674 in the 11/479,226 US patent application
  misc_feature: The sequence is a functional homolog of SEQ ID NO 652 in the 11/479,226 US patent application
  misc_feature: The sequence is a functional homolog of SEQ ID NO 671 in the 11/479,226 US patent application
  misc_feature: The sequence is a functional homolog of SEQ ID NO 656 in the 11/479,226 US patent application
  misc_feature: The sequence is a functional homolog of SEQ ID NO 738 in the 10/374,780 US patent application
  misc_feature: The sequence is a functional homolog of SEQ ID NO 598 in the 10/666,642 US patent application
  misc_feature: The sequence is a functional homolog of SEQ ID NO 904 in the 11/435,388 US patent application
  misc_feature: The sequence is a functional homolog of SEQ ID NO 667 in the 11/479,226 US patent application
MSPPLELDYIGLSPQPAAAAAAADADDDLKGTELRLGLPGSGSPDRRVAAATATTLELLPAKGAKRGFSDEAPPPSPAAAAGKGKKVAEEEDDDKKVAATPQPAAKAQVVGWPPIRSYRKNTMATTQLKGSKEDTEAKQGQGFLYVKVSMDGAPYLRKIDLKTYKNYKDLSTALEKMFSGFSTGKDGLSEYRKDGEYVLTYEDKDGDWMLVGDVPWEMFADSCRRLRIMKGSDAIGLAPRAADKSKNRN

SEQ ID NO: 6987 - DNA, 1017 bp, Sorghum bicolor
  misc_feature: Ceres ANNOT ID no. 6072085
  misc_feature: Encodes the peptide sequence at SEQ ID NO 6988
atggccgtgttgtctcgtggtgagaagcttggtactattgtttgtgttctggcacatgtatcgttattggtgctcgtgctagctccctgtgtgtgcaaggcgactggtgacaactacggcggcggcctctccgacgaccactacagggagtcctgcccggagctggagatcatcaccaagaagtccctggcgccgatcttcgccgtggacatcacctcgccggccgccctcctccgcctgctcttccacgactgccaagtccatggatgtgacggctccatattgctcagctccgacgagcgccggcacacgacctcggagctggactcacgcaagaaccacggcatccggcacgtcggcacgatcgggctcgtgaaggcggccgtggaagcggcctgccccggcctggtgtcctgcgccgacatcgtcgtcctggcggcgagggaggccgtggcgcacgccggcgggccgcgcatcgccagcgtgccccttggccggagggacgccaccactaccagcacgcaggccgccgatgcgcagcttccgtcctgtttcctcgggattgacggcgcgctcgacatctttaccagccacggcatgaccgtcgaggagacagtcgccattctaggaagccacacgctggggggtggccactgcatcagcatagacagcggccgcgagtggcgtgacaaggctttccaggccctggtgtatctgcagtgccccaagatcgtgccgccactgatcacagaggccgtcgttgtgtccagcgacctgacgccgacatggttcgacacccactactactggggcgccgccgcaggccgtgggctcttcaacgtcgacgccgaggcttccaccgacgcgcgcacggcggcctacgtgaggaagtttgctcacgacagggagggcttcttcggggtctttgcctcggcgttcgtgaagctcgctgggtttggcgtgctcaccggtgaggagggtgagatcaggaaggagtgtcatgtcgtcaactactga

SEQ ID NO: 6988 - protein, 338 aa, Sorghum bicolor
  misc_feature: Ceres ANNOT ID no. 6072085
  misc_feature (59)..(301): Pfam Id: peroxidase Pfam Desc: Peroxidase
  misc_feature (26)..(337): NCBI GI: 7670031 NCBI Desc: peroxidase-like protein [arabidopsis thaliana]
  misc_feature (18)..(337): NCBI GI: 23821326 NCBI Desc: peroxidase 1 [marchantia polymorpha]
  misc_feature (42)..(337): NCBI GI: 55057256 NCBI Desc: peroxidase [picea abies]
  misc_feature (17)..(337): NCBI GI: 55701027 NCBI Desc: tpa: class iii peroxidase 80 precursor [oryza sativa (japonica cultivar-group)]
  misc_feature (42)..(337): NCBI GI: 1781322 NCBI Desc: peroxidase [spinacia oleracea]
  misc_feature: Useful for making plants with altered cell wall content and/or composition
  misc_feature: GREAT-hit functional homolog of the protein sequence encoded by LOCUS at3g17070
  misc_feature: Functional homolog of the protein sequence encoded by LOCUS at3g42570
MAVLSRGEKLGTIVCVLAHVSLLVLVLAPCVCKATGDNYGGGLSDDHYRESCPELEIITKKSLAPIFAVDITSPAALLRLLFHDCQVHGCDGSILLSSDERRHTTSELDSRKNHGIRHVGTIGLVKAAVEAACPGLVSCADIVVLAAREAVAHAGGPRIASVPLGRRDATTTSTQAADAQLPSCFLGIDGALDIFTSHGMTVEETVAILGSHTLGGGHCISIDSGREWRDKAFQALVYLQCPKIVPPLITEAVVVSSDLTPTWFDTHYYWGAAAGRGLFNVDAEASTDARTAAYVRKFAHDREGFFGVFASAFVKLAGFGVLTGEEGEIRKECHVVNY

SEQ ID NO: 6989 - DNA, 1383 bp, Sorghum bicolor
  misc_feature: Ceres ANNOT ID no. 6072087
  misc_feature: Encodes the peptide sequence at SEQ ID NO 6990
atggacgccgcagggtacccacacatgcaggggagcgggtccgccgcctcctcgtcctgccgcgccgccgactattccgccgggtgggactccgcgcagcagcagaagcgccagcgctgccagggttcttcttctaatgatcaagttggatctagcacagagaataattctcttgaagcacctggatctgagctaaaatatgactatggaaaaaatgaggaagaagattactattttgaagatgaagatgatgggtgctatgatgaggatgatgagggatctgactatgagcttgagactgctgactataatcaactgctagctgataaatttgatcatttagacctgcctccaggtgtggaggctgcagtaccatggttgcagaaagttgaaagggatgggcctggaaaattcaagtcaatgtcagaaatagaggaggaaattgcaaagaagtataattttttcaagcagtttgataccgttgaggactttatagatcataagtatgctaaaatttctgtcggaaatgcaaggaaagaatgggcaaaaagaatccagcatgaatggagtctcctggagaaagatttaccagcattaatatatgtccgtgcctcggaaaatcgaatggaccttctcagggctgtaatgattgggcctcaaggaactccctaccatgatggccttttcttctttgatgcccacttccccccttcttatcctgctattcccccagtggtacattatcatgcaggtgggctaaggcttaatccaaatctatatgcttgtggaaaagtctgtcttagcctcctagggacctggcagggtcaatcttgtgagaaatggaacccagcacaatcaacaatgcttcaggtgctaatctccattcaagctcttgtattgaatgagaagccattctataatgagcctggatatgaacgctatgccaatagtgctgagggactggcttatgccttggactataatgatacagcatttcagtactcatgcaggacaatgttatactcacttcgtaaacctccacagcactttgaagaccttgtcgcgggccacttccgtgaacgcggccatgccattttggctgcatgcaaatactacatggagggccatgaagttggatccaaagtcccagaggaggacgaggataccaaagggtgtcaaaatggggaaggatccagcagtagcaccacggcaaagccgcaacaaaataagcctgcattgcgcaccaatcgcaatcgcaatgcatccttcaaaaccaacctgggggttctgtttgaggagctcttgatggagttcaatgtgaagggtgccaacactgcaagattccgtgcggagaaattgaagaaccagctggcagctgcttga

SEQ ID NO: 6990 - protein, 460 aa, Sorghum bicolor
  misc_feature: Ceres ANNOT ID no. 6072087
  misc_feature (184)..(324): Pfam Id: UQ_con Pfam Desc: Ubiquitin-conjugating enzyme
  misc_feature (1)..(460): NCBI GI: 115462765 NCBI Desc: os05g0232500 [oryza sativa (japonica cultivar-group)]
  misc_feature (5)..(459): NCBI GI: 56783934 NCBI Desc: ubiquitin-conjugating enzyme -like [oryza sativa (japonica cultivar-group)]
  misc_feature (118)..(398): NCBI GI: 50726452 NCBI Desc: ubiquitin-conjugating enzyme-like protein [oryza sativa (japonica cultivar-group)]
  misc_feature (72)..(362): NCBI GI: 55783585 NCBI Desc: ubiquitin-conjugating enzyme e2 [zea mays]
  misc_feature (125)..(392): NCBI GI: 92881363 NCBI Desc: ubiquitin-conjugating enzyme, e2 [medicago truncatula]
MDAAGYPHMQGSGSAASSSCRAADYSAGWDSAQQQKRQRCQGSSSNDQVGSSTENNSLEAPGSELKYDYGKNEEEDYYFEDEDDGCYDEDDEGSDYELETADYNQLLADKFDHLDLPPGVEAAVPWLQKVERDGPGKFKSMSEIEEEIAKKYNFFKQFDTVEDFIDHKYAKISVGNARKEWAKRIQHEWSLLEKDLPALIYVRASENRMDLLRAVMIGPQGTPYHDGLFFFDAHFPPSYPAIPPVVHYHAGGLRLNPNLYACGKVCLSLLGTWQGQSCEKWNPAQSTMLQVLISIQALVLNEKPFYNEPGYERYANSAEGLAYALDYNDTAFQYSCRTMLYSLRKPPQHFEDLVAGHFRERGHAILAACKYYMEGHEVGSKVPEEDEDTKGCQNGEGSSSSTTAKPQQNKPALRTNRNRNASFKTNLGVLFEELLMEFNVKGANTARFRAEKLKNQLAAA

SEQ ID NO: 6991 - DNA, 2496 bp, Sorghum bicolor
  misc_feature: Ceres ANNOT ID no. 6072119
  misc_feature: Encodes the peptide sequence at SEQ ID NO 6992
atggaggcgttcagtgggttctacgtggacgagaaggcggcgcgggtggagaacatcttcctcgagttcctgaagcgattcaaggagtcggatggcgcgggggagccgttctacgaggtggagatggaggcgatgcggtcgcgggagtccactaccatgtacgtagactttgagcacgtcatgcgcttcaacgacgtcctccagaaggccatctccgaggagtacctcaggtttgaaccatgcttaaggaatgcatgcaagaggtttgtgttggagcaccgggctggcgagaaccgtgccccaatcatctcagatgatagtcccaacaaggatatcaacattgccttctataacatcccgatgctgaaaaaactgagagagcttgggacagccgaaattggtaagctcacagcagtaatgggtgttgtgacacggacaagtgaagtgcggcctgaactattgcaaggcaccttcaaatgccttgactgtgggaatgttgtaaagaatgtggagcagcagttcaagtacactgagccgataatatgcgttaatgcaacttgccagaaccgaacaaaatgggcccttctccgccaggaaagcaaattcacagattggcagcgggtcagaatgcaggagacatcaaaagagatacctgctgggtcgcttcctcgttcccttgatgtcattctgcggcatgagattgttgagaaggctagagctggggacacggttatatttactggaactgttgttgcagttcctgatgttatggcactaacttcacctggtgaacgagcagagtgtcgcagggaaggtcctcagcgaaaaaatggaggtgttcaagaaggtgtaaagggcttgaagtcccttggagttagggatctctcttatcgcctcgcttttgtagcaaattcagtgcaggtcgcagatggcaggagagaagtggacatcagggatcgtgacacagatggcgatgacagtgagagacagaaattcacagaagaagaggaagatgaggttgttaggatgaggaacactcctgatttctttaataagatagttgatagcatatgccctaccgtctttggtcatcaagaaattaagagggcagtgcttcttatgcttttgggtggtgttcataagataacacatgaagggatcaacctgagaggtgacatcaatgtctgtattgttggcgacccaagctgtgcaaagtcccagtttctaaagtatactgctggtattgttccaagatctgtttacacatcagggaagtcgtcatctgctgctggtctgacagcaactgttgctaaagaaccagagactggtgaattctgtattgaggctggtgccctgatgttagctgataatggcatttgttgtatcgatgaatttgataaaatggacattaaggatcaggtcgctatacatgaagcaatggaacagcaaacaattagcataaccaaagcaggaatacaggcaactttgaatgcacgaacatcaattttagctgcagcaaatccgacaggtggccgttatgacaagtcaaaaccacttaagtacaatgtggcattgcccccagctattctttcaagatttgatctggtctacatcatgattgatgaacctgatgaaaacactgactaccacattgctcatcacattgtaagagtccatcagaaacgtgaagaagcacttgcccctgcatttagcacagcacaactgaagcgttatatttcttttgcaaagtctttgaaacctcagctgagttcagaagcaaagaaagttctggtggagtcgtatgttacccttcgtagaggggacagtactcctggaactagggttgcttacaggatgacagttcgacaattggaagcattgattcggctgtccgaagctattgctcgaagccatttagaaagagttgttctcccagctcatgtctgcctggcagttaaattgctcaagacatccatcatcagtgttgaatcaagtgaagttgatctctctgacttccaagatgctgaagatggaacaaatgtaccttctgagaatgatgctggacagccagctgaagaagatactgctcctcagcagcagggtgcagaaaatgaccaagcagcggacagcggtaagaagaaattggtaataactgaagaacacttccagagagttactcaagctttggttatgagactaaggcagcatgaagagtcagtcaagaaagatggcgatggtttggctggcatgaagcaaggggatcttatcatttggtatgttgagcagcagaatgccaaaggggcatatagttctacagcagaggtgaaggaagaagtgaagtgtatcaaggccattatagagagacttatacagcgggaaggccatcttatagtcattgatgaaggcacagcagccccagccgaagatggcagtggcgtaagaagaacatcagagagcagaatattggcagttaacccgaactatgttgttgattag

SEQ ID NO: 6992 - protein, 831 aa, Sorghum bicolor
  misc_feature: Ceres ANNOT ID no. 6072119
  misc_feature (336)..(660): Pfam Id: MCM Pfam Desc: MCM2/3/5 family
  misc_feature (1)..(831): NCBI GI: 57639342 NCBI Desc: minichromosome maintenance protein [zea mays]
  misc_feature (1)..(831): NCBI GI: 68236762 NCBI Desc: mini-chromosome maintenance protein mcm6 [pisum sativum]
  misc_feature (1)..(831): NCBI GI: 22327575 NCBI Desc: minichromosome maintenance family protein / mcm family protein [arabidopsis thaliana]
  misc_feature (35)..(744): NCBI GI: 6983768 NCBI Desc: mis5 [schizosaccharomyces pombe]
  misc_feature (35)..(744): NCBI GI: 19113406 NCBI Desc: mis5 protein [schizosaccharomyces pombe]
MEAFSGFYVDEKAARVENIFLEFLKRFKESDGAGEPFYEVEMEAMRSRESTTMYVDFEHVMRFNDVLQKAISEEYLRFEPCLRNACKRFVLEHRAGENRAPIISDDSPNKDINIAFYNIPMLKKLRELGTAEIGKLTAVMGVVTRTSEVRPELLQGTFKCLDCGNVVKNVEQQFKYTEPIICVNATCQNRTKWALLRQESKFTDWQRVRMQETSKEIPAGSLPRSLDVILRHEIVEKARAGDTVIFTGTVVAVPDVMALTSPGERAECRREGPQRKNGGVQEGVKGLKSLGVRDLSYRLAFVANSVQVADGRREVDIRDRDTDGDDSERQKFTEEEEDEVVRMRNTPDFFNKIVDSICPTVFGHQEIKRAVLLMLLGGVHKITHEGINLRGDINVCIVGDPSCAKSQFLKYTAGIVPRSVYTSGKSSSAAGLTATVAKEPETGEFCIEAGALMLADNGICCIDEFDKMDIKDQVAIHEAMEQQTISITKAGIQATLNARTSILAAANPTGGRYDKSKPLKYNVALPPAILSRFDLVYIMIDEPDENTDYHIAHHIVRVHQKREEALAPAFSTAQLKRYISFAKSLKPQLSSEAKKVLVESYVTLRRGDSTPGTRVAYRMTVRQLEALIRLSEAIARSHLERVVLPAHVCLAVKLLKTSIISVESSEVDLSDFQDAEDGTNVPSENDAGQPAEEDTAPQQQGAENDQAADSGKKKLVITEEHFQRVTQALVMRLRQHEESVKKDGDGLAGMKQGDLIIWYVEQQNAKGAYSSTAEVKEEVKCIKAIIERLIQREGHLIVIDEGTAAPAEDGSGVRRTSESRILAVNPNYVVD

SEQ ID NO: 6993 - DNA, 2496 bp, Sorghum bicolor; identical to SEQ ID NO: 6991
  misc_feature: Ceres ANNOT ID no. 6072120
  misc_feature: Encodes the peptide sequence at SEQ ID NO 6994

SEQ ID NO: 6994 - protein, 831 aa, Sorghum bicolor; identical to SEQ ID NO: 6992
  misc_feature: Ceres ANNOT ID no. 6072120
  misc_feature (336)..(660): Pfam Id: MCM Pfam Desc: MCM2/3/5 family
  misc_feature (1)..(831): NCBI GI: 57639342 NCBI Desc: minichromosome maintenance protein [zea mays]
  misc_feature (1)..(831): NCBI GI: 68236762 NCBI Desc: mini-chromosome maintenance protein mcm6 [pisum sativum]
  misc_feature (1)..(831): NCBI GI: 22327575 NCBI Desc: minichromosome maintenance family protein / mcm family protein [arabidopsis thaliana]
  misc_feature (35)..(744): NCBI GI: 6983768 NCBI Desc: mis5 [schizosaccharomyces pombe]
  misc_feature (35)..(744): NCBI GI: 19113406 NCBI Desc: mis5 protein [schizosaccharomyces pombe]

SEQ ID NO: 6995 - DNA, 1062 bp, Sorghum bicolor
  misc_feature: Ceres ANNOT ID no. 6072144
  misc_feature: Encodes the peptide sequence at SEQ ID NO 6996
atggacatggacagcgtggagtgcctctccctcccagacgctgccatggacgtggacgacgtcgacggccacccgcaccacggccaccacggccatctcggcctcccgctccaccccgcccacctcccatcctcgggcgccggccgcgcgttccccaaggtgaatgccgggggcggcggggcgggaccggcgggagcgggtgcggcgggggcagcgggcgcagcgggagcaggcggggggccaccggcgaccagcgttcacgagctgctcgagtgccccgtctgcaccaactccatgttcccgcccatccatcagtgtcaaaatggacatactttgtgttcgacatgcaaggccagggtgcacaaccggtgccctacatgcagacaagagcttggtgatatcaggtgcttagcattggaaaaggtagcagagtcacttgagcttccctgtaagtactgctctttaggttgcccagagatcttcccatactacagcaagataaagcatgaagcgcagtgcagcttcaggccatataactgcccctacgctggctctgaatgtgctgtggctggtgatattccattccttgttgcacatttgagggatgatcacaaagttgacatgcacagtggctgcacattcaaccatagatacgtcaaatccaacccgcgcgaggttgaaaatgccacctggatgctaacagtattccattgttttgggcagtacttctgcctgcactttgaggcattccagctcgcaatggctccagtgtatatggctttcctccgattcatgggtgatgagaatgaagcaaggaactatacatatagcctagaggttggtggtaatgggaggaaaatggtatgggaaggtactcctagaagcatccgtgacagccaccgcaaggtccgtgacagccatgatggcctcatcatccagaggaatatggcgctgttcttctcaggcggtgacaggaaggagctgaagctgagggtgactgggcggatctggaaagagcagaccaacccggatggagcctgcattcctaacctttgcagctga

SEQ ID NO: 6996 - protein, 353 aa, Sorghum bicolor
  misc_feature: Ceres ANNOT ID no. 6072144
  misc_feature (134)..(333): Pfam Id: Sina Pfam Desc: Seven in absentia protein family
  misc_feature (66)..(353): NCBI GI: 92883480 NCBI Desc: zinc finger, ring-type; seven in absentia protein [medicago truncatula]
  misc_feature (67)..(353): NCBI GI: 92873199 NCBI Desc: zinc finger, ring-type; seven in absentia protein [medicago truncatula]
  misc_feature (74)..(351): NCBI GI: 21536945 NCBI Desc: seven in absentia-like protein [arabidopsis thaliana]
  misc_feature (83)..(353): NCBI GI: 63095207 NCBI Desc: sina [phyllostachys praecox]
  misc_feature (74)..(351): NCBI GI: 6850870 NCBI Desc: seven in absentia-like protein [arabidopsis thaliana]
MDMDSVECLSLPDAAMDVDDVDGHPHHGHHGHLGLPLHPAHLPSSGAGRAFPKVNAGGGGAGPAGAGAAGAAGAAGAGGGPPATSVHELLECPVCTNSMFPPIHQCQNGHTLCSTCKARVHNRCPTCRQELGDIRCLALEKVAESLELPCKYCSLGCPEIFPYYSKIKHEAQCSFRPYNCPYAGSECAVAGDIPFLVAHLRDDHKVDMHSGCTFNHRYVKSNPREVENATWMLTVFHCFGQYFCLHFEAFQLAMAPVYMAFLRFMGDENEARNYTYSLEVGGNGRKMVWEGTPRSIRDSHRKVRDSHDGLIIQRNMALFFSGGDRKELKLRVTGRIWKEQTNPDGACIPNLCS

SEQ ID NO: 6997 - DNA, 1764 bp, Sorghum bicolor
  misc_feature: Ceres ANNOT ID no. 6072159
  misc_feature: Encodes the peptide sequence at SEQ ID NO 6998
atgaagacagaggtcgaggaggtaagcattggacagttctggactgaggaagacaaagccctctgttcttccgtgctgggctcggatgccttcacatatctaacaaaatgtggtggtgccatatctgaaggtcttgtagcagcatctgtgttggcagatttgcaaaataaactccagaacctagttgaggctgatgatcagagcattcgttgggactatgccatcttctggcagctctcccgcacaaaatctggtgctattgtccttggctggggtgatggatcttgccgtgaaccccatgatagtgagattggctttgctacatctatgagtgttgatgatgcatctttggtgaccagacagaagatgcggaagcgggtgctgcagaggttgcacacagcatttgctggggctgacgaggaggattacgctcctggaattgaccaggtcactaacactgaaatattctttctagcatctatgtattttgcgtttccacgtcacgttggtggtcctgggaaagtttttggtgcagaggcacctctttggattccaaacaataagcacaatgtttccccagcaaattattgttaccggggattccttgcaaatgcagcgggattcaagaccattgtgctagtgccattcaaagctggtgtacttgaggtaggttcaatgcagaatgtacctgagagtgctgaagctctgcaaactataaggtcaatgtttcttgggacatgcagtgacaggatagcaattgagaagcatgaggatagtagttctgttcaaatatcgccaggtttgacaaagatttttgggaaggatttgagtatcagacaaccttcagacagcaaaggagctgatccatcaaaggtggatgaaagttcaatgattgcacagaagagtggtggtggtgagagcaggttgctacctaatctccggaaaggtttgcagaatttctcatggagtcagtctcgaggcctgagttctgatcagcagaagtttggcaatggtatcttagttgagacaagcgagactgcaaattgcagcaatggagcttctcatagcaccacagtgagcccatttcagcttcagaatccacagcagatcttggcccaacaagcatctcagccccgagggccaatgcaaattgattttcgtgtaggttccagttccaagtttggtgttttgatttctcaaaaagccatgttggatgtggataagggcaatgccaatgacttgttcgatgaggaaagggagggtcgacagccaaggaagagggaaaggaaaccaacaaacgggagagaggaaccaccgcttagccatgttgaggctgagcgtcagagaagggaaaagctcaacaagcgattctgtgctctgagagctattgtgcccaacatctcaaaaatggataaggcatccattctggaagatgctgtaatgcatatcggtgatctcaagaagaaactggaaaagttggaggcagagcgggatcaacttccagagcaaacacctgggccagaagtggacatccaggtggtgcaaggcgagattcttgttcgagcggtatctcagattgaaaaccatccaatacaaaaggtgctccaagcatttgaagatgcagaggtcaaagtaggtgagtcaaaggtcacagccaacaatgggacagttgtgcattcctttgttatcaagtcccctggctctgaacagcatacacgaaagaaattgcttgcctctatttctaatgcaactagcgctgtgtag

SEQ ID NO: 6998 - protein, 587 aa, Sorghum bicolor
  misc_feature: Ceres ANNOT ID no. 6072159
  misc_feature (438)..(487): Pfam Id: HLH Pfam Desc: Helix-loop-helix DNA-binding domain
  misc_feature (1)..(438): NCBI GI: 115435532 NCBI Desc: os01g0235700 [oryza sativa (japonica cultivar-group)]
  misc_feature (14)..(277): NCBI GI: 20453066 NCBI Desc: at2g46510/f13a10.4 [arabidopsis thaliana]
  misc_feature (363)..(574): NCBI GI: 51572284 NCBI Desc: bhlh transcription factor [oryza sativa (japonica cultivar-group)]
  misc_feature (361)..(556): NCBI GI: 51702428 NCBI Desc: bhlh transcription factor [triticum aestivum]
  misc_feature (404)..(585): NCBI GI: 56784918 NCBI Desc: bhlh protein-like [oryza sativa (japonica cultivar-group)]
  misc_feature: The sequence is a functional homolog of SEQ ID NO 1108 in the 10/225,066US patent application
  misc_feature: The sequence is a functional homolog of SEQ ID NO 1177 in the 11/479,226US patent application
  misc_feature: The sequence is a functional homolog of SEQ ID NO 12 in the 10/412,699US patent application
  misc_feature: The sequence is a functional homolog of SEQ ID NO 1238 in the 10/412,699US patent application
  misc_feature: The sequence is a functional homolog of SEQ ID NO 2 in the 10/374,780US patent application
  misc_feature: The sequence is a functional homolog of SEQ ID NO 42 in the 11/375,241US patent application
  misc_feature: The sequence is a functional homolog of SEQ ID NO 464 in the 11/435,388US patent application
  misc_feature: The sequence is a functional homolog of SEQ ID NO 528 in the 10/412,699US patent application
  misc_feature: The sequence is a functional homolog of SEQ ID NO 943 in the 10/374,780US patent application
  misc_feature: The sequence is a functional homolog of SEQ ID NO 955 in the 10/374,780US patent application
  misc_feature: The sequence is a functional homolog of SEQ ID NO 96 in the 10/374,780US patent application
  misc_feature: The sequence is a functional homolog of SEQ ID NO 960 in the 10/374,780US patent application
  misc_feature: Useful for making plants with modulated growth and phenotype characteristics
  misc_feature: The sequence is a functional homolog of SEQ ID NO 12 in the 20040045049 US patent application
  misc_feature: The sequence is a functional homolog of SEQ ID NO 1238 in the 20040045049 US patent application
  misc_feature: The sequence is a functional homolog of SEQ ID NO 528 in the 20040045049 US patent application
  misc_feature: The sequence is a functional homolog of SEQ ID NO 955 in the 20060162006 US patent application
  misc_feature: The sequence is a functional homolog of SEQ ID NO 96 in the 20060162006 US patent application
  misc_feature: The sequence is a functional homolog of SEQ ID NO 960 in the 20060162006 US patent application
  misc_feature: The sequence is a functional homolog of SEQ ID NO. 483 in the 11/188,298 US application
MKTEVEEVSIGQFWTEEDKALCSSVLGSDAFTYLTKCGGAISEGLVAASVLADLQNKLQNLVEADDQSIRWDYAIFWQLSRTKSGAIVLGWGDGSCREPHDSEIGFATSMSVDDASLVTRQKMRKRVLQRLHTAFAGADEEDYAPGIDQVTNTEIFFLASMYFAFPRHVGGPGKVFGAEAPLWIPNNKHNVSPANYCYRGFLANAAGFKTIVLVPFKAGVLEVGSMQNVPESAEALQTIRSMFLGTCSDRIAIEKHEDSSSVQISPGLTKIFGKDLSIRQPSDSKGADPSKVDESSMIAQKSGGGESRLLPNLRKGLQNFSWSQSRGLSSDQQKFGNGILVETSETANCSNGASHSTTVSPFQLQNPQQILAQQASQPRGPMQIDFRVGSSSKFGVLISQKAMLDVDKGNANDLFDEEREGRQPRKRERKPTNGREEPPLSHVEAERQRREKLNKRFCALRAIVPNISKMDKASILEDAVMHIGDLKKKLEKLEAERDQLPEQTPGPEVDIQVVQGEILVRAVSQIENHPIQKVLQAFEDAEVKVGESKVTANNGTVVHSFVIKSPGSEQHTRKKLLASISNATSAV

SEQ ID NO: 6999 - DNA, 2376 bp, Sorghum bicolor
  misc_feature: Ceres ANNOT ID no. 6072213
  misc_feature: Encodes the peptide sequence at SEQ ID NO 7000
atggacaacgcggcggcggaggcgttgaagccgatgaaggcaacgtcggacggcgtgttccagggagagaacccgctacactcggcacttccgctcgccatcctgcaaatttgcattgtcgtcgtgctcacccgcgtcctcgccttcatcctccgcccgctacgtcagcctcgcgtcgtcgcggagatcatcggcgggattcttcttggtccgtcggcggttggccgcagcaccgcattcctcaacaccgtgttcccgaagcagagcctaacggttcttgataccctcgccaacatcggcctcctctacttcctcttcctggtcggccttgaactggacctccgcgccatacgccgcactgggagcacggcgctcgtgattgctgtcgccgggatctcccttcctttcatcatgggcatcggcacctcctttgtcctccagcacaccgtcgcccgcggcgtgcccacggggccattcctcgtcttcatgggcgtcgcgctctccatcacagcgttcccggtgctggcacgcatcctcgccgagctcaaactgctcaccaccgacatcgggcgcatggccatgtcagctgccgccgtcaacgacgtcgttgcgtggatacttctagccctcgccattgctttgtcaggcagcggctcccctcttgtctcgctatgggtgctgctagcgggagctggcttcgtcctcgcggcgttcttgctgatccgccctgtcctcacctggatggcacggcgatctcccgaaggcgagccagtgaaggagctttacatatgcgcgactctggccatcgtgcttgccgctgggttcgccaccgacaccattggcatccacgcgctctttggcgccttcatcgtcggcatcgtcgttccaaaggacgggcccttcgccggggttctcctggagaaggtggaggacctcatatctgggctattcctgccactctacttcgtgtccagcggcctcaagacgaacgtaatgaccatcaagggtggtgactcgtgggcgctcctcgtcctcgtcgttgccaccgcgtgcataggcaagatcggcggcacggttatcgcgtcgctcatcgtgcgggtgccattccgtgaggcgctcacgctcggcttcctcatgaataccaaggggctcgtggagctcatcgtcctcaacatcggcaaggaccggcacgtgctcaacgacgagacattcgccatcctcgtgctgatggcgctcataacaaccttcatcacgacgccggtggtcatggcgatctacaagccagcacggcgtgggccgccctacaagaaccgcgccgtggagcgcgcgaacccgcacgacgagttccgcatgatggcctgcttccacagcacgcgcaacatccccaccatcatcaacctgatggagtcgtcgcgcggcacgcggaagcgcggcatcaccgtctacgccatgcacctcgtggagctctccgagaggtcgtccgccatctccatggtccacaaagcgcggcgcaacggcatgccgttctggaacaagcgacgcaacggcgacggcgacggcgaccagctcgtcgtcgccttcgagacgtaccagcagctgagccgcgtgtccatccgggccatgacggccatctccgacctgcatacgatccacgaggacgtggtcaccagcgcgcaccagaagcgagccgcgctcatcgtgctcccgttccacaagctccaccagatggacggccacatggagtcgcttggcgaccagtaccagcacatcaaccagcgcgtgctccaccacgcgccctgctccgtaggcatcctcgtcgaccgcggcctaggaggtgctgctcaggtggctgccagcgatgtgtcctacaccatcgttgtcatcttcttcggaggccgcgacgaccgtgaggctctggcctatgccatgcgcatggtcgagcacccaggcatcgggctccatgtgctacgcttctgcttggtacagtccagctccactgacgtcgacgacgacgcgttccttgaagacttccgaaccaaggtggccaacgggaacgattctgtccgttacgaagataagccggcgggagggaaagaggaggtcgtggaggcgatcaaggcaatagggccgtgcaacctgttccttgtcgggcagggcacgccctgcatgccgctgattgactggagcacagactgcccggagctcgggccgctcggtacgtacttggcgttaccagaattctcaacggtagcatctgtgctggtcatgaaacagtacgatcccacggcgaagcactacgacctcgtggaggaggtggccgacatagccgtggacgtcgacacgccggggccccagcaacaggggcaccaacactag

SEQ ID NO: 7000 - protein, 791 aa, Sorghum bicolor
  misc_feature: Ceres ANNOT ID no. 6072213
  misc_feature (37)..(424): Pfam Id: Na_H_Exchanger Pfam Desc: Sodium/hydrogen exchanger family
  misc_feature (3)..(774): NCBI GI: 9294151 NCBI Desc: na+/h+ exchangeing protein-like [arabidopsis thaliana]
  misc_feature (3)..(708): NCBI GI: 61658325 NCBI Desc: cation/h+ exchanger [arabidopsis thaliana]
  misc_feature (45)..(767): NCBI GI: 115489590 NCBI Desc: os12g0616500 [oryza sativa (japonica cultivar-group)]
  misc_feature (11)..(781): NCBI GI: 92870446 NCBI Desc: na+/h+ antiporter-like protein [medicago truncatula]
  misc_feature (11)..(759): NCBI GI: 92870445 NCBI Desc: na+/h+ antiporter-like protein [medicago truncatula]
  misc_feature: Useful for making plants with modulated heat sensitivity
  misc_feature: Functional homolog of the protein sequence encoded by LOCUS at5g41610
  misc_feature: Useful for making plants with modulated heat sensitivity
  misc_feature: Functional homolog of the protein sequence given in SEQ ID NO 13975
  misc_feature: The sequence is a functional homolog of SEQ ID NO. 516 in the 11/188,298 US application
MDNAAAEALKPMKATSDGVFQGENPLHSALPLAILQICIVVVLTRVLAFILRPLRQPRVVAEIIGGILLGPSAVGRSTAFLNTVFPKQSLTVLDTLANIGLLYFLFLVGLELDLRAIRRTGSTALVIAVAGISLPFIMGIGTSFVLQHTVARGVPTGPFLVFMGVALSITAFPVLARILAELKLLTTDIGRMAMSAAAVNDVVAWILLALAIALSGSGSPLVSLWVLLAGAGFVLAAFLLIRPVLTWMARRSPEGEPVKELYICATLAIVLAAGFATDTIGIHALFGAFIVGIVVPKDGPFAGVLLEKVEDLISGLFLPLYFVSSGLKTNVMTIKGGDSWALLVLVVATACIGKIGGTVIASLIVRVPFREALTLGFLMNTKGLVELIVLNIGKDRHVLNDETFAILVLMALITTFITTPVVMAIYKPARRGPPYKNRAVERANPHDEFRMMACFHSTRNIPTIINLMESSRGTRKRGITVYAMHLVELSERSSAISMVHKARRNGMPFWNKRRNGDGDGDQLVVAFETYQQLSRVSIRAMTAISDLHTIHEDVVTSAHQKRAALIVLPFHKLHQMDGHMESLGDQYQHINQRVLHHAPCSVGILVDRGLGGAAQVAASDVSYTIVVIFFGGRDDREALAYAMRMVEHPGIGLHVLRFCLVQSSSTDVDDDAFLEDFRTKVANGNDSVRYEDKPAGGKEEVVEAIKAIGPCNLFLVGQGTPCMPLIDWSTDCPELGPLGTYLALPEFSTVASVLVMKQYDPTAKHYDLVEEVADIAVDVDTPGPQQQGHQH

SEQ ID NO: 7001 - DNA, 747 bp, Sorghum bicolor
  misc_feature: Ceres ANNOT ID no. 6072494
  misc_feature: Encodes the peptide sequence at SEQ ID NO 7002
atgatgtctgagagtgaagagcatggctcgctcctagagaagatcaacgagaagatccacgagtacaagcactcatcatcgtcctcctcttcggactcagatgatgacaagaagccaaagaagactaagaagaagaagaagctattcgggaggaaacattcattgcatcacgttctcggaggaggcaaagccgccgatcttgtgctgtggaggaacaaacaggcatccgggagcatcttggcaggagtcactgtgatctggctactatttgagggcatcggctaccacctccttaccttcctctgccatgcactaattgtgtttctcaccgtctggttcgtctggtccaatgctgcatcctttgtcaacaggtctcctccaaagttcccagaggtcattctatctgaagtccaatgcctgaaggtagctcatattgcaaggaaagaaatcaatgaggctttctatacattgcgcaatgttgcttctggaaaagatttgaaaacatatctgatgacaattgtggtgctgtggttcatttccatagttggaagctgcttcagcttcttgactctgtcttacactattttcctgatggcatacactcttcccatgttgtatgagaagtacgaagatcaagttgatgttgtgggtgaaaaggcccttattgagataaaaaagcagtataaagtgattgatgctaagtttatctctaagatcccaatgttgtctgagaagaaacaacactga

SEQ ID NO: 7002 - protein, 248 aa, Sorghum bicolor
  misc_feature: Ceres ANNOT ID no. 6072494
  misc_feature (64)..(245): Pfam Id: Reticulon Pfam Desc: Reticulon
  misc_feature (1)..(248): NCBI GI: 115463129 NCBI Desc: os05g0312500 [oryza sativa (japonica cultivar-group)]
  misc_feature (2)..(246): NCBI GI: 20160502 NCBI Desc: osjnbb0021a09.5 [oryza sativa (japonica cultivar-group)]
  misc_feature (10)..(245): NCBI GI: 56381963 NCBI Desc: at3g61560 [arabidopsis thaliana]
  misc_feature (13)..(246): NCBI GI: 92874883 NCBI Desc: reticulon [medicago truncatula]
  misc_feature (72)..(246): NCBI GI: 115435410 NCBI Desc: os01g0226300 [oryza sativa (japonica cultivar-group)]
MMSESEEHGSLLEKINEKIHEYKHSSSSSSSDSDDDKKPKKTKKKKKLFGRKHSLHHVLGGGKAADLVLWRNKQASGSILAGVTVIWLLFEGIGYHLLTFLCHALIVFLTVWFVWSNAASFVNRSPPKFPEVILSEVQCLKVAHIARKEINEAFYTLRNVASGKDLKTYLMTIVVLWFISIVGSCFSFLTLSYTIFLMAYTLPMLYEKYEDQVDVVGEKALIEIKKQYKVIDAKFISKIPMLSEKKQH

SEQ ID NO: 7003 - DNA, 813 bp, Sorghum bicolor
  misc_feature: Ceres ANNOT ID no. 6072660
  misc_feature: Encodes the peptide sequence at SEQ ID NO 7004
atgagtaacctcctcaagagcaagagcgacccaaagctgaagaaacaggcgtcgtcttcacatgaacagcaggcaaagataaatgaggtacgggaactcctgggtgacctgcccacagagatgccaggcttcttgacggactccaccatccgccgcttcctccgtactagaaactggagcacggtgcaagcgaccaaggctctgaaagaaactgtcaagtggaggcgtcagtacaggccagacaaaatccgttgggaagacattgctgaaacggagcagttgttgaagaaaatgtatatagctgactacctcgacaagaatgggcgaactgtgtttgtagccatgccgtcaataaagagcttagttccagcgaaggagcaggtaaaactactagtttacaacttggaaagttgtaccatgagctcagaaaatgcacaagaaaatgttgtttgggtagttgatttcagtggatggacagtatcaagtactccattggcggagtcccgtcaatcagtgcatataattcagaactattatccagggttgatagatgttgcaattctttgcaaccctccaaagatgttcgaatccttttggaagatactaaattacttcatcgagccagaggtgaaagagaaagtgaaatttgtctacactaacgattccgagtgccagagaataatggctgacatgtttgacctggacaagctggagtctgcatttggtggctgcaacacctctggtatcgacattgtcaagtattctgagagaatgcaaagaagggatcagactaggaatcttcatattccataa

SEQ ID NO: 7004 - protein, 270 aa, Sorghum bicolor
  misc_feature: Ceres ANNOT ID no. 6072660
  misc_feature (10)..(83): Pfam Id: CRAL_TRIO_N Pfam Desc: CRAL/TRIO, N-terminus
  misc_feature (97)..(271): Pfam Id: CRAL_TRIO Pfam Desc: CRAL/TRIO domain
  misc_feature (19)..(263): NCBI GI: 92893041 NCBI Desc: cellular retinaldehyde-binding/triple function, n-terminal [medicago truncatula]
  misc_feature (7)..(262): NCBI GI: 30687745 NCBI Desc: sec14 cytosolic factor family protein / phosphoglyceride transfer family protein [arabidopsis thaliana]
  misc_feature (22)..(262): NCBI GI: 83283975 NCBI Desc: transporter-like protein [solanum tuberosum]
  misc_feature (18)..(262): NCBI GI: 92868927 NCBI Desc: cellular retinaldehyde-binding/triple function, n-terminal [medicago truncatula]
  misc_feature (68)..(262): NCBI GI: 145334241 NCBI Desc: sec14 cytosolic factor family protein / phosphoglyceride transfer family protein [arabidopsis thaliana]
MSNLLKSKSDPKLKKQASSSHEQQAKINEVRELLGDLPTEMPGFLTDSTIRRFLRTRNWSTVQATKALKETVKWRRQYRPDKIRWEDIAETEQLLKKMYIADYLDKNGRTVFVAMPSIKSLVPAKEQVKLLVYNLESCTMSSENAQENVVWVVDFSGWTVSSTPLAESRQSVHIIQNYYPGLIDVAILCNPPKMFESFWKILNYFIEPEVKEKVKFVYTNDSECQRIMADMFDLDKLESAFGGCNTSGIDIVKYSERMQRRDQTRNLHIP

SEQ ID NO: 7005 - DNA, 1380 bp, Sorghum bicolor; identical to SEQ ID NO: 37
  misc_feature: Ceres ANNOT ID no. 6073270
  misc_feature: Encodes the peptide sequence at SEQ ID NO 7006

SEQ ID NO: 7006 - protein, 459 aa, Sorghum bicolor; identical to SEQ ID NO: 38
  misc_feature: Ceres ANNOT ID no. 6073270
  misc_feature (235)..(459): Pfam Id: 2-oxoacid_dh Pfam Desc: 2-oxoacid dehydrogenases acyltransferase (catalytic domain)
  misc_feature (39)..(112): Pfam Id: Biotin_lipoyl Pfam Desc: Biotin-requiring enzyme
  misc_feature (161)..(199): Pfam Id: E3_binding Pfam Desc: e3 binding domain
  misc_feature (34)..(459): NCBI GI: 9279589 NCBI Desc: dihydrolipoamide s-acetyltransferase [arabidopsis thaliana]
  misc_feature (20)..(458): NCBI GI: 115487664 NCBI Desc: os12g0182200 [oryza sativa (japonica cultivar-group)]
  misc_feature (1)..(458): NCBI GI: 8778253 NCBI Desc: f12k21.24 [arabidopsis thaliana]
  misc_feature (38)..(459): NCBI GI: 22298842 NCBI Desc: dihydrolipoamide s-acetyltransferase [thermosynechococcus elongatus bp-1]
  misc_feature (38)..(459): NCBI GI: 75909383 NCBI Desc: biotin/lipoyl attachment [anabaena variabilis atcc 29413]

SEQ ID NO: 7007 - DNA, 4878 bp, Sorghum bicolor
  misc_feature: Ceres ANNOT ID no. 6073285
  misc_feature: Encodes the peptide sequence at SEQ ID NO 7008
atgggggtgctggagtttgcggcggggaaggccagatcccttgccgccgccactgaccaggagcggcgccacgtgcacaagggcgacctcgcgcggatcgagacgcggcggcgccaggaccaggaggcgggccatggcgtgggcacgcccaaggcccaggaggcggcggcttcgcccgtcgggccgcccacgcccccgcgcagcccgcccgaggcgagatctgggggccaagccgacgccggttcgcgctttcatcctctcggccgtgatattaggcgagtggatgaggaggctgctgacgaacctggggcccagtttctagcctctgcgactgacttcttacaagacttttcagatacagaatctagtgttaattcaatgtacagatcaatgaccccaagccccgcagagagtcctacttgcgtggtgaggttggatgatgcttctgatcctgatgcgacaacattgaccgactcagatgatgcacgggagctagtcagtgctgctagcagtagcagcactggtgagagagaagtcgtcaatgcatcaacacatattgttgattttggtgatgctatttggtgcccaccaccacctgaagatgagagagatgatgttgaatcgaggatattcggatttgacgacgacgacgacgatgctttcctagaacctagttgttttggtgataataaagtagccagtgagtgtggtgcttttggtggatctcaacaaggtggtgttcagaatgatttgctgaagcattttcgggctctggttgcacagttactgaaggcggaaggcattagtttttccagtgatgacaattccaaaagttggcttgagatagtgtcctcattggcttggcaagctgctaactatgtgaaacctgataccaagaaaggtggcagcatggatcctggtgattatgtgaagattaaatgcatagcatctgggaacccaactgatagcaattttgttagaggaattgtttgctctaagaatgtaagacacaaacggatggtctcagaacacaggaatgtcaaattgctcattttaggaggtgcacttgagtaccaaaaagtttcaaataaattggcatctatagggacaatacttgaacaggaaaaggagtatcttagaactgttgttggaaagatcgagtctaggcagcctaatgtccttctagttgagaaaagcgcctcatcttttgctctggagctcttagcaaaagatatttctttggttctgaatgtgaagagacctcttttggaaagaatatcaagatgcacaggtggtcagattgcctcgtcaattgacaacattgcctcagcaaggcttggacattgtgacttgttcaaggtggagaaagtttcggaatccttattagcagaacacggagaaaagggatcaattaagactctgatgttctttgaaggctgtctgaagcgcttgggttgcacggttctgttaaggggaacatgtcgggaagaattaaagaagattaagcgtgcaatgcaacttgcagtctttgctgcttatcacctctccttggagacatcattccttgctgatgagggagcaacacttccgaaaattccttcaatatctgtgacaggtgcaccggatatttctgctagtcctactgatcatggtactcctgatggtcttagaaatgctgaagagacatatccacaaaattctactatcagccagatttttgaggttatttctgcatcttcaactttattaccatttgctggagtaagccaaggaatcacaccggaatgtagagcatccaaatttccagttgatcccctcaactctcaagatctgtccaacttatgccatccaaatgttacctgcaatgccaatttaatatctccatgttctgtcagtgatgacttaagagcaacatgtgctggcacacaacatggtgattcatacaagtctttgcaatcttcaattgctgttgatgtctgtcgtgatggtgcgttaactttgaaaaataaccaaccttgtcattcagaaaaccatagtagcaatccctcactagacgactttccagtaggggatacagatgacaaagacaagctttcagctggttccttatctggtagtgacaacaaccagagcatcttagtttccctctcaagcacttgcattcccaaaagcttggcgtgccagcgttctcacctcctccggatcaagttttatggtagttttgataagccattagggaggtatctccgtgaggacttatttgatcaggcatattgctgcccatcttgtaaggagccttcagaatcacatgtgaggtgctatatgcaccaacatggcagcctaacgattagtgtcaggcgccttcagtctcaaaagttgccaggtgaacatgatgggaggatatggatgtggcatagatgcatgaggtgcaagcttaaggatggaatgccgccagcaacacagagagtaatcatgtctgatgcagcttggggcctatcatttggcaagttcctggagctcagcttttcaaatcatatgactgctaaccggattgcaagctgtgggcattctctccaaagggattgccttcgcttttatgggtatggaaatatggtggccgccttccactatggtcctatgattactctatctgttgaccttccacccccagtgctagatctcaattcccatgccacacaagattgggtgaaaagagaagctgttgaggtatttcacacaatggagttgctgcacaccgaggtatatgatgtccttcataatcttgagaagagtatcatcactgatgatgattcaaccaagacaagcatacaaaggcaaatagttgagatgaaagatttgcttaatgtggaaagaaatgagtatgaggctttgcttcttccagttataatggggagtgctcattcattcaaatcaaatattgatattttggagcttaatcgtattagacgtagtctcctcctagatgctcacacttgggactgcaggttgtgcgacatagattcacttgaagcaaatggccatatttccagaactgatccctttaatcaagagaaaacccaaggaatcaatgaagggagatctgattcacttcagattgttaggaaacacggaggaacatatgaagaaccatgtcctcaacactcttcagaaagcccaaggaaatctctcttgtctacagagggccatgtgaatgataaacaatctgtcatggttgagacagatttgccggttgggctagtggatggtgtttcaggtggtgcaggaggtcttgatttgattttcaacaaatttgacacatgtgaaggacgctgtctatcaaaatatcctagcaagacagagccagtagagaggttaccttcacttgcatctattttagctgacaaaatagatatggcatggtctggatttggtgaattagactgcaatcttccacatgatttgaccaaagcaaacgaaaataggtctttgaacttgttggccaatccaagttacgagaaggctactgccccagtcagaatccattcatttgatactgtgatgagattacatcagcgagaacaaactggagtaatacctgcttcactgcattcagcactgaaatcagttgattcctttagagacttgacaagccttgtcaaggatccaatgacaaatatgcgaagagccttttctcaaatatctcccaggacaagaggaaacttaaatactgttcttatacgtgctcccaagtatatcacatcagcttctcatatggtgaatgatggggctcgactgcttctgcccaatattagctgtggaggttctgtttttgtcactgtctatgatgacgagccgaccagtgcagtgtcatatgctatgacatcgcaagaatatgctgatcatgtcacacataaaatgaacataaatactagcttttcagattttactagcagtaatggacttcatagatctttgtcctcacatgaagacctttcaaattctaaaggaactcacttcagattgtccttcgacgatgatgcatctcctactgatagtacaaagttttctgtcacttgctattttgcaaagcagtttgctgcacttagaaagaaatgctgtccaagtgatattgattacatacgctcgataagtcgttgtaagcgatggagcgcgcaaggtggaaaaagcaatgtttactttgcaaagacaatggatgagagattcataattaaacaagtcaccaagacagagctggactcttttgtagattttgctcctcattacttcaggcacttgacagaatcattgacttctagaagccctacttgcctggccaaaatagtggggctttatcaggttagtatcaagaattcaaaaggtgggcgtgaggtgaagatggatctgatggtgatggagaacatattcttccagagatcaatatctagggtgtatgatctgaagggttctgggcgttcacgctataattctgatgcttctggccacaataaagttcttctagattctaatctcatagaagcactacatacaaagcctatgtttttggggagtaaggcaaaacaaagattggaaagagctgtctggaatgatacatcatttcttgcgtctttggatgtcatggattactcccttttggtcggtgtcgacgaggagaaaaaagagctggtggttggcatcatcgacttcctgcggcagtacacctgggacaagcagctggagacatgggtgaaggcctcggggatcctgggggggcccaagaatgaggcccccaccgtgatttctcctatccagtacaaaaagaggttcaggaaggccatgtcgagatacttcctcgccgtccctgaccaatggacctcctga

SEQ ID NO: 7008 - protein, 1625 aa, Sorghum bicolor
  misc_feature: Ceres ANNOT ID no. 6073285
  misc_feature (1381)..(1616): Pfam Id: PIP5K Pfam Desc: Phosphatidylinositol-4-phosphate 5-Kinase
  misc_feature (219)..(600): Pfam Id: Cpn60_TCP1 Pfam Desc: TCP-1/cpn60 chaperonin family
  misc_feature (1)..(1625): NCBI GI: 25553693 NCBI Desc: fyve finger-containing phosphoinositide kinase-like [oryza sativa (japonica cultivar-group)]
  misc_feature (706)..(1625): NCBI GI: 52077152 NCBI Desc: finger-containing phosphoinositide kinase-like [oryza sativa (japonica cultivar-group)]
  misc_feature (1290)..(1624): NCBI GI: 92884025 NCBI Desc: chaperonin cpn60/tcp-1; phosphatidylinositol-4-phosphate 5-kinase; zinc finger, fyve/phd-type [medicago truncatula]
  misc_feature (704)..(1624): NCBI GI: 144924365 NCBI Desc: chaperonin cpn60/tcp-1; phosphatidylinositol-4-phosphate 5-kinase [medicago truncatula]
  misc_feature (147)..(594): NCBI GI: 140072141 NCBI Desc: chaperonin cpn60/tcp-1; phosphatidylinositol-4-phosphate 5-kinase; zinc finger, fyve/phd-type [medicago truncatula]
MGVLEFAAGKARSLAAATDQERRHVHKGDLARIETRRRQDQEAGHGVGTPKAQEAAASPVGPPTPPRSPPEARSGGQADAGSRFHPLGRDIRRVDEEAADEPGAQFLASATDFLQDFSDTESSVNSMYRSMTPSPAESPTCVVRLDDASDPDATTLTDSDDARELVSAASSSSTGEREVVNASTHIVDFGDAIWCPPPPEDERDDVESRIFGFDDDDDDAFLEPSCFGDNKVASECGAFGGSQQGGVQNDLLKHFRALVAQLLKAEGISFSSDDNSKSWLEIVSSLAWQAANYVKPDTKKGGSMDPGDYVKIKCIASGNPTDSNFVRGIVCSKNVRHKRMVSEHRNVKLLILGGALEYQKVSNKLASIGTILEQEKEYLRTVVGKIESRQPNVLLVEKSASSFALELLAKDISLVLNVKRPLLERISRCTGGQIASSIDNIASARLGHCDLFKVEKVSESLLAEHGEKGSIKTLMFFEGCLKRLGCTVLLRGTCREELKKIKRAMQLAVFAAYHLSLETSFLADEGATLPKIPSISVTGAPDISASPTDHGTPDGLRNAEETYPQNSTISQIFEVISASSTLLPFAGVSQGITPECRASKFPVDPLNSQDLSNLCHPNVTCNANLISPCSVSDDLRATCAGTQHGDSYKSLQSSIAVDVCRDGALTLKNNQPCHSENHSSNPSLDDFPVGDTDDKDKLSAGSLSGSDNNQSILVSLSSTCIPKSLACQRSHLLRIKFYGSFDKPLGRYLREDLFDQAYCCPSCKEPSESHVRCYMHQHGSLTISVRRLQSQKLPGEHDGRIWMWHRCMRCKLKDGMPPATQRVIMSDAAWGLSFGKFLELSFSNHMTANRIASCGHSLQRDCLRFYGYGNMVAAFHYGPMITLSVDLPPPVLDLNSHATQDWVKREAVEVFHTMELLHTEVYDVLHNLEKSIITDDDSTKTSIQRQIVEMKDLLNVERNEYEALLLPVIMGSAHSFKSNIDILELNRIRRSLLLDAHTWDCRLCDIDSLEANGHISRTDPFNQEKTQGINEGRSDSLQIVRKHGGTYEEPCPQHSSESPRKSLLSTEGHVNDKQSVMVETDLPVGLVDGVSGGAGGLDLIFNKFDTCEGRCLSKYPSKTEPVERLPSLASILADKIDMAWSGFGELDCNLPHDLTKANENRSLNLLANPSYEKATAPVRIHSFDTVMRLHQREQTGVIPASLHSALKSVDSFRDLTSLVKDPMTNMRRAFSQISPRTRGNLNTVLIRAPKYITSASHMVNDGARLLLPNISCGGSVFVTVYDDEPTSAVSYAMTSQEYADHVTHKMNINTSFSDFTSSNGLHRSLSSHEDLSNSKGTHFRLSFDDDASPTDSTKFSVTCYFAKQFAALRKKCCPSDIDYIRSISRCKRWSAQGGKSNVYFAKTMDERFIIKQVTKTELDSFVDFAPHYFRHLTESLTSRSPTCLAKIVGLYQVSIKNSKGGREVKMDLMVMENIFFQRSISRVYDLKGSGRSRYNSDASGHNKVLLDSNLIEALHTKPMFLGSKAKQRLERAVWNDTSFLASLDVMDYSLLVGVDEEKKELVVGIIDFLRQYTWDKQLETWVKASGILGGPKNEAPTVISPIQYKKRFRKAMSRYFLAVPDQWTS

SEQ ID NO: 7009 - DNA, 513 bp, Sorghum bicolor
  misc_feature: Ceres ANNOT ID no. 6073287
  misc_feature: Encodes the peptide sequence at SEQ ID NO 7010
atggccggcgaagacggcgccgcccctcccccgcctccgcccccgctcccgtcctaccctgagatgatcgtggaggcaatccgcgcgctgggactcgaggtcagctccaacaagactgcgatctcggactacatcaggggcaggtacggctccagcctcccggcccagcacaacgccttcctcacgggtcacctcgcccgcatgaaggccaccggcgagctcgccttcctcaggaacaactaccttcgtgggcgcggacgcccccccaagcccaaggacaccatcactgtggccaccgaccgggccaccagcggcatgctcagcccacgtggccgtggccgtggccgtggccgcccgcccaagaaggccaaggtcgccgtggaagatcccagtggtgagcctgctgcagctcccggcgttgctgctgatgccagtgctgtgcctgtcaagcgtgggcgtggacggccccccaaggtgaggcctgcagtggttggggcgccgtctgagtcttaa

SEQ ID NO: 7010 - protein, 170 aa, Sorghum bicolor
  misc_feature: Ceres ANNOT ID no. 6073287
  misc_feature (15)..(85): Pfam Id: Linker_histone Pfam Desc: linker histone H1 and H5 family
  misc_feature (16)..(162): NCBI GI: 454279 NCBI Desc: dna-binding protein
  misc_feature (1)..(164): NCBI GI: 115476508 NCBI Desc: os08g0428800 [oryza sativa (japonica cultivar-group)]
  misc_feature (7)..(158): NCBI GI: 115479061 NCBI Desc: os09g0402100 [oryza sativa (japonica cultivar-group)]
  misc_feature (7)..(158): NCBI GI: 453692 NCBI Desc: at hook 1 from aa 98-106, at hook 2 from aa 129-137, at hook 3 from aa 154-162, at hook 4 from aa 192-200
  misc_feature (13)..(170): NCBI GI: 1181589 NCBI Desc: high mobility group protein [canavalia gladiata]
  misc_feature: The sequence is a functional homolog of SEQ ID NO 138 in the 11/375,241US patent application
  misc_feature: The sequence is a functional homolog of SEQ ID NO 204 in the 10/412,699US patent application
  misc_feature: The sequence is a functional homolog of SEQ ID NO 2286 in the 10/374,780US patent application
  misc_feature: The sequence is a functional homolog of SEQ ID NO 56 in the 10/669,824US patent application
  misc_feature: The sequence is a functional homolog of SEQ ID NO 56 in the 10/870,198US patent application
  misc_feature: The sequence is a functional homolog of SEQ ID NO 706 in the 10/225,066US patent application
  misc_feature: Useful for making plants with modulated growth and phenotype characteristics
  misc_feature: Useful for making plants with modulated nitrogen use efficiency
  misc_feature: Functional homolog of the protein sequence given in SEQ ID NO 12883
  misc_feature: The sequence is a functional homolog of SEQ ID NO 204 in the 20040045049 US patent application
MAGEDGAAPPPPPPPLPSYPEMIVEAIRALGLEVSSNKTAISDYIRGRYGSSLPAQHNAFLTGHLARMKATGELAFLRNNYLRGRGRPPKPKDTITVATDRATSGMLSPRGRGRGRGRPPKKAKVAVEDPSGEPAAAPGVAADASAVPVKRGRGRPPKVRPAVVGAPSES

SEQ ID NO: 7011 - DNA, 951 bp, Sorghum bicolor
  misc_feature: Ceres ANNOT ID no. 6073357
  misc_feature: Encodes the peptide sequence at SEQ ID NO 7012
atggcgagcctcaccctgccgccggcgcccccgaacccacgccaggacgccatcgacctccacaaggccttcaaagggtttggctgtgatagtacagcagtgataaacatacttactcatcgcgattcagttcagcgtggacttattcaacaggaatacagggctatgtatcatgaggaactcttccatcgtatttcatctgaactcagtggaaaccacaagaaagctatgtcgctgtggattcttgatcctgctggacgtgatgcaactgttttgagagaagctctaagcggtgacactatggatctgagagcagccactgagattatatgttccaggacaccatcacagttgcaaataatgaaacagacttattatgctagattcggtacttatcttgagcatgacattggtcaccacacatctggcgatcaccagaagcttttacttgcctatgtggggattccacgctatgaaggtcctgaggttgatcctaccattgtgacacatgatgcaaaggatttgtacaaagctggtgagaaaaggctgggtacggatgagaagacctttatccgtgttttcactgaacgcagttgggcacacttggcatctgtttcttctgcttaccatcatatgtatgaccggaaattagagaaggttgtcaagagcgaaacatctggaaactttgaatttgcacttttgactatcctcagatgcgcggaaaacccagcgaagtattttgctaagctcttacgaaaggccatgaaaggtttaggcaccgatgagaagacacttacaagggtcgtggtgacgaggactgagattgacatgcaatatatcaaggcagagtacttcaagaagtataagaagccattagctgaggctatcaactccgaaacatcaggaaactatcgggcgttccttctttcacttgttggtcatggccattag

SEQ ID NO: 7012 - protein, 316 aa, Sorghum bicolor
  misc_feature: Ceres ANNOT ID no. 6073357
  misc_feature (15)..(80): Pfam Id: Annexin Pfam Desc: Annexin
  misc_feature (87)..(152): Pfam Id: Annexin Pfam Desc: Annexin
  misc_feature (170)..(236): Pfam Id: Annexin Pfam Desc: Annexin
  misc_feature (246)..(311): Pfam Id: Annexin Pfam Desc: Annexin
  misc_feature (1)..(313): NCBI GI: 38606205 NCBI Desc: annexin [triticum aestivum]
  misc_feature (1)..(307): NCBI GI: 3881978 NCBI Desc: annexin-like protein [medicago sativa]
  misc_feature (1)..(313): NCBI GI: 18408941 NCBI Desc: annexin 5 (ann5) [arabidopsis thaliana]
  misc_feature (1)..(313): NCBI GI: 12667520 NCBI Desc: calcium-binding protein annexin 5 [arabidopsis thaliana]
  misc_feature (1)..(315): NCBI GI: 71834743 NCBI Desc: 80c09_22 [brassica rapa subsp. pekinensis]
MASLTLPPAPPNPRQDAIDLHKAFKGFGCDSTAVINILTHRDSVQRGLIQQEYRAMYHEELFHRISSELSGNHKKAMSLWILDPAGRDATVLREALSGDTMDLRAATEIICSRTPSQLQIMKQTYYARFGTYLEHDIGHHTSGDHQKLLLAYVGIPRYEGPEVDPTIVTHDAKDLYKAGEKRLGTDEKTFIRVFTERSWAHLASVSSAYHHMYDRKLEKVVKSETSGNFEFALLTILRCAENPAKYFAKLLRKAMKGLGTDEKTLTRVVVTRTEIDMQYIKAEYFKKYKKPLAEAINSETSGNYRAFLLSLVGHGH

SEQ ID NO: 7013 - DNA, 1608 bp, Sorghum bicolor
  misc_feature: Ceres ANNOT ID no. 6073370
  misc_feature: Encodes the peptide sequence at SEQ ID NO 7014
atgacaagacagaacatatcgaagtcgctcgccgtcctcctccgcgcccgcatgcagcccaaccccatcccctccccgccgccgccgccgcccacggaccccgaccccgccgccccgcccgtggctctcgtccgccactggctccacgcgtctgcctccgccgcctccccggcccccgcggcgctcgacagcttctccgatgggtaccgctccctcgacctcgtcgggcgccgcgaggtcctccgttccctcgccatcgactacgatgtgccccgcgcgcgtgtccgggacctcttgagacagtacatgagcgtcgcctccgccgagccgtcaggcggggatgacgtggaggcggaggggaaggagggcgccgcgtcggcgctgtaccggatggagcgggggctccgggacgcactccggccccggtacgccgggttcctcgaggccatgaacgcgcagccaggcgggctcaagctcctcgccgtgctccgcgccgatctcctcgccttgctgggggaggagaacgctccagcgctgcgggctctggacttgtacttgaaggagaagctggtgacttggcttagtcctgcggcactgacgctccaccagattacctgggatgatcctgcctccttgctagagaagattgtggcatatgaagtttgtggccggctccctgttaatttggctgtgcatccaatcaggaatctgatagacttgaagagaagattgggcattggccgccgatgctttgggtacttccatccagcaataccaggggagcccctgattttcattgaagttgctttacttaaagatatggccgcatctatacaggaggtcttgtgggatgaccccccgactcctgaatctgaagccagctgtgcactattttactcaatatcgtcaacccagcctggtttatcaggtattaatctagggaagtttcttctcaagcgtgtgattgacatgttgagaagagatatgccatcagtacagatttttgcaacacttagtccaatccctggtttcatgcaatggcttcttgctaagctggcctcccaaataaagttatcagaggcagaatcacaggaggggaattcactaggagcttgttctactttcaaagaatccatccttcttcctgacgaagagagaatgattcatgatgccaccgaacaagctgatggaaagcaagggattgaactattgcaagatatactgaaatcaagacagtgggtaaagtctgacaaattatctgctgcattaaaacggcctcttatgcgtttatgtgcaaggtatcttgccagagagaagaagcgaggaaaagctctagatgctgttgcaaattttcacttgcaaaatggagcaatgattgaaagaataaattggatggccgaccaatcagagaagggcattcatcaaagtggaggtatcatggtcaattatctttacaggttagagaacatagaagagtatgcactatcatattcgagtacagggttcatccattcttcacctagcctgtctgagtatctcgaggatatggcagctcttccccctgttcgttgtgaacatgaggcatgcgaactaatgtgcaggcagtag

SEQ ID NO: 7014 - protein, 535 aa, Sorghum bicolor
  misc_feature: Ceres ANNOT ID no. 6073370
  misc_feature (114)..(486): Pfam Id: MCD Pfam Desc: Malonyl-CoA decarboxylase (MCD)
  misc_feature (43)..(513): NCBI GI: 51536590 NCBI Desc: at4g04320 [arabidopsis thaliana]
  misc_feature (43)..(513): NCBI GI: 42572829 NCBI Desc: malonyl-coa decarboxylase family protein [arabidopsis thaliana]
  misc_feature (108)..(413): NCBI GI: 4960188 NCBI Desc: malonyl-coa decarboxylase [homo sapiens]
  misc_feature (108)..(413): NCBI GI: 12653045 NCBI Desc: malonyl-coa decarboxylase [homo sapiens]
  misc_feature (108)..(413): NCBI GI: 119615919 NCBI Desc: malonyl-coa decarboxylase [homo sapiens]
MTRQNISKSLAVLLRARMQPNPIPSPPPPPPTDPDPAAPPVALVRHWLHASASAASPAPAALDSFSDGYRSLDLVGRREVLRSLAIDYDVPRARVRDLLRQYMSVASAEPSGGDDVEAEGKEGAASALYRMERGLRDALRPRYAGFLEAMNAQPGGLKLLAVLRADLLALLGEENAPALRALDLYLKEKLVTWLSPAALTLHQITWDDPASLLEKIVAYEVCGRLPVNLAVHPIRNLIDLKRRLGIGRRCFGYFHPAIPGEPLIFIEVALLKDMAASIQEVLWDDPPTPESEASCALFYSISSTQPGLSGINLGKFLLKRVIDMLRRDMPSVQIFATLSPIPGFMQWLLAKLASQIKLSEAESQEGNSLGACSTFKESILLPDEERMIHDATEQADGKQGIELLQDILKSRQWVKSDKLSAALKRPLMRLCARYLAREKKRGKALDAVANFHLQNGAMIERINWMADQSEKGIHQSGGIMVNYLYRLENIEEYALSYSSTGFIHSSPSLSEYLEDMAALPPVRCEHEACELMCRQ

SEQ ID NO: 7015 - DNA, 648 bp, Sorghum bicolor
  misc_feature: Ceres ANNOT ID no. 6073392
  misc_feature: Encodes the peptide sequence at SEQ ID NO 7016
atggccaagacgaagcaagggaagcgggacgtcgacgcctacaccatcaagggcaccaacaaggtggtccgagtcggggactgcgtgctgatgcggccggcggacacggacaagccgccgtacgtggcgcgggtggagcggatggagtcggacgggcgcggcggcgtccgggtgcgggtgcgctggtactaccgccccgaggaggccaagggcggccgccgcccattccacggcgccaaggagctcttcctctccgaccacttcgacacgcagagcgcgcacaccattgagggcaagtgcatcgttcactccttcaagagctacaccaagctcgacaacgtcggcccggaggacttctactgccgatttgactacaaggccagcaccggcgcattcacccccgaccgtgtcgccgtgtattgcaagtgtgagatgccttacaacccggatgacctcatggtgcagtgcgaaggatgcaaggactggttccatccgtcttgtatgggaatgaccattgagcaagccaaaaagatagatcattacatgtgctcggattgtgctaaagaaaatggtgcaaagagaccctcaaattcatatccagtttcacccaactctgattctaaggtagtgtggttttctgtcacatga

SEQ ID NO: 7016 - protein, 215 aa, Sorghum bicolor
  misc_feature: Ceres ANNOT ID no. 6073392
  misc_feature (21)..(136): Pfam Id: BAH Pfam Desc: BAH domain
  misc_feature (140)..(189): Pfam Id: PHD Pfam Desc: PHD-finger
  misc_feature (1)..(208): NCBI GI: 37573088 NCBI Desc: receptor like protein [oryza sativa (japonica cultivar-group)]
  misc_feature (2)..(209): NCBI GI: 79325221 NCBI Desc: dna binding / protein binding / zinc ion binding [arabidopsis thaliana]
  misc_feature (2)..(209): NCBI GI: 79481800 NCBI Desc: dna binding / protein binding / zinc ion binding [arabidopsis thaliana]
  misc_feature (26)..(209): NCBI GI: 7269059 NCBI Desc: receptor like protein (fragment) [arabidopsis thaliana]
  misc_feature (1)..(213): NCBI GI: 7270893 NCBI Desc: es43 like protein [arabidopsis thaliana]
  misc_feature: The sequence is a functional homolog of SEQ ID NO. 482 in the 11/188,298 US application
MAKTKQGKRDVDAYTIKGTNKVVRVGDCVLMRPADTDKPPYVARVERMESDGRGGVRVRVRWYYRPEEAKGGRRPFHGAKELFLSDHFDTQSAHTIEGKCIVHSFKSYTKLDNVGPEDFYCRFDYKASTGAFTPDRVAVYCKCEMPYNPDDLMVQCEGCKDWFHPSCMGMTIEQAKKIDHYMCSDCAKENGAKRPSNSYPVSPNSDSKVVWFSVT

SEQ ID NO: 7017 - DNA, 1230 bp, Sorghum bicolor
  misc_feature: Ceres ANNOT ID no. 6073394
  misc_feature: Encodes the peptide sequence at SEQ ID NO 7018
  misc_feature: Up-regulated in root tissues in response to salicylic acid treatment
  misc_feature: Up-regulated in shoot tissues in response to salicylic acid treatment
atggcggcgtacctgagcatgggtgaggcgcaccgccgcatcggcgactacctctctcgcgtgaccaacgccatctcctactccgacggcgccgcgctcgcctccctcctctccgtctcctccgcgccggcctccaccccgctctccgacgcgctcgccgccttcccggacttcccgcgcctcgccggagaccgcttcccccaccttgccgacttcctcgttccgttgctccgcgccatccactcccactccgtccagcgcttcgccgacgcctactcctcgttcgagaaggcctccagcgcgttcctgcaggagtttaggaactgggagacgccgtgggcgatggaggcgatgcacactgtggcgctcgagatcaggctaatcgctgagaaggcagatagggagcttgctacgaatggaaagaaccccgacaagcttcaggcagccgggtcctttctgatgaaggtttttggcacactagcggtgaaaggacctaagcgtattggagcactctatgttacctgccagctattcaaaatttacttcaggcttggaacagtaaacctttgccgtagtgtcataaggagtatcgaaactgcaaggaattttgattttgaagattttccagtgaaagacaaggtcacttatatgtactacactgggcggttggaggtgtttaatgagaactttcttgttgcagatcagaagctaacttatgctttgatgcattgcaattctcaaagcgagtcaaatttgaggagaattttgaagtttcttatccctgtaaagctttcaataggtgtactgccaaaaaggactctcctggagcggtacaatttgcttgagtatgcagatgttgtaactgcacttaagagaggagatctcaggcttctcaggcaagctctagacaggcatgaagaccaatttttgaaatctggcgtctacctagtattggagaaacttgaacttcaagtctatcagagattagttaagaaaatccataacattcagaggcagaaggaaccagccaaggcacatcaaattaagctagatgttgtcgtaagagctctgaaatggcttgaaattgacatggatgtggatgaggtggagtgcatcatggcatgcctcatatacaagaaccttataaagggttactttgctcacaagagcaaggtccttgtcctcagcaaacaagaccccttccccaagttgaacgggaagcctgtttaa

SEQ ID NO: 7018 - protein, 409 aa, Sorghum bicolor
  misc_feature: Ceres ANNOT ID no. 6073394
  misc_feature (281)..(397): Pfam Id: PCI Pfam Desc: PCI domain
  misc_feature (1)..(409): NCBI GI: 49387717 NCBI Desc: proteasome protein-like [oryza sativa (japonica cultivar-group)]
  misc_feature (10)..(405): NCBI GI: 117938779 NCBI Desc: pcid2 protein [mus musculus]
  misc_feature (13)..(405): NCBI GI: 57208835 NCBI Desc: rp11-98f14.6 [homo sapiens]
  misc_feature (10)..(405): NCBI GI: 62857903 NCBI Desc: loc549344 [xenopus tropicalis]
  misc_feature (77)..(405): NCBI GI: 9963791 NCBI Desc: ht004 protein [homo sapiens]
  misc_feature: Up-regulated in root tissues in response to salicylic acid treatment
  misc_feature: Up-regulated in shoot tissues in response to salicylic acid treatment
MAAYLSMGEAHRRIGDYLSRVTNAISYSDGAALASLLSVSSAPASTPLSDALAAFPDFPRLAGDRFPHLADFLVPLLRAIHSHSVQRFADAYSSFEKASSAFLQEFRNWETPWAMEAMHTVALEIRLIAEKADRELATNGKNPDKLQAAGSFLMKVFGTLAVKGPKRIGALYVTCQLFKIYFRLGTVNLCRSVIRSIETARNFDFEDFPVKDKVTYMYYTGRLEVFNENFLVADQKLTYALMHCNSQSESNLRRILKFLIPVKLSIGVLPKRTLLERYNLLEYADVVTALKRGDLRLLRQALDRHEDQFLKSGVYLVLEKLELQVYQRLVKKIHNIQRQKEPAKAHQIKLDVVVRALKWLEIDMDVDEVECIMACLIYKNLIKGYFAHKSKVLVLSKQDPFPKLNGKPV

SEQ ID NO: 7019 - DNA, 1128 bp, Sorghum bicolor
  misc_feature: Ceres ANNOT ID no. 6073410
  misc_feature: Encodes the peptide sequence at SEQ ID NO 7020
atggagaacacctcgtccgccaccgccactcatgaactggcgggctggtcgtccctccctggcgacctactcaaaaccatcctggacctgctgccatggtcgagccacccgaggttcgccgccgtgtgcaggcactggcgctccgtcgtggccccgttctaccccgcctggctaaccccggtcctcctcaacgccgccgccgacatcggctccgccaaccttcggtactacagcccttaccaccacaaaatcttcgaggaggccagcttcaacttgcaaactcccaacgccaagatctgcagcgccagtggccggcacctcacggtgtgccagcgtgcggatcaggaaattacggtggcccacatcgatcttgtgactggcgtcatctgtgacctcttcccgctccatagaacccactttgactttgtcatctatgatggtgagcgtagaagaatgtatggcgtcaacaatgcgttccccatttctcaggtcgcccgtgctatccaggacgccgacagtggcgggtggtacccatggaagttctcagagtttagagtcgacaagccaacgctcgacgcgtcgccgatgacgaacctggtccgccaccgtggcttgctctacatgttgggtgtcgacgggaggttggcagtgtatgatgacaaccgacacgaggaaggacttcggcttcttgacaaaccccaagggtttggtggtttcgacgacgattttttctcctatcttttcgagtccgacgaaggtgagctgatggcggtgctcatgggctgctgccgtgggactccggtggacggcggcctaaaagggcgggcattgttcaccggtacgcccgctacgataatggttgagaccgacgttaagtggatgcgaaacaagatctttgtcccgaggctgtacgattggccggagacgctgcatgttgaccttgttgagagaggaggtgaagtggccttcgtaccgatatctacagcggctagcagcgtggcacagtgcactactggatcttcaggcactgctggcatgtggacttgtggattgggacaccaagaatcgtccgagttttgggagaccataaaacttgattacagtatctgggttgatttcagaaattga

SEQ ID NO: 7020 - protein, 375 aa, Sorghum bicolor
  misc_feature: Ceres ANNOT ID no. 6073410
  misc_feature (14)..(61): Pfam Id: F-box Pfam Desc: F-box domain
MENTSSATATHELAGWSSLPGDLLKTILDLLPWSSHPRFAAVCRHWRSVVAPFYPAWLTPVLLNAAADIGSANLRYYSPYHHKIFEEASFNLQTPNAKICSASGRHLTVCQRADQEITVAHIDLVTGVICDLFPLHRTHFDFVIYDGERRRMYGVNNAFPISQVARAIQDADSGGWYPWKFSEFRVDKPTLDASPMTNLVRHRGLLYMLGVDGRLAVYDDNRHEEGLRLLDKPQGFGGFDDDFFSYLFESDEGELMAVLMGCCRGTPVDGGLKGRALFTGTPATIMVETDVKWMRNKIFVPRLYDWPETLHVDLVERGGEVAFVPISTAASSVAQCTTGSSGTAGMWTCGLGHQESSEFWETIKLDYSIWVDFRN

SEQ ID NO: 7021 - DNA, 1731 bp, Sorghum bicolor
  misc_feature: Ceres ANNOT ID no. 6073414
  misc_feature: Encodes the peptide sequence at SEQ ID NO 7022
atggcgctgcaccacctccgcctcgcgccgctcgcgctccttcgcgccgcgagcctcccgcctctcgcctcctcccgtatcgccgcgagccgccaccgccacgttctcctcttcgcgccgccgccgccgtggccgtggcgcctcctgtcgcccgctgcgaggccgcgcgcgcttgccaccgcggccgaggccgaggccgacgatgttggctcgggctcggccaacggcttcttcgccgagagcacgtcgtggggttcactcggcgtatccgaacgcctcgcgtccgccctgcgcggtgcggggctctcgaggccttcccttgtccaggcaacctgtataccacatgttctcatggagaatgatgtaattgttgcagcagagactggcagtgggaaaacccatggttacctcgtacctttgattgaaaagctgtgttcaaaatcttctaccaccaaagatgacaattctcaggacaccaccccaggggcacatgacattgtgttggtcctttgtcccaatgtcatgctctgtgagcaagttgttcgcatggctaattcattgcttgacgagtctggcgaaccacttaaaagtgctgctgctgtttgtgggccaaagggctggccagctgttcatccagatattcttgtagccactccagctgctctcttaaactatctatttgactatgacccagaaaagaggcgaagagagagattcctgcgcaatgtaaaattcgtagtgtttgatgaagcggacatgctactttgtggaagttttgagaaccaggtcattcgtctcatccatatgttgagatttgatgaaaagctactttcaagagcacaggattctggaaaggaagtatcacttgggagtgatgatggatatcttgaggattcaaggtttgagactgctgaatttagtggttctgacgaggaaattgaagacaatattgtgcaagatagacctgtcaaggtggagaatagtcatgttggagcacgcaaggactggaggagagttagaaaaatatacagacgcagcaagcagtatgtctttgttgctgccacccttcctcagagtgggaaaagaactgctggtggtgtgctaaaacgtatgtttccagatgctgtatgggttagtggcacttatcttcactgtcacaaccccagattagagcgaagatggatagaggtcactgctgatacacaagttgatgctcttctgaacgcagttaaatatggcctgaagagtgaagttcatgatgctaaagatgttcgaagacgaactatggtcttcacaaacactgttgatgctgccaattcagtctctgatatattgcggcgagttggtattccatgtatcttgtaccatcgtgagagttccttggaggagagggctaacaatttgcaatctttccgggaaaatggcggtgtgcttgtatgcactgatgctgctgcccgtgggcttgatgtcccaaatgtttctcatgtcattcaggcagaatttgctgcctgtgctgttgattttttgcacagggtgggccgcacagccagagctggtcaatctggtatagtgaccagcctatacacagaggcaaatcgtgatcttgtaagagcagttcgtcaagcagaggagttggctcagccagtggagagagcattcagcaggaaaagaagctttcgcaacaaattaaagaagcaagcattacaaaaacgtgcagcactggtatcttga

SEQ ID NO: 7022 - protein, 576 aa, Sorghum bicolor
  misc_feature: Ceres ANNOT ID no. 6073414
  misc_feature (106)..(363): Pfam Id: DEAD Pfam Desc: DEAD/DEAH box helicase
  misc_feature (444)..(519): Pfam Id: Helicase_C Pfam Desc: Helicase conserved C-terminal domain
  misc_feature (1)..(576): NCBI GI: 143361695 NCBI Desc: dead-box atp-dependent rna helicase 22
  misc_feature (69)..(567): NCBI GI: 92890167 NCBI Desc: helicase, c-terminal [medicago truncatula]
  misc_feature (81)..(570): NCBI GI: 3776015 NCBI Desc: rna helicase [arabidopsis thaliana]
  misc_feature (337)..(541): NCBI GI: 85708371 NCBI Desc: dna and rna helicase [erythrobacter sp. nap1]
  misc_feature (338)..(548): NCBI GI: 116126498 NCBI Desc: ensangp00000021826 [anopheles gambiae str. pest]
MALHHLRLAPLALLRAASLPPLASSRIAASRHRHVLLFAPPPPWPWRLLSPAARPRALATAAEAEADDVGSGSANGFFAESTSWGSLGVSERLASALRGAGLSRPSLVQATCIPHVLMENDVIVAAETGSGKTHGYLVPLIEKLCSKSSTTKDDNSQDTTPGAHDIVLVLCPNVMLCEQVVRMANSLLDESGEPLKSAAAVCGPKGWPAVHPDILVATPAALLNYLFDYDPEKRRRERFLRNVKFVVFDEADMLLCGSFENQVIRLIHMLRFDEKLLSRAQDSGKEVSLGSDDGYLEDSRFETAEFSGSDEEIEDNIVQDRPVKVENSHVGARKDWRRVRKIYRRSKQYVFVAATLPQSGKRTAGGVLKRMFPDAVWVSGTYLHCHNPRLERRWIEVTADTQVDALLNAVKYGLKSEVHDAKDVRRRTMVFTNTVDAANSVSDILRRVGIPCILYHRESSLEERANNLQSFRENGGVLVCTDAAARGLDVPNVSHVIQAEFAACAVDFLHRVGRTARAGQSGIVTSLYTEANRDLVRAVRQAEELAQPVERAFSRKRSFRNKLKKQALQKRAALVS

SEQ ID NO: 7023 - DNA, 1593 bp, Sorghum bicolor
  misc_feature: Ceres ANNOT ID no. 6073447
  misc_feature: Encodes the peptide sequence at SEQ ID NO 7024
  misc_feature: Up-regulated in root tissues in response to salicylic acid treatment
  misc_feature: Up-regulated in shoot tissues in response to salicylic acid treatment
atggccgccgcgccgccgcctaaggccgacgagctccagccgttcccgcccaaggagcagctgcccggcgtcgccttctgcatcaccagcccgccgccatggcccgaggccattttactaggattccagcatttcatcgtcatgctgggcaccactgtcattatacccagctcgctcgttcctcagatgggaggcggaaatgaagagaaagcccgggtggttcagacgatattgttcgtggctggcataaacaccctgttccaaacattcttcgggacacgccttccggttgtgatgggtggctcatacatcttcgtcggacccaccatctccatcatcttggctggacggtacagcaatgaagcagaccctcacgagaaattcttgcggacgatgaggggaacgcaaggtgctctcctaattgcgtcgacaattcagatcatacttgggttcagtgggctctggcgcaatgtagtcaaattattgagtccgctggcagctgttcctctagtatcacttgtcggatttgggctttatgagcttggctttccaggggtagcgaaatgtgttgaaattggccttccagaagttttcctgttggttgtattttctcagtatttgtctcaagttctggatttcgggaagtctgtctttagccggttcagtgttcttttcactgtctctattgtgtggctgtatgcttacattctcaccatcggtggtgcttacaagaattctccaccgaagacacaggtgcattgccgtgttgatcgttcaggccttatttcaggagcgccttggataagtgttccatacccctttcagtggggtgctccaacatttgacgctggagaagcttttgcaatgatgatgacttcattcattgctcttgtagagtcaactggcgccttcattggtgcttcaagatatgcaagtgcaactatgattcctccatcaattattagtcggggcgtgggatggcagggcattggcctcttgcttgattcattttttgggacagccaccgggacatcagtttcagtagagaatatcggattgcttgcattgacacgtattggcagccggagagtagtacaaatatctgcagggttcatgattttcttctctgtccttggaaaatttggagctttgtttgcatcgattccactgcccatatttgctggcatgtactgtctcttcttcgcatatgttggtggtgttggcctgagcttacttcaattctgcaatctaaacagctttaggaccaagttcatcatggggtttgctttcttcatgggcttatcagttcctcagtacttcaatgagtatacagctgttgcaagttatggtccagtgcacactggcgccagatggttcaatgacatgataaacgtgccattctcgtcaaagccgttcgtcgctgggttggtagcctacatcctggacaacacccttcagataaaggaaagcgcggtgaggaaggacagaggcaaccactggtgggaaaagttcaggagcttcaagaaagacgcgaggagccaagagttctactcgttgccgttcaatctgaacaaattcttcccttcggtctga

SEQ ID NO: 7024 - protein, 530 aa, Sorghum bicolor
  misc_feature: Ceres ANNOT ID no. 6073447
  misc_feature (35)..(442): Pfam Id: Xan_ur_permease Pfam Desc: Permease family
  misc_feature (3)..(530): NCBI GI: 89330191 NCBI Desc: leaf permease 1 [oryza sativa (japonica cultivar-group)]
  misc_feature (3)..(530): NCBI GI: 31711940 NCBI Desc: at5g49990 [arabidopsis thaliana]
  misc_feature (4)..(530): NCBI GI: 30696385 NCBI Desc: xanthine/uracil permease family protein [arabidopsis thaliana]
  misc_feature (3)..(530): NCBI GI: 144923095 NCBI Desc: xanthine/uracil/vitamin c permease [medicago truncatula]
  misc_feature (48)..(530): NCBI GI: 9758398 NCBI Desc: permease [arabidopsis thaliana]
  misc_feature: Up-regulated in root tissues in response to salicylic acid treatment
  misc_feature: Up-regulated in shoot tissues in response to salicylic acid treatment
MAAAPPPKADELQPFPPKEQLPGVAFCITSPPPWPEAILLGFQHFIVMLGTTVIIPSSLVPQMGGGNEEKARVVQTILFVAGINTLFQTFFGTRLPVVMGGSYIFVGPTISIILAGRYSNEADPHEKFLRTMRGTQGALLIASTIQIILGFSGLWRNVVKLLSPLAAVPLVSLVGFGLYELGFPGVAKCVEIGLPEVFLLVVFSQYLSQVLDFGKSVFSRFSVLFTVSIVWLYAYILTIGGAYKNSPPKTQVHCRVDRSGLISGAPWISVPYPFQWGAPTFDAGEAFAMMMTSFIALVESTGAFIGASRYASATMIPPSIISRGVGWQGIGLLLDSFFGTATGTSVSVENIGLLALTRIGSRRVVQISAGFMIFFSVLGKFGALFASIPLPIFAGMYCLFFAYVGGVGLSLLQFCNLNSFRTKFIMGFAFFMGLSVPQYFNEYTAVASYGPVHTGARWFNDMINVPFSSKPFVAGLVAYILDNTLQIKESAVRKDRGNHWWEKFRSFKKDARSQEFYSLPFNLNKFFPSV

SEQ ID NO: 7025 - DNA, 807 bp, Sorghum bicolor
  misc_feature: Ceres ANNOT ID no. 6073448
  misc_feature: Encodes the peptide sequence at SEQ ID NO 7026
atgcaggctacggccgccgccttcctcgcccgcccgctcccgcggctccgccgcattggcggctggggtccggatgtgccggcggtgcgcggcggcgtcatagcgctcccgccgcggctgcgggggtcgcggtgctccatcagcctctccatcggcgccggcgctggcgccggaggtgaccgcgagttcagctacgagcatgttccggtgttccctagataccgaatacgagatccctacaagcttcttggtgttgatcgtgacgcgtctgaagaagagatccggagtgcaaggaatttccttattcaacagtatgctgggcatgaaccgagtgaagaagctattgaaggtgcttatgagaagataattatgaagagctaccagcagcggaagaagacaaaaattaatcttaaaaccaagttaaagaagagagtagaggaatccccttcatgggtcaaagcacttattggttactttgaggtgccatcgatggatattatttccagacgattgtttttctttgctttcattgctggatggagcatagcaacttctgcagaaaacggacctgcatttcagctcgcgatatcgctattctcgtgcatatatttcctcaacgaaaagatgaagaacctcctcagggcatcaagcactgggtttggaatacttgtgggcggttggattattggttctctactggttccactggtcccaacattcatcatcccgccttcatggtccctagagctcctcacctcgctggttgcttacattttcttgttcctgggatccactttcctgaaatga

SEQ ID NO: 7026 - protein, 268 aa, Sorghum bicolor
  misc_feature: Ceres ANNOT ID no. 6073448
  misc_feature (63)..(268): NCBI GI: 140069900 NCBI Desc: heat shock protein dnaj, n-terminal [medicago truncatula]
  misc_feature (36)..(268): NCBI GI: 78191452 NCBI Desc: cell growth defect factor-like [solanum tuberosum]
  misc_feature (132)..(268): NCBI GI: 115476430 NCBI Desc: os08g0416900 [oryza sativa (japonica cultivar-group)]
  misc_feature (38)..(267): NCBI GI: 140071822 NCBI Desc: flavodoxin; heat shock protein dnaj, n-terminal [medicago truncatula]
  misc_feature (69)..(268): NCBI GI: 115451983 NCBI Desc: os03g0255200 [oryza sativa (japonica cultivar-group)]
  misc_feature: Useful for making plants with altered protein content
  misc_feature: Useful for making plants with modulated biomass
  misc_feature: Useful for making plants with modulated drought sensitivity
  misc_feature: Useful for making plants with modulated heat sensitivity
  misc_feature: GREAT-hit functional homolog of the protein sequence given in SEQ ID NO 13434
  misc_feature: GREAT-hit functional homolog of the protein sequence given in SEQ ID NO 13476
  misc_feature: GREAT-hit functional homolog of the protein sequence given in SEQ ID NO 13478
  misc_feature: Useful for making plants with altered protein content
  misc_feature: Functional homolog of the protein sequence given in SEQ ID NO 13478
MQATAAAFLARPLPRLRRIGGWGPDVPAVRGGVIALPPRLRGSRCSISLSIGAGAGAGGDREFSYEHVPVFPRYRIRDPYKLLGVDRDASEEEIRSARNFLIQQYAGHEPSEEAIEGAYEKIIMKSYQQRKKTKINLKTKLKKRVEESPSWVKALIGYFEVPSMDIISRRLFFFAFIAGWSIATSAENGPAFQLAISLFSCIYFLNEKMKNLLRASSTGFGILVGGWIIGSLLVPLVPTFIIPPSWSLELLTSLVAYIFLFLGSTFLK

SEQ ID NO: 7027 - DNA, 2145 bp, Sorghum bicolor
  misc_feature: Ceres ANNOT ID no. 6073451
  misc_feature: Encodes the peptide sequence at SEQ ID NO 7028
atggccgccgagttgcacaagcccctgggcgcgatcaccgccgacgacctcgcggcggcggcgcctgggtgcgacgccaccgcgctccactcggcgctccggcgcgcgctcgactcgcacggccccgccgcggtgtgggcggagctctgccggtccgtgctccgtccgtccgtccccttcgccgtccaccggatgctctactacggctgcttcgccgggttcccgtcccccacgccgccggcctggacccccgaccccaaggaggctgccttgaccaatgtcggccgtgtcctggaggcgcgcgggagggacttcatcggcgacgcgtacaaggatcccatcaccagcttcccagacctccacaagttctccaacgagaacccagaggagatgggtgtccaattcagtgtagagccatcctgcatctggagagagaacgctgcgtatcccggtggtgagtggctaccgggcgccgagctgaatgctgctgcgaattgcttgaccgctaaacctgggaggagctctgacagtccagccattgtatggagagatgaggggaaggattctgagcctcttaactttatgtctctggaggaattgaggaagaaagtttgcctcgtggcgaatgcactcgatgccctggaactgccaaagggatctgcaattgctattgacatgcctatggatgtcaatgctgttgtgatctaccttgctatcgtattggcaggatatgtggttgtctcaattgcagacagttttgctgcacctgcgatatcgatgaggttaaagatatcagaagcaaaggcaatttttactcaggattacatccttcgtgatgacaaagaactgccattgtacagtagagttgtggaggttaaggcccctatggcaattgtgattcctgtaagggggtctttgccaataaagggactacgtgttgatgacctttcctggcaagacttccttggaagagttaataataccgaggcggaaaattacattgctgttaagcaaccggccgacgcgttcacaaatatcctattttcatcagggaccacaggggagcccaaggcaattccatggacacatataacacccctaaaggcagctgctgatggatggtgccacatggatattcgtaaaggagatgttgttgcatggccaactaatcttggttggatgatgggcccttggcttgtttatgcctctttactgaatggagcttccatggctctgtataatggctccccaaatagttcaggctttgcaaagtttgtacaggatgctaaggtgacaatgcttggactggtacccagcatcgctcgtacatggaagaatacagactgtacagctggactagactggtcctccatccgatgctttagctcatctggggaggcatccagtgtggatgattatttatggctgatgggaagagctggctacaagccagtaatcgagtactgtggaggcacagagattggtggtggatttgttactggatccttgctgcaacctcaagcgttgtctgcattcagcacacctgccatgggttgtaacctgttcattcttgatagcaacgggaatcctttgccacaagactctgtgggtatcggtgaacttgcacttgatccaactttatttggatcatcaacaacacttctaaatgctgatcatcaggaggtttatttcaacggaatgccagaatggcacgggaaaatcctccgcaggcatggagatgaatttgagcgtacttctgacgggtattacagggctcatgggcgtgcagatgatacaatgaacctcggtggaattaaggttagttccattgagattgagaggatctgcaacagagtacatgatgccatcgttgaaacagcagctatcggggttccacctgtagggggtggccccgaacaactaaccatagccgtcgtgttgaaagaccagagctcacaattagaggactggaaccaactgaaactagcgttcaacgttgctctgaagaaactgaaccctctcttcaaggtatcctcggtcgtcgtggtcccgtctctccctagaaccgcctctaacaaggtcatgaggagggtcctgcgcaaggagttcagccaggcagcccaggcaaagcattcgaaaatatag

SEQ ID NO: 7028 - protein, 714 aa, Sorghum bicolor
  misc_feature: Ceres ANNOT ID no. 6073451
  misc_feature (196)..(628): Pfam Id: AMP-binding Pfam Desc: AMP-binding enzyme
  misc_feature (6)..(705): NCBI GI: 42568023 NCBI Desc: acyl-activating enzyme 17 (aae17) [arabidopsis thaliana]
  misc_feature (65)..(705): NCBI GI: 29893266 NCBI Desc: acyl-activating enzyme 17 [arabidopsis thaliana]
  misc_feature (129)..(705): NCBI GI: 9759363 NCBI Desc: acetyl-coa synthetase-like protein [arabidopsis thaliana]
  misc_feature (33)..(714): NCBI GI: 29893268 NCBI Desc: acyl-activating enzyme 18 [arabidopsis thaliana]
  misc_feature (98)..(714): NCBI GI: 140066676 NCBI Desc: amp-dependent synthetase and ligase [medicago truncatula]
MAAELHKPLGAITADDLAAAAPGCDATALHSALRRALDSHGPAAVWAELCRSVLRPSVPFAVHRMLYYGCFAGFPSPTPPAWTPDPKEAALTNVGRVLEARGRDFIGDAYKDPITSFPDLHKFSNENPEEMGVQFSVEPSCIWRENAAYPGGEWLPGAELNAAANCLTAKPGRSSDSPAIVWRDEGKDSEPLNFMSLEELRKKVCLVANALDALELPKGSAIAIDMPMDVNAVVIYLAIVLAGYVVVSIADSFAAPAISMRLKISEAKAIFTQDYILRDDKELPLYSRVVEVKAPMAIVIPVRGSLPIKGLRVDDLSWQDFLGRVNNTEAENYIAVKQPADAFTNILFSSGTTGEPKAIPWTHITPLKAAADGWCHMDIRKGDVVAWPTNLGWMMGPWLVYASLLNGASMALYNGSPNSSGFAKFVQDAKVTMLGLVPSIARTWKNTDCTAGLDWSSIRCFSSSGEASSVDDYLWLMGRAGYKPVIEYCGGTEIGGGFVTGSLLQPQALSAFSTPAMGCNLFILDSNGNPLPQDSVGIGELALDPTLFGSSTTLLNADHQEVYFNGMPEWHGKILRRHGDEFERTSDGYYRAHGRADDTMNLGGIKVSSIEIERICNRVHDAIVETAAIGVPPVGGGPEQLTIAVVLKDQSSQLEDWNQLKLAFNVALKKLNPLFKVSSVVVVPSLPRTASNKVMRRVLRKEFSQAAQAKHSKI

SEQ ID NO: 7029 - DNA, 2559 bp, Sorghum bicolor
  misc_feature: Ceres ANNOT ID no. 6073467
  misc_feature: Encodes the peptide sequence at SEQ ID NO 7030
atggacgacggcgggatccaggaggagccgccgtcggcgcggttcctgacgccgacgcgctcggggggcacgcgctgggtggacggcagcgaggtcgactcgtccgagtccgcgccgtcgtggtcgctcgaggacgagcgctcggcgggggccgtctcctccaacgggggcgccggggcggcgtctcgggtgtcctccggcgcattccgccggcggttcgggaagcggccccgccgggtggactcgctcgacgtcgagtccatgaacgtgcgcggcgcgcacggccacagcgctaaggaaatatcgatgttgagcaccttcgcaatggccttccaaacccttggtgtggtgtacggcgacatgggtacaagtcctctctatgtcttcagtgacgtgttcagtaaagtgcccataaagtcagaggtcgagatactgggagcactttcgctggtcatgtacactattgcattgatcccattcgctaaatatgtcttcattgttctcaaagctaatgacaatggtgaagggggcacttttgcgctgtattcattgatttgcaggtatgcaaaagttagcatgcttcccaatcagcagcgtgtggatgaagatatttctagttttaggcttaagttgccaactcctgaacttgagcgtgctatctctgtcaaagactgcctagaaaagaagccactcttcaagaacattctcctgtttttagttctgatgggtacctccatggtgattggtgatggcattctcactccgtcaatgtcagtcatgtctgctgttagtggtctccagggtcaagttccaggatttgacacaaatgctgttgtaattgtctccatcgttgttcttctgctattgtttagtgtgcagaggtttggaacaggcaaagttggattcatgtttgctcctattttggcattatggtttattaacttgggctccatcggtatatataatattgttaagtatgacatttctgttgtgagagctttcaatccagtgtatatatatttgttttttgagacaaatggcatcaaggcgtggtcagctcttggtggttgtgtcttgtgcatcacaggagctgaagcaatgtttgctgatttgggccatttctctgtcaaatcaatacaggtagcatttaccgccgtggtattcccctgcctgctaattgcttacatggggcaagctgcttttttgatgaaaaacccacttgctgtagaaagaatattttatgattctgtaccaggggctttattctggccagtatttgtgattgctacacttgcagctatgattgccagccaagctatgatatctgcaacattctcttgcataaagcaggccatggctcttggctgcttccctaggattaagataatccatacttccaagaaagtcatgggccagatttacatacctgtgatgaattggtttctaatggtcatgtgcatcatcatcgtggccacttttaggagtaccaatgatattgccaacgcatatggcattgctgaagttggcgtcatgatggttagcactgcactggtgactttggttatgcttcttatatggcaaaccaacttgttccttgtgttatgcttccctattatttttggtgcagtagagtttgtttacttaactgccgttctgtcaaagatacaagaaggagggtggttaccgttggctttctcatcactgtttctctgtataatgtacacatggaactatggaagtgtgctgaagtaccagagtgagatgcgtggcaagatatccctggacttcattcttgatctgggagccacacttggcactgtaagagtcccaggcattggacttgtgtacaatgagctggtccagggaatcccatcgatttttggccaactattagtcacacttccagcgatgcactctacgattgtctttgtttgcataaagtatgttcctgtcccgtatgtcgctctagaagaaaggttcttgttccgaagggttggccagaaggactaccacatgttccgctgtgttgcacgctatggttataaggatattaggaaagaagatcatggcttctttgagcaacttttggccgacagccttgaaaagtttcttaggagggaagcccaggaaattgcgctcgaggcaagcacaatggaggcagagcgtgatgacatatctgttgtatctgaggtgcctcaatctcctgcttgtgatggggatctgcaaactccactgctttctgatcagagatcaggtgataacaacagaatggtcaccacagatggtagcgatcctgtgcttccctccagttccatgtctgcagaagaagatcctggtttagagtatgagctggcagctctgagagaagccatggcatctgggtttacatatctcctagcacacggcgatgtgagggcaaggaaggagtcgctcttcatgaagaagtttgtcattaattatttctatgcattcctcaggaggaactgcagggctggcactgcaaccctgaaggtcccccattcgaacatcatgcgtgttggtatgacgtacatggtttga

SEQ ID NO: 7030 - protein, 852 aa, Sorghum bicolor
  misc_feature: Ceres ANNOT ID no. 6073467
  misc_feature (108)..(852): Pfam Id: K_trans Pfam Desc: K+ potassium transporter
  misc_feature (1)..(852): NCBI GI: 92109212 NCBI Desc: potassium transporter [phragmites australis]
  misc_feature (1)..(852): NCBI GI: 92109214 NCBI Desc: potassium transporter [phragmites australis]
  misc_feature (1)..(695): NCBI GI: 92109210 NCBI Desc: potassium transporter [phragmites australis]
  misc_feature (65)..(852): NCBI GI: 3249065 NCBI Desc: similar to hak1 gbu22945 high affinity potassium transporter from schwanniomyces occidentalis. [arabidopsis thaliana]
  misc_feature (21)..(852): NCBI GI: 38503183 NCBI Desc: potassium transporter 7 (atpot7) (athak7)
  misc_feature: The sequence is a functional homolog of SEQ ID NO. 279 in the 11/188,298 US application
MDDGGIQEEPPSARFLTPTRSGGTRWVDGSEVDSSESAPSWSLEDERSAGAVSSNGGAGAASRVSSGAFRRRFGKRPRRVDSLDVESMNVRGAHGHSAKEISMLSTFAMAFQTLGVVYGDMGTSPLYVFSDVFSKVPIKSEVEILGALSLVMYTIALIPFAKYVFIVLKANDNGEGGTFALYSLICRYAKVSMLPNQQRVDEDISSFRLKLPTPELERAISVKDCLEKKPLFKNILLFLVLMGTSMVIGDGILTPSMSVMSAVSGLQGQVPGFDTNAVVIVSIVVLLLLFSVQRFGTGKVGFMFAPILALWFINLGSIGIYNIVKYDISVVRAFNPVYIYLFFETNGIKAWSALGGCVLCITGAEAMFADLGHFSVKSIQVAFTAVVFPCLLIAYMGQAAFLMKNPLAVERIFYDSVPGALFWPVFVIATLAAMIASQAMISATFSCIKQAMALGCFPRIKIIHTSKKVMGQIYIPVMNWFLMVMCIIIVATFRSTNDIANAYGIAEVGVMMVSTALVTLVMLLIWQTNLFLVLCFPIIFGAVEFVYLTAVLSKIQEGGWLPLAFSSLFLCIMYTWNYGSVLKYQSEMRGKISLDFILDLGATLGTVRVPGIGLVYNELVQGIPSIFGQLLVTLPAMHSTIVFVCIKYVPVPYVALEERFLFRRVGQKDYHMFRCVARYGYKDIRKEDHGFFEQLLADSLEKFLRREAQEIALEASTMEAERDDISVVSEVPQSPACDGDLQTPLLSDQRSGDNNRMVTTDGSDPVLPSSSMSAEEDPGLEYELAALREAMASGFTYLLAHGDVRARKESLFMKKFVINYFYAFLRRNCRAGTATLKVPHSNIMRVGMTYMV

SEQ ID NO: 7031 - DNA, 447 bp, Sorghum bicolor
  misc_feature: Ceres ANNOT ID no. 6073498
  misc_feature: Encodes the peptide sequence at SEQ ID NO 7032
atgatgagcagcaacagcggcggcggcgcaggaggctctggcgggggcatgggtccgggagtgggtggaggcggggacgggcggcatgacgatgaggctgcacttaccgagttcctctcatcgctcatggactacacccccacgattcccgacgagctggtggagcactacctcggccgcagcgggttccactgccccgaccttcgcctaacgagactggttgctgtagccacccagaagttcctatcagacattgctagtgattctcttcaggtagcagcacctatcaaagacaataagagcaaacagcctaaggatagacgtcttgtattaaccatggatgatctttctaaagctttgcgtgagcatggtgtgaacttgaaacacccggagtacttcgcagacagcccttcagcaggaatggctccttcgacaagagaggagtag

SEQ ID NO: 7032 - protein, 148 aa, Sorghum bicolor
  misc_feature: Ceres ANNOT ID no. 6073498
  misc_feature (47)..(98): Pfam Id: TFIID_30kDa Pfam Desc: Transcription initiation factor TFIID 23-30kDa subunit
  misc_feature (26)..(125): NCBI GI: 140054316 NCBI Desc: transcription initiation factor tfiid, 23-30 kda subunit [medicago truncatula]
  misc_feature (28)..(148): NCBI GI: 41529318 NCBI Desc: tata box-binding protein associated factor 10 [flaveria trinervia]
  misc_feature (6)..(133): NCBI GI: 61363578 NCBI Desc: taf10 rna polymerase ii tata box binding protein-associated factor [synthetic construct]
  misc_feature (9)..(133): NCBI GI: 62859727 NCBI Desc: taf10 [xenopus tropicalis]
  misc_feature (6)..(133): NCBI GI: 5454106 NCBI Desc: tbp-related factor 10 [homo sapiens]
  misc_feature: Useful for making plants with altered Lignin content
  misc_feature: Useful for making plants with altered terpenoid content
  misc_feature: GREAT-hit functional homolog of the protein sequence given in SEQ ID NO 12990
  misc_feature: GREAT-hit functional homolog of the protein sequence given in SEQ ID NO 13033
  misc_feature: Useful for making plants with altered terpenoid content
  misc_feature: Functional homolog of the protein sequence given in SEQ ID NO 12990
  misc_feature: Useful for making plants with altered lignin content
  misc_feature: Functional homolog of the protein sequence given in SEQ ID NO 13033
MMSSNSGGGAGGSGGGMGPGVGGGGDGRHDDEAALTEFLSSLMDYTPTIPDELVEHYLGRSGFHCPDLRLTRLVAVATQKFLSDIASDSLQVAAPIKDNKSKQPKDRRLVLTMDDLSKALREHGVNLKHPEYFADSPSAGMAPSTREE

SEQ ID NO: 7033 - DNA, 171 bp, Sorghum bicolor
  misc_feature: Ceres ANNOT ID no. 6073513
  misc_feature: Encodes the peptide sequence at SEQ ID NO 7034
atggattcagagccgtcatcacagaacccaacagatatgactgcatttgtaaatgaaatgggaaccaagatcgacgaactcgagcagagcatcaacaatctcaaagctgagatgggcactgagatgccggccaagaagcctgatgagccaaagcctgctgactccgcgtaa

SEQ ID NO: 7034 - protein, 56 aa, Sorghum bicolor
  misc_feature: Ceres ANNOT ID no. 6073513
  misc_feature (10)..(41): Pfam Id: HSBP1 Pfam Desc: Heat shock factor binding protein 1
  misc_feature (1)..(56): NCBI GI: 20257534 NCBI Desc: heat shock factor-binding protein 1 [zea mays]
  misc_feature (17)..(55): NCBI GI: 115478883 NCBI Desc: os09g0375100 [oryza sativa (japonica cultivar-group)]
  misc_feature (17)..(56): NCBI GI: 38349095 NCBI Desc: heat shock factor binding protein 2 [zea mays]
MDSEPSSQNPTDMTAFVNEMGTKIDELEQSINNLKAEMGTEMPAKKPDEPKPADSA

SEQ ID NO: 7035 - DNA, 1437 bp, Sorghum bicolor
  misc_feature: Ceres ANNOT ID no. 6073517
  misc_feature: Encodes the peptide sequence at SEQ ID NO 7036
atggcccacccgcggctcgtgctcccctccccgaagccccttctccccgccgccgctaccgccactccatcgcgccgcgccgtcgccgtccgcgcggcgctctccaccgcttcgccgcccgccaaggcggcggcgggagcggaggcggtgcggtcgatccgcgcgcggcagatcgtggacagccgcgggaaccccaccgtcgaggtcgacctcgtcgccggggacggacgcctccaccgctccgcggtgcccagcggggcgtccacggggatctacgaggcgctcgagctccgcgacggcgacaaggccgtgtacggcgggaagggcgtgctccaagccgtgcgtaacatcaacgaggtcatcgcgcccaagctcgtgggcgtcgatgtgaggaaccagagcgatgttgatgcaatcatgctagacatcgatggaactgagaataaatcgaagttgggtgccaatgctattcttggagtctccttgagtgtatgtagggctggcgctggtgcaaagggagttcctttgtataaacatattcaggagctagcgggaattaaggagcttgtcatgcctgtccctgctttcaatgtaataaatggaggtagccatgctggcaacaatcttgccatgcaggaattcatgcttttacctgttggagcagctacttttgctgaagctcttcgtatgggcagtgaagtttaccatgtcctgaagggcatcattaagtcaaaatatggtcaagatgcatgcaatgttggagatgaaggaggttttgctcctaatgttcaagacaacagagagggtcttgtcttgcttatggatgccattgagaaggcaggctacactggaaagatcaaaattggaatggatgttgcggcatcagagtttcttacaaaggatgggagctacgatctaaactttaagaatcaacctaacgatggagcccatgttctttcagcccagcgtctgggtgatctgtacagagattttgtcaaggatttccctattgtatcaattgaggacccttttgatcaggatgactggagttcatgggcatcattgcaatcctcagtcgatatccaaattgtgggtgatgatttacttgtcacaaacccaaaacgtatatcagaggctattggcaagaaggcttgcaatgctttgttgctaaaggttaaccagattggtactgtcactgaatcaattcaagctgctctcgattcgaaagctgctggttggggtgtgatggtcagccacagaagtggtgaaaccgaagacaacttcattgcagatttggctgttggcttagcaagtgggcagattaaaaccggggctccatgccgcagcgagaggctggccaaatataatcagcttctgcggattgaagaggagcttggcaacgtgcgctatgcaggggaggcgttcaggtctccataa

SEQ ID NO: 7036 - protein, 478 aa, Sorghum bicolor
  misc_feature: Ceres ANNOT ID no. 6073517
  misc_feature (188)..(479): Pfam Id: Enolase_C Pfam Desc: Enolase, C-terminal TIM barrel domain
  misc_feature (49)..(180): Pfam Id: Enolase_N Pfam Desc: Enolase, N-terminal domain
  misc_feature (1)..(478): NCBI GI: 115478881 NCBI Desc: os09g0375000 [oryza sativa (japonica cultivar-group)]
  misc_feature (50)..(478): NCBI GI: 119381542 NCBI Desc: enolase [bombyx mori]
  misc_feature (50)..(476): NCBI GI: 60467884 NCBI Desc: phosphopyruvate hydratase [dictyostelium discoideum]
  misc_feature (50)..(478): NCBI GI: 19281 NCBI Desc: enolase [lycopersicon esculentum]
  misc_feature (49)..(478): NCBI GI: 515827 NCBI Desc: enolase [neocallimastix frontalis]
  misc_feature (50)..(478): SWISSPROT Homolog: EC 4.2.1.11 Enolase
  misc_feature: The sequence is a functional homolog of SEQ ID NO. 412 in the 11/188,298 US application
MAHPRLVLPSPKPLLPAAATATPSRRAVAVRAALSTASPPAKAAAGAEAVRSIRARQIVDSRGNPTVEVDLVAGDGRLHRSAVPSGASTGIYEALELRDGDKAVYGGKGVLQAVRNINEVIAPKLVGVDVRNQSDVDAIMLDIDGTENKSKLGANAILGVSLSVCRAGAGAKGVPLYKHIQELAGIKELVMPVPAFNVINGGSHAGNNLAMQEFMLLPVGAATFAEALRMGSEVYHVLKGIIKSKYGQDACNVGDEGGFAPNVQDNREGLVLLMDAIEKAGYTGKIKIGMDVAASEFLTKDGSYDLNFKNQPNDGAHVLSAQRLGDLYRDFVKDFPIVSIEDPFDQDDWSSWASLQSSVDIQIVGDDLLVTNPKRISEAIGKKACNALLLKVNQIGTVTESIQAALDSKAAGWGVMVSHRSGETEDNFIADLAVGLASGQIKTGAPCRSERLAKYNQLLRIEEELGNVRYAGEAFRSP

SEQ ID NO: 7037 - DNA, 1110 bp, Sorghum bicolor
  misc_feature: Ceres ANNOT ID no. 6073529
  misc_feature: Encodes the peptide sequence at SEQ ID NO 7038
atggagcacaagaaagctagagcagtggaggatcctgcccggttgatttgcgacgatgccctcactgaggtcttccgcaggctgcctgcccgtgcgctcgcggcatgcagattggtgtgcaagtcgtggatgtccgtgctcacagatccacatttcatccatgagcacctgagccgcggccagcagaagctgctgctctttgcgaacgaccgggcaaatgacaggtcgctcgccatggtgcttgcagacgacaagtccatgtaccagctgtcgaggcccgcggcgtctcggagcgtctttgtgcacaattcttgcaatggcctgctgtgcctaggcgatagcacaggagctgtggaggtgctgaacccgacgacaggtgaatctttaatgttgccgatgccaatgtacacggcagggagcagccagttctcatcctgtaattggcactgcttgggattttgcccacaaaaaagggaacacaaggttgtgcatttctatccaggagctcacattgattctttcaaggtacaatgtgagatatacacagttggagctggtgtctggagacaagttgggagctttcatggggctccgacggacagaggggtgcatgtgaatgggatggtgtactatctgacaaagtttcgctacattgcttcatcgcgtatcaactgcttgaatcttgagagtgaaaaatttgatgtgatgatgcttcccccgcgcaaatcttatggaggccattgctctttgacagagctcgagggaaagttatgcttgttgattgtggatggtgcactggaaggcccgcctcgtacaatggacatcctgatgctcaatagccatgataagcaggactggactcccagataccacttctccttgccttggttgatgccttcatgttattttactccgaaacacacgctcttccacgaaggaaagatttgggtgcagttgttggctaggagtctatactgttttgacccaagttcaagttcagaagaactaacgacagcctggccagagcttgacttttcatttagcacacatactttcattgagagcatagttccactgcgtaaagactactacttcaagcagatacaatga

SEQ ID NO: 7038 - protein, 369 aa, Sorghum bicolor
  misc_feature: Ceres ANNOT ID no. 6073529
  misc_feature (11)..(58): Pfam Id: F-box Pfam Desc: F-box domain
  misc_feature (202)..(332): Pfam Id: FBA_3 Pfam Desc: F-box associated
  misc_feature (19)..(239): NCBI GI: 86439727 NCBI Desc: fimbriata-like protein [triticum aestivum]
  misc_feature (13)..(262): NCBI GI: 86439730 NCBI Desc: fimbriata-like protein [triticum aestivum]
  misc_feature (19)..(239): NCBI GI: 115480177 NCBI Desc: os09g0517800 [oryza sativa (japonica cultivar-group)]
  misc_feature (2)..(191): NCBI GI: 86438632 NCBI Desc: fimbriata-like protein [brachypodium sylvaticum]
  misc_feature (1)..(294): NCBI GI: 42408777 NCBI Desc: stripe rust resistance protein-like [oryza sativa (japonica cultivar-group)]
  misc_feature: The sequence is a functional homolog of SEQ ID NO. 456 in the 11/188,298 US application
MEHKKARAVEDPARLICDDALTEVFRRLPARALAACRLVCKSWMSVLTDPHFIHEHLSRGQQKLLLFANDRANDRSLAMVLADDKSMYQLSRPAASRSVFVHNSCNGLLCLGDSTGAVEVLNPTTGESLMLPMPMYTAGSSQFSSCNWHCLGFCPQKREHKVVHFYPGAHIDSFKVQCEIYTVGAGVWRQVGSFHGAPTDRGVHVNGMVYYLTKFRYIASSRINCLNLESEKFDVMMLPPRKSYGGHCSLTELEGKLCLLIVDGALEGPPRTMDILMLNSHDKQDWTPRYHFSLPWLMPSCYFTPKHTLFHEGKIWVQLLARSLYCFDPSSSSEELTTAWPELDFSFSTHTFIESIVPLRKDYYFKQIQ

SEQ ID NO: 7039 - DNA, 978 bp, Sorghum bicolor
  misc_feature: Ceres ANNOT ID no. 6073530
  misc_feature: Encodes the peptide sequence at SEQ ID NO 7040
atgggctgctccatgtcggggctcaacgcgctgtacgacgcgaccacgggcggcagcgacgtctggatcaacgaccgccgcttccgcatcctccgccagatcggcgagggcggcttcgccttcgtctacctcgtcagggagcaccagcccgcctccgatgccgcggtcgccaggcgtgacaccgcccacgtctcagaggatggaacgtatgccatgaagaaggtgctgatacagagcaaggagcagttggatctggtgagggaggagatccgtgtgtcgtccttgttcaatcaccccaaccttctgccgcttcttgatcatgccgtattagcggtcaagggagattggagccatgaagcatacctacttttccctgttcatttggatggtactttgttcgacaacgctaacatcatgctctcaagaaaggaattctattccacagctgatgttctgcaaatattccggcagatgtgtgaagggctgaaacacatgcacagctttgatcctccgtacgcccataatgatgttaagcctggtaatgttcttataacctggcgtaaaggacaagcacctgttgcaactttaatggattttggaagtgcaaggcctgcaagaaaggaaatccgttctcgttctgaggcattacaattgcaggaatgggctgctgagcattgctctgcaccttatcgggcccctgaattatgggactgcccaagccatgccgatatcgatgagaggacagacatctggtacaatgtttcaccatttgagtatgctcttggtgaatctgaaggaagtctgcaacttgccattgtcaacgggcagttgaagtggccagcaggacccaaacctccttatcctgatgagcttcgccagtttgttatctggatgcttcaacctcaagctgcaatgcgcccgcacatttccgatgtgcttcttcatgttgacaagctcattgcaaaatacttgccctag

SEQ ID NO: 7040 - protein, 325 aa, Sorghum bicolor
  misc_feature: Ceres ANNOT ID no. 6073530
  misc_feature (28)..(316): Pfam Id: Pkinase Pfam Desc: Protein kinase domain
  misc_feature (28)..(316): Pfam Id: Pkinase_Tyr Pfam Desc: Protein tyrosine kinase
  misc_feature (1)..(323): NCBI GI: 21593866 NCBI Desc: serine/threonine protein kinase [arabidopsis thaliana]
  misc_feature (1)..(323): NCBI GI: 71727712 NCBI Desc: serine/threonine protein kinase [gossypium hirsutum]
  misc_feature (45)..(325): NCBI GI: 82400199 NCBI Desc: serine/threonine kinase [elaeis guineensis]
  misc_feature (21)..(319): NCBI GI: 49257927 NCBI Desc: mgc69350 protein [xenopus tropicalis]
  misc_feature (67)..(319): NCBI GI: 51949998 NCBI Desc: mgc81705 protein [xenopus laevis]
  misc_feature: The sequence is a functional homolog of SEQ ID NO. 366 in the 11/188,298 US application
  misc_feature: The sequence is a functional homolog of SEQ ID NO. 498 in the 11/188,298 US application
  misc_feature: The sequence is a functional homolog of SEQ ID NO. 340 in the 11/188,298 US application
  misc_feature: The sequence is a functional homolog of SEQ ID NO. 310 in the 11/188,298 US application
  misc_feature: The sequence is a functional homolog of SEQ ID NO. 464 in the 11/188,298 US application
  misc_feature: The sequence is a functional homolog of SEQ ID NO. 446 in the 11/188,298 US application
  misc_feature: The sequence is a functional homolog of SEQ ID NO. 399 in the 11/188,298 US application
  misc_feature: The sequence is a functional homolog of SEQ ID NO. 358 in the 11/188,298 US application
  misc_feature: The sequence is a functional homolog of SEQ ID NO. 311 in the 11/188,298 US application
  misc_feature: The sequence is a functional homolog of SEQ ID NO. 312 in the 11/188,298 US application
MGCSMSGLNALYDATTGGSDVWINDRRFRILRQIGEGGFAFVYLVREHQPASDAAVARRDTAHVSEDGTYAMKKVLIQSKEQLDLVREEIRVSSLFNHPNLLPLLDHAVLAVKGDWSHEAYLLFPVHLDGTLFDNANIMLSRKEFYSTADVLQIFRQMCEGLKHMHSFDPPYAHNDVKPGNVLITWRKGQAPVATLMDFGSARPARKEIRSRSEALQLQEWAAEHCSAPYRAPELWDCPSHADIDERTDIWYNVSPFEYALGESEGSLQLAIVNGQLKWPAGPKPPYPDELRQFVIWMLQPQAAMRPHISDVLLHVDKLIAKYLP

SEQ ID NO: 7041 - DNA, 1563 bp, Sorghum bicolor
  misc_feature: Ceres ANNOT ID no. 6073551
  misc_feature: Encodes the peptide sequence at SEQ ID NO 7042
  misc_feature: Up-regulated in shoot tissues in response to salicylic acid treatment
atggcggcggaggcggggaggcggacgctggcgctggtgaacctggcggccatcatggagcgcgccgacgaggcgctgctgccggccgtgtaccgggaggtgggcgacgcgctgggcgccacgcccgtcgcgctcggcgggctcacgctctaccgctccgccgtgcaggccgcctgctacccgctcgccgcctacgccgccgtgcgctacaaccgcgcccacgttgtcgccgttggggcgcttctctgggccgccgctaccttcctcgtcgccgtctccggcaccttcgcccaggtagcgatagctagaggtttgaatggtattggcctagcacttgtcaccccagcaatccaatctctagtggcagattgctctgatgacaatactcgaggcgccgcatttggatggcttcaactcacgggcaacatcggttcaattattggtggattgttttccctgatgctagcatcaaccacagtcatgggtattgccggttggcgcgtagcatttcacattgttgctcttataagtgttgtagtcggtgtgttggttggcctattcgcagtggaccctcatttcctccatgttcaaagtggcgagcagctgttgggcaagtctgcatgggcagagatgaaggatttactgagagaagccaaggctgttgtaaaaatctcatcatttcagatcattgtggctcagggtgtcacaggctcgtttccatggtctgccctggcctttgccccgatgtggttggagttgatggggtttacacataacaaaactggactcctcataacaacatttgcactggcaagctcacttggagggctattaggtggaaagatgggggatcactttgctactcgcttcccagattctggtcgaatagtcctgtcacagataagctcggcttctgctattccactggctgctctattgcttttggggctccctgataactcttcttctggtttcttgcatggacttgtcatgtttattatggggctgagcatctcctggaacggtcctgcaactaacaacccgatatttgctgagattgtacctgagaggtcaagaacaagtatctatgcattggaccgttcttttgagtcagttttagcttcatttgctccaccagttgttgggtttctagctgagcatgtttatggctacaatcccatctcctatggagctgcagataacaatgttggcagggataaatcaaatgctgatgccctagccaaagctctatacacgtcgatcgccatacccatgctgctttgctgcttcatctactccctgttgtaccggacatacccacgcgacagggagagggcaaggatggacactctgatcacttcagagctccagcagattgaactggaaagatgtcatgggatagggggtcattattctggaaggaaggatgacgccactgtgatcgatatggagtacagcgaggaagattttgatgccgatgatgatgaaaagggtctgatggatcagcaggctaagcagagtggcagtgtcaagtggaacgggagtgattcacaaaatttgtga

SEQ ID NO: 7042 - protein, 520 aa, Sorghum bicolor
  misc_feature: Ceres ANNOT ID no. 6073551
  misc_feature (10)..(378): Pfam Id: MFS_1 Pfam Desc: Major Facilitator Superfamily
  misc_feature (9)..(450): Pfam Id: Sugar_tr Pfam Desc: Sugar (and other) transporter
  misc_feature (4)..(511): NCBI GI: 37806444 NCBI Desc: transporter-like protein [oryza sativa (japonica cultivar-group)]
  misc_feature (7)..(503): NCBI GI: 115478853 NCBI Desc: os09g0371200 [oryza sativa (japonica cultivar-group)]
  misc_feature (99)..(462): NCBI GI: 49389121 NCBI Desc: transporter-like protein [oryza sativa (japonica cultivar-group)]
  misc_feature (7)..(497): NCBI GI: 49389120 NCBI Desc: membrane transport protein-like [oryza sativa (japonica cultivar-group)]
  misc_feature (9)..(487): NCBI GI: 72384418 NCBI Desc: 4d11_20 [brassica rapa subsp. pekinensis]
  misc_feature: Up-regulated in shoot tissues in response to salicylic acid treatment
MAAEAGRRTLALVNLAAIMERADEALLPAVYREVGDALGATPVALGGLTLYRSAVQAACYPLAAYAAVRYNRAHVVAVGALLWAAATFLVAVSGTFAQVAIARGLNGIGLALVTPAIQSLVADCSDDNTRGAAFGWLQLTGNIGSIIGGLFSLMLASTTVMGIAGWRVAFHIVALISVVVGVLVGLFAVDPHFLHVQSGEQLLGKSAWAEMKDLLREAKAVVKISSFQIIVAQGVTGSFPWSALAFAPMWLELMGFTHNKTGLLITTFALASSLGGLLGGKMGDHFATRFPDSGRIVLSQISSASAIPLAALLLLGLPDNSSSGFLHGLVMFIMGLSISWNGPATNNPIFAEIVPERSRTSIYALDRSFESVLASFAPPVVGFLAEHVYGYNPISYGAADNNVGRDKSNADALAKALYTSIAIPMLLCCFIYSLLYRTYPRDRERARMDTLITSELQQIELERCHGIGGHYSGRKDDATVIDMEYSEEDFDADDDEKGLMDQQAKQSGSVKWNGSDSQNL

SEQ ID NO: 7043 - DNA, 843 bp, Sorghum bicolor
  misc_feature: Ceres ANNOT ID no. 6073558
  misc_feature: Encodes the peptide sequence at SEQ ID NO 7044
atgttgacaccgcgcgtcctcaagccttcgctgctccgccgcctgcgcgctgccgccgagctgcctccgccgtggcgaccccggatcctacctgtgcagacttaccattccagaggctattctaatgggggaagctccaagtatgataggccaatgagacagttttctgaacagaatgagtcaacttctaggccattgatatattatgttgctcctgctctacttgcttttgctgggatagcaacttttgttcattacaatgatgagaggcgtgcagttcccttcgctaaagtaccaggacagaccagtgttcccaaaagatgtaataccaatagacctgctataggagggccatttaagctatatgatacagaaaaaaatgaggtgactgaatcgaagcttcggggaaattggactctgatgtactttggctatacatcatgcccagatgtgggtccagccgaagttcagaagatggctgatgttgttaaactgttagagtcaaagtatgctatcaagattataccactctttatcacaattgatcctcaacgtgattcaccttctcagcttaaggcataccttagtgagtttgacccaagaatagtaggactaacaggccccatcagtgcagtaagacagattgctcaggagtaccgtgttttctttaaaagagtagaggaagttggtcaggactatcttgtagagagctctcacaatatgtacttgctagatccatgcttggagacagttaggtgctttggaactgagtatgaagcatcagaccttgctgaggcgataacaacagaggttcagaaagcatctgcttcatcaacaaattag

SEQ ID NO: 7044 - protein, 280 aa, Sorghum bicolor
  misc_feature: Ceres ANNOT ID no. 6073558
  misc_feature (73)..(259): Pfam Id: SCO1-SenC Pfam Desc: SCO1/SenC
  misc_feature (93)..(272): NCBI GI: 115444369 NCBI Desc: os02g0159700 [oryza sativa (japonica cultivar-group)]
  misc_feature (71)..(272): NCBI GI: 6319511 NCBI Desc: sco1p [saccharomyces cerevisiae]
  misc_feature (56)..(259): NCBI GI: 44983312 NCBI Desc: ael191cp [eremothecium gossypii]
  misc_feature (56)..(259): NCBI GI: 45190416 NCBI Desc: ael191cp [eremothecium gossypii]
  misc_feature (112)..(272): NCBI GI: 99031881 NCBI Desc: chain d, crystal structure of yeast sco1
MLTPRVLKPSLLRRLRAAAELPPPWRPRILPVQTYHSRGYSNGGSSKYDRPMRQFSEQNESTSRPLIYYVAPALLAFAGIATFVHYNDERRAVPFAKVPGQTSVPKRCNTNRPAIGGPFKLYDTEKNEVTESKLRGNWTLMYFGYTSCPDVGPAEVQKMADVVKLLESKYAIKIIPLFITIDPQRDSPSQLKAYLSEFDPRIVGLTGPISAVRQIAQEYRVFFKRVEEVGQDYLVESSHNMYLLDPCLETVRCFGTEYEASDLAEAITTEVQKASASSTN

SEQ ID NO: 7045 - DNA, 948 bp, Sorghum bicolor
  misc_feature: Ceres ANNOT ID no. 6073583
  misc_feature: Encodes the peptide sequence at SEQ ID NO 7046
atggccgccgctatagatctgtcaggggaggagctgatgagagcactcgagccttttatccgggatgcctcctctgctcctcacggatccagtccgctcctccacccccaccaccagcctctcagtccctcgtcgccgttctccttccaccacgccgccgcctacggcgggtacccgttcgccgccgccgcggccgagggggcgggccagctgagcccagcccagatgcagtacatccaggcccgcctccacctgcagcgccagtcgcagcagtcctccgtgctgggcccgcgggcccagcccatgaaggcgtccgcggcggcggccccgaccccgccgcgtccgcagaagctgtaccgcggcgtgcggcagcggcactggggcaagtgggtcgccgagatccgcctcccgcggaaccgcacccgcctctggctcggccgcctaccgcctccgcggcgacgcggcgcgcctcaacttccccgacaacgccgcctcccggggcccgctccacgcctccgtcgacgccaagctccagacgctctgccagaacatcgccgcgtccaagaagggcgccaagaagcacgcctccgcctccgccgcagctgctgccgccacgtcgtcgtccgcccccaccagcaactgctcctcgtcgccgtcctccgacgacgcgtcctcgtcctgctgcctcgagtccgccgccgagtcctcgtgcccgtccccgtccccgtccgcctcccccgagtcgtcgacggtgccggagatgcagcagctggacttcagcgaggcgccgtgggacgaggccgccggcttcgcgctcaccaagtacccgtcgtacgagatcgactgggactccctcctcgccgccaattaaccaccgaccgacattgttctttccttcttggctccttccgactgctactactactgcaggctgcagcagagggttaa

SEQ ID NO: 7046 - protein, 315 aa, Sorghum bicolor
  misc_feature: Ceres ANNOT ID no. 6073583
  misc_feature (1)..(172): NCBI GI: 32140997 NCBI Desc: dre binding factor 2 [oryza sativa (japonica cultivar-group)]
  misc_feature (1)..(172): NCBI GI: 49388786 NCBI Desc: dre binding factor 2 [oryza sativa (japonica cultivar-group)]
  misc_feature (1)..(172): NCBI GI: 31745669 NCBI Desc: ap2-domain dre binding factor dbf1 [oryza sativa (japonica cultivar-group)]
  misc_feature (1)..(146): NCBI GI: 34099926 NCBI Desc: dreb2 [glycine max]
  misc_feature (76)..(172): NCBI GI: 21908036 NCBI Desc: dre binding factor 1 [zea mays]
  misc_feature: The sequence is a functional homolog of SEQ ID NO 116 in the 11/479,226US patent application
  misc_feature: The sequence is a functional homolog of SEQ ID NO 1288 in the 10/374,780US patent application
  misc_feature: The sequence is a functional homolog of SEQ ID NO 1289 in the 10/374,780US patent application
  misc_feature: The sequence is a functional homolog of SEQ ID NO 1290 in the 10/374,780US patent application
  misc_feature: The sequence is a functional homolog of SEQ ID NO 1434 in the 10/412,699US patent application
  misc_feature: The sequence is a functional homolog of SEQ ID NO 1435 in the 10/412,699US patent application
  misc_feature: The sequence is a functional homolog of SEQ ID NO 1436 in the 10/412,699US patent application
  misc_feature: The sequence is a functional homolog of SEQ ID NO 1712 in the 10/412,699US patent application
  misc_feature: The sequence is a functional homolog of SEQ ID NO 1948 in the 10/374,780US patent application
  misc_feature: The sequence is a functional homolog of SEQ ID NO 256 in the 11/375,241US patent application
  misc_feature: The sequence is a functional homolog of SEQ ID NO 6 in the 10/412,699US patent application
  misc_feature: The sequence is a functional homolog of SEQ ID NO 722 in the 10/225,066US patent application
  misc_feature: The sequence is a functional homolog of SEQ ID NO 906 in the 11/435,388US patent application
  misc_feature: Useful for making plants with modulated growth and phenotype characteristics
  misc_feature: The sequence is a functional homolog of SEQ ID NO 1434 in the 20040045049 US patent application
  misc_feature: The sequence is a functional homolog of SEQ ID NO 1435 in the 20040045049 US patent application
  misc_feature: The sequence is a functional homolog of SEQ ID NO 1436 in the 20040045049 US patent application
  misc_feature: The sequence is a functional homolog of SEQ ID NO 1712 in the 20040045049 US patent application
MAAAIDLSGEELMRALEPFIRDASSAPHGSSPLLHPHHQPLSPSSPFSFHHAAAYGGYPFAAAAAEGAGQLSPAQMQYIQARLHLQRQSQQSSVLGPRAQPMKASAAAAPTPPRPQKLYRGVRQRHWGKWVAEIRLPRNRTRLWLGRLPPPRRRGAPQLPRQRRLPGPAPRLRRRQAPDALPEHRRVQEGRQEARLRLRRSCCRHVVVRPHQQLLLVAVLRRRVLVLLPRVRRRVLVPVPVPVRLPRVVDGAGDAAAGLQRGAVGRGRRLRAHQVPVVRDRLGLPPRRQLTTDRHCSFLLGSFRLLLLLQAAAEG

SEQ ID NO: 7047 - DNA, 453 bp, Sorghum bicolor
  misc_feature: Ceres ANNOT ID no. 6073587
  misc_feature: Encodes the peptide sequence at SEQ ID NO 7048
atgaccaaaactgccgtgttttcccggaggatcagccactgcaaggtgaaggccgtggctacatcgccaagggctttatgccccaagggaagcatgacagactactacaaggtgctgtcgctggagcactcggcggccgtgggcgcggaggagatcaagcgcgcgtaccggcggctggcgctgcggtaccaccccgacgtgtgcccgccgtcgcgtcgcggcgagtccacggagctcttcctcgagctgcgtcgcgcctacgagacgctgtccgacccggcgcagaggctccggtacgacgccgagctgagggcgggcggcgaggacccggccgccggtgttgcgttcgcgagggacgtgtgggaggcgcagctgtgtgcgctgcgcgcgcgctccgagcagcggcagagcgcgaggagcggtggcgtgcgcactcgcagggcacgcgcatga

SEQ ID NO: 7048 - protein, 150 aa, Sorghum bicolor
  misc_feature: Ceres ANNOT ID no. 6073587
  misc_feature (34)..(100): Pfam Id: DnaJ Pfam Desc: DnaJ domain
  misc_feature (35)..(147): NCBI GI: 6691127 NCBI Desc: dnaj-like protein [arabidopsis thaliana]
  misc_feature (35)..(149): NCBI GI: 113374278 NCBI Desc: dnaj-like protein isoform [solanum phureja]
  misc_feature (2)..(106): NCBI GI: 146424720 NCBI Desc: dnaj-like protein [glycine max]
  misc_feature (34)..(119): NCBI GI: 15678002 NCBI Desc: dnaj protein [neisseria meningitidis mc58]
  misc_feature (35)..(140): NCBI GI: 144924052 NCBI Desc: cellular retinaldehyde-binding/triple function, c-terminal; heat shock protein dnaj, n-terminal; phosphatidylinositol transfer protein-like, n-terminal [medicago
  misc_feature (35)..(140): NCBI GI: 144924052 (continued) truncatula]
MTKTAVFSRRISHCKVKAVATSPRALCPKGSMTDYYKVLSLEHSAAVGAEEIKRAYRRLALRYHPDVCPPSRRGESTELFLELRRAYETLSDPAQRLRYDAELRAGGEDPAAGVAFARDVWEAQLCALRARSEQRQSARSGGVRTRRARA

SEQ ID NO: 7049 - DNA, 486 bp, Sorghum bicolor
  misc_feature: Ceres ANNOT ID no. 6073616
  misc_feature: Encodes the peptide sequence at SEQ ID NO 7050
atgggaggcacgctggagtacttgtcggatctgctgggcggcggcggcggcggcagcagccggcgccggtacaagaagaggaagcagttccagacggtggagctcaaggtgcgcatggactgcgacggctgcgagatgaaagtcaggaacgccctctccagcatgaaaggggtgcactccgtggagatcaaccggaagcagtacaaggtgacggtgcaggggtacgtggagccgcacaaggtggtgaagcgggtgcaggccacggggaagaaggccgagatctggccctacgtgccctacagcctcgtcgcgcacccctacgccgcgccggcctacgacaagaaggcgccgccggggtacgtgcgcagggtcgacgccgtcatgcccgtctccagctacggcggaccaacggcggccggcccgcaggaggagcggctcgtcaccatgttcagcgacgacaaccccaacgcatgctccatcatgtaa

SEQ ID NO: 7050 - protein, 161 aa, Sorghum bicolor
  misc_feature: Ceres ANNOT ID no. 6073616
  misc_feature (34)..(94): Pfam Id: HMA Pfam Desc: Heavy-metal-associated domain
  misc_feature (1)..(161): NCBI GI: 92899055 NCBI Desc: heavy metal transport/detoxification protein [medicago truncatula]
  misc_feature (62)..(161): NCBI GI: 115478815 NCBI Desc: os09g0364800 [oryza sativa (japonica cultivar-group)]
  misc_feature (20)..(161): NCBI GI: 23304411 NCBI Desc: farnesylated protein 1 [hordeum vulgare subsp. vulgare]
  misc_feature (3)..(161): NCBI GI: 21536547 NCBI Desc: farnesylated protein (atfp6) [arabidopsis thaliana]
  misc_feature (21)..(161): NCBI GI: 79547451 NCBI Desc: metal ion binding [arabidopsis thaliana]
  misc_feature: Useful for biocontainment applications
  misc_feature: Functional homolog of the protein sequence given in SEQ ID NO 13156
MGGTLEYLSDLLGGGGGGSSRRRYKKRKQFQTVELKVRMDCDGCEMKVRNALSSMKGVHSVEINRKQYKVTVQGYVEPHKVVKRVQATGKKAEIWPYVPYSLVAHPYAAPAYDKKAPPGYVRRVDAVMPVSSYGGPTAAGPQEERLVTMFSDDNPNACSIM

SEQ ID NO: 7051 - DNA, 1794 bp, Sorghum bicolor
  misc_feature: Ceres ANNOT ID no. 6073618
  misc_feature: Encodes the peptide sequence at SEQ ID NO 7052
atgctatcccgcgcgcggcgcctccatcccgccgtccgccgattcctcctcccaaacacgcctgcaccctcccgtcctgctccgctcccacctcaacacagcgcttccgcccaaacctctaaaaccttctcgatcctcttccgccgccacctctgctcctcaccacccgcgccgccgccgtcgacatcaccgcctccagcggtggtatcttctgacctcccggccgttcgcgtcaatgaagtctgcccgggatgcggaatctccatgcaatcctccgaccccgcgctcccgggcttcttcttgctcccctccgcaaaatcccccgactaccgcgcgcgcctcgcgcccgtcaccaccgacgacactcgaatctccgcctccctcaagtccggtcaccttagggaggacttagagccgtcgggaagcgacaagccggccgcggcggcggctgagatggctgattccaagggagagggaaaggtgttggtatgcgcgcgatgccactccctgcgccactacggccgcgtcaagcatccggacgccgagcgcctcctcccggacttcgacttcgtcgccgccgtcggcccgcgcctcgcgtcgccttccggggccaggtcgctcgtgctgctcctggcggacgcctctgacttcgacggctcgttcccgcgcgccgtcgcgcggttggtggccgcagccggcgaggcccacagcgcggactggaagcacggggccccggccaacctcccacgcgcgctgctcgtggtcaccaagctcgacctgctccccacgccgtcgctgtcccccgacgatgtgcacgcgtgggcgcactcccgcgctcgtgccggtgcaggttcagaccttcggctcgctggggtgcacttggttagcgccgcgcgcggatggggcgtccgcgacctgctcgaacatgtgcgcgagctcgccgggacgcgcggcaatgtctgggccgtgggtgcgcgaaacgttggtaagtcgacgctgctcaatgcgatcgccagatgctctggcatagccgggcgacccaccttgacggaggcgccagttccgggaacgacccttgatgtgattaagctagatggcgttcttggtgctcaagcaaagctgtttgacactcctggacttctccatgggcatcagttgacatctagactgacgagcgaggagatgaagttggttcaagtgagaaaggagatgagtcccagaacttacagaataaagacaggacagtccatacatatcggtggactggtgcgcctggacgttgaagagttaactgtaggatcgatctatgttacagtttgggcagcaccacttgtcccacttcacatgggaaagacagaaaacgcagcagcattgatgaaagaacactttggcttacaactacagcctcccataggccaggagcaggtaaaggagcttggtaaatgggtgaggaaacaattcaaagtttccgggaacagttgggatatgaactctaaggatatagccattgctggtattggctggtttggaattgggctgaaaggagaggcggtgttaggattatggacatatgatggtgttgatgtcatctccaggagctccttagtccatgagagggcttcaatttttgaggaagctggtttcacagtttcacagattgtttctaaggcagatagcatgaccaataagctgaagagcaccaagaagccgaacaagaagaaagagagaacgaaaagtgcttctcccctcacaaagccggaagcttcagaacctgcttccaacatagatgcttga

SEQ ID NO: 7052 - protein, 597 aa, Sorghum bicolor
  misc_feature: Ceres ANNOT ID no. 6073618
  misc_feature (318)..(412): Pfam Id: MMR_HSR1 Pfam Desc: GTPase of unknown function
  misc_feature (1)..(597): NCBI GI: 50726207 NCBI Desc: gtp-binding protein-like [oryza sativa (japonica cultivar-group)]
  misc_feature (278)..(578): NCBI GI: 87241448 NCBI Desc: imp dehydrogenase/gmp reductase [medicago truncatula]
  misc_feature (252)..(536): NCBI GI: 94993651 NCBI Desc: gtp-binding protein [streptococcus pyogenes mgas10750]
  misc_feature (252)..(536): NCBI GI: 71902919 NCBI Desc: gtp-binding protein [streptococcus pyogenes mgas6180]
  misc_feature (252)..(536): NCBI GI: 94543275 NCBI Desc: gtp-binding protein [streptococcus pyogenes mgas10270]
MLSRARRLHPAVRRFLLPNTPAPSRPAPLPPQHSASAQTSKTFSILFRRHLCSSPPAPPPSTSPPPAVVSSDLPAVRVNEVCPGCGISMQSSDPALPGFFLLPSAKSPDYRARLAPVTTDDTRISASLKSGHLREDLEPSGSDKPAAAAAEMADSKGEGKVLVCARCHSLRHYGRVKHPDAERLLPDFDFVAAVGPRLASPSGARSLVLLLADASDFDGSFPRAVARLVAAAGEAHSADWKHGAPANLPRALLVVTKLDLLPTPSLSPDDVHAWAHSRARAGAGSDLRLAGVHLVSAARGWGVRDLLEHVRELAGTRGNVWAVGARNVGKSTLLNAIARCSGIAGRPTLTEAPVPGTTLDVIKLDGVLGAQAKLFDTPGLLHGHQLTSRLTSEEMKLVQVRKEMSPRTYRIKTGQSIHIGGLVRLDVEELTVGSIYVTVWAAPLVPLHMGKTENAAALMKEHFGLQLQPPIGQEQVKELGKWVRKQFKVSGNSWDMNSKDIAIAGIGWFGIGLKGEAVLGLWTYDGVDVISRSSLVHERASIFEEAGFTVSQIVSKADSMTNKLKSTKKPNKKKERTKSASPLTKPEASEPASNIDA

SEQ ID NO: 7053 - DNA, 1842 bp, Sorghum bicolor
  misc_feature: Ceres ANNOT ID no. 6073657
  misc_feature: Encodes the peptide sequence at SEQ ID NO 7054
atggccgccaccccgccggccccggcgccgccgcgcatcctcctcgccggcgatgcccacggccgactccaccagctcttcaagcgcgtcaaatcggtgaaccagtcgacggggccgttccacgcgctgctctgcgtggggcagttcttctctcccgagggggatgccgagggcgcaccgggggacgtcgccgactacatcgaggggcgcgcttccgtgcccatcccgacctacttcaccggcgactacggcccctcggcgccgcggctgctgtcgaaggccgccgctggtgctcgcgggttcgcgcccggaggcatcgagatatgccccaacctcttctggcttaggggaagcaaccgcttcaccctccacgttttgtcggtggtttatttgtcagggagaaagggactaggagggcctggctgctacagccaggatgacgtggatgccctgcgggctcttgcagaagagccagggatcgtcgatctgttcttgacatatcctttttttttcattactgttacttccactgccttggtcagtggggctgacacttccaatgtgcctaaccaggttttggatcctattgggtatgatcctattgttgctgaattggttgctgagattaagccaagatatcacattgctggtactaaaggtgtcttttattcaagggaaccatatgtcaatgattctgctgcgcatgttacccgctttattggacttgctaatgttggaaacaaagagaagcagaaatttattcatgcgatttctcctactccagcatctgtcatgtccagtgctgatatccatgccaagcctccaaatgctactttgtcaccatatgttggtccatcaaaatcagttcctattgaagaagctccaaaacgtccagctgagaacattgattcgcaatattggcgttatgatgtcaagcggcaaaggcatggtgaagctgatggaggtgggttgtgtttcaaatttacatcctcaggatcctgtcaacgagggagtaaatgcaattataggcatgatgaggaggcactggagcattatcagagaaatgtctgttttgattttctaaacaaagggaaatgtgagaggggtccagagtgcaagtttgttcacagcctttcaggggagactgccctaagagatgcaagacctcgtagtgaaagaagacgtgtggagagcagttgctggttctgcttatcgagtccagatgttgagtcacatcttgtcattagcattggagaaggttactactgcacacttgcaaaggggccgcttgttccaaatcacgttctaatgattcccgtcgaacactgccccaatacattgatgatgcctccagaagcagaggcagaacttgggagatataaaattgctctgggtaagtactttgagaagcaaggaaagactgcagtctactttgagtgggtttcaccgcgctcccaccatgcaaacctgcaggttgttcctgtaccattgcctaaagcagacgctgttaataagatatttcatctagcagcaaaaaaactgggatttgaattctctatggtgaatccagatggtgcaaaaacagctagagaatcattgatgtctcagtgcgaaagcaaatcaggcatgttttatgttgagctcccggaaggtagaattctcctgcacatgatcgacagtaatgagaagttccctgtgcagtttggacgcgaggtgttagcaggactgctaagcatggcggattgcgcagattggaggaactgcaagatttcaaaggaagaagagattaaaatggtggatgatttcaaacaaggtttccacgaatttgatcccgcagagtga

SEQ ID NO: 7054 - protein, 613 aa, Sorghum bicolor
  misc_feature: Ceres ANNOT ID no. 6073657
  misc_feature (387)..(508): Pfam Id: CwfJ_C_1 Pfam Desc: Protein similar to CwfJ C-terminus 1
  misc_feature (517)..(612): Pfam Id: CwfJ_C_2 Pfam Desc: Protein similar to CwfJ C-terminus 2
  misc_feature (352)..(378): Pfam Id: zf-CCCH Pfam Desc: Zinc finger C-x8-C-x5-C-x3-H type (and similar)
  misc_feature (2)..(613): NCBI GI: 50726200 NCBI Desc: cwfj / zinc finger(ccch-type)-like protein [oryza sativa (japonica cultivar-group)]
  misc_feature (208)..(613): NCBI GI: 22327900 NCBI Desc: cwfj-like family protein / zinc finger (ccch-type) family protein [arabidopsis thaliana]
  misc_feature (377)..(610): NCBI GI: 14250583 NCBI Desc: cwf19-like 1, cell cycle control [homo sapiens]
  misc_feature (385)..(610): NCBI GI: 27503205 NCBI Desc: mgc53307 protein [xenopus laevis]
  misc_feature (380)..(610): NCBI GI: 45550410 NCBI Desc: cg7741-pa [drosophila melanogaster]
MAATPPAPAPPRILLAGDAHGRLHQLFKRVKSVNQSTGPFHALLCVGQFFSPEGDAEGAPGDVADYIEGRASVPIPTYFTGDYGPSAPRLLSKAAAGARGFAPGGIEICPNLFWLRGSNRFTLHVLSVVYLSGRKGLGGPGCYSQDDVDALRALAEEPGIVDLFLTYPFFFITVTSTALVSGADTSNVPNQVLDPIGYDPIVAELVAEIKPRYHIAGTKGVFYSREPYVNDSAAHVTRFIGLANVGNKEKQKFIHAISPTPASVMSSADIHAKPPNATLSPYVGPSKSVPIEEAPKRPAENIDSQYWRYDVKRQRHGEADGGGLCFKFTSSGSCQRGSKCNYRHDEEALEHYQRNVCFDFLNKGKCERGPECKFVHSLSGETALRDARPRSERRRVESSCWFCLSSPDVESHLVISIGEGYYCTLAKGPLVPNHVLMIPVEHCPNTLMMPPEAEAELGRYKIALGKYFEKQGKTAVYFEWVSPRSHHANLQVVPVPLPKADAVNKIFHLAAKKLGFEFSMVNPDGAKTARESLMSQCESKSGMFYVELPEGRILLHMIDSNEKFPVQFGREVLAGLLSMADCADWRNCKISKEEEIKMVDDFKQGFHEFDPAE

SEQ ID NO: 7055 - DNA, 1776 bp, Sorghum bicolor
  misc_feature: Ceres ANNOT ID no. 6073664
  misc_feature: Encodes the peptide sequence at SEQ ID NO 7056
atggcgtcgagcagcagagccgtgcgcttcttcaagctgctgctcctggcgtgcctcctcagcctctgcgagctgtcccaaggcaaggacaagaagccattcttcaccttgaagaacctcccgccgctccagaaggccagcagctacccggcggggtgcgcgacgacgtacgactacatcatcgtcggcggcggcaccgcggggtgcccgctggcggcgacgctgtcgctccggtacaaggtgctgctgctggagcgcggaggctccccgtacggcaaccgcaacgtctcctacatggagaacttccacatcgggctgatgaacatggcgccggactcgccgtcgcaggccttcatctccaccgacggcgtcatcaatgccagggccagggtgttgggcggtggaacctgcatcaatgccggcttctacagccgggccagctcaagctttatccaggaggtcggctgggatgaagacctggtgaacaagtccttcccttgggtagaagagaagattgtccagtggcctaagatcgcaccttggcaggccgcgctacgggatgggctgctacaagcaggtgtagcccctttcaatgggtatacctacgatcatgtttctggaacaaaggtgggtggcaccatctttgacgagactgggtaccgccacacggctgccgacttgctagcagctggagatcctaacaacctgagggtgctgctccatgctagtgtgcacaagatagtgtttgactcgcgacaaggacgaatgaaggcaagagccatcggagtccaattcactgatgagaatgggagacaccaccaggcatttttaaacagcaacaaagatagtgaaataattgtatctgctggtgcgatcggtaccccccagttgctgctgctcagtgggattggacccaagaatgacctcaagaatcataacattccagtggttctccataacaaatatgtgggtaaagggatggctgacaatcccatgaactccatattcataccaacaagaagccctcctcggcagtctctcattgaaactgttggaataactgaagaaggtgtgttcattgaggccagcagcgggtttggtcagtcatcagagagtgtccactgccaccatggaatcatgtctgctgagattggacagctttctaccattcctccgaagcaaagaaccctggaagcagcccagaaatacgctcataacaaacttaatctacccaaagaggtattccacggtggttttatacttgagaagattgatggtccgctgtccacaggccatctggtcctcacagacactgatgtccggaacaatccagcagttaccttcaactacttcagtcatccacaggatctcaatcattgtgtctatggtatcaagaccattgaaaggatactcaagacaaaccgtttctctgaactctctgctgatggtgctgggttatcaatggaaagggtgctcaatatgagtgtgcaggctaatgtgaacctgatacccaagcatacaaatgacacagaatccctggagcagttttgcaaggacactgtgatcaccatctggcattatcatggtgggtgccatgtagggaaggtggttgaccagcattacagggtgcttggagtttcaggtctccgggtggtcgatggctcaatattttctagatcaccagggaccaaccctcaagctacagtcatgatgatgggcagatatatgggagtgaagatcctaagggaaaggctgggacgagcagctggagtgtag

SEQ ID NO: 7056 - protein, 591 aa, Sorghum bicolor
  misc_feature: Ceres ANNOT ID no. 6073664
  misc_feature (420)..(576): Pfam Id: GMC_oxred_C Pfam Desc: GMC oxidoreductase
  misc_feature (57)..(347): Pfam Id: GMC_oxred_N Pfam Desc: GMC oxidoreductase
  misc_feature (7)..(591): NCBI GI: 4903006 NCBI Desc: ace [arabidopsis thaliana]
  misc_feature (7)..(591): NCBI GI: 4903018 NCBI Desc: ace [arabidopsis thaliana]
  misc_feature (153)..(591): NCBI GI: 124360378 NCBI Desc: abc transporter related; choline dehydrogenase [medicago truncatula]
  misc_feature (52)..(585): NCBI GI: 9502391 NCBI Desc: t12c24.11 [arabidopsis thaliana]
  misc_feature (52)..(585): NCBI GI: 17978954 NCBI Desc: at1g12570/t12c24_9 [arabidopsis thaliana]
MASSSRAVRFFKLLLLACLLSLCELSQGKDKKPFFTLKNLPPLQKASSYPAGCATTYDYIIVGGGTAGCPLAATLSLRYKVLLLERGGSPYGNRNVSYMENFHIGLMNMAPDSPSQAFISTDGVINARARVLGGGTCINAGFYSRASSSFIQEVGWDEDLVNKSFPWVEEKIVQWPKIAPWQAALRDGLLQAGVAPFNGYTYDHVSGTKVGGTIFDETGYRHTAADLLAAGDPNNLRVLLHASVHKIVFDSRQGRMKARAIGVQFTDENGRHHQAFLNSNKDSEIIVSAGAIGTPQLLLLSGIGPKNDLKNHNIPVVLHNKYVGKGMADNPMNSIFIPTRSPPRQSLIETVGITEEGVFIEASSGFGQSSESVHCHHGIMSAEIGQLSTIPPKQRTLEAAQKYAHNKLNLPKEVFHGGFILEKIDGPLSTGHLVLTDTDVRNNPAVTFNYFSHPQDLNHCVYGIKTIERILKTNRFSELSADGAGLSMERVLNMSVQANVNLIPKHTNDTESLEQFCKDTVITIWHYHGGCHVGKVVDQHYRVLGVSGLRVVDGSIFSRSPGTNPQATVMMMGRYMGVKILRERLGRAAGV

SEQ ID NO: 7057 - DNA, 399 bp, Sorghum bicolor
  misc_feature: Ceres ANNOT ID no. 6073666
  misc_feature: Encodes the peptide sequence at SEQ ID NO 7058
atgggtaattccacgaacaaagacaaagttcatgacaaggaaactcacggaacaagtagcaatataactgaggagacgtctgtggaaaaggtgaaggctccagatctgcttgagcgagcaaaggaagagatcgaggctcttgccggagctgttcatactaagatggagcaccattccagtccccatgagaagaagggagaatcacataaggaagacaaggaggggagcctgcacaatataaaaacacacacgaatgaaactcacggaacaagtgatgacataaatgagaacacaccagtcgacaaagtcaaaggcccgaatgtgtttgagcgtgccaaggaagagattgaagctattgtcgaagctatccatccgaagagtggatcagacagtaagtga

SEQ ID NO: 7058 - protein, 132 aa, Sorghum bicolor
  misc_feature: Ceres ANNOT ID no. 6073666
  misc_feature (28)..(123): NCBI GI: 4240037 NCBI Desc: zmgr2a [zea mays]
  misc_feature (28)..(123): NCBI GI: 4240039 NCBI Desc: zmgr2b [zea mays]
  misc_feature (7)..(132): NCBI GI: 30721676 NCBI Desc: phoshoprotein 300 [plasmodium falciparum]
  misc_feature: The plant produces a reduced number of seeds.
  misc_feature: Useful for biocontainment applications
  misc_feature: Functional homolog of the protein sequence given in SEQ ID NO 12925
  misc_feature: Useful for biocontainment applications
  misc_feature: Functional homolog of the protein sequence given in SEQ ID NO 12925
MGNSTNKDKVHDKETHGTSSNITEETSVEKVKAPDLLERAKEEIEALAGAVHTKMEHHSSPHEKKGESHKEDKEGSLHNIKTHTNETHGTSDDINENTPVDKVKGPNVFERAKEEIEAIVEAIHPKSGSDSK

SEQ ID NO: 7059 - DNA, 1146 bp, Sorghum bicolor
  misc_feature: Ceres ANNOT ID no. 6073674
  misc_feature: Encodes the peptide sequence at SEQ ID NO 7060
atggcggcggcggcggcgcaatctcatccggcgtcaatggacgcgcgagggtgggacgaggcatcctaccgccgcggcatcctccgtgcccgcgacctctcgtcccgcaccctcttccgtgccgtcttcttcgaccacagcgacgacccggaccccgacgtcctactcgccgccgcctccagcgacggatccctcgcctcattctccctttcaacctgcatctccgccggctccgctgcctcccaggtggagaccgccgccgttctggtcgatcctgtctgcatcgtgcaggcgcacagcggccccgcctacgacgtcaggttctaccccgatccgcagcaaccgctgctcttcagctgcggggacgatggacgcatcaggggctggaggtggcatgagatgcagagctgccttgtcccgctctccctgcaaggggatcatctagaaccagcacttgacttggtgaaccctcagcacgagggtccttggggtgctcggtctccgatacctgaaaataatgccattgcaattaataaacaggatggatccattttggcagcagcgggtgatgcatgtgcttactgctgggatgtggagactggtaaatgtaaaatcacattcaaggggcatgctgattatttgcacagcgttgcagttcgtgagtcaaaccgccaggttgtaacaggatcagaggatgggacagctcgtatctgggattgcagaagtgggaagtgcatgcaggttatacatccagtaaagagcaaggcatttgatagttcttgggtcagctgtgttgccattgatgcaagtgaaagttggctggcctgtggcacgtctagtggtatatcagtttggagtcttctctcaaatgagtgcatctttaatttggactgtcatgctcctgttcaagatttattgtttgacaagaatcaaattttggcagttggtgctgaacctgtgctctcccgtctcacaataaacgggacagtcctttcacaaataaaatgtgctcctcagtcggcgttttctgtctccatgcattcatctgggatagcagctgttgctggatacggaggtctggtggatgtgatctcagaagttgggagccatctgtgcacattcggtagccggggcctagacaagtaa

SEQ ID NO: 7060 - protein, 381 aa, Sorghum bicolor
  misc_feature: Ceres ANNOT ID no. 6073674
  misc_feature (90)..(130): Pfam Id: WD40 Pfam Desc: WD domain, G-beta repeat
  misc_feature (201)..(239): Pfam Id: WD40 Pfam Desc: WD domain, G-beta repeat
  misc_feature (1)..(280): NCBI GI: 50726195 NCBI Desc: wd-40 repeat protein-like [oryza sativa (japonica cultivar-group)]
  misc_feature (117)..(368): NCBI GI: 13111899 NCBI Desc: mgc2655 protein [homo sapiens]
  misc_feature (117)..(368): NCBI GI: 119605828 NCBI Desc: tho complex 6 homolog (drosophila), isoform cra_b [homo sapiens]
  misc_feature (117)..(365): NCBI GI: 53733716 NCBI Desc: zgc:101618 [danio rerio]
  misc_feature (117)..(316): NCBI GI: 119605827 NCBI Desc: tho complex 6 homolog (drosophila), isoform cra_a [homo sapiens]
  misc_feature: The sequence is a functional homolog of SEQ ID NO. 485 in the 11/188,298 US application
MAAAAAQSHPASMDARGWDEASYRRGILRARDLSSRTLFRAVFFDHSDDPDPDVLLAAASSDGSLASFSLSTCISAGSAASQVETAAVLVDPVCIVQAHSGPAYDVRFYPDPQQPLLFSCGDDGRIRGWRWHEMQSCLVPLSLQGDHLEPALDLVNPQHEGPWGARSPIPENNAIAINKQDGSILAAAGDACAYCWDVETGKCKITFKGHADYLHSVAVRESNRQVVTGSEDGTARIWDCRSGKCMQVIHPVKSKAFDSSWVSCVAIDASESWLACGTSSGISVWSLLSNECIFNLDCHAPVQDLLFDKNQILAVGAEPVLSRLTINGTVLSQIKCAPQSAFSVSMHSSGIAAVAGYGGLVDVISEVGSHLCTFGSRGLDK

SEQ ID NO: 7061 - DNA, 2889 bp, Sorghum bicolor
  misc_feature: Ceres ANNOT ID no. 6073679
  misc_feature: Encodes the peptide sequence at SEQ ID NO 7062
atggcgctgcacttgccacctcccgctctgtccacgacccctccctttctctccgctctccgaccagcacggctaccctgcgtcagatgcaccagaactaacaccgccaccgcaagcgtctcctcctctcctcccgcatcggcgtcttctccctcggcctcctcgccggtggcgtcggacggcgcaggtggaaggaagagtaagaagaagagcaggcccctcaagccgagttttgaggaacatgccctccgccgctggtcctccagggcaccctcccagcgtgcctcagtgccctgggaacagcctcagcagcagtcgccttcgctgccgcaccgggatagccgagaaagtggtggtgcgggcggccgaaaccgcagtggtggaggttcaagcgcaacgttgcgctccatcgtggactactttggcggcgtctcctctaatgacgacggagttggagcagaggaaggggcgtgggacaccaccgcggtgcagggcgaagcggcgcgggagcaggacgatggatcgcattttcggccgagctatctgcttgggagccagccagtctctgcgccgtggattcacggggaagaatcgaccagtgatagggtttctggtccggtggcagaaggggaggaagggatggacatgagtgatgtttctgatgatgagctgagcttggaggatagggataaggaagagatcgacgatggtgaggagcttcctactgggagttcagaagagcaattgtatgatgattatgccacaccgactgtgaattcttcatatgaggtggatttgtcagcagatagagattcatacggtggcagattcgataggagtatgaggcagggcagcgtaaacaccatagttaaaacattgaggggttcgatggaggaaagcgatccgaatgccgcgattgagctgtcaaatgctgaagattttgtccagaaattgggccctgtactcctgccatgggaaagggaagaggaggatgatgaggcattcagtggtggcagggtggggaggcgcagcaacacagaactggccgagaggactattccagagcctgaactgcggaggcttagggacacggcattgaggatgaaggagaggataaaggttggaccaggaggggttactcaagacattgtggagagcatccacaggaaatggaaggtggatgaggtggtcaagatgaggtttgaaggccctccaagcctgaacatgaagagaactcatgatttactagaggataggactgggggagttgttatatggaggtcagggagatcagttgttttgtataggggaatgaattacaaccttcaatgtgtgcagtcatatgctaaatccatagaaactgattctggtaaggaagttgatgatgctagtagtgctgtatcgagccatggtggtcacaacttgcaggactcaagagaagctggtgcgaagcgcttaacgtctactgaaaatttttctctagaatcctcagaaacatttgatattgataacttcttggatcagttgggaccacggtacagggattggtctggtcgcggccctgtccctgttgatgccgacttgcttcctggtgtagtgcatggctacaaacctccatttagagtacttccctacaagattaagagcactcttcgagataaggaaatgacaactctgcgtagactttcaaggcaaactgctcctcatttcgctctagggagaaacagagaacaccaaggcttagctgctgctatggttaaattatgggagaaaagtgctattgcaaagattgccatcaagagaggagttccaaacacatgcaatgatagaatggcagaagaaatcaagaaattgacaggaggagtgctcttgtcaaggaacaaggagtacattgtcttctacaggggcaatgatttcatagcacctaaagtaaggcaggtcttggtggagaagcaagaacaagccattactcaacaggatgaggaagagctggctcggcttaaagcatcagcctctattataactgtccccaagggtataaaaggtcctctagttgctggtactctgacagaaactacagaagcaaaatctcgatggggaatgtcacttaatgacaagcagagggaagaggagatgaagcgtttgtctttgttgaagcacacgtctcttttgaagaacttgaagagaaaattgattttagcaaaaacaaaagttgcaaaagcagagagggctctggcgaaagttcaggaatttctttccccagcagagcttccaactgatttggaaacagttacagatgaggaacgcttcttatttcgcagaattggcctaaaaatgagggcctttttgatgcttggcagacgagaagtttttgatggaactgtacaaaacatgcatttgcattggaagcaccgagagttggttaaaattattgtcaggggaaagagcttcgcgcaagtgaaacatattgcaatctctttagaagctgagagtgaaggtgttctcatttcacttgacaagacaagtaaaggatatgcaatcattttctaccggggtaaaaactacaggcgaccccaaatcatgaagcctaggaatctattaacaaggaggcaagcattggcacgctctatagagctgcaaaggcgggaggccttgaagcatcacatctctagtctgcaaggcaagatctggaagttgcagtcacaacttgtacaaacaaaggttgctagcgaaaagcaggatctgaagctgcttcaaacagttgaggatgacctgtcatcagatgatgatgatgatgtagaggatgatggggaggaagcttatttgcaaacttacagcagcgctgatgaagaggacgtggaggatgatgctaataatgaatatatttga

SEQ ID NO: 7062 - protein, 962 aa, Sorghum bicolor
  misc_feature: Ceres ANNOT ID no. 6073679
  misc_feature (353)..(436): Pfam Id: CRS1_YhbY Pfam Desc: CRS1 / YhbY domain
  misc_feature (551)..(635): Pfam Id: CRS1_YhbY Pfam Desc: CRS1 / YhbY domain
  misc_feature (764)..(851): Pfam Id: CRS1_YhbY Pfam Desc: CRS1 / YhbY domain
  misc_feature (501)..(903): NCBI GI: 116310121 NCBI Desc: osigba0130p02.2 [oryza sativa (indica cultivar-group)]
  misc_feature (283)..(960): NCBI GI: 115486097 NCBI Desc: os11g0592400 [oryza sativa (japonica cultivar-group)]
  misc_feature (315)..(903): NCBI GI: 9837550 NCBI Desc: crs1 [zea mays]
  misc_feature (574)..(903): NCBI GI: 21741981 NCBI Desc: osjnba0060p14.12 [oryza sativa (japonica cultivar-group)]
  misc_feature (501)..(632): NCBI GI: 9837552 NCBI Desc: crs1 [zea mays]
MALHLPPPALSTTPPFLSALRPARLPCVRCTRTNTATASVSSSPPASASSPSASSPVASDGAGGRKSKKKSRPLKPSFEEHALRRWSSRAPSQRASVPWEQPQQQSPSLPHRDSRESGGAGGRNRSGGGSSATLRSIVDYFGGVSSNDDGVGAEEGAWDTTAVQGEAAREQDDGSHFRPSYLLGSQPVSAPWIHGEESTSDRVSGPVAEGEEGMDMSDVSDDELSLEDRDKEEIDDGEELPTGSSEEQLYDDYATPTVNSSYEVDLSADRDSYGGRFDRSMRQGSVNTIVKTLRGSMEESDPNAAIELSNAEDFVQKLGPVLLPWEREEEDDEAFSGGRVGRRSNTELAERTIPEPELRRLRDTALRMKERIKVGPGGVTQDIVESIHRKWKVDEVVKMRFEGPPSLNMKRTHDLLEDRTGGVVIWRSGRSVVLYRGMNYNLQCVQSYAKSIETDSGKEVDDASSAVSSHGGHNLQDSREAGAKRLTSTENFSLESSETFDIDNFLDQLGPRYRDWSGRGPVPVDADLLPGVVHGYKPPFRVLPYKIKSTLRDKEMTTLRRLSRQTAPHFALGRNREHQGLAAAMVKLWEKSAIAKIAIKRGVPNTCNDRMAEEIKKLTGGVLLSRNKEYIVFYRGNDFIAPKVRQVLVEKQEQAITQQDEEELARLKASASIITVPKGIKGPLVAGTLTETTEAKSRWGMSLNDKQREEEMKRLSLLKHTSLLKNLKRKLILAKTKVAKAERALAKVQEFLSPAELPTDLETVTDEERFLFRRIGLKMRAFLMLGRREVFDGTVQNMHLHWKHRELVKIIVRGKSFAQVKHIAISLEAESEGVLISLDKTSKGYAIIFYRGKNYRRPQIMKPRNLLTRRQALARSIELQRREALKHHISSLQGKIWKLQSQLVQTKVASEKQDLKLLQTVEDDLSSDDDDDVEDDGEEAYLQTYSSADEEDVEDDANNEYI

SEQ ID NO: 7063 - DNA, 294 bp, Sorghum bicolor
  misc_feature: Ceres ANNOT ID no. 6073692
  misc_feature: Encodes the peptide sequence at SEQ ID NO 7064
atggcgccgccacggcaaggggaggaggagcaggaggtccggggcgattcggcggcggcgctgcgggccccggcgcacgtgatggcgcgggtgttctcgcagctcgactgcgtcgacctcctcagctgctccctcgtctgcaagcaatggtaccgcgattccgcggagctaagagaggagtggaggatggagtacctggatgcttggaaccagtttggattgtcggtgtcgcgtgagccgctgccgctatgcgctacttgtgcgatcagaagcctgcgtagcctgtgcccttga

SEQ ID NO: 7064 - protein, 97 aa, Sorghum bicolor
  misc_feature: Ceres ANNOT ID no. 6073692
  misc_feature (24)..(66): NCBI GI: 55244299 NCBI Desc: ensangp00000002531 [anopheles gambiae str. pest]
  misc_feature (15)..(62): NCBI GI: 67514288 NCBI Desc: f-box protein 45 [mus musculus]
  misc_feature (15)..(62): NCBI GI: 22267973 NCBI Desc: f-box protein 45 [mus musculus]
  misc_feature (15)..(62): NCBI GI: 146286173 NCBI Desc: f-box/spry domain-containing protein 1 (f-box only protein 45)
  misc_feature (20)..(75): NCBI GI: 48140090 NCBI Desc: similar to cg4643-pa [apis mellifera]
MAPPRQGEEEQEVRGDSAAALRAPAHVMARVFSQLDCVDLLSCSLVCKQWYRDSAELREEWRMEYLDAWNQFGLSVSREPLPLCATCAIRSLRSLCP

SEQ ID NO: 7065 - DNA, 2811 bp, Sorghum bicolor
  misc_feature: Ceres ANNOT ID no. 6073695
  misc_feature: Encodes the peptide sequence at SEQ ID NO 7066
atggattcgccgaggggccccgcgagcttcgcgacgcaggccaacgccctcctccgaaagaacctcagcgtccagaaacggaacctcaagacaaacatcggcatcaccttcttcccgatcctcatatgcgtgcttctcatcgtgctccagaacatcatcaacaatgagctcgacaagcccaagtacaaatgcggttgcgtctgcctcgagaccagtttggatggaaggtgtgcaaggaaacagtgtggcatccagtactcgacgctggatcaggtggggagctgtccgatccccagcccgccacagtggccagccatgattcagatcccccgtgctgatttcagggctgtaaggacattctcccaaccgttcagtgatttgcctgatccattttgccgtgactcctggtcttgccctgcaactgtgcttgtcactgggaaggacaaagcagttgcagaagctatatcgggagggctgtttcctgtcctttctccgtcgttgaatgcaacagatttactggatctcttcaccaagatagttgctggctcagatacacagccatggtacacacagttgctagagcctgcatttttctctggccgtactttgtatgtgatccagcctgagtgcttacctgtcatgtcacagaccattacatataatactgggggcataccctttcagctcagtgtcccgttatggcgtgaaagtgcatcaattatcaaccatgaattcttaaagggttatagacaacgaggaggagaaataaacgaatttattgcagggtatgacttcttgggcacaacacagtatggcctcggtgtaaatgtttggtacaattctacttacagcgataacaatgcatattcatttatcacaacattgcgggttccacgcttggtgaatgcagtatccaacgcttatctcaaatttatcaaaggaactggggtagaaatgctacttgagtatgtaaaagatatgcccaaagttgggacaagttttcagttggatctgtcttctcttctcagtgtgttattcttcacatggatcatcgaacttcttttcccagttatgttgtcatatctggtgtatgagaagcagcagaagctaaggattatgatgaaaatgcatggtctgaaggatgggccttactggctgatatcttattcttatttccttgctctatcaatcgtctatatgttattctttatgatttttggctccttgataggtctcaattttttcagagtaaatgaatatagcatacaagttgtttttttcttcatctgtataaatttgcagattgcacttgcattttttgtggcgtctttctttttgtctgtcaagatggccacagtgattggctacatgtatgtatttggctctggcttacttggtgcatttcttttccgtttctttgttgaggaccaaatgtttccctatggttggacattagtcatggagattgtcccagcattttccctctatcggggcctatatgaacttggtcaatatgcattctcgggaagcagtatgggagccactggtatgacctggagaagtctgaaagatcccctcaatggaatgcatgatgtcatgatcataatgagtgtagaatgggcagtgctgctcatattagcattctatttagatcaagcctctttgctaggcggtggtgtcagaaaaaacccttttttctgcttcagatgtttacagaagaaacatgcaccatcattgcatgaacctagcaatgcccaacaggattccaaagtcattctcgatgtggagaaatccgatgttgctctagaaagaaaacgagttgagcaacttttgatagatcccaatgcaaaccaagctatcatctgtgataacctcaggaaggtttatcatggaagggatggaaaccccaacaagctggctgttcgagggttatctcttgtccttcaaaagggccaatgcttcggaatgcttggcccaaatggagctgggaaaacatctttcattaatatgatgattggactcattaaacctacatctggtactgcttatgtccacggaatggatataaatatggatatgggtaacatatatacaaatatgggagtgtgcccacaacacaacttgctttgggaaacactgactggaaaagaacatcttttcttttatggcaggttgaaaaatcttaaaggtgctgaattaatgaaggctgttgaccactctctgaagagtgtaaatctctcccatggtaatgttggcgataagcaagtgaagaaatacagcggcggcatgaaaagaaggctcagcgtggcaatctcattgattggggaccctaaagttgtcttcatggatgagccaagcacaggactggatccagcatcaagaaataacctatggaatgttgtgaaggaggccaagaaaaacccacactcaatggaagaggcagaggtattgtgtgacaggcttggcatctttgttgatggtgatttccaatgccttggaaaccctaaagagctaaaggctagatatggggggacatacatattaacagtgacaacacccccagaccaagagatggaggttgaacagctagtgcatcagttctcgcccagtgcaaacaagatctaccatctatctggaactcagaagttcgagctgccaaaacaagaggtgaaaatagcacatgtttttgacgtggtcgagaaagcgaagcgccggctcacaatacatgcctggggactggttgacactaccttggaggatgtcttcatcaaggtcgccagaggagcacaagtgttcaacgagttcgtgtag

SEQ ID NO: 7066 - protein, 936 aa, Sorghum bicolor
  misc_feature: Ceres ANNOT ID no. 6073695
  misc_feature (651)..(827): Pfam Id: ABC_tran Pfam Desc: ABC transporter
  misc_feature (3)..(933): NCBI GI: 115476294 NCBI Desc: os08g0398300 [oryza sativa (japonica cultivar-group)]
  misc_feature (1)..(935): NCBI GI: 22331657 NCBI Desc: abc transporter family protein [arabidopsis thaliana]
  misc_feature (77)..(927): NCBI GI: 22331659 NCBI Desc: abc transporter family protein [arabidopsis thaliana]
  misc_feature (77)..(927): NCBI GI: 20466398 NCBI Desc: abc-type transport protein-like protein [arabidopsis thaliana]
  misc_feature (7)..(933): NCBI GI: 144923966 NCBI Desc: aaa atpase [medicago truncatula]
MDSPRGPASFATQANALLRKNLSVQKRNLKTNIGITFFPILICVLLIVLQNIINNELDKPKYKCGCVCLETSLDGRCARKQCGIQYSTLDQVGSCPIPSPPQWPAMIQIPRADFRAVRTFSQPFSDLPDPFCRDSWSCPATVLVTGKDKAVAEAISGGLFPVLSPSLNATDLLDLFTKIVAGSDTQPWYTQLLEPAFFSGRTLYVIQPECLPVMSQTITYNTGGIPFQLSVPLWRESASIINHEFLKGYRQRGGEINEFIAGYDFLGTTQYGLGVNVWYNSTYSDNNAYSFITTLRVPRLVNAVSNAYLKFIKGTGVEMLLEYVKDMPKVGTSFQLDLSSLLSVLFFTWIIELLFPVMLSYLVYEKQQKLRIMMKMHGLKDGPYWLISYSYFLALSIVYMLFFMIFGSLIGLNFFRVNEYSIQVVFFFICINLQIALAFFVASFFLSVKMATVIGYMYVFGSGLLGAFLFRFFVEDQMFPYGWTLVMEIVPAFSLYRGLYELGQYAFSGSSMGATGMTWRSLKDPLNGMHDVMIIMSVEWAVLLILAFYLDQASLLGGGVRKNPFFCFRCLQKKHAPSLHEPSNAQQDSKVILDVEKSDVALERKRVEQLLIDPNANQAIICDNLRKVYHGRDGNPNKLAVRGLSLVLQKGQCFGMLGPNGAGKTSFINMMIGLIKPTSGTAYVHGMDINMDMGNIYTNMGVCPQHNLLWETLTGKEHLFFYGRLKNLKGAELMKAVDHSLKSVNLSHGNVGDKQVKKYSGGMKRRLSVAISLIGDPKVVFMDEPSTGLDPASRNNLWNVVKEAKKNPHSMEEAEVLCDRLGIFVDGDFQCLGNPKELKARYGGTYILTVTTPPDQEMEVEQLVHQFSPSANKIYHLSGTQKFELPKQEVKIAHVFDVVEKAKRRLTIHAWGLVDTTLEDVFIKVARGAQVFNEFV

SEQ ID NO: 7067 - DNA, 1155 bp, Sorghum bicolor
  misc_feature: Ceres ANNOT ID no. 6073723
  misc_feature: Encodes the peptide sequence at SEQ ID NO 7068
atggatcgtcgcaagggcagcaaccgcgacgccaacggcggcctggcggaggccacggcgtcgcggctgaggttcgacaccgaggaagaggcggaagaggtgggtatggaggtggaagagagcctcgacgcggagggggaggacgggcaggcgtcggcggaggtgattggaagcgaaaagaccagcgccgactactacttcgactcctattcccacttcggtattcatgaagaaatgctaaaagatgttgttcggacaaagacatatcaaaatgttatcttccagaacagctttcttatcaaggacaaagtagtccttgatgttggtgctggaactggaattctttcacttttctgtgcaaaggcaggagctaaacatgtctatgcgattgaatgttcccagatggcagacatggcaaaggaaattgtgaaatcaaatggatattctgatgtcataactgtaataaaagggaaagtggaagaaatagaacttccggtcccaaaagtagatgtcatcatctcggagtggatgggttattttctcctgttcgagaatatgttgaacactgtcctatatgcacgtgataaatggcttgctgatggtggtgtggtcctgccagacaaaacttctttgcgtcttactgcgattgaagatgctgaatataaggaagacaaaattgaattttggaataatgtatatggatttgatatgagctgcataaagaaacaggcgatgatggagccactggtagatacagtggatgcaaatcagattgtcactaactgccagttactaaagacaatggatatctccaaaatgacccctggtgacgcgtcctttactgtaccattcaagctggttgcggagcggaatgattacattcatgctcttgttgcatacttcgacgtgtcattcaccaaatgccataagctgatgggcttctcaacaggcccgaggtcaaaagccactcactggaagcaaactgttctttacctcgaggatgtaataactatctgccagggggaaaccctgacgggtagcatgacagtcacacccaataagaacaaccctcgagatatcgacattaagctcaagtactccatagatgggcataggtgtcaggtatcaagaactcaattctacaagatgcggtga

SEQ ID NO: 7068 - protein, 384 aa, Sorghum bicolor
  misc_feature: Ceres ANNOT ID no. 6073723
  misc_feature (106)..(204): Pfam Id: Methyltransf_12 Pfam Desc: Methyltransferase domain
  misc_feature (1)..(384): NCBI GI: 115478763 NCBI Desc: os09g0359800 [oryza sativa (japonica cultivar-group)]
  misc_feature (21)..(384): NCBI GI: 92871597 NCBI Desc: sam (and some other nucleotide) binding motif [medicago truncatula]
  misc_feature (5)..(370): NCBI GI: 3292849 NCBI Desc: arginine methyltransferase [arabidopsis thaliana]
  misc_feature (49)..(384): NCBI GI: 28207757 NCBI Desc: cr061 protein [chlamydomonas reinhardtii]
  misc_feature (35)..(384): NCBI GI: 7453575 NCBI Desc: protein arginine n-methyltransferase 1-variant 2 [homo sapiens]
MDRRKGSNRDANGGLAEATASRLRFDTEEEAEEVGMEVEESLDAEGEDGQASAEVIGSEKTSADYYFDSYSHFGIHEEMLKDVVRTKTYQNVIFQNSFLIKDKVVLDVGAGTGILSLFCAKAGAKHVYAIECSQMADMAKEIVKSNGYSDVITVIKGKVEEIELPVPKVDVIISEWMGYFLLFENMLNTVLYARDKWLADGGVVLPDKTSLRLTAIEDAEYKEDKIEFWNNVYGFDMSCIKKQAMMEPLVDTVDANQIVTNCQLLKTMDISKMTPGDASFTVPFKLVAERNDYIHALVAYFDVSFTKCHKLMGFSTGPRSKATHWKQTVLYLEDVITICQGETLTGSMTVTPNKNNPRDIDIKLKYSIDGHRCQVSRTQFYKMR

SEQ ID NO: 7069 - DNA, 798 bp, Sorghum bicolor
  misc_feature: Ceres ANNOT ID no. 6073724
  misc_feature: Encodes the peptide sequence at SEQ ID NO 7070
atgagcatgatcgacgtgctcacacggctggacgccatctgcaagaagtacgaccggtacgacgccgacaagcaccggaacgacggcgaccccttctcgcgcctctacgctaccgtggacgccgagatcgacgcgaaatcggcgagggccgcgaacgagaagaaccgggcggcctcggtgaccctgaacgccgacgtgcggcggaccaaggcgcggctcctggaggaggtggtcaagctccagaagatagccgccaagaaggtgaaagggctctcgccggaggagaaggcgctgcgggctgatctggtggccgcgctgccccacaggatccaccaggccatccccgaccccgatagccacgacggcggcgccacacaccagggcgccggctggaatgctcggccagggatcaagttggacgattattcagctgaaagattagaagaggggtacttccacgcaactgaggagtcggagcagttcaggcgagagtacgagatgcggcgaatcaagcaggcagaattcagatgggatgtgcaggatgaagggctggacttcatctctcaaggtctagaaacgctcaagaatctggccgaggacatgaacgaggaactggataggcaagtccctctcatggatgagattgacaccaaggtggataaagctaatttagaaatcaggaagaccaatgtcagactaaaacaaactgtcaaccagtttcgatcaaccaggaacttcacaattgatatcatcttgatctgcatcattcttggcattgcaacatacctctacaagtaa

SEQ ID NO: 7070 - protein, 265 aa, Sorghum bicolor
  misc_feature: Ceres ANNOT ID no. 6073724
  misc_feature (179)..(241): Pfam Id: SNARE Pfam Desc: SNARE domain
  misc_feature (1)..(140): NCBI GI: 48716947 NCBI Desc: syntaxin 71 (syp71)-like protein [oryza sativa (japonica cultivar-group)]
  misc_feature (1)..(264): NCBI GI: 115465329 NCBI Desc: os05g0553700 [oryza sativa (japonica cultivar-group)]
  misc_feature (1)..(264): NCBI GI: 13811650 NCBI Desc: syntaxin of plants 72 [arabidopsis thaliana]
  misc_feature (1)..(264): NCBI GI: 87241198 NCBI Desc: target snare coiled-coil region [medicago truncatula]
  misc_feature (1)..(243): NCBI GI: 140042792 NCBI Desc: t-snare [medicago truncatula]
MSMIDVLTRLDAICKKYDRYDADKHRNDGDPFSRLYATVDAEIDAKSARAANEKNRAASVTLNADVRRTKARLLEEVVKLQKIAAKKVKGLSPEEKALRADLVAALPHRIHQAIPDPDSHDGGATHQGAGWNARPGIKLDDYSAERLEEGYFHATEESEQFRREYEMRRIKQAEFRWDVQDEGLDFISQGLETLKNLAEDMNEELDRQVPLMDEIDTKVDKANLEIRKTNVRLKQTVNQFRSTRNFTIDIILICIILGIATYLYK

SEQ ID NO: 7071 - DNA, 1038 bp, Sorghum bicolor
  misc_feature: Ceres ANNOT ID no. 6073776
  misc_feature: Encodes the peptide sequence at SEQ ID NO 7072
atggaccgcgaggcgctccgcatggtatggtcgccgcagttctggcggatggccgtcctctgggccctctccctcctctactcctacgtcctcgtgttcctccgcggccgggcggccgcccctcgtcggcggcggccgcgccccgccgaaggccgctgccccgtctgcgtcgtcaccggagcgacgtcggggctgggcagggcggcggcggcggcgctcgcgcgggagggctaccacgtcgtgcttgctggacgttccatgcagttcttatacgagactgttcaagatattcagaggcaacagccagaggcccatctcaaagtgttccagcttgacttagcatctttcaagtcaattaagaagtttggaagttctctgaagcaatgggttcaggagataaatttggagccttctattcagcttttggtaaataatgctggaatattagcaaagtcacatcgaattactgaggatggccttgatgagatgatacagacaaactacattggtccatttatgctgaccaacattcttttaccattactgaagaagagctcagtaccatctcgagtggttaatctaacttctttcacacacaggtgtggtattgatgtatgtgaggatgcattgagagggatgaaatttggccggtgctcagtagggggaagttaccccttagcttctacttataagtataccaagctttgcatgctgatgttctcatatgatgctgctgatcctggtgtcgtggaaacaaagatcatgcgagagcttcctcaatgtctctcttggttcgcatttttggctctgcgctcccttagactcctgcaggaacctgatacaggggttggtgctgtcctcgatgctgctttggcgctgcctgacgaatctgggaagtatttctttggtgggaaagggaaaacaatcagatcctcccgtctatcctatgacacagaagtagccaagaagctgtgggcagaatcgtcagcggtgttcaaggagctgcagcttagaggaggtgattttggggatagttaa

SEQ ID NO: 7072 - protein, 345 aa, Sorghum bicolor
  misc_feature: Ceres ANNOT ID no. 6073776
  misc_feature (54)..(206): Pfam Id: adh_short Pfam Desc: short chain dehydrogenase
  misc_feature (1)..(338): NCBI GI: 115478693 NCBI Desc: os09g0346600 [oryza sativa (japonica cultivar-group)]
  misc_feature (3)..(336): NCBI GI: 45773892 NCBI Desc: at5g04070 [arabidopsis thaliana]
  misc_feature (15)..(329): NCBI GI: 144924165 NCBI Desc: short-chain dehydrogenase/reductase sdr [medicago truncatula]
  misc_feature (48)..(329): NCBI GI: 62298570 NCBI Desc: retinol dehydrogenase 13 (unq736/pro1430)
  misc_feature (50)..(344): NCBI GI: 88797402 NCBI Desc: short chain dehydrogenase [reinekea sp. med297]
  misc_feature: The sequence is a functional homolog of SEQ ID NO. 453 in the 11/188,298 US application
MDREALRMVWSPQFWRMAVLWALSLLYSYVLVFLRGRAAAPRRRRPRPAEGRCPVCVVTGATSGLGRAAAAALAREGYHVVLAGRSMQFLYETVQDIQRQQPEAHLKVFQLDLASFKSIKKFGSSLKQWVQEINLEPSIQLLVNNAGILAKSHRITEDGLDEMIQTNYIGPFMLTNILLPLLKKSSVPSRVVNLTSFTHRCGIDVCEDALRGMKFGRCSVGGSYPLASTYKYTKLCMLMFSYDAADPGVVETKIMRELPQCLSWFAFLALRSLRLLQEPDTGVGAVLDAALALPDESGKYFFGGKGKTIRSSRLSYDTEVAKKLWAESSAVFKELQLRGGDFGDS

SEQ ID NO: 7073 - DNA, 1008 bp, Sorghum bicolor
  misc_feature: Ceres ANNOT ID no. 6073783
  misc_feature: Encodes the peptide sequence at SEQ ID NO 7074
atggcgcgccgccgcgtgctgctcttcctcaagcccttcgacgtataccctccccgcccgtacgtcggggccgcggcctcctctcccacctctgcgccctcgacgccgccgcaaccgcgcgccgccagccccaagatcctgagctatctggatgataggtgcagagttcacaaggacacaattgatctttgccagagtgtcttgcagcgcaagtcccttgactggatttctgtgcagcgcaatcatttgtctcagccaatacgtgatgtggatcttgtgattgctgttggcggcgatggcacccttctccgggctagccattttttggatagctcagttcctatattgggtgttaattcagatcctacttgtactaaggaggttgaggagctaactgatgaatttgatgcaaggaggagcacagggtatctttgtgcagctactgcaggaaactttgaacagatacttgatgcaacgcttgatggcagtaggcgccctttggagctgtcaaggatatcggtgaaactaaatggaattcagctgccgacttatgctctgaatgatatattggtgtcacacccttgtccagcaagtgtgtcacgcttctcatttaggtattgccatctcaggaaaaggaacaatatgggagagacctcgcgtttaattaattgtagatcaagtggtctgagggtctcaacagctgctggatcaactgctgccatgctatcagctggaggatttatgatgccattatcaagccgtgaacttcagtatatgataagggagccaatttctccaacagatgctgacaaaccaatgctccatggttttctaaagcaagagcaacacatgcttgttgtatggtacaatcaagagggtgctgtttatgttgatggttcacatgtagtgcattcaattcagcatggggactcacttgagatatcctcagatgctccaaccttaaaagttgttttgccagaacatttgctgaagaaggcacctgaatag

SEQ ID NO: 7074 - protein, 335 aa, Sorghum bicolor
  misc_feature: Ceres ANNOT ID no. 6073783
  misc_feature (1)..(332): NCBI GI: 75121565 NCBI Desc: probable nadh kinase
  misc_feature (1)..(332): NCBI GI: 50252877 NCBI Desc: atp-nad kinase protein-like [oryza sativa (japonica cultivar-group)]
  misc_feature (1)..(325): NCBI GI: 30699338 NCBI Desc: atp-nad kinase family protein [arabidopsis thaliana]
  misc_feature (142)..(327): NCBI GI: 89211745 NCBI Desc: atp-nad/acox kinase [halothermothrix orenii h 168]
  misc_feature (225)..(327): NCBI GI: 24418609 NCBI Desc: probable inorganic polyphosphate/atp-nad kinase (poly(p)/atp nad kinase)
  misc_feature (1)..(325): SWISSPROT Homolog: EC 2.7.1.86 NADH kinase
MARRRVLLFLKPFDVYPPRPYVGAAASSPTSAPSTPPQPRAASPKILSYLDDRCRVHKDTIDLCQSVLQRKSLDWISVQRNHLSQPIRDVDLVIAVGGDGTLLRASHFLDSSVPILGVNSDPTCTKEVEELTDEFDARRSTGYLCAATAGNFEQILDATLDGSRRPLELSRISVKLNGIQLPTYALNDILVSHPCPASVSRFSFRYCHLRKRNNMGETSRLINCRSSGLRVSTAAGSTAAMLSAGGFMMPLSSRELQYMIREPISPTDADKPMLHGFLKQEQHMLVVWYNQEGAVYVDGSHVVHSIQHGDSLEISSDAPTLKVVLPEHLLKKAPE

SEQ ID NO: 7075 - DNA, 1395 bp, Sorghum bicolor
  misc_feature: Ceres ANNOT ID no. 6073828
  misc_feature: Encodes the peptide sequence at SEQ ID NO 7076
  misc_feature: Down-regulated in shoot tissues in response to salicylic acid treatment
atgccgccctctgtcgacgcaatgccggcccccggaggaggagacgccgcgggcgccggcgacgtgcgcatgatctcctccaaggagctccgcgcgcacgcgtccgccgacgacctctggatctccatctccggcgacgtctacgacgtcacgccctggctcccccaccaccccggcggcgacctcccgctcatcaccctcgcggggcaggacgccaccgacgccttcgccgcctaccacccgccctcggcgcgcccgctcctccgccgcttcttcgtcggccgcctctccgactacaccgtctcccccgcgtccgccgactaccgccgcctcctcgcgcagctctcctccgcgggcctcttcgagcgcgtcggccccacccccaaggtccagctcgccctcatggccgtcctcttctacgccgcgctctacctcgtcctcgcctgcgccaccgcctccgcgcacctcctcgcgggggggctcatcggcttcgtctggatccagtccggctggatgggccacgactcgggccaccaccgcatcacgggccacccgctcctcgaccgcgtcgtccaggtgctctccggcaactgcctcaccggcctcagcatcgcctggtggaagtgcaaccacaacacgcaccacatcgcctgcaacagcctcgaccatgacccggacctccagcacatgccgctcttcgccgtctcccccaagctcttcggcaacatatggtcctacttctaccagcggaccctcgcgttcgacgccgcctccaaattcctcatcagctaccagcactggaccttctacccggtaatgtgcgtcgccaggataaatcttcttgcgcagtccgcgctcttcgttctcaccgagaagagggtaccgcagcgctcgcttgagatcgcgggcgtcgccgcattctgggcttggtacccgctgctcgtggcttccctgcccaattggtgggagagggtcgcgtttgtgcttctcagctttaccatctgcgggattcagcacgtccagttctgcctcaaccacttctcgtccgatgtctatgtcggcccacccaagggcaatgactggtttgagaagcagacggcaggcacgctcgacatcctgtgccctccctggatggattggttccatggtggtctgcaattccagattgagcaccatctgtttccccgcctacctcggtgccaccttcgcaaggtcgcgccggccgtgcgtgacctttgcaagaagcatgggctcacttattctgcagcctcattctggggcgcaaatgtgcttacatggaagacactcagggctgctgcattgcaggccaggagcgccacaagcggtgccgccccgaagaatttggtctgggaggctttgaacacccatggatga

SEQ ID NO: 7076 - protein, 464 aa, Sorghum bicolor
  misc_feature: Ceres ANNOT ID no. 6073828
  misc_feature (159)..(413): Pfam Id: FA_desaturase Pfam Desc: Fatty acid desaturase
  misc_feature (24)..(97): Pfam Id: Cyt-b5 Pfam Desc: Cytochrome b5-like Heme/Steroid binding domain
  misc_feature (3)..(464): NCBI GI: 4104056 NCBI Desc: s276 [triticum aestivum]
  misc_feature (19)..(464): NCBI GI: 144583293 NCBI Desc: d8-sphingolipid desaturase [jatropha curcas]
  misc_feature (23)..(464): NCBI GI: 129593742 NCBI Desc: sphingolipid delta-8 desaturase [nicotiana tabacum]
  misc_feature (25)..(464): NCBI GI: 30350279 NCBI Desc: sphingolipid delta-8 desaturase [primula vialii]
  misc_feature (23)..(464): NCBI GI: 4101626 NCBI Desc: desaturase/cytochrome b5 protein [ricinus communis]
  misc_feature: Down-regulated in shoot tissues in response to salicylic acid treatment
MPPSVDAMPAPGGGDAAGAGDVRMISSKELRAHASADDLWISISGDVYDVTPWLPHHPGGDLPLITLAGQDATDAFAAYHPPSARPLLRRFFVGRLSDYTVSPASADYRRLLAQLSSAGLFERVGPTPKVQLALMAVLFYAALYLVLACATASAHLLAGGLIGFVWIQSGWMGHDSGHHRITGHPLLDRVVQVLSGNCLTGLSIAWWKCNHNTHHIACNSLDHDPDLQHMPLFAVSPKLFGNIWSYFYQRTLAFDAASKFLISYQHWTFYPVMCVARINLLAQSALFVLTEKRVPQRSLEIAGVAAFWAWYPLLVASLPNWWERVAFVLLSFTICGIQHVQFCLNHFSSDVYVGPPKGNDWFEKQTAGTLDILCPPWMDWFHGGLQFQIEHHLFPRLPRCHLRKVAPAVRDLCKKHGLTYSAASFWGANVLTWKTLRAAALQARSATSGAAPKNLVWEALNTHG

SEQ ID NO: 7077 - DNA, 1359 bp, Sorghum bicolor
  misc_feature: Ceres ANNOT ID no. 6073836
  misc_feature: Encodes the peptide sequence at SEQ ID NO 7078
atggccctttcccgccgccttctcccgctcttcctccgccgcggcgcccgcgtccccgcccgcgcgctctccacggccgccgcgcctgcggcggtgtcctcggagggggaggacgaggaggctatcaccgtcaagggcgtgcgcatctcgggacgccctctctatatggacatgcaggcgaccacccccgtcgacccgcgcgtcctcgacgccatgctccccttctacctctcccgctacgggaaccctcactcccgtacccacctctacggctgggagtccgacgccgccgtcgaggacgcccgcgcccgcgtcgcctccctcgtcggcgccgacccgcgcgagatcttcttcacctcgggcgccaccgagtgcaacaacatcgccgtcaagggcgtcatgcgcttctaccgcgagcgccgccgccacgtcgtcaccacgcagaccgagcacaagtgcgtgctcgactcctgcaggtacctgcagcaggaagggttcgaggtcacctacctccccgtgcgcaaggacgggctcgttgacctcgcgcagctccaggacgccatccgcccggacaccggcctggtgtccgtcatggccgtcaacaacgagatcggcgtcgtccagccgctcgaggagattggccgcatctgcaaggagaaaggcgtgccgttccacactgatgctgctcaggcgctgggcaagatccccattgatgtcaacaggatggggattgggctcatgtccctgtccggccacaagatttatgggcccaagggcgtgggggccctctaccttcgccgccgcccacgcatcagggtggaaccgcagatgagtggcggtgggcaggagcgtggcatccgcagtgggactgtgcccacgccgcttgttgttggattcggggctgcctgtgagattgctgctcaagagatggattatgaccacaggcgcgtcagtgctctgcagcagaggcttcttgatggcatacgtgcgcaggtcgatgatgttgtcatcaatggaagcatggagcaccgttacccaggcaacctcaacttgtcatttgcgtatgttgaaggggagagcttactgatgggtctgaaggaggtggctgtgtcaagcggtagtgcctgcactagtgccagcttggagccttcatatgtgctgcgggcacttggagtggaggaggatatggcgcacacctctattcgttttggcatcggtcgctttaccactgaggaagaggtggacagagcaattgagcttactgtgcatcaggtgaagaagctccgtgacatgagcccactctatgagatggccaaggctggcattgacctcaagagcatcgagtggtcacaacactga

SEQ ID NO: 7078 - protein, 452 aa, Sorghum bicolor
  misc_feature: Ceres ANNOT ID no. 6073836
  misc_feature (54)..(417): Pfam Id: Aminotran_5 Pfam Desc: Aminotransferase class-V
  misc_feature (88)..(345): Pfam Id: Beta_elim_lyase Pfam Desc: Beta-eliminating lyase
  misc_feature (52)..(452): NCBI GI: 62898039 NCBI Desc: nfs1 nitrogen fixation 1 isoform a precursor variant [homo sapiens]
  misc_feature (52)..(452): NCBI GI: 32307132 NCBI Desc: nfs1 nitrogen fixation 1 isoform a precursor [homo sapiens]
  misc_feature (52)..(452): NCBI GI: 24042327 NCBI Desc: cysteine desulfurase [homo sapiens]
  misc_feature (12)..(452): NCBI GI: 75775189 NCBI Desc: nfs1 protein [rattus norvegicus]
  misc_feature (52)..(452): NCBI GI: 14714866 NCBI Desc: nitrogen fixation gene, yeast homolog 1 [mus musculus]
  misc_feature (21)..(452): SWISSPROT Homolog: EC 2.8.1.7 Cysteine desulfurase 1, mitochondrial precursor
MALSRRLLPLFLRRGARVPARALSTAAAPAAVSSEGEDEEAITVKGVRISGRPLYMDMQATTPVDPRVLDAMLPFYLSRYGNPHSRTHLYGWESDAAVEDARARVASLVGADPREIFFTSGATECNNIAVKGVMRFYRERRRHVVTTQTEHKCVLDSCRYLQQEGFEVTYLPVRKDGLVDLAQLQDAIRPDTGLVSVMAVNNEIGVVQPLEEIGRICKEKGVPFHTDAAQALGKIPIDVNRMGIGLMSLSGHKIYGPKGVGALYLRRRPRIRVEPQMSGGGQERGIRSGTVPTPLVVGFGAACEIAAQEMDYDHRRVSALQQRLLDGIRAQVDDVVINGSMEHRYPGNLNLSFAYVEGESLLMGLKEVAVSSGSACTSASLEPSYVLRALGVEEDMAHTSIRFGIGRFTTEEEVDRAIELTVHQVKKLRDMSPLYEMAKAGIDLKSIEWSQH

SEQ ID NO: 7079 - DNA, 1215 bp, Sorghum bicolor
  misc_feature: Ceres ANNOT ID no. 6073867
  misc_feature: Encodes the peptide sequence at SEQ ID NO 7080
atggcgtcgctggcggcggcgggtgaggcgctgcccttcagcgacgacatgctagcagagatgttcatccggctccccaccctcgaggacttgggccgcgcctgcgcgtcctgccccgcgttccgccgcgtcatcaccagccactccttcctccgccgcctgcacgcgctccacccgccgtccttgctcggcttcctctccttctcctcgttgttccaccccgcggaatcgccacacccctcggcgcgcgccgccagcgccgtcgctgaagctgccgatttcgagttctcgttccttcccaccaagggtttctggatggtccgggacgcccgcggcggccgcttcgtcctcgactgcgacgacgatacaggttctacattcaccaccatagcggtctgcgaccccttgttccgccgccacgtagttctcccgccactcccccaagacttggccgcggcagtcgagcagccgctcgaagtgaatggtgagcgtaggtgcgatgttttccttgctccctgcagcgaggaagaggcagagggagagccggaggcgttcagcgtgatttggatggccctgtgcccgactaagttagtggcattcatattctcctcggctagctggcagtggcgagcccttgcatctagcagttggcgtgatctgaaccctgccatgcctcctgtcattaagcttaagcactcccccttgctgtgtcgcagctatgcatatggctgtttctactggagtttgtcggaattccccttccgcagcaagctgattgtgctagacgtgggtaggatggagttctaccctgtcactcatccatccagccacaggcttgggaaatttgctgttgtggagttaggagaaagcagactggggatgttcatgcttggtgataatacttgcgatgaataccgcatagtccaactatttagtgcaagcaaccaaattcatggtgagggtgccagtgagtgggtgctggagaatacagtctcactgtatagctcgtgtagcttcaacattctaggtgttgctgatgggaaattactattgcaaggagcacgtgaacataaatctgaagggtctgtttgtatttcgctggacttcaagactaggcaggttcagagggttcgagggattattcacagtggcttctgtcctagggtaggccaatatattggttacccaccatcactttcattacctactatatga

SEQ ID NO: 7080 - protein, 404 aa, Sorghum bicolor
  misc_feature: Ceres ANNOT ID no. 6073867
  misc_feature (11)..(404): NCBI GI: 116308909 NCBI Desc: osigba0107a02.1 [oryza sativa (indica cultivar-group)]
  misc_feature (11)..(404): NCBI GI: 115481050 NCBI Desc: os10g0135300 [oryza sativa (japonica cultivar-group)]
  misc_feature (1)..(197): NCBI GI: 115462089 NCBI Desc: os05g0147700 [oryza sativa (japonica cultivar-group)]
  misc_feature (128)..(220): NCBI GI: 115472723 NCBI Desc: os07g0555400 [oryza sativa (japonica cultivar-group)]
  misc_feature (14)..(357): NCBI GI: 115481076 NCBI Desc: os10g0137700 [oryza sativa (japonica cultivar-group)]
MASLAAAGEALPFSDDMLAEMFIRLPTLEDLGRACASCPAFRRVITSHSFLRRLHALHPPSLLGFLSFSSLFHPAESPHPSARAASAVAEAADFEFSFLPTKGFWMVRDARGGRFVLDCDDDTGSTFTTIAVCDPLFRRHVVLPPLPQDLAAAVEQPLEVNGERRCDVFLAPCSEEEAEGEPEAFSVIWMALCPTKLVAFIFSSASWQWRALASSSWRDLNPAMPPVIKLKHSPLLCRSYAYGCFYWSLSEFPFRSKLIVLDVGRMEFYPVTHPSSHRLGKFAVVELGESRLGMFMLGDNTCDEYRIVQLFSASNQIHGEGASEWVLENTVSLYSSCSFNILGVADGKLLLQGAREHKSEGSVCISLDFKTRQVQRVRGIIHSGFCPRVGQYIGYPPSLSLPTI

SEQ ID NO: 7081 - DNA, 357 bp, Sorghum bicolor
  misc_feature: Ceres ANNOT ID no. 6073869
  misc_feature: Encodes the peptide sequence at SEQ ID NO 7082
atggaaattctgatctacatcttgcttgctgtgcttcttgtactgggagccctgtttgttatcccaaagtctaacagcaaaggtaaaggaaatggagcgcatccattaggaagtgggaagacatctagaacctatacaaagaaagaggtatcaactcacaacacaaggaaggattgttggataataatcaaagataaggtttatgatgtcacttcatacgtggaggaacacccaggtggtgatgccatcttgaacaatgctggagatgattcaacggagggattttttgggccgcaacatgggacaagagtgtttgacatcatcgaggatttctgcatcggcgaactgaaggagtag

SEQ ID NO: 7082 - protein, 118 aa, Sorghum bicolor
  misc_feature: Ceres ANNOT ID no. 6073869
  misc_feature (44)..(117): Pfam Id: Cyt-b5 Pfam Desc: Cytochrome b5-like Heme/Steroid binding domain
  misc_feature (1)..(117): NCBI GI: 40253472 NCBI Desc: cytochrome b5-like [oryza sativa (japonica cultivar-group)]
  misc_feature (67)..(91): NCBI GI: 115478633 NCBI Desc: os09g0334600 [oryza sativa (japonica cultivar-group)]
  misc_feature (48)..(116): NCBI GI: 19921470 NCBI Desc: cg6870-pa [drosophila melanogaster]
  misc_feature (42)..(116): NCBI GI: 50844679 NCBI Desc: cytochrome b5 isoform cb5-d [vernicia fordii]
  misc_feature (39)..(116): NCBI GI: 50844677 NCBI Desc: cytochrome b5 isoform cb5-c [vernicia fordii]
MEILIYILLAVLLVLGALFVIPKSNSKGKGNGAHPLGSGKTSRTYTKKEVSTHNTRKDCWIIIKDKVYDVTSYVEEHPGGDAILNNAGDDSTEGFFGPQHGTRVFDIIEDFCIGELKE

SEQ ID NO: 7083 - DNA, 675 bp, Sorghum bicolor
  misc_feature: Ceres ANNOT ID no. 6073943
  misc_feature: Encodes the peptide sequence at SEQ ID NO 7084
atggcgggcgagaataacgggctccagctgctagacttctgggtgagcccgttcgcgcagtggtgccgcatcgcgctggcggagaaaggcctggcgtacgagtccctgccgcaggacctgtccaacaagggcgacctcctgctccgcgccaacccgatccacaagaagatcccggtgctcctccacgacggacgccccccggtctgcgagtccctcatcatcctgcactacctcgacgaggcgttcccggcgacgccgccgctgctgccgtccgaccccgccgcccgcgcgcacgccaggttctgggccgactacgcggagaagaaggtgttcgactgcgggacccggctgtggaagctcaacaagggcacggcgcaggcgcaggcgcggacggagatggtggaggctctgcggacgctggaggacgagctcggcgacaaggcctacctcgccggcgaggcgttcgggttcgtggacctcgccgtcgtgcccttcgcgacgtggttcctcggctacggccgcctcgcggagttcagcgtcgaggaggtgtgcccgaggctgctcgcgtgggcgaagcggtgcggcgagagggacagcgtcgccaagaacctgtacctgccggagaaggtgttcgagttcatcggctatctcaaggacaagtacggcgacaagtag

SEQ ID NO: 7084 - protein, 224 aa, Sorghum bicolor
  misc_feature: Ceres ANNOT ID no. 6073943
  misc_feature (6)..(80): Pfam Id: GST_N Pfam Desc: Glutathione S-transferase, N-terminal domain
  misc_feature (101)..(198): Pfam Id: GST_C Pfam Desc: Glutathione S-transferase, C-terminal domain
  misc_feature (1)..(222): NCBI GI: 2288969 NCBI Desc: glutathione transferase [zea mays]
  misc_feature (1)..(222): NCBI GI: 75674128 NCBI Desc: glutathione-s-transferase [hordeum vulgare]
  misc_feature (1)..(222): NCBI GI: 6683765 NCBI Desc: glutathione-s-transferase [hordeum vulgare]
  misc_feature (1)..(222): NCBI GI: 20067419 NCBI Desc: glutathione transferase [triticum aestivum]
  misc_feature (1)..(222): NCBI GI: 20067417 NCBI Desc: glutathione transferase [triticum aestivum]
  misc_feature: Useful for making plants with modulated drought sensitivity
  misc_feature: Functional homolog of the protein sequence given in SEQ ID NO 13370
  misc_feature: Useful for making plants with modulated drought sensitivity
  misc_feature: Functional homolog of the protein sequence given in SEQ ID NO 13370
MAGENNGLQLLDFWVSPFAQWCRIALAEKGLAYESLPQDLSNKGDLLLRANPIHKKIPVLLHDGRPPVCESLIILHYLDEAFPATPPLLPSDPAARAHARFWADYAEKKVFDCGTRLWKLNKGTAQAQARTEMVEALRTLEDELGDKAYLAGEAFGFVDLAVVPFATWFLGYGRLAEFSVEEVCPRLLAWAKRCGERDSVAKNLYLPEKVFEFIGYLKDKYGDK

SEQ ID NO: 7085 - DNA, 951 bp, Sorghum bicolor
  misc_feature: Ceres ANNOT ID no. 6073961
  misc_feature: Encodes the peptide sequence at SEQ ID NO 7086
atggcggcttcttgcgcctccaccctcccttcgctctccttcgtttcctcctcttccagttcatcccgccgattcaggcgctctggtgtggtggccatggccagcgttgggcagaaggtgtatgcgcccggtgtggcggtgtcggagggcaatggcgggctccagaaaatcgacctcaaatccccgcacgggagcgaggctgagatttatctgtttggagcatgtgttacttctttcaaagtccctaatggcaaggacctgctctttgttcgaccagatgctgtgtttaacgggcagaaacccatcagtggtggaattccacattgtttcccccagtttggcccaggtcctatgcagcagcatggatttgcacggaatgtgaattggtctatcacagattcagaagtcatggaaggagatccaactgtaactttggaactgaaagatgactcttatagtcgttctatgtgggatttcagcttccatgcactgtacaaggtttccctgcactctacaagcttgtcaacaactctagaaataataaatacggatgtcaagcctttctcattcaactcagcactccacacttatttctctgcttccatagctggtgtttctgtgaaaggtctaaaaggttgcaaaactctcaataaggatcctgacccgaaaaatcctttggagggcaaagaagagagggaagaggtgacttttccaggattcgttgactgcatctaccttggtgcaccaagtgagctcatcctggacaatggattgggtgacaaaattgccatcgcaaattcaaattggtcagatgcagtcttgtggaatcctcacttgcagatggaggcctgctacaaagattttgtctgtgtggaaaacgccaagattgaaatggtacaactggagccaaaacaatcttgggtggcagaacagaaaattgaactagtctga

SEQ ID NO: 7086 - protein, 316 aa, Sorghum bicolor
  misc_feature: Ceres ANNOT ID no. 6073961
  misc_feature (55)..(314): Pfam Id: Aldose_epim Pfam Desc: Aldose 1-epimerase
  misc_feature (1)..(316): NCBI GI: 48716905 NCBI Desc: apospory-associated protein c-like [oryza sativa (japonica cultivar-group)]
  misc_feature (11)..(315): NCBI GI: 23197658 NCBI Desc: apospory-associated protein c-like protein [arabidopsis thaliana]
  misc_feature (10)..(316): NCBI GI: 6970044 NCBI Desc: apospory-associated protein c; apoc [chlamydomonas reinhardtii]
  misc_feature (10)..(307): NCBI GI: 74272623 NCBI Desc: apospory-associated protein c [chlamydomonas incerta]
  misc_feature (42)..(297): NCBI GI: 38344152 NCBI Desc: osjnba0041a02.19 [oryza sativa (japonica cultivar-group)]
MAASCASTLPSLSFVSSSSSSSRRFRRSGVVAMASVGQKVYAPGVAVSEGNGGLQKIDLKSPHGSEAEIYLFGACVTSFKVPNGKDLLFVRPDAVFNGQKPISGGIPHCFPQFGPGPMQQHGFARNVNWSITDSEVMEGDPTVTLELKDDSYSRSMWDFSFHALYKVSLHSTSLSTTLEIINTDVKPFSFNSALHTYFSASIAGVSVKGLKGCKTLNKDPDPKNPLEGKEEREEVTFPGFVDCIYLGAPSELILDNGLGDKIAIANSNWSDAVLWNPHLQMEACYKDFVCVENAKIEMVQLEPKQSWVAEQKIELV

SEQ ID NO: 7087 - DNA, 1161 bp, Sorghum bicolor
  misc_feature: Ceres ANNOT ID no. 6073962
  misc_feature: Encodes the peptide sequence at SEQ ID NO 7088
atgggtggcgccgccgtggccgttcttgccgccgcaaccgcacgccggaagtctggtccgttcgtatccttgttctccagggcggcgcgcaggctccacgatgctgcagagactgcagcggcggaggaggataaggcagggacgcagagtcggcggcggcggaggagcagcagcagcctccttcttggaccggacttcctcgacacctgggaccctatatcgcgtgacacgacgccgcaggctcctccgcggtgtgcacaagctgattatgatcgcactgcaaccattattgatggcaagtccattgcggaggacataaggtttcatattgctgaagaagtctgtcaaatgaaacgttcagttggacatgtgcctggtctagctgttgttttggttggtgatagaagagattctgaatcatatgtgcgatacaaagtaaaaggctgtgaggaagttggaattaaatctttgttggcgaagttgcctggaaactgttcagaagatgaagtgatggattcagtgtcaagatttaatgaggatccatctgttcatggcatcctagtgcagttacctctaccagagtttatggatgaggaaaggattctgagcaccatcagtctggagaaggacgttgatggtttccatcccttaaatgtgggtaatcttgcactcagaagccgaaatcctttgtttgtgccctgtgctgcaaaggcttgcattgagttattgcttcaatctgggattgaactgatgggcaagcatgtagctgtcattgggagaagcaaagttgttggattgcccacttccttacttttacagcggcatcacgccactgtcagtgttatccatgccttcacaacaaatccagaggctattacccgtgaatctgatattgtgatatcagctgctggagtggccaatcttgtaaggggaagctggttaaagcaaggtgcagtggtgattgatgttgggacaaatccaatcgaggatccaaccagtgattacggttatcgcctaactggagatgtctgcttcgaagaagcagtgaatgtggcctctgctataactccagttcctggcggagttggaccagtaacgattgcgatgcttcttggcaacacacttgattcagcaaaacgcgtttatggccaaagtgactga

SEQ ID NO: 7088 - protein, 386 aa, Sorghum bicolor
  misc_feature: Ceres ANNOT ID no. 6073962
  misc_feature (215)..(382): Pfam Id: THF_DHG_CYH_C Pfam Desc: Tetrahydrofolate dehydrogenase/cyclohydrolase, NAD(P)-bindingdomain
  misc_feature (95)..(212): Pfam Id: THF_DHG_CYH Pfam Desc: Tetrahydrofolate dehydrogenase/cyclohydrolase, catalyticdomain
  misc_feature (1)..(383): NCBI GI: 48716904 NCBI Desc: methylenetetrahydrofolate dehydrogenase-like [oryza sativa (japonica cultivar-group)]
  misc_feature (91)..(382): NCBI GI: 140052235 NCBI Desc: tetrahydrofolate dehydrogenase/cyclohydrolase [medicago truncatula]
  misc_feature (35)..(382): NCBI GI: 3786006 NCBI Desc: methylenetetrahydrofolate dehydrogenase [arabidopsis thaliana]
  misc_feature (72)..(382): NCBI GI: 115443867 NCBI Desc: os02g0120900 [oryza sativa (japonica cultivar-group)]
  misc_feature (53)..(382): NCBI GI: 87162643 NCBI Desc: tetrahydrofolate dehydrogenase/cyclohydrolase [medicago truncatula]
MGGAAVAVLAAATARRKSGPFVSLFSRAARRLHDAAETAAAEEDKAGTQSRRRRRSSSSLLLGPDFLDTWDPISRDTTPQAPPRCAQADYDRTATIIDGKSIAEDIRFHIAEEVCQMKRSVGHVPGLAVVLVGDRRDSESYVRYKVKGCEEVGIKSLLAKLPGNCSEDEVMDSVSRFNEDPSVHGILVQLPLPEFMDEERILSTISLEKDVDGFHPLNVGNLALRSRNPLFVPCAAKACIELLLQSGIELMGKHVAVIGRSKVVGLPTSLLLQRHHATVSVIHAFTTNPEAITRESDIVISAAGVANLVRGSWLKQGAVVIDVGTNPIEDPTSDYGYRLTGDVCFEEAVNVASAITPVPGGVGPVTIAMLLGNTLDSAKRVYGQSD

SEQ ID NO: 7089 - DNA, 1131 bp, Sorghum bicolor
  misc_feature: Ceres ANNOT ID no. 6074073
  misc_feature: Encodes the peptide sequence at SEQ ID NO 7090
atgcagagccccagctctgcctcggctataaccactggtatctgccggcttcaagggtgggcagagcttcaagggtgggcagatctcccacaatgtcttctccattccatcattcctctattgggttccgtccttgagctcattgccttcgccagcacctgccactcttggcgcgctgccttgtcatcacacccatccaaatctacactcctcacctttctgccacctctcctcatccagccccacattactgtcccttccagcgctgacagtcgtgtgtttcgcacgtgcaaagtcgttgatccagcggaaatgagaagaaccctttgctgccagattcctgaattaacatttgatgtggcgtggttatctggtgagctgtggttcactcgttcttcctatggcaagctgatttgtggtcgtgatgaagattgtcgtgttgtggatgtgttcactggtgcccaagttgtacctccacatcccccatttgagaaaagtgttattggcttgtatggcatgctgacagctcccctttcatcacgagactcacacctcctactttgcgcagtatcagaacatcatcgtttcctgcttgattgggtgatcggcagtaatgattggtcaagattggatttatgttgcatagattgcaataatgtagagattgtgcagattgtggagttcaagggtgatttcatcgctataggattggcgcccaggcggattcaggagatagaagttgagtggtgggccaccattcgatggccattaagacatttcatggttgtatgcaacggaatccttcatattgttgaggacccattgtgctttcgtactagctcaggtgtgtacaaagtctaccgcctggacatgtcaactaagcctgcaacttgcatggaggtggtgaatctggagaatgacgctctctttattgggcttgatccaaggagcccgccattctattgtacgagtccaggacgatggggcaggaggagcaactgcctgtactgtgcccattacagtcaaccctgtgcttctcctaggttgggtgatgtcgttttggttgatgaaaacatcttccaaggcattgggtatttgccattctgggtctacccaagcatgttatactga

SEQ ID NO: 7090 - protein, 376 aa, Sorghum bicolor
  misc_feature: Ceres ANNOT ID no. 6074073
  misc_feature (1)..(376): NCBI GI: 115465968 NCBI Desc: os06g0111200 [oryza sativa (japonica cultivar-group)]
  misc_feature (33)..(376): NCBI GI: 115465996 NCBI Desc: os06g0113500 [oryza sativa (japonica cultivar-group)]
  misc_feature (129)..(376): NCBI GI: 55295887 NCBI Desc: selenium-binding protein-like [oryza sativa (japonica cultivar-group)]
  misc_feature (26)..(376): NCBI GI: 55295888 NCBI Desc: selenium-binding protein-like [oryza sativa (japonica cultivar-group)]
  misc_feature (101)..(347): NCBI GI: 55295904 NCBI Desc: selenium-binding protein-like [oryza sativa (japonica cultivar-group)]
MQSPSSASAITTGICRLQGWAELQGWADLPQCLLHSIIPLLGSVLELIAFASTCHSWRAALSSHPSKSTLLTFLPPLLIQPHITVPSSADSRVFRTCKVVDPAEMRRTLCCQIPELTFDVAWLSGELWFTRSSYGKLICGRDEDCRVVDVFTGAQVVPPHPPFEKSVIGLYGMLTAPLSSRDSHLLLCAVSEHHRFLLDWVIGSNDWSRLDLCCIDCNNVEIVQIVEFKGDFIAIGLAPRRIQEIEVEWWATIRWPLRHFMVVCNGILHIVEDPLCFRTSSGVYKVYRLDMSTKPATCMEVVNLENDALFIGLDPRSPPFYCTSPGRWGRRSNCLYCAHYSQPCASPRLGDVVLVDENIFQGIGYLPFWVYPSMLY

SEQ ID NO: 7091 - DNA, 1248 bp, Sorghum bicolor
  misc_feature: Ceres ANNOT ID no. 6074110
  misc_feature: Encodes the peptide sequence at SEQ ID NO 7092
atggagcacgcttcctgtgatgatgtacatgagcatgttataagtgtagcacatggggaaaccgcatcaacatcaaccagtcatcaagatatgtacagtgactcggatgaaccgcatcaggaggataggcaatcaacaagcacacaaaccccatcatcagagtcttcaccgtcaatatcaccaattgcatatagctccagaaatttatcttttcctagaagagatagtatatatggtcatggaagaagtccttggaattctggtctatggatctcgtttgaagttgtcatgtacattgctcaggttgtagctgctattgtcatcctcgtcttttcaagacatgaacatccccatgctcctttgttcgcatggataattggatatacagttggctgcattgctagtcttcctcttatttattggcggtatgttcatcgaaatagacatttggaccaagaacctcagcaaccacctacaacatatcctactttgactccctctcagtcatcagaaggacgcaaccatcgtaccagtggtatagtcttgcgtcttggatgtatagcaatttcttgcccaaggcttagtgtactggcttatcacttcaagacagctgttgactgtttctttgctgtgtggtttgttgttggcaatgtgtggatttttggtgggcgcagtatttcatcagatgctcaggacgcccccaatatgtacaggttatgtttggcattccttgcgcttagttgtgttggatatgccattccctttatcatgtgtgcagcaatatgctgctgctttccatgcttgatttctgttttgcgccttcaagaagatttgggtcaaaatagaggagctactcaagagctaatagatgcattgccaacctacaaattcaaaccaaaacgtaacaaaaactgggggattgaccatgcttcaagctcagagcatcttgatgagggcggcatcctcggcccaggaactaagaaggaaagagttgtttcagctgaagatgctgtgtgctgcatctgtctaacaaagtatggagatgatgatgagctccgtgagcttccttgcacacatttctttcatgttcaatgcgtagataaatggctcaagataaacgcagtgtgcccactctgcaaaacagagattgggggtgtggttcgatctttcttcggtttgccatttggccgccgccgtgtcgataggatcgctggaagaggtgtagctagctcaagattcaatgtatag

SEQ ID NO: 7092 - protein, 415 aa, Sorghum bicolor
  misc_feature: Ceres ANNOT ID no. 6074110
  misc_feature (339)..(379): Pfam Id: zf-C3HC4 Pfam Desc: Zinc finger, C3HC4 type (RING finger)
  misc_feature (1)..(384): NCBI GI: 140059785 NCBI Desc: zinc finger, ring-type [medicago truncatula]
  misc_feature (32)..(410): NCBI GI: 115462405 NCBI Desc: os05g0179000 [oryza sativa (japonica cultivar-group)]
  misc_feature (11)..(385): NCBI GI: 55296253 NCBI Desc: atp synthetase alpha chain -like [oryza sativa (japonica cultivar-group)]
  misc_feature (82)..(383): NCBI GI: 115449125 NCBI Desc: os02g0787500 [oryza sativa (japonica cultivar-group)]
  misc_feature (204)..(383): NCBI GI: 47497754 NCBI Desc: ring zinc finger protein-like [oryza sativa (japonica cultivar-group)]
  misc_feature: The sequence is a functional homolog of SEQ ID NO 178 in the 10/666,642US patent application
  misc_feature: Useful for making plants with modulated growth and phenotype characteristics
  misc_feature: The sequence is a functional homolog of SEQ ID NO 178 in the 20070033671 US patent application
  misc_feature: The sequence is a functional homolog of SEQ ID NO. 329 in the 11/188,298 US application
  misc_feature: The sequence is a functional homolog of SEQ ID NO. 271 in the 11/188,298 US application
MEHASCDDVHEHVISVAHGETASTSTSHQDMYSDSDEPHQEDRQSTSTQTPSSESSPSISPIAYSSRNLSFPRRDSIYGHGRSPWNSGLWISFEVVMYIAQVVAAIVILVFSRHEHPHAPLFAWIIGYTVGCIASLPLIYWRYVHRNRHLDQEPQQPPTTYPTLTPSQSSEGRNHRTSGIVLRLGCIAISCPRLSVLAYHFKTAVDCFFAVWFVVGNVWIFGGRSISSDAQDAPNMYRLCLAFLALSCVGYAIPFIMCAAICCCFPCLISVLRLQEDLGQNRGATQELIDALPTYKFKPKRNKNWGIDHASSSEHLDEGGILGPGTKKERVVSAEDAVCCICLTKYGDDDELRELPCTHFFHVQCVDKWLKINAVCPLCKTEIGGVVRSFFGLPFGRRRVDRIAGRGVASSRFNV

SEQ ID NO: 7093 - DNA, 1101 bp, Sorghum bicolor
  misc_feature: Ceres ANNOT ID no. 6074111
  misc_feature: Encodes the peptide sequence at SEQ ID NO 7094
atgtctgcggccaaggaggcggggccgagcagcagggcggtgcttgtgacgggcggggcgggctacatcggcagccacgccgtgctgcagctgctcaccgcgggcttccgcgtcgtcgtcctcgacagcctcgccaactcctccgagctcgtcatccgccgcctgcgctccctcgcggggccggacaacgccaaaaacctcgcgttccacaaggttgatatccgtgacaaagatggattggaaaaggtttttgcttcaacaagatttgatgctgttattcattttgctggattgaaagctgttggagaaagtgtacaaaaaccattgctttattatgaccataatgttgtgggcacgataaatcttctggaagttatggcagctcatggatgtaagaagttagtgttctcatcatcagctgcagtttatgggtcacctaagaactcaccctgcactgaagattttcctctcactccacataacccatatggcagaaccaaacttatggctgaggagatctgccgtgatatctaccattcagatcctgaatggaatatcattttgcttaggtactttaatccggttggggctcaccccagtggataccttggtgaagacccatgtggaactcctaacaaccttatgcccttcgttcagcaaattgctgttggcaggaggccatcactaacaatatttggaaataactatgcaacaaaggatgggacaggggttcgtgactatattcatgtggttgaccttgctgaaggacatcttttcgcattaaggaagctttttgaaagctcatctaacataggatgtgaagcatacaaccttggaaccggaaaaggaacatcagtgttggagatagtcaatgcatttgagaaggcttctggaaagaaaatccctttggtcatgggtcaacggcgtcctggtgatgctgagattctcttttcatcgccggcaaaagcagagagagagctccactggaaagcgaaatatggcatcacagaaatgtgcagagacctgtggaactgggctagcaagagcccttatggatacgcggcatctgagtctcccaagctgaatggtagttcatgctga

SEQ ID NO: 7094 - protein, 366 aa, Sorghum bicolor
  misc_feature: Ceres ANNOT ID no. 6074111
  misc_feature (14)..(279): Pfam Id: Epimerase Pfam Desc: NAD dependent epimerase/dehydratase family
  misc_feature (15)..(303): Pfam Id: 3Beta_HSD Pfam Desc: 3-beta hydroxysteroid dehydrogenase/isomerase family
  misc_feature (16)..(221): Pfam Id: NAD_binding_4 Pfam Desc: Male sterility protein
  misc_feature (12)..(155): Pfam Id: adh_short Pfam Desc: short chain dehydrogenase
  misc_feature (7)..(365): NCBI GI: 71063878 NCBI Desc: udp-d-glucose epimerase 2 [hordeum vulgare]
  misc_feature (10)..(357): NCBI GI: 3021357 NCBI Desc: udp-galactose 4-epimerase [cyamopsis tetragonoloba]
  misc_feature (12)..(356): NCBI GI: 32130594 NCBI Desc: udp-glucose-4-epimerase [zea mays]
  misc_feature (11)..(358): NCBI GI: 92898077 NCBI Desc: udp-glucose 4-epimerase [medicago truncatula]
  misc_feature (12)..(358): NCBI GI: 61658230 NCBI Desc: udp-d-galactose epimerase 1 [hordeum vulgare]
  misc_feature (10)..(357): SWISSPROT Homolog: EC 5.1.3.2 UDP-glucose 4-epimerase GEPI48
  misc_feature: Useful for making plants with altered cell wall content and/or composition
  misc_feature: Functional homolog of the protein sequence encoded by LOCUS at1g64440
  misc_feature: Functional homolog of the protein sequence encoded by LOCUS at4g10960
  misc_feature: Functional homolog of the protein sequence encoded by LOCUS at4g23920
  misc_feature: Useful for making plants with altered carbohydrate content
  misc_feature: Functional homolog of the protein sequence given in SEQ ID NO 13976
  misc_feature: Useful for making plants with altered cell wall content and/or composition
  misc_feature: Functional homolog of the protein sequence given in SEQ ID NO 13977
MSAAKEAGPSSRAVLVTGGAGYIGSHAVLQLLTAGFRVVVLDSLANSSELVIRRLRSLAGPDNAKNLAFHKVDIRDKDGLEKVFASTRFDAVIHFAGLKAVGESVQKPLLYYDHNVVGTINLLEVMAAHGCKKLVFSSSAAVYGSPKNSPCTEDFPLTPHNPYGRTKLMAEEICRDIYHSDPEWNIILLRYFNPVGAHPSGYLGEDPCGTPNNLMPFVQQIAVGRRPSLTIFGNNYATKDGTGVRDYIHVVDLAEGHLFALRKLFESSSNIGCEAYNLGTGKGTSVLEIVNAFEKASGKKIPLVMGQRRPGDAEILFSSPAKAERELHWKAKYGITEMCRDLWNWASKSPYGYAASESPKLNGSSC

SEQ ID NO: 7095 - DNA, 1023 bp, Sorghum bicolor
  misc_feature: Ceres ANNOT ID no. 6074269
  misc_feature: Encodes the peptide sequence at SEQ ID NO 7096
atggaccaacaagctcctcaggtccctcgcgtcaagctcggcacccaaggattagaggtgtccaagcttggtctcggatgcttggggctgacgggcgcctacaacttgccgctggacgacgaggctggcgccgctgtagtcgtgcatgccttccgccgaggcgtcaccttcttcgacactacgggccccttaccaacgagatactcctcggcgctgaagctgctgccgcgagagcaggtgcaggtggccaccaagtttgggttgcggcgggagcgtgccgccggcggctcctcgtggggcgtctgcggccggccggagtacgtgcgcgcctgctgcgaggccagcctgcaccgcctcggtctggattacatcgacctctactaccagcaccgcgtcgacaccaccgtgcccatcgaggacacgattggtgagctcaagaagctggtggaggaggggaaggtcaggtacattgggctgtcggaggcgagccccgacacgatacggcgcgcgcacgccgtgcacccaatctccgcggtgcagatggaatggtctctctggtctcgtgacatcgagcctgagatagtgccactatgcagagaactgggcattggaattgtttcatacagccccatcggccgtgggtttttcggcggaagaggcgccacagaacaagtgcctgctgtgtctaatctgcttgggtatccaaggtttgtagcagaaaatttggagaagaacaagaaaatatatctcgcgatggaaaaccttgccaacaagcaccggtgcagctgcgctcagttggctttagcttgggttctgcatcaaggggatgatgtggttcctataccagggaccacgaagataaaaaatctggatgcgaacattgactcattgaaggtgaggttcacagataaggacctgaaagaaattgccagccacatacgtgaagaagatatctctggtgaaagggcacacatatgctttgcacatactacatgggagcatgctgatacaccgaggaaatag

SEQ ID NO: 7096 - protein, 340 aa, Sorghum bicolor
  misc_feature: Ceres ANNOT ID no. 6074269
  misc_feature (14)..(314): Pfam Id: Aldo_ket_red Pfam Desc: Aldo/keto reductase family
  misc_feature (7)..(338): NCBI GI: 78708648 NCBI Desc: oxidoreductase, aldo/keto reductase family [oryza sativa (japonica cultivar-group)]
  misc_feature (8)..(338): NCBI GI: 59896631 NCBI Desc: perakine reductase [rauvolfia serpentina]
  misc_feature (7)..(338): NCBI GI: 2462762 NCBI Desc: highly similar to auxin-induced protein (aldo/keto reductase family) [arabidopsis thaliana]
  misc_feature (8)..(338): NCBI GI: 38344994 NCBI Desc: osjnba0008a08.8 [oryza sativa (japonica cultivar-group)]
  misc_feature (8)..(338): NCBI GI: 115457782 NCBI Desc: os04g0337500 [oryza sativa (japonica cultivar-group)]
MDQQAPQVPRVKLGTQGLEVSKLGLGCLGLTGAYNLPLDDEAGAAVVVHAFRRGVTFFDTTGPLPTRYSSALKLLPREQVQVATKFGLRRERAAGGSSWGVCGRPEYVRACCEASLHRLGLDYIDLYYQHRVDTTVPIEDTIGELKKLVEEGKVRYIGLSEASPDTIRRAHAVHPISAVQMEWSLWSRDIEPEIVPLCRELGIGIVSYSPIGRGFFGGRGATEQVPAVSNLLGYPRFVAENLEKNKKIYLAMENLANKHRCSCAQLALAWVLHQGDDVVPIPGTTKIKNLDANIDSLKVRFTDKDLKEIASHIREEDISGERAHICFAHTTWEHADTPRK

SEQ ID NO: 7097 - DNA, 1593 bp, Sorghum bicolor
  misc_feature: Ceres ANNOT ID no. 6074270
  misc_feature: Encodes the peptide sequence at SEQ ID NO 7098
atggcacgctcttcctctcgcacagtaggttcgtgggcacgacgcctcccgtgctgcgacggtgacggtaggaataggttcagtagtggcggcaacctctccggcgatcttctgccgtcgctcggcgcaacggcgcaggcacagcagcagcctcccaggctcaggagaaacctcgtgtcaccctacgatccgcgttacaaggtctgggagatatttctgatcctgctagtggtgtactcggcgtggatctgcccactggagttcgcgttcctgaggtacctgcccagggcccctttcatcgtggacgacgtcgtcaacggcttcttcgccgtcgacatcgtgctcacgttcttcgtcccctacgtcgacagcaagtcctacctcctcgtcgacgatcacaagaaaatagcagtcaggtacctgtcgacttggtttgcctttgatgtgtgctccacattcccgttccagtccatcagcctgctgttcaacaagcacgaccacggcctgggcctcaagttcctcaacgttctcaggctttggcggctgcgtagggtcagctccatgtttgcaaggctcgagaaggacatccggttcaactacgcagtgatccgctgcacaaagctcatctcagtcaccctgttcgccatccactgcgccgggtgcatcaactacctgatcgcggaccggtacccggacccgaggcggacgtggatcggcgccgtcatgccggacttccgcgaggacgggctgtggatccgctacgtcacgtccctctactggtccatcaccacgatgaccaccacggggtacggcgacctgcacgccgagaacagccgggagatgctgttcgggatcgcctacatgctcttcaacctctggctcaccgcctacctcatcggcaacatgacaaacctcgtcgtccacagcaccagccgcaccagggacttcagggatatggtccaggccgcttcagaattcgcggcgaggaaccaactgccgcagcagatcgaggagcagatgctgaaccacatatgcctgaggttcaggacggagggcctcaagcagcaggagacgctggatatccttcccaaggcgatgcggtctagcatctccctgtatctcttcttcccggtggtgcaagggtcctacttgttcaagggagtatcctctggtttcatccagcaactggtgacggagatgcagactgagtacttcgccccaaaggaggatatcatgctgcagaatgacaaaccgtcagacttgtatcttcttgtatcaggagcagtggacattctggcattcctagatgaaacagagcagatctatggaaaagcagctgagggagaactgttaggagaggttggagtcatgtccaacaagccacagccattcactttccggactacaaaactatctcagattctgaggatcggcaggtccaagctgatggacatcatgcaagaaaacggagaagacggtcagatcatcagagtcaactttcagcaaaaactccgcgtggagcaaagactgtacatcgcaatgcatcaagacgatcctccggtccctgcatttgaacggaggatggatccctga

SEQ ID NO: 7098 - protein, 530 aa, Sorghum bicolor
  misc_feature: Ceres ANNOT ID no. 6074270
  misc_feature (101)..(302): Pfam Id: Ion_trans Pfam Desc: Ion transport protein
  misc_feature (402)..(491): Pfam Id: cNMP_binding Pfam Desc: Cyclic nucleotide-binding domain
  misc_feature (211)..(308): Pfam Id: Ion_trans_2 Pfam Desc: Ion channel
  misc_feature (33)..(527): NCBI GI: 1165000 NCBI Desc: k+ channel [arabidopsis thaliana]
  misc_feature (11)..(527): NCBI GI: 10177705 NCBI Desc: potassium channel protein kat1 [arabidopsis thaliana]
  misc_feature (18)..(517): NCBI GI: 15824823 NCBI Desc: inward rectifying shaker-like k+ channel [vitis vinifera]
  misc_feature (18)..(517): NCBI GI: 16516993 NCBI Desc: inward rectifying potassium channel [vitis vinifera]
  misc_feature (11)..(504): NCBI GI: 109942298 NCBI Desc: inwardly rectifying potassium channel subunit [daucus carota]
  misc_feature: The sequence is a functional homolog of SEQ ID NO 1838 in the 10/374,780US patent application
  misc_feature: Useful for making plants with modulated growth and phenotype characteristics
  misc_feature: The sequence is a functional homolog of SEQ ID NO 1838 in the 20060162006 US patent application
  misc_feature: The sequence is a functional homolog of SEQ ID NO 1838 in the 10/374,780 US patent application
  misc_feature: The sequence is a functional homolog of SEQ ID NO. 503 in the 11/188,298 US application
MARSSSRTVGSWARRLPCCDGDGRNRFSSGGNLSGDLLPSLGATAQAQQQPPRLRRNLVSPYDPRYKVWEIFLILLVVYSAWICPLEFAFLRYLPRAPFIVDDVVNGFFAVDIVLTFFVPYVDSKSYLLVDDHKKIAVRYLSTWFAFDVCSTFPFQSISLLFNKHDHGLGLKFLNVLRLWRLRRVSSMFARLEKDIRFNYAVIRCTKLISVTLFAIHCAGCINYLIADRYPDPRRTWIGAVMPDFREDGLWIRYVTSLYWSITTMTTTGYGDLHAENSREMLFGIAYMLFNLWLTAYLIGNMTNLVVHSTSRTRDFRDMVQAASEFAARNQLPQQIEEQMLNHICLRFRTEGLKQQETLDILPKAMRSSISLYLFFPVVQGSYLFKGVSSGFIQQLVTEMQTEYFAPKEDIMLQNDKPSDLYLLVSGAVDILAFLDETEQIYGKAAEGELLGEVGVMSNKPQPFTFRTTKLSQILRIGRSKLMDIMQENGEDGQIIRVNFQQKLRVEQRLYIAMHQDDPPVPAFERRMDP

SEQ ID NO: 7099 - DNA, 1098 bp, Sorghum bicolor
  misc_feature: Ceres ANNOT ID no. 6074272
  misc_feature: Encodes the peptide sequence at SEQ ID NO 7100
atggatcagcagcaccagcaagggctcgacgcggcggcggctaggcggatggccacgctcgcctcacacctgcgcccgcaccctgcctctccccctcaggtggaggatgttcccctcctgaggggttccaattgccgcgcaaaaggggcggcgccgggcttcaaagtcgcgatcttgggcgcagcaggtgggatcgggcagccactcgcgctattgatgaagataaaccctcttgtttcggtgctccatctatatgatgtcgtcaacacacctggtgtcacagctgacatcagccacatgagcactggtgctgtggtacgtggcttcttgggccagccacagttggaaaatgccctgaccggaatggatcttgtaataattccggctggtgtccctcggaaacctgggatgacaagggatgatttgttcaacataaatgctggaatagtccgtaccctgtgtgaaggaattgcaaaatgctgcccaaatgcaattgtgaatgtgatcagtaatcctgtcaactctactgttccgattgctgctgaagttttcaagaaagctggaacttatgaccctaagcgtcttttgggtgtgaccacacttgatgtagtgagagcaaatacttttgtgggagaggttcttggacttgaccccagagaagtaaatgttccagttatcggtgggcatgcaggaattacgatactgccactcctttcacaggtgaatccttcctgctcattcacgtcagaagaggttaaatacctcacttctcgcatacagaatggtggcacagaagtagtcgaggctaaagctggagcaggatcagcaactctttcaatggcctatgcagctgccaaatttgcagatgcttgcctgagaggattgcgtggtgatgctgggatagtagagtgctcttatgtagcttctcaggtcacagagctgcctttctttgcatccaaagtgcggttagggcgatgtggcattgaggagatcctaccacttgggccattaaatgagtttgagagagctggtctggagaaggcaaagaaagaactggccgagagtatccagaagggtgtctctttcatcaacaagtga

SEQ ID NO: 7100 - protein, 365 aa, Sorghum bicolor
  misc_feature: Ceres ANNOT ID no. 6074272
  misc_feature (199)..(363): Pfam Id: Ldh_1_C Pfam Desc: lactate/malate dehydrogenase, alpha/beta C-terminal domain
  misc_feature (54)..(197): Pfam Id: Ldh_1_N Pfam Desc: lactate/malate dehydrogenase, NAD binding domain
  misc_feature (11)..(365): NCBI GI: 3183079 NCBI Desc: malate dehydrogenase, glyoxysomal precursor
  misc_feature (15)..(363): NCBI GI: 167284 NCBI Desc: glyoxysomal malate dehydrogenase precursor (ec 1.1.1.37)
  misc_feature (15)..(363): NCBI GI: 60593476 NCBI Desc: chain b, mature and translocatable forms of glyoxysomal malate dehydrogenase have different activities and stabilities but similar crystal structures
  misc_feature (15)..(363): NCBI GI: 126894 NCBI Desc: malate dehydrogenase, glyoxysomal precursor
  misc_feature (15)..(363): NCBI GI: 695311 NCBI Desc: glyoxysomal malate dehydrogenase
  misc_feature (11)..(365): SWISSPROT Homolog: EC 1.1.1.37 Malate dehydrogenase, glyoxysomal precursor
  misc_feature: The sequence is a functional homolog of SEQ ID NO. 341 in the 11/188,298 US application
MDQQHQQGLDAAAARRMATLASHLRPHPASPPQVEDVPLLRGSNCRAKGAAPGFKVAILGAAGGIGQPLALLMKINPLVSVLHLYDVVNTPGVTADISHMSTGAVVRGFLGQPQLENALTGMDLVIIPAGVPRKPGMTRDDLFNINAGIVRTLCEGIAKCCPNAIVNVISNPVNSTVPIAAEVFKKAGTYDPKRLLGVTTLDVVRANTFVGEVLGLDPREVNVPVIGGHAGITILPLLSQVNPSCSFTSEEVKYLTSRIQNGGTEVVEAKAGAGSATLSMAYAAAKFADACLRGLRGDAGIVECSYVASQVTELPFFASKVRLGRCGIEEILPLGPLNEFERAGLEKAKKELAESIQKGVSFINK

SEQ ID NO: 7101 - DNA, 1146 bp, Sorghum bicolor
  misc_feature: Ceres ANNOT ID no. 6074295
  misc_feature: Encodes the peptide sequence at SEQ ID NO 7102
atgaaggagcgacagcgctggcggcctgaggaagacgccgtcctgcgcgcgtacgtccggcagtacggcccgcgcgagtggcaccttgtgtcgcagcgcatgaacgtggccctcgaccgcgacgccaagtcctgcctcgagcgctggaagaactacctccgccccgggatcaagaaggggtcgctgtccgaggaggagcagcgcctggtgatccgcctgcaggccaagcacggcaacaagtggaagaagatcgccgccgaggtgcccgggcgcacggccaagcgcctcggcaagtggtgggaggtgttcaaggagaagcagcagcgggagctcagggacagccggcgcccgccgccggagcccagcccggacgagcggggaaggtacgagtggctgctcgagaacttcgccgagaagctcgtcggcgagaggccacaccagcaggtcgccgccgcagccgcgccaccgacgctgctcatggcctcgcccgtgctgccgccgtggctgtcgccgaacgccggggccaccgttggcgtcgcgcagccgcccagaccgccttcgccgtccgtgacgctcagcctcgcgtccgccaccgtggccccgcccgcgcccgcgccgtggatgccggagcgcgccgcggccgaggccgccgccgcggcgtacgggttccctagcccgccgcagcagcacggcgcccccggcggcggcgtgcccccgccccagccgccgcctccgcatccgggcatggcggtggtggaggggcaggcgctggcggagctcgccgagtgctgccgcgagctggaggaagggcagcgcgcgtgggcggcgcaccggcgggaggcggcgtggcggctgaagcgcgtggagcagcagctggagatggagcgcgagatgcggcggcgcgaggtgtgggaggagttcgaggccaagatgcgcaccatgcggctggagcaagccgccgcggccgagcgcgtggagcgggaccacagggagaaggtggccgagctccgccgcgacgcgcagctcaaggaggagaagatggccgagcagtgggcggccaagcacgcgcgcgtcgccaagttcctcgaccagatcggctgctcctcacgttcttcgtggtcctcggccaccgaaatgaactgctga

SEQ ID NO: 7102 - protein, 381 aa, Sorghum bicolor
  misc_feature: Ceres ANNOT ID no. 6074295
  misc_feature (4)..(53): Pfam Id: Myb_DNA-binding Pfam Desc: Myb-like DNA-binding domain
  misc_feature (59)..(104): Pfam Id: Myb_DNA-binding Pfam Desc: Myb-like DNA-binding domain
  misc_feature (1)..(381): NCBI GI: 4929195 NCBI Desc: rough sheath 2 [zea mays]
  misc_feature (1)..(370): NCBI GI: 45504723 NCBI Desc: phantastica [nicotiana tabacum]
  misc_feature (1)..(367): NCBI GI: 30314006 NCBI Desc: phantastica-like myb protein [eschscholzia californica subsp. californica]
  misc_feature (1)..(370): NCBI GI: 60476424 NCBI Desc: phantastica transcription factor a [glycine max]
  misc_feature (1)..(367): NCBI GI: 98962495 NCBI Desc: asymmetric leaves 1 [cardamine hirsuta]
  misc_feature: Useful for making plants with modulated nitrogen use efficiency
  misc_feature: GREAT-hit functional homolog of the protein sequence encoded by LOCUS at2g37630
  misc_feature: Useful for making plants with modulated nitrogen use efficiency
  misc_feature: Functional homolog of the protein sequence given in SEQ ID NO 13978
  misc_feature: Useful for making plants with altered cell wall content and/or composition
  misc_feature: Functional homolog of the protein sequence given in SEQ ID NO 13602
  misc_feature: The sequence is a functional homolog of SEQ ID NO. 395 in the 11/188,298 US application
MKERQRWRPEEDAVLRAYVRQYGPREWHLVSQRMNVALDRDAKSCLERWKNYLRPGIKKGSLSEEEQRLVIRLQAKHGNKWKKIAAEVPGRTAKRLGKWWEVFKEKQQRELRDSRRPPPEPSPDERGRYEWLLENFAEKLVGERPHQQVAAAAAPPTLLMASPVLPPWLSPNAGATVGVAQPPRPPSPSVTLSLASATVAPPAPAPWMPERAAAEAAAAAYGFPSPPQQHGAPGGGVPPPQPPPPHPGMAVVEGQALAELAECCRELEEGQRAWAAHRREAAWRLKRVEQQLEMEREMRRREVWEEFEAKMRTMRLEQAAAAERVERDHREKVAELRRDAQLKEEKMAEQWAAKHARVAKFLDQIGCSSRSSWSSATEMNC

SEQ ID NO: 7103 - DNA, 2007 bp, Sorghum bicolor
  misc_feature: Ceres ANNOT ID no. 6074360
  misc_feature: Encodes the peptide sequence at SEQ ID NO 7104
atgtgtggtatcgcccttgtcctctccagtgaccgcctcgtcatcgttccctgtgccactgcggctgccgccacatcagagatccagcactcctgcaagaggaagggcgtgccagatgagctgaaggaggccctgcgcaggcgaggacctgataacctaggctatgaaagtcgctgccttctcgctgatggcacggttgttgttagtgatggctacaatgatggagtagagggtaaagtcggtgtgagtgactctggtgttgctgatttgttcttcatcggggcaacactgcatcttaggggagctaagctggtttcacagcctctggtggcccccactggaagtgtccttgtgtataatggtgagatatatggaggaattcaggttgcagatgatgaaaacgacacacaagctctttttacctctctggaatcttgttgttcatgtgattgccatgctcttggtagagataaaacatgtccttgttgtgggagtggtgccacatcagttttgcaactcctttccacaatcaaaggtccatgggctttgatatactggcagatgaagtcaaatacaatttggtttggccgggatgcatttggaagaagaagcctcttggtacattggcccacagctgatgattctcgtttcatactatcatcagtatcacccctttcatttgcaaagaataactctgatcatgacatgtctaaccataccaaagctagctactgggaagagcttccttgtgggatatacagcatccatatgaaagacattggaaaacatggtgcacgcatgaaggaagggtggattgtggaggttaacacacataaatggatgacttcttcattgaatgaattgattaaatgggagaggaaacttacagttcctaccatggagaacaattctgttgacagagggaaccatcagttgtctcagagcttcataagctcaagagaagctgaagaaaatacgaataatgggatcacaaaggcaaatctcctgtcagattctagtttatgtgaagcaaattgcgtaacacagttagcacatagagtattggttgcattaagggaatctgtaatgctgcggactaaaatgaacacactctttcagggtactctaaataaatttgaggacgaagagtcagccccaatagcagtcctcttctccggtggtttagactccatgatacttgcagcattgctagaccagtgcattgattccaaatggacaattgatttgttaaatgtcagttttgatgggcagcttgcccctgataggatttctgcaatagcaggactgaaggagcttcagaggatatctccgtgccggagatggcgtcttattgagattgacactgctttgacagacttgaaaggggaaagcgaacatgtgatgtcactcatacacccttcaaatacctatatggatttgaacattggtattgctctctggttggctgctggtggggatggttgggtggatggaagtacatgtcatatgcaagacggttctcgctataagtacaggtcaagatctagagtccttatagtgggttctggggctgatgagcagtgtgctggttatggtagacatcggactaaatataggcttggagggtggaatgcattggatcaggagatgagactagatgtgcagagaatatggaaaaggaatatgggaagagatgataggtgcatatctgatcatggcaaggaggcccgtttcccatttcttgatgagaacgtgataaaaactctgttggaaattccattatgggaaattgctaaacttgatgaacctgttggaaggggtgacaagaagatattgagagaggttgcaaggctgctaggcctacaagaagctgctcttcagccaaagcgtgcgatccagtttggttcaaggatagcgagggagtcgaaccggaagaacttcggcagtaacagagctgcgaaccaggcatcagcaggcagcgtgcagattcaccagcatatgcaatga

SEQ ID NO: 7104 - protein, 668 aa, Sorghum bicolor
  misc_feature: Ceres ANNOT ID no. 6074360
  misc_feature (353)..(629): Pfam Id: Asn_synthase Pfam Desc: Asparagine synthase
  misc_feature (351)..(665): NCBI GI: 115489234 NCBI Desc: os12g0574900 [oryza sativa (japonica cultivar-group)]
  misc_feature (427)..(645): NCBI GI: 34875820 NCBI Desc: similar to hcv ns3-transactivated protein 1 [rattus norvegicus]
  misc_feature (427)..(640): NCBI GI: 15488990 NCBI Desc: riken cdna 2210409m21 [mus musculus]
  misc_feature (405)..(645): NCBI GI: 22204221 NCBI Desc: novel protein [danio rerio]
  misc_feature (358)..(645): NCBI GI: 145342431 NCBI Desc: asparagine synthase (glutamine-hydrolyzing) related protein [ostreococcus lucimarinus cce9901]
MCGIALVLSSDRLVIVPCATAAAATSEIQHSCKRKGVPDELKEALRRRGPDNLGYESRCLLADGTVVVSDGYNDGVEGKVGVSDSGVADLFFIGATLHLRGAKLVSQPLVAPTGSVLVYNGEIYGGIQVADDENDTQALFTSLESCCSCDCHALGRDKTCPCCGSGATSVLQLLSTIKGPWALIYWQMKSNTIWFGRDAFGRRSLLVHWPTADDSRFILSSVSPLSFAKNNSDHDMSNHTKASYWEELPCGIYSIHMKDIGKHGARMKEGWIVEVNTHKWMTSSLNELIKWERKLTVPTMENNSVDRGNHQLSQSFISSREAEENTNNGITKANLLSDSSLCEANCVTQLAHRVLVALRESVMLRTKMNTLFQGTLNKFEDEESAPIAVLFSGGLDSMILAALLDQCIDSKWTIDLLNVSFDGQLAPDRISAIAGLKELQRISPCRRWRLIEIDTALTDLKGESEHVMSLIHPSNTYMDLNIGIALWLAAGGDGWVDGSTCHMQDGSRYKYRSRSRVLIVGSGADEQCAGYGRHRTKYRLGGWNALDQEMRLDVQRIWKRNMGRDDRCISDHGKEARFPFLDENVIKTLLEIPLWEIAKLDEPVGRGDKKILREVARLLGLQEAALQPKRAIQFGSRIARESNRKNFGSNRAANQASAGSVQIHQHMQ

SEQ ID NO: 7105 - DNA, 1860 bp, Sorghum bicolor
  misc_feature: Ceres ANNOT ID no. 6074363
  misc_feature: Encodes the peptide sequence at SEQ ID NO 7106
atgagggcgccggttctgctatgggcggccaccacgtggctggccgtcagcgccgtggctcaccctggcagaggcggcggcggcggcggcggcggggagcagccgctgtcgaggatcgccgtcgagagagcggtcctcgccgtcgacgatgccgcgcacgtcaaggcgtcccctttggttcttgggctcacgggcgagaacagtgaatgggtggacgtggagttcttccatcccaacccatccagtgacgattggatcggtgtgttctctcctgcgaatttcagtgctgcaatctgtgagcctgagaataagaggcagtatcctccagtgctttgcactgcacctatcaagtaccagtttgcaaacttcacaaatgatggctataacaagactggaaagggatatctgaagcttcagttgatcaaccagagggaagatttctcgttcgcacttttttcaggaggcctcttgaagcccaagctgattgctgtctcaaacaaggtagcatttgcgaatccaaaggcaccagtctacccacgtttagcacaagggaagtcttggaatgaaatgacagtcacctggacaagtggctatgatattaccgaagcggttccttttgttgaatggggcgagaaaggaggacgccgctttcttgctccagctggaacattaacatttgacagaaatagcatgtgtggtgcaccagcccgaactgttggttggcgccatcctggttacattcatactagctacctgaaggatctgtggccagactcaccgtacacttacaggcttggccacaggttaatgaatgggacccgcgtctggagcaaatcatacagcttcaaagcatcaccttaccctggacaagattctttgcaacgagtcatcatattcggagacatgggaaaggcagaggcagacggttcaaatgagttcaacaacttccagccaggttcactaaacactactcaccaggtcatcagtgacatagaaaacatcgacatggtggtccacattggggacatctgctacgcgaatggctacttgtctcaatgggaccagttcactgcacagatcgaaccaatcgcttcaagggtgccatacatgattggcagtggtaatcatgagagggattggcctggcactggttcattctacgggaatctcgactccggcggagaatgcggtgtccctgcccaaaccgtgttctacacaccagctgagaaccgtgcaaagttctggtacgcaacagactacggcatgttcaggttctgcatcgcgaacacagaagaggactggaggcccgggaccgagcaatacaagttcatcgagcaatgcctgtcttctgtcgacaggcagaagcagccatggctcatcttcctcgcgcaccgcgttcttggctactcgtcctgcgcctactacgagttagagggcacgttcgaggaacccatggggcgggaagcgctgcaggagctctggcagaagtacaaggtcgatctcgccttctatggacatgtccacagctatgaaaggacatgcccagtctatcagagtcaatgcgttgtcgaggcgtcggaccactacagcggcccgttccaggcgacgacgcacgtcgtcgtcggcggcgcaggagccagtctctcgaagttcaccgactcaaagattcagtggagccacttcactgacttcgatcatggcttcgtcaagctcacggctttcaaccactcgtccctgctgttcgagtacaagaagagccgcgacggcaacgtgtacgaccatttcacgatctcgcgggactaccgggacatcctcgcttgctccgtcgacaactgcccctggagcacactggcttcatga

SEQ ID NO: 7106 - protein, 619 aa, Sorghum bicolor
  misc_feature: Ceres ANNOT ID no. 6074363
  misc_feature (294)..(510): Pfam Id: Metallophos Pfam Desc: Calcineurin-like phosphoesterase
  misc_feature (2)..(619): NCBI GI: 115489244 NCBI Desc: os12g0576600 [oryza sativa (japonica cultivar-group)]
  misc_feature (5)..(619): NCBI GI: 77556254 NCBI Desc: diphosphonucleotide phosphatase 1 [oryza sativa (japonica cultivar-group)]
  misc_feature (5)..(619): NCBI GI: 77556256 NCBI Desc: diphosphonucleotide phosphatase 1 [oryza sativa (japonica cultivar-group)]
  misc_feature (34)..(619): NCBI GI: 18075958 NCBI Desc: diphosphonucleotide phosphatase 1 [lupinus luteus]
  misc_feature (34)..(415): NCBI GI: 144924941 NCBI Desc: metallophosphoesterase; fibronectin, type iii-like fold [medicago truncatula]
MRAPVLLWAATTWLAVSAVAHPGRGGGGGGGGEQPLSRIAVERAVLAVDDAAHVKASPLVLGLTGENSEWVDVEFFHPNPSSDDWIGVFSPANFSAAICEPENKRQYPPVLCTAPIKYQFANFTNDGYNKTGKGYLKLQLINQREDFSFALFSGGLLKPKLIAVSNKVAFANPKAPVYPRLAQGKSWNEMTVTWTSGYDITEAVPFVEWGEKGGRRFLAPAGTLTFDRNSMCGAPARTVGWRHPGYIHTSYLKDLWPDSPYTYRLGHRLMNGTRVWSKSYSFKASPYPGQDSLQRVIIFGDMGKAEADGSNEFNNFQPGSLNTTHQVISDIENIDMVVHIGDICYANGYLSQWDQFTAQIEPIASRVPYMIGSGNHERDWPGTGSFYGNLDSGGECGVPAQTVFYTPAENRAKFWYATDYGMFRFCIANTEEDWRPGTEQYKFIEQCLSSVDRQKQPWLIFLAHRVLGYSSCAYYELEGTFEEPMGREALQELWQKYKVDLAFYGHVHSYERTCPVYQSQCVVEASDHYSGPFQATTHVVVGGAGASLSKFTDSKIQWSHFTDFDHGFVKLTAFNHSSLLFEYKKSRDGNVYDHFTISRDYRDILACSVDNCPWSTLAS

SEQ ID NO: 7107 - DNA, 1680 bp, Sorghum bicolor
  misc_feature: Ceres ANNOT ID no. 6074365
  misc_feature: Encodes the peptide sequence at SEQ ID NO 7108
atgaggctcctggtggcgctatgggcggttcttgcacacgtcctgggctgcgccgacgtgctgcacgccggccaccagccgctgtcgaggatcgccatcgagagggcgacggccgctctcgacgattcagccagcatcattgctcaccccacggttcttggcctcaagttccagtatgcaaacttcaggaatgatgcctataataagagtgggaagggatccttgaggctgcagctgatcaaccagagagcggacttcgcctttgccctcttctctggaggcttctcggctcccaaattgattgctgtctcaaacaatgtgacgtttacaaatccaaaggcacctgtctaccctcgcttggcgcaagggaagtcttggaatgaaatgacagtcacctggacaagtggatacaacatcaaggaagcagtgccatttgtggaatggggccctaaaggcggagaccgaactctttctcctgctggaacactgacatttggaaggaacagcatgtgtggttcgccagcacggacggtcggatggcgcgatccaggttatattcatacgagtttcctgaaggaactgtggcctgatgccctgtacacttacaggcttggtcacaggctgtcagatggtactcacatctggagcaagtcttacagcttccgtgcatcaccttttcccgggcaagaatctttgcaacgcgttataatctttggggacatgggaaaggcagaaatagatggctcggatgagtacggtaactacgagcaagcttctctgaatacaaccaaacagatcatcaatgatttggagaacattgacatggtcatccacattggagatctttcatatgctaatggatatctgtcccagtgggatcagttcacagagcagatagaaccgattgcgtcaactgtgccttacatgattggcattggtaatcatgagagagattggcctgacaccggatcattctatggatacaacgattctggtggcgaatgtggtgttcctactcagacaatgttctatgtccctgccgagaaccgggcgaaatcctggtattcgacagattatggcatgtttagattctgcatagctaacactgaagaggactggaggccaggaaccgaccagtataagttcatcgagcattgcttgtcgtcagtcgacaggcagaaacaaccatggctcatcttcctcgcacatcgggttcttgggtactcatcgggcggctggtatgagatcatgatgggttcatatggggagccgatgggccgggaagggctccaagatctttggcagaagtacaaggttgatttagcggttttcggtcacattcacagctatgagcgcacctgccccatctatcagaaccgatgtgtccaggatggatctaaccactatagcgggcgattcaacgcaacaacccatgtcactgttggtggcggtggcgcaagcctctctacattcagaaacaatgtgccatattggagcttcttcagggactctgactttgggttcggcaagctcacagccatcaacaactcgttcctattgtttgagtacaagaagagccgtgacggcaatgtgtatgatcatttcacaatctcgcgtgattaccgtgacattatggcctgctccatcgacaattgcccccgaaacaccttagccgtatga

SEQ ID NO: 7108 - protein, 559 aa, Sorghum bicolor
  misc_feature: Ceres ANNOT ID no. 6074365
  misc_feature (233)..(450): Pfam Id: Metallophos Pfam Desc: Calcineurin-like phosphoesterase
  misc_feature (1)..(559): NCBI GI: 77556257 NCBI Desc: diphosphonucleotide phosphatase 1 [oryza sativa (japonica cultivar-group)]
  misc_feature (55)..(558): NCBI GI: 77556256 NCBI Desc: diphosphonucleotide phosphatase 1 [oryza sativa (japonica cultivar-group)]
  misc_feature (37)..(558): NCBI GI: 115489244 NCBI Desc: os12g0576600 [oryza sativa (japonica cultivar-group)]
  misc_feature (37)..(558): NCBI GI: 77556254 NCBI Desc: diphosphonucleotide phosphatase 1 [oryza sativa (japonica cultivar-group)]
  misc_feature (55)..(558): NCBI GI: 18075958 NCBI Desc: diphosphonucleotide phosphatase 1 [lupinus luteus]
MRLLVALWAVLAHVLGCADVLHAGHQPLSRIAIERATAALDDSASIIAHPTVLGLKFQYANFRNDAYNKSGKGSLRLQLINQRADFAFALFSGGFSAPKLIAVSNNVTFTNPKAPVYPRLAQGKSWNEMTVTWTSGYNIKEAVPFVEWGPKGGDRTLSPAGTLTFGRNSMCGSPARTVGWRDPGYIHTSFLKELWPDALYTYRLGHRLSDGTHIWSKSYSFRASPFPGQESLQRVIIFGDMGKAEIDGSDEYGNYEQASLNTTKQIINDLENIDMVIHIGDLSYANGYLSQWDQFTEQIEPIASTVPYMIGIGNHERDWPDTGSFYGYNDSGGECGVPTQTMFYVPAENRAKSWYSTDYGMFRFCIANTEEDWRPGTDQYKFIEHCLSSVDRQKQPWLIFLAHRVLGYSSGGWYEIMMGSYGEPMGREGLQDLWQKYKVDLAVFGHIHSYERTCPIYQNRCVQDGSNHYSGRFNATTHVTVGGGGASLSTFRNNVPYWSFFRDSDFGFGKLTAINNSFLLFEYKKSRDGNVYDHFTISRDYRDIMACSIDNCPRNTLAV

SEQ ID NO: 7109 - DNA, 2139 bp, Sorghum bicolor
  misc_feature: Ceres ANNOT ID no. 6074366
  misc_feature: Encodes the peptide sequence at SEQ ID NO 7110
atgctgcatcctagctgggtcggcgtctcagcatacatctcggagtattggtccgtgataatcgccactgttgttttcgcatttgttggtgcggtgacaatttactacacagtcaatcaattgaacaagaacatcagcttgagcctgataaaggctatcaaggccagggccaagaggtacaagaaatggaaggacaaggtgcccgccgcatcccacatctggaggaaagaagtgatcccccgcagtaaagggctgaaatgctgtgtgtgcttgaagtctgtttcacctcctcagtactctggggggaccatccatcagtgcgatatctgcggcgccgccgcacatccgagctgctcggggaatgcgcacaaggattgcaagtgtgtatctatggctggtttggaccatgtgcttcaccagtgggctgtgcaatggatcgacagcgtggatcactctgaagaagactccttctgttgctactgcgatgaatcttgcaatggggctttccttgcagggtcaccggtttggtactgtatgtggtgtcagaggctggtgcatgttgattgtcacagcagcttggccaaggaaactggtgatatctgtgacctgggaccattgaagcggttgatattatcacctctttgtgttaaggagcttcattggacaggtgctgggattttgagttctatcacaaatggggctaatgaattagcttctactgtccgagagacaattcggattcgtagtaaaaggtacaaaaagggtagcgcttctgctgattcagatagctctggggctattgagctaccatctgatgttgaaggagattcacaagaagtaaacagcgcagcaaagaggagggatgatcaggccaatggtgaactcagtgaggtacatcaaagctcagatgcagagaaagataagcaacatgtaccagacaacgtagctacaaccaatagatcacaacgtgagaattctcatgtacagaaccatcagaagtatgaaattatcaacgtgccttctgattctaggccgcttctagttttcattaacaagagaagtggtgcacagagtggtgattcattgagacagcgtctgcagattcttcttaatcctgtgcaggttttcgagttgagcaaacagcaaggtccagatgtcggtttagctttatttcggaaggtaacccatttcagagttcttgtatgtggtggagatggcactgctggttgggttttggatgccattgagaaacagaagtttgaaactccgcctcctgtagccatccttccagctggcactggtaatgatcttgcgagggttttatgttggggtggtggccttggtgttattgagaagcggggaggtctattctcagttttgcaagatgtagagcatgcagcagtcactgttcttgacagatggaagatcacaataaaggacaaccaagggaaacttatggcaccaccaaaatttatgaacaactactttggggttggctgtgatgcaaaggttgccttagatatacacaatctgagggaagagaaccctgaatggttttatagccagtttatgaacaaggtgctgtatgcaagagagggagcaaagaacattatggataacacatttgattgttttccttgggatgtcaagctcgagatagatggatccaaaattgatattcctcaggattctgaaggtatccttgtcgccaatatcaggagctacatgggaggggtcgacctttggaagaacgaggatgatgtctctgacacttacctccctcagtccatgcatgacaagaagctggaagttgttagcttcacaggaatgctgcatctcggaagactgcaggttggtctttctcgtgcaaaaagattagctcaaggtcatcatataaaagttgaaatcagtactacaatgccaattcaagttgatggagagccatggtcccaggagcccggcaccatagaggtttctcatcatagccaggccttcatgcttaagagagtctccgaagaaccactcggtcatgctgcttcggtaatggccgacatcttggaaaacgctgagaacagtggcattatctcagcctcgcagaagaggactttgctccaggagatagcatctaggcttttgtag

SEQ ID NO: 7110 - protein, 712 aa, Sorghum bicolor
  misc_feature: Ceres ANNOT ID no. 6074366
  misc_feature (491)..(648): Pfam Id: DAGK_acc Pfam Desc: Diacylglycerol kinase accessory domain
  misc_feature (345)..(474): Pfam Id: DAGK_cat Pfam Desc: Diacylglycerol kinase catalytic domain
  misc_feature (139)..(200): Pfam Id: C1_1 Pfam Desc: Phorbol esters/diacylglycerol binding domain (C1 domain)
  misc_feature (1)..(711): NCBI GI: 1374772 NCBI Desc: diacylglycerol kinase [arabidopsis thaliana]
  misc_feature (332)..(711): NCBI GI: 92883618 NCBI Desc: diacylglycerol kinase accessory region; diacylglycerol kinase, catalytic region; protein kinase c, phorbol ester/diacylglycerol binding [medicago truncatula]
  misc_feature (150)..(711): NCBI GI: 145334891 NCBI Desc: atdgk2 (diacylglycerol kinase 2) [arabidopsis thaliana]
  misc_feature (291)..(582): NCBI GI: 28972367 NCBI Desc: mkiaa0718 protein [mus musculus]
  misc_feature (291)..(582): NCBI GI: 117616334 NCBI Desc: dagk-beta [synthetic construct]
  misc_feature (1)..(711): SWISSPROT Homolog: EC 2.7.1.107 Diacylglycerol kinase 1
MLHPSWVGVSAYISEYWSVIIATVVFAFVGAVTIYYTVNQLNKNISLSLIKAIKARAKRYKKWKDKVPAASHIWRKEVIPRSKGLKCCVCLKSVSPPQYSGGTIHQCDICGAAAHPSCSGNAHKDCKCVSMAGLDHVLHQWAVQWIDSVDHSEEDSFCCYCDESCNGAFLAGSPVWYCMWCQRLVHVDCHSSLAKETGDICDLGPLKRLILSPLCVKELHWTGAGILSSITNGANELASTVRETIRIRSKRYKKGSASADSDSSGAIELPSDVEGDSQEVNSAAKRRDDQANGELSEVHQSSDAEKDKQHVPDNVATTNRSQRENSHVQNHQKYEIINVPSDSRPLLVFINKRSGAQSGDSLRQRLQILLNPVQVFELSKQQGPDVGLALFRKVTHFRVLVCGGDGTAGWVLDAIEKQKFETPPPVAILPAGTGNDLARVLCWGGGLGVIEKRGGLFSVLQDVEHAAVTVLDRWKITIKDNQGKLMAPPKFMNNYFGVGCDAKVALDIHNLREENPEWFYSQFMNKVLYAREGAKNIMDNTFDCFPWDVKLEIDGSKIDIPQDSEGILVANIRSYMGGVDLWKNEDDVSDTYLPQSMHDKKLEVVSFTGMLHLGRLQVGLSRAKRLAQGHHIKVEISTTMPIQVDGEPWSQEPGTIEVSHHSQAFMLKRVSEEPLGHAASVMADILENAENSGIISASQKRTLLQEIASRLL

SEQ ID NO: 7111 - DNA, 1623 bp, Sorghum bicolor
  misc_feature: Ceres ANNOT ID no. 6074391
  misc_feature: Encodes the peptide sequence at SEQ ID NO 7112
atgaggttatggtctctcttcctcttgcctctgctctgtctgcctgcgcgggttcgatcagaggattactcggatgtaactgtcattgttcgaggctctgagacgattgcttcgaccagtgacgagtttgtttgcgccaccattgattggtggcctccagagaagtgtaactacgaccagtgcccatggggaagggcttctgtcttaaatttggacttgactaatcctttgttggctaaagctatccaagcctttagtccactacgaatcagagttggaggctccttacaagatcaagtgttatatggcacaccaaatttaggatcgtcatgtgacccatttacaaaggtttcaagtggcctttttgggttttctcaaggatgcataaccttggaaagatgggatgatattaataatctgttcctgagtactggtgccgttgttacatttggtctcaatgcgcttcaaggacgacagcagacaagaaaaggtgtttggggtggtccctggaattctagcaatgctcgagaatttattgaatacactgtttcaaagaactatcctattgattcttgggaatttggtaatgaactgagtggaagtggaataggtgcgagtgtggcagctgaacaatatggaaaagacctagttgaacttcaaaccatcatcaacgagttatacggagattccagcaaaccactggttgtagccccaggaggattttatgaccaaaaatggtttgctcagcttctcgatgtctccgggccaaatgttctcaatgcaatgactcatcatatttacaatcttggtgctggtaatgatccacaagttccaaacagaattttgaacccacagtatctgagccggacctccgatacattcagaagtctccaactcaccatacagcgccatggaccgtggtctgctccatgggttggtgaatccggtggtgcatataatagtggcagccgactcgtgtccaatacttttctcaatagcttctggtatcttgatcaattgggtcagtcagcaaagtatgacaccaaggtatattgtagacagacgctgattggtggcaattacggtcttcttgacaccgacacttttgtaccaaacccagattactacagtgccttgctgtggcatcagatcatggggacgcgtgttctttccatagacatcagtggttcttcgtacttgcgtgcctatgtgcattgcgcaaagcaaaagggtggtgttgctcttctcttgctgaacctgcaccgaaccatgggcttcatggtttcagtcaggaacgacctaaatgtcaatctcgcagaagggcgagggatcagaagggacaatgcctttgtccatggcctgaaaagaacggtttcttgggtcgggagcaaagcctccgatggattttctaagagggaagagtaccatctctcagcgaaagatgggaacccttttgcccggaccatgctgctgaatggagttcctcttgagctcactgaagatggtgacatccctccattgtatccagtggaagtttcagttaactcaccaatctatgttgcccctctgaccattgcgtttgtcgtcttccctgactttgaggctgaagcttgtggccgatga

SEQ ID NO: 7112 - protein, 540 aa, Sorghum bicolor
  misc_feature: Ceres ANNOT ID no. 6074391
  misc_feature (23)..(341): Pfam Id: Glyco_hydro_79n Pfam Desc: Glycosyl hydrolase family 79, N-terminal domain
  misc_feature (28)..(435): NCBI GI: 92896668 NCBI Desc: glycoside hydrolase family 79, n-terminal [medicago truncatula]
  misc_feature (27)..(419): NCBI GI: 8918740 NCBI Desc: beta-glucuronidase precursor [scutellaria baicalensis]
  misc_feature (6)..(376): NCBI GI: 30692673 NCBI Desc: glycosyl hydrolase family 79 n-terminal domain-containing protein [arabidopsis thaliana]
  misc_feature (131)..(538): NCBI GI: 30692666 NCBI Desc: glycosyl hydrolase family 79 n-terminal domain-containing protein [arabidopsis thaliana]
  misc_feature (171)..(407): NCBI GI: 92884256 NCBI Desc: glycoside hydrolase family 79, n-terminal [medicago truncatula]
  misc_feature: Useful for making plants with altered carbohydrate content
  misc_feature: Functional homolog of the protein sequence given in SEQ ID NO 13979
MRLWSLFLLPLLCLPARVRSEDYSDVTVIVRGSETIASTSDEFVCATIDWWPPEKCNYDQCPWGRASVLNLDLTNPLLAKAIQAFSPLRIRVGGSLQDQVLYGTPNLGSSCDPFTKVSSGLFGFSQGCITLERWDDINNLFLSTGAVVTFGLNALQGRQQTRKGVWGGPWNSSNAREFIEYTVSKNYPIDSWEFGNELSGSGIGASVAAEQYGKDLVELQTIINELYGDSSKPLVVAPGGFYDQKWFAQLLDVSGPNVLNAMTHHIYNLGAGNDPQVPNRILNPQYLSRTSDTFRSLQLTIQRHGPWSAPWVGESGGAYNSGSRLVSNTFLNSFWYLDQLGQSAKYDTKVYCRQTLIGGNYGLLDTDTFVPNPDYYSALLWHQIMGTRVLSIDISGSSYLRAYVHCAKQKGGVALLLLNLHRTMGFMVSVRNDLNVNLAEGRGIRRDNAFVHGLKRTVSWVGSKASDGFSKREEYHLSAKDGNPFARTMLLNGVPLELTEDGDIPPLYPVEVSVNSPIYVAPLTIAFVVFPDFEAEACGR

SEQ ID NO: 7113 - DNA, 1608 bp, Sorghum bicolor
  misc_feature: Ceres ANNOT ID no. 6074392
  misc_feature: Encodes the peptide sequence at SEQ ID NO 7114
atgcagatccggctgtcgccgagcatgaggagcatcaccatctccactagccatggcctgctagacttgatgaggctcaaggtcgccgcgcgacacttctcctaccgcaccgtcttccacaccgtcctcatcctcgccttcctcctgcccttcgtcttcatactcaccgccgtcatgacgctcgagggcttcaacaagtgctcctcactagattgtctgggaagacgtttaggtccgcgccttcttggtaggggaaatgatggttccatgaggcttgtgagggatttgtatgtgatgcttgatgaagtaaattctgaggaagcacctcttgatttgaaggttccagaaacttttgatgaatttatctgggacatgaagaataatgattatgatttaagatcatttgcttttaagctgaaggctacgatggagagcatggataaggaattgaggtcatcaaggttatcggagcagttgaacaagcattatgctgcaattgctattcctaaaggcctttattgcctttcattgcgtttaactgatgaatactcctcaaatgcccttgcaaggaaacaactaccacccccagagttggtgccttgtctttcggacaactcctattaccattttgttttagcatcagataacatccttgcagcctcagttgtggtcagatcaacagttagatcatcactgaaacctgagaggatagttttccatgttattactgacaaaaagacctatcctgccatgcattcatggtttgctttaaattctctcagtcctgctattgttgaggtgaaaggtgttcaccaatttgattggttaacaaaagaaaatgttcctgtacttgaagctatagaaactcagcgcactgcccgagatcgttaccatggaagtcaccgtccaagaaccagtgctagtgatagcccaagggtttttgcagccaagctgcaggcaggaagtccaacatatactaatatgctcaatcatattcgaatatacttgcctgagttgttcccaagcctcaacaaggtcgtatttcttgatgatgatgttgttgtccaacatgacctatcaccactttgggatatcgatctagctgggaaggttaatggtgctgttgagacttgcagaggtggagatagttgggtgatgtctaagaagttcagaaattatttcaacttttcgcatcccctcattgcaaaaaactttgacccttcagagtgtgcttgggcatatggtatgaatatttttgacctcaatgcatggaggaagacaacaatcaaagataaatatcatcattgggtcaaggagaacctgaagtcaaacttcacactttggaggcttggaacattaccaccaggccttatagcatttaaaggccatgttcacccaattgatccatcatggcatctgttaggcttgggttatcaggaaaagacagatatcagtagtgttgaacaagcagcagttatacattataacgggcaaagtaaaccgtggctggagattggttttaaacatcttcaaccattttggacaaaatatgtgaactactcaaatgaattcataagaaactgtcatataatggagcctcagttgtag

SEQ ID NO: 7114 - protein, 535 aa, Sorghum bicolor
  misc_feature: Ceres ANNOT ID no. 6074392
  misc_feature (174)..(506): Pfam Id: Glyco_transf_8 Pfam Desc: Glycosyl transferase family 8
  misc_feature (1)..(530): NCBI GI: 145408196 NCBI Desc: secondary wall-associated glycosyltransferase family 8d [populus tremula x populus alba]
  misc_feature (130)..(532): NCBI GI: 52077221 NCBI Desc: glycosyl transferase family 8 protein-like [oryza sativa (japonica cultivar-group)]
  misc_feature (41)..(532): NCBI GI: 57899736 NCBI Desc: glycosyl transferase family 8 protein-like [oryza sativa (japonica cultivar-group)]
  misc_feature (126)..(532): NCBI GI: 30691875 NCBI Desc: glycosyl transferase family 8 protein [arabidopsis thaliana]
  misc_feature (130)..(532): NCBI GI: 115481690 NCBI Desc: os10g0363100 [oryza sativa (japonica cultivar-group)]
  misc_feature: Useful for making plants with altered cell wall content and/or composition
  misc_feature: GREAT-hit functional homolog of the protein sequence encoded by LOCUS at3g01040
  misc_feature: Functional homolog of the protein sequence encoded by LOCUS at3g58790
  misc_feature: GREAT-hit functional homolog of the protein sequence encoded by LOCUS at5g15470
  misc_feature: Functional homolog of the protein sequence encoded by LOCUS at5g54690
  misc_feature: Useful for making plants with altered cell wall content and/or composition
  misc_feature: Functional homolog of the protein sequence given in SEQ ID NO 13980
  misc_feature: Useful for making plants with altered carbohydrate content
  misc_feature: Functional homolog of the protein sequence given in SEQ ID NO 13981
MQIRLSPSMRSITISTSHGLLDLMRLKVAARHFSYRTVFHTVLILAFLLPFVFILTAVMTLEGFNKCSSLDCLGRRLGPRLLGRGNDGSMRLVRDLYVMLDEVNSEEAPLDLKVPETFDEFIWDMKNNDYDLRSFAFKLKATMESMDKELRSSRLSEQLNKHYAAIAIPKGLYCLSLRLTDEYSSNALARKQLPPPELVPCLSDNSYYHFVLASDNILAASVVVRSTVRSSLKPERIVFHVITDKKTYPAMHSWFALNSLSPAIVEVKGVHQFDWLTKENVPVLEAIETQRTARDRYHGSHRPRTSASDSPRVFAAKLQAGSPTYTNMLNHIRIYLPELFPSLNKVVFLDDDVVVQHDLSPLWDIDLAGKVNGAVETCRGGDSWVMSKKFRNYFNFSHPLIAKNFDPSECAWAYGMNIFDLNAWRKTTIKDKYHHWVKENLKSNFTLWRLGTLPPGLIAFKGHVHPIDPSWHLLGLGYQEKTDISSVEQAAVIHYNGQSKPWLEIGFKHLQPFWTKYVNYSNEFIRNCHIMEPQL

SEQ ID NO: 7115 - DNA, 1476 bp, Sorghum bicolor
  misc_feature: Ceres ANNOT ID no. 6074414
  misc_feature: Encodes the peptide sequence at SEQ ID NO 7116
atgaccggcgccgcggccgcggccgtcgtcgatcccccggcggcgcctctgccgcggcggctgacggtgctgcccctgatcgcgctcatcttctacgacgtctcgggggggcccttcggcatcgaggactcggtccgcgcgggcggcggcgcgctgctcccgatcctcggcttcctcatcctcccggtcctctggtcgctcccggaggcgctcgtcaccgccgagctcgcctccgcgttccccaccaacgccgggtacgtggcctgggtgtccgccgccttcggccccgccgcggcgttcctcgtcggcttctccaagtgggcgtcgggcacgctcgacaacgcgctctacccggtgctgttcctcgactacctccgctccggcggcggggtggcgctgccgcaccccgtccgctcgctcgcggtgctcgcgctcacggccgcgctcacctacctcaactaccgggggctacacatcgtcggcctctcggcgctggcgctcaccgcgttctccctctccccgtttctcgcgctcaccgtgctcgccgcccccaagatccgcccgtcccgctggctcgccttcgacgcccgcgccgtcgacctcaggggctacttcaactccatgttctggaacctcaacttctgggacaaggctagcacgctcgccggcgaggtcgaggagccccggaagacgttccccaaggcggtgttcggcgccgttgggctcgtcgtcggcgcgtacctcattccgctgctggctggtaccggcgcgctgccgtccgagacggcggccgagtggaccgacggcttcttctccgaggtcgggctgcggatcggcgggccgtggctgcgcgtgtggatccaagccgccgccgccatgtccaacatggggctcttcgaggccgagatgagcagcgactccttccagctcctcggcatggctgagatgggcatgatccctgccattttcgcccgcaggtcgaagtacgggacgccgacgttcagcatcctgtgctcagcgacgggggtcgtgatcctctccttcatgagcttccaggagatcatcgagttcctcaacttcctctacgggctcgggatgctggcagtgttcgcggccttcgtcaagctacgcttcaagaacccggacctgacgaggccgtaccggatccccgtcggcacgaccggggccgccgtcatgtgcgccccgcccgtcgtgctcatcaccaccgtcatgtgcctcgcgtcggccaggaccgtcctcatcaacgccgccgtggtcgtcgccggtgtcgcgctgtattatgtcgtggagcacgccaagaggcacgcttgggtcgagttcttggcgcccgtgcctccggctgacagctcccatggatcaaccacggcgcctgacgccgccgccgacctcgaggatgtccgcgccgggctgctctctgacgagtcggcagacgaagaaggaagcaaggttgagtga

SEQ ID NO: 7116 - protein, 491 aa, Sorghum bicolor
  misc_feature: Ceres ANNOT ID no. 6074414
  misc_feature (3)..(447): NCBI GI: 42571713 NCBI Desc: amino acid permease family protein [arabidopsis thaliana]
  misc_feature (11)..(447): NCBI GI: 92868690 NCBI Desc: amino acid/polyamine transporter i [medicago truncatula]
  misc_feature (20)..(273): NCBI GI: 115453231 NCBI Desc: os03g0375100 [oryza sativa (japonica cultivar-group)]
  misc_feature (8)..(433): NCBI GI: 94968005 NCBI Desc: amino acid transporter [acidobacteria bacterium ellin345]
  misc_feature (21)..(435): NCBI GI: 29650768 NCBI Desc: amino acid permease aap10ld [leishmania donovani]
MTGAAAAAVVDPPAAPLPRRLTVLPLIALIFYDVSGGPFGIEDSVRAGGGALLPILGFLILPVLWSLPEALVTAELASAFPTNAGYVAWVSAAFGPAAAFLVGFSKWASGTLDNALYPVLFLDYLRSGGGVALPHPVRSLAVLALTAALTYLNYRGLHIVGLSALALTAFSLSPFLALTVLAAPKIRPSRWLAFDARAVDLRGYFNSMFWNLNFWDKASTLAGEVEEPRKTFPKAVFGAVGLVVGAYLIPLLAGTGALPSETAAEWTDGFFSEVGLRIGGPWLRVWIQAAAAMSNMGLFEAEMSSDSFQLLGMAEMGMIPAIFARRSKYGTPTFSILCSATGVVILSFMSFQEIIEFLNFLYGLGMLAVFAAFVKLRFKNPDLTRPYRIPVGTTGAAVMCAPPVVLITTVMCLASARTVLINAAVVVAGVALYYVVEHAKRHAWVEFLAPVPPADSSHGSTTAPDAAADLEDVRAGLLSDESADEEGSKVE

SEQ ID NO: 7117 - DNA, 786 bp, Sorghum bicolor
  misc_feature: Ceres ANNOT ID no. 6074422
  misc_feature: Encodes the peptide sequence at SEQ ID NO 7118
atgccgatcgcctccaagctcgtctacttccagcgccgcccctcgccggcgccgccggacgacccgggccccgagccgcccgacccgcgacgccgaccctgccgcgaccaccaccgccgccgccgccgcagctccctctcctcctcccaccacaagccgggccaggaccatgttcccggacaccaaagggatgctgctgccaagcctctgggatcagttggaaacatagcagagcatgcagcgggcatgtcctccagcacaaggcttcaccgcagcatatcagaccatggccggcttcctgatgccgttcatcaggccagggaaaggctccttcagaggctcaacagtgtggatctgtcaggaagaaggcaaaagacatggccctcagaatcattctgggctggactaactcgcaccactgacgccggtgtgtccacctcttcagacagcatactgggcagtctaactaattgcttccagcccagtgaacccgtcgtggccagcaaggttgaagaaggcgccgtcatcattaacgcagatgagtgtatgcccatcacagtgttccccaaactggcatctgagctgcaggaagcagaagacagtgaaggcgtggaggcttcttctccagctgagtgctccatatgcctggagaggtgcgctgactcaggcgacgggctcatccaactacgctgcaggcacatcttccactcggcctgcctggaccggtggctgcggtcccacgccgactgcccctactgccgcgccaccgtgcgagtttgctcctga

SEQ ID NO: 7118 - protein, 261 aa, Sorghum bicolor
  misc_feature: Ceres ANNOT ID no. 6074422
  misc_feature (212)..(253): Pfam Id: zf-C3HC4 Pfam Desc: Zinc finger, C3HC4 type (RING finger)
  misc_feature (94)..(259): NCBI GI: 22597166 NCBI Desc: ring-h2 finger protein [glycine max]
  misc_feature (207)..(257): NCBI GI: 12323602 NCBI Desc: ring-h2 finger protein rhy1a; 24780-23662 [arabidopsis thaliana]
  misc_feature (207)..(257): NCBI GI: 21592374 NCBI Desc: ring-h2 finger protein rhy1a [arabidopsis thaliana]
  misc_feature (207)..(257): NCBI GI: 28416631 NCBI Desc: at1g49850 [arabidopsis thaliana]
  misc_feature (132)..(257): NCBI GI: 108708054 NCBI Desc: zinc finger, c3hc4 type family protein [oryza sativa (japonica cultivar-group)]
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
  misc_feature: The sequence is a functional homolog of SEQ ID NO. 350 in the 11/188,298 US application
MPIASKLVYFQRRPSPAPPDDPGPEPPDPRRRPCRDHHRRRRRSSLSSSHHKPGQDHVPGHQRDAAAKPLGSVGNIAEHAAGMSSSTRLHRSISDHGRLPDAVHQARERLLQRLNSVDLSGRRQKTWPSESFWAGLTRTTDAGVSTSSDSILGSLTNCFQPSEPVVASKVEEGAVIINADECMPITVFPKLASELQEAEDSEGVEASSPAECSICLERCADSGDGLIQLRCRHIFHSACLDRWLRSHADCPYCRATVRVCS

SEQ ID NO: 7119 - DNA, 1635 bp, Sorghum bicolor
  misc_feature: Ceres ANNOT ID no. 6074427
  misc_feature: Encodes the peptide sequence at SEQ ID NO 7120
  misc_feature: Up-regulated in shoot tissues in response to salicylic acid treatment
atggccgcccccgccggggaccccgcctccgccgcggccgcggccagggccgtcgaggaggcgcgcgcgctgctccccgcctcggccccggcgccggactacgacgacgacgacgaggacctcgaggagcgcgcgtacgaggcggcggagaaggtcatcgtgtccatctcggacgggccggacccagcggacggcgacggcgacgacgacgcggcgttctgctcttcgtcggggtcctccacgccgcccttctcgtggcggaagctctggctcttcacgggtcccgggttcctgatgagcatcgcgttcctggacccgggcaacctcgagggcgacctccaggcgggcgccgtcgccggggacacgctgctgtggctgctcatgtgggccaccgccatgggcctcctcgtgcagctcctcgccgcgcgactcggcgtcgccacgggccgccacctcgccgagctctgccgcgacgagtaccccgactgggcgcgacgcgcgctctggctcatggccgaggtcgccatggtgggcgcggacatccaggaggtcattggcagcgccatcgccatcaagatcctcagccgcgggtacctgccgctctgggccggcgtcgtcatcaccgccttggattgctttatttttctttcactcgaaaattatggggtgaggaaactagaagctgtatttgccattttaattgcaactatggctgtctcctttgcatggatgttcacagacactaagcccaacgggaaagacttgttgattggtattttggttccaaaattgagctcaaggacaataagacaagcagttggggttgttggctgtgtcatcatgccccacaatgtgtttcttcattcagcactcgtgcaatcacggaaaatagatcaaaataaggaatatcaagtccgtgaagcattgagatactattcaatagagtcaactatagcattagttgtctctttcatgataaacctctttgtcacaacagtttttgcaaaaggattttatggaagcaaggaagctggtaatattggccttgaaaatgctggacagtatctacaagagaagtttggtggaggattttttcctatactgtacatctgggggattgggcttttagcggctgggcagagtagtacgataacaggaacttatgctggacagtttataatgggtggatttctgaatttaaggttaaaaaaatgggtcagggcattgatcaccagaagctttgcaattgtgcctactataattgttgctttgttcttcgacacatctgattctgcactggatgttttaaatgagtggctcaatgtgctccaatcaattcagatcccttttgccctcattccactcattaccttagtttccaaggagcaagttatgggagtcttcaaaataggccctaacacccaagctgtaacctggaccgtcgccactctgctgatcactatcaacggttaccttttgatggacttcttctcttctgaaattcgaggccccctatctggctcacttctctgcgtggcggtcctcatctatgcttcgtttgtaatgtatctcatactgcggggcaccgagctgtccgagaagattgtcaaagcagtccacagcagtttttcatga

SEQ ID NO: 7120 - protein, 544 aa, Sorghum bicolor
  misc_feature: Ceres ANNOT ID no. 6074427
  misc_feature (109)..(472): Pfam Id: Nramp Pfam Desc: Natural resistance-associated macrophage protein
  misc_feature (19)..(525): NCBI GI: 5231117 NCBI Desc: nramp2 [arabidopsis thaliana]
  misc_feature (35)..(541): NCBI GI: 57231016 NCBI Desc: nramp metal transporter-like protein [thlaspi caerulescens]
  misc_feature (37)..(541): NCBI GI: 6468012 NCBI Desc: metal transporter nramp3 [arabidopsis thaliana]
  misc_feature (37)..(525): NCBI GI: 31322147 NCBI Desc: ferrous ion membrane transport protein dmt1 [glycine max]
  misc_feature (42)..(537): NCBI GI: 30267436 NCBI Desc: metal transporter [lycopersicon esculentum]
  misc_feature: Up-regulated in shoot tissues in response to salicylic acid treatment
MAAPAGDPASAAAAARAVEEARALLPASAPAPDYDDDDEDLEERAYEAAEKVIVSISDGPDPADGDGDDDAAFCSSSGSSTPPFSWRKLWLFTGPGFLMSIAFLDPGNLEGDLQAGAVAGDTLLWLLMWATAMGLLVQLLAARLGVATGRHLAELCRDEYPDWARRALWLMAEVAMVGADIQEVIGSAIAIKILSRGYLPLWAGVVITALDCFIFLSLENYGVRKLEAVFAILIATMAVSFAWMFTDTKPNGKDLLIGILVPKLSSRTIRQAVGVVGCVIMPHNVFLHSALVQSRKIDQNKEYQVREALRYYSIESTIALVVSFMINLFVTTVFAKGFYGSKEAGNIGLENAGQYLQEKFGGGFFPILYIWGIGLLAAGQSSTITGTYAGQFIMGGFLNLRLKKWVRALITRSFAIVPTIIVALFFDTSDSALDVLNEWLNVLQSIQIPFALIPLITLVSKEQVMGVFKIGPNTQAVTWTVATLLITINGYLLMDFFSSEIRGPLSGSLLCVAVLIYASFVMYLILRGTELSEKIVKAVHSSFS

SEQ ID NO: 7121 - DNA, 1368 bp, Sorghum bicolor
  misc_feature: Ceres ANNOT ID no. 6074454
  misc_feature: Encodes the peptide sequence at SEQ ID NO 7122
atggcgatcttggcaggcctcgtcgccgtcctctccgccctcctcgccgccgtcctccggcgcctcctaatcccgcgccgccgccccgcggacgccgccgggttcttccacccgtacaccaacgacggaggcggcggcgagcgcgtgctctggtgcgcggtgcgcgccgtgcaggagctccgcccggacctcccctgcgccgtctacaccggcgatgccgacgccgcgcccgacgccctcgccgcgcgcgcgctcgaccggttcggtgtccgtctcctccgcccgccgcaggttgttcacttgaataagagaaagtggatcgaagcaagcacctatccccacttcacaatgattgggcaaagtcttggctccgtttatcttgcatgggaggcccttactaattttacccccatgttttactttgatacaagtggctatgcttttacatatccactggctcggctatttggttgcaaagtcatctgctacacccattaccctacaatcagttctgatatggttgaacgtgttaagcaccgcagttctatgtacaataacaactcccgtatcgcaggaagcatttggctgtcccgatgcaaaatcctctactataccatattcagttggttatatggtctggtgggttcatgtgcacatcttgtaatggttaattcgtcatggacaagatcccatattttaaacatttggaagatcccagagcatactaagagggtgtaccctccatgtgatacttcttctcttcaggtgcttcccctggaaagaccaacaacacctcctatttttatttcagttgcacagttccgcccagaaaagctggaggcatttgcacttgctcttcaaaggcttgatcctgattttcctaagccaaagcttcaatttgttggtagttgccggaataaagaggatctggacagactacaaaaacttaaggacagatccactgaactgcaaatagatgagcttgtggagttccacagggatatttcttacagcgacctggtacgacttcttgggggtgccatttctgggctccattcgatgacagatgaacattttggaataagtgttgttgagtatatggcagctggtgctattccaattgcacataaatcagcaggcccaatgatggacattgtgctagatgaggatgggcatcaaacgggatttctagcctccgagaaggaagaatacactgaagcaattatcaaggtcttgaggatgcgagagtcagagaggcaagaaatggcagctgtggctaggaaacgtgcacaaagattttcagatcagagattccatgaagatttcactgaggctgttcgccatattttgtcagcaagggaagcctga

SEQ ID NO: 7122 - protein, 455 aa, Sorghum bicolor
  misc_feature: Ceres ANNOT ID no. 6074454
  misc_feature (252)..(429): Pfam Id: Glycos_transf_1 Pfam Desc: Glycosyl transferases group 1
  misc_feature (1)..(451): NCBI GI: 68160672 NCBI Desc: glycosyl transferase family 1 protein [thlaspi caerulescens]
  misc_feature (3)..(451): NCBI GI: 42569790 NCBI Desc: glycosyl transferase family 1 protein [arabidopsis thaliana]
  misc_feature (203)..(452): NCBI GI: 115489314 NCBI Desc: os12g0583000 [oryza sativa (japonica cultivar-group)]
  misc_feature (35)..(449): NCBI GI: 55957672 NCBI Desc: otthump00000040891 [homo sapiens]
  misc_feature (34)..(445): NCBI GI: 54641153 NCBI Desc: ga10904-pa [drosophila pseudoobscura]
MAILAGLVAVLSALLAAVLRRLLIPRRRPADAAGFFHPYTNDGGGGERVLWCAVRAVQELRPDLPCAVYTGDADAAPDALAARALDRFGVRLLRPPQVVHLNKRKWIEASTYPHFTMIGQSLGSVYLAWEALTNFTPMFYFDTSGYAFTYPLARLFGCKVICYTHYPTISSDMVERVKHRSSMYNNNSRIAGSIWLSRCKILYYTIFSWLYGLVGSCAHLVMVNSSWTRSHILNIWKIPEHTKRVYPPCDTSSLQVLPLERPTTPPIFISVAQFRPEKLEAFALALQRLDPDFPKPKLQFVGSCRNKEDLDRLQKLKDRSTELQIDELVEFHRDISYSDLVRLLGGAISGLHSMTDEHFGISVVEYMAAGAIPIAHKSAGPMMDIVLDEDGHQTGFLASEKEEYTEAIIKVLRMRESERQEMAAVARKRAQRFSDQRFHEDFTEAVRHILSAREA

SEQ ID NO: 7123 - DNA, 1332 bp, Sorghum bicolor
  misc_feature: Ceres ANNOT ID no. 6074455
  misc_feature: Encodes the peptide sequence at SEQ ID NO 7124
atggcggcaacaacattggtgttactcgtgctcttgtgcctcagcgctgccctaacctgcagcggcggcggcggcggtggcggcaccagcaacacagggatccgcatgaagctcacccatgtcgacgccaaggggaactacaccgcaccggagcgcgtgcgccgtgccatcgccctcagccgccagattaacctggcctccacgcgtgccgaaggcggcggcgtgagtgcgccggtgcactgggcgacccggcagtacatcgcggagtacatggtcggcgacccgccgcagcgcgcggaggccctcatcgacaccggcagcagcctcatctggacgcagtgcaccgcgtgcctccgcaaggtctgcgtgcggcaggacctgccctacttcaacgcgtccagctccggcagcttcgcgcccgtgccgtgccaggacaaggcgtgcgcgggcaactacctgcacttctgcgccctggacggcacctgcacgttccgggtcacctacggcgccggcggcatcatcgggttcctcggcaccgacgccttcaccttccagtccggcggtgccacgctcgccttcgggtgcgtgagcttcacgcggttcgcggcgccggacgtgctccacggcgcgtcgggcctcatagggctcggccgcgggcgcctgtcgctggcatcccagacgggcgccaagaggttctcctactgcctcacgccctacttccacaacaacggcgcgtcgagccacctgttcgtcggcgccgcggcgagcctgagcggcggcggcggggccgtgatgtccatggcgttcgtggagagccccaaggactacccctacagcacgttctactacctcccgctggtggggatcaccgtgggcgagaccaagctggccatcccgagcacggcgttcgatctccaggaagtcgaggaggggttctgggagggcggcgtcatcatcgactccggcagccccttcacgtcgctggtcgaggacgcgtacgagccgctgatgggggagcttgcccggcagctgaacggaagcctcgtgccgccgccgggggaggacgacggtggcatggcgctgtgcgtggcacgcggcgacctggacagggtggtgccgacgctggtgctccacttcagcggcggcgcggacatggccctgccgcccgagaactactgggccccgctggagaagtcgacggcctgcatggcgatcgtcagagggtacctgcagagcatcatcggcaacttccagcagcagaacatgcacatcctctttgacgtcggcgggggacggctctccttccagaacgccgattgcagcactatctga

SEQ ID NO: 7124 - protein, 443 aa, Sorghum bicolor
  misc_feature: Ceres ANNOT ID no. 6074455
  misc_feature (85)..(438): Pfam Id: Asp Pfam Desc: Eukaryotic aspartyl protease
  misc_feature (1)..(443): NCBI GI: 77556903 NCBI Desc: eukaryotic aspartyl protease [oryza sativa (japonica cultivar-group)]
  misc_feature (1)..(443): NCBI GI: 115472519 NCBI Desc: os07g0533800 [oryza sativa (japonica cultivar-group)]
  misc_feature (33)..(443): NCBI GI: 38344829 NCBI Desc: osjnba0064h22.10 [oryza sativa (japonica cultivar-group)]
  misc_feature (33)..(443): NCBI GI: 115458644 NCBI Desc: os04g0448300 [oryza sativa (japonica cultivar-group)]
  misc_feature (33)..(443): NCBI GI: 116310063 NCBI Desc: h0818e04.1 [oryza sativa (indica cultivar-group)]
MAATTLVLLVLLCLSAALTCSGGGGGGGTSNTGIRMKLTHVDAKGNYTAPERVRRAIALSRQINLASTRAEGGGVSAPVHWATRQYIAEYMVGDPPQRAEALIDTGSSLIWTQCTACLRKVCVRQDLPYFNASSSGSFAPVPCQDKACAGNYLHFCALDGTCTFRVTYGAGGIIGFLGTDAFTFQSGGATLAFGCVSFTRFAAPDVLHGASGLIGLGRGRLSLASQTGAKRFSYCLTPYFHNNGASSHLFVGAAASLSGGGGAVMSMAFVESPKDYPYSTFYYLPLVGITVGETKLAIPSTAFDLQEVEEGFWEGGVIIDSGSPFTSLVEDAYEPLMGELARQLNGSLVPPPGEDDGGMALCVARGDLDRVVPTLVLHFSGGADMALPPENYWAPLEKSTACMAIVRGYLQSIIGNFQQQNMHILFDVGGGRLSFQNADCSTI

SEQ ID NO: 7125 - DNA, 1677 bp, Sorghum bicolor
  misc_feature: Ceres ANNOT ID no. 6074464
  misc_feature: Encodes the peptide sequence at SEQ ID NO 7126
atgggagagacgaacgagcagccgccgccgccgccgccggtcgccgcgccgccgcccatgatggccatgatggtgccgcccgtcggcgcgggcgccatccacccgccccacgagcagttccaccacctcaactactgcgtccactcgaatccgtcctgggttcaggtggcagcacttgcattccttcactatcttgtgatgttgggttctaccgtcatgcttgcatcagttattgttcctgcaatgggtggtaacgctggtgacaaggctcgagtcattcaatcgttgctctttatgagtggcataaatacactgattcaaacacttattggaacgagacttccaacagttatgaatgcctcttttgcatttgttgtcccagtgctctcaatagcaagagagatcgagtcaaataatgacttgctgaatgatcacgagagatttaaacacacaatgagaacagcacaaggagctctgattgtggcttccatcctcaacatgattcttgggttcagcacgatatgggcagcatatgccaagaagttcagccctgtaataatgacccctgttgtttgtgttgttggtcttggactattcgaaattggctttccccaggttgggaaatgtgtggagattgggcttccaatgctaattcttgcggtgcttgtgcaacagtatgtgccaaattacttcggttatatccatccacgggtcaccttcttgtttgagaggtattcgttgcttctttgtatcggcattgtgtgggcctttgcagccattcttactgctgcgggtgcatacgaccatgtttcacttaagacacagcagcactgccgcactgataagtctcgactcatctcatcggcaccatgggttaaagttccattgccattccaatggggtcctccaatcttcactgctggtcattcatttgggatgatgggtgctgtacttgttgcagcctttgagtcaactggagcacactttgctactgctcgtctagcgggtgctacaccacctccagctcatgtccttagtcggagcgttggcttgcagggtattggaatgttcctgggggggatctttagttgtccgacaggctcatctgtatcagttgaaaatattggcctccttggtctgaccaaagtcggaagtaggagagtcgtccagatatcaactgggtttatgatcttcttctccctatttggtaagtttggtgccttctttgcatcaattccattgccaatctttgcagcaatttactgcatcttgtttggcattgtagctgctgtgggagtctccttcatgcagtttgccaacaaaaactccatgaggaacatctatatcattggactctcattgttccttggcatctcaatccctcaatacttcaatgaatacacttcttcagctgacggccgtggacctgcccggacaaacgctggatggttcaacgacatcataaacaccgtgtttgcttccggcccgacggtggcgctaattgttgcttctgtcctggataacacattggagttcaggggctacgagtccgaccgggggctctcatggtttcagccattcctgcgtcgccataaaggatactcggaccccaggaacgaggagttctatagcttcccaatcagggttcatgacttcatcccaagccgatttctctga

SEQ ID NO: 7126 - protein, 558 aa, Sorghum bicolor
  misc_feature: Ceres ANNOT ID no. 6074464
  misc_feature (54)..(466): Pfam Id: Xan_ur_permease Pfam Desc: Permease family
  misc_feature (1)..(558): NCBI GI: 144924229 NCBI Desc: xanthine/uracil/vitamin c permease [medicago truncatula]
  misc_feature (100)..(554): NCBI GI: 115440067 NCBI Desc: os01g0759900 [oryza sativa (japonica cultivar-group)]
  misc_feature (15)..(555): NCBI GI: 89330191 NCBI Desc: leaf permease 1 [oryza sativa (japonica cultivar-group)]
  misc_feature (292)..(554): NCBI GI: 115478518 NCBI Desc: os09g0320400 [oryza sativa (japonica cultivar-group)]
  misc_feature (23)..(555): NCBI GI: 31711940 NCBI Desc: at5g49990 [arabidopsis thaliana]
MGETNEQPPPPPPVAAPPPMMAMMVPPVGAGAIHPPHEQFHHLNYCVHSNPSWVQVAALAFLHYLVMLGSTVMLASVIVPAMGGNAGDKARVIQSLLFMSGINTLIQTLIGTRLPTVMNASFAFVVPVLSIAREIESNNDLLNDHERFKHTMRTAQGALIVASILNMILGFSTIWAAYAKKFSPVIMTPVVCVVGLGLFEIGFPQVGKCVEIGLPMLILAVLVQQYVPNYFGYIHPRVTFLFERYSLLLCIGIVWAFAAILTAAGAYDHVSLKTQQHCRTDKSRLISSAPWVKVPLPFQWGPPIFTAGHSFGMMGAVLVAAFESTGAHFATARLAGATPPPAHVLSRSVGLQGIGMFLGGIFSCPTGSSVSVENIGLLGLTKVGSRRVVQISTGFMIFFSLFGKFGAFFASIPLPIFAAIYCILFGIVAAVGVSFMQFANKNSMRNIYIIGLSLFLGISIPQYFNEYTSSADGRGPARTNAGWFNDIINTVFASGPTVALIVASVLDNTLEFRGYESDRGLSWFQPFLRRHKGYSDPRNEEFYSFPIRVHDFIPSRFL

SEQ ID NO: 7127 - DNA, 3063 bp, Sorghum bicolor
  misc_feature: Ceres ANNOT ID no. 6074526
  misc_feature: Encodes the peptide sequence at SEQ ID NO 7128
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
atggagagctacctggaggagcggttcggcggcgtgcaggccaagaactcctccgaggaggcgctccgccgctggcgccgcctctgcagcgtcgtcaagaaccccaagcgccgcttccgcttcaccgccaacctcgagaagcgcggcgaggccgaggccatcaagcacgccaaccacgagaagctgcgcgtcgctgtgctcgtctcaaaggctgcactgcagtttctacatggtctctcccttcgaagtgagtacgtcgtccctgaggaagtcaaggctgcagggtttcaaatctgcgccgatgagctggggtccattgttgagggccatgatagtaagaagctcatcacccatggtggagttgatggaattgcggaaaaacttgcaacttcgaagacggacgggctaagcacagccgatgatagcattaagcgcaggcaagacatatatggagtaaacaagttcactgaaagtgaggtccgcagtttctgggtgtttgtatgggaggcgcttcaagatacaactcttataattctcgctgtctgcgcgttcgtgtcgctggttgttggtattgtgatggaagggtggccaaaaggcgctcatgatggccttggaattgttgcaagtatcctcttggttgtgtttgtgactgcgacaagtgactatcggcagtcgctgcagttcaaggacctggacaaggagaaaaagaaaatccaagtacaggttacaaggagtggtttcaggcaaaggctatcgatatatgatcttcttcctggcgatgttgtccatttagcaattggagatcaggtccctgctgatgggctcttcatttcagggttctctctattgatcaatgaatccagcctaactggtgaaagtgaacctgttgctgtaaatgaagataaccctttcctgttgtcggggaccaaagtacaagatggctcctgcaagatgctggtcacaactgttggcatgcgcacccaatggggaaaactgatggccactctcagtgaaggcggcgatgatgaaaccccactccaggttaaacttaatggagttgcaaccattattggccagattggactattttttgctgttataactttcattgtcctgtcccaagggcttttcagtaagaaataccatgaacggatgcttttaagctggtcaggagatgatgcattggagctgctggagcattttgctattgcagttaccattgttgttgttgctgttcctgagggattgccattagcagtcacgctgagtcttgcatttgccatgaagaaaatgatgaatgacaaggctctggttcgccacttagctgcatgtgagactatgggttcagctactaccatctgcagtgacaagacaggaacactgacaaccaatcatatgactgttgttaaggcctgcatctgcggaaacattaaggaagttaatggttctgagaatgcatccaagttacgctctgaatttccagagatcgtcgttaaaactcttctggagtctatatttaacaatacagctggtgaggttgtaattaaccaggatggtaaatatcagatcctgggtagccccacggagacagctttactagagtttgcattgtcactaggtggagattttaaggcaaaacgtgatgaaactaagattgtgaaagtggagccttttaattcaacaaaaaagaggatgagtgtcattcttgagcttcctggaggagggtgtcgtgcacactgtaaaggtgcttcagagatagtcttggctgcttgtgataaattcctagacgagacaggtggtgttcatcctctggataaaataactgctgacaagctcaatggtattattgatagttttgctggtgaagctcttaggacattatgccttgcttttagggaaatggaagaaggtttttccaccgcagagcatataccactacaagggtacacatgcattggaattataggtatcaaagatcctgtccgtccaggggtgaaggagtctgttgctacttgccgggctgctggaattatggtgagaatggtcacaggagacaacataaatacagcgaaggcaattgctcgtgaatgtggtatacttactgaagatggcatagctattgaaggaccggagttcagagagaaaagcctagatgaactccttaagctggttccaaaaatccaggtaatggcccgatcatcaccacttgacaagcatacacttgtaaagcatttgcgtacaacattcaatgatgttgttgctgttactggtgatggtacaaatgatgctcctgccttgcatgaagcagatattggacttgcaatgggcattgctgggactgaggtggcaaaagagagcgctgatgttataattctggacgacaacttctctacgattgtaactgttgccaagtggggacgatctgtttacatcaatattcaaaagtttgtccagtttcagctgactgtcaatgtagtggcacttctagttaacttttcctcagcctgctttacaggaaatgcaccgctgacagctgttcagcttctttgggttaacatgatcatggacacccttggcgcgcttgcgttagccacggagccacctaatgatgacttgatgaacagagagccagtaggaaggacagggaaattcattacgaatgtgatgtggaggaacatcctgggtcagtctttctaccagttctttgtgatgtggtatctccaaacgcaagggaaaaacttctttgggcttgaagactctggtactgatattgtgctaaatacaatcattttcaactcattcgtcttctgtcaggtgttcaatgagataagctctcgggagatggagaagatcaacgttctcaagggcatgactaggaactacgtgttcatggctgtccttaccagcacggtcatcttccagttcatcatggtgcagtttctaggcgagtttgccaacacgacgcccctgaccatacaccagtggctggccagcgtgctcctcggtctggctgggatgcccattgccgctgccgtcaagctgattccagttggctcgtcatga

SEQ ID NO: 7128 - protein, 1020 aa, Sorghum bicolor
  misc_feature: Ceres ANNOT ID no. 6074526
  misc_feature (205)..(446): Pfam Id: E1-E2_ATPase Pfam Desc: E1-E2 ATPase
  misc_feature (110)..(191): Pfam Id: Cation_ATPase_N Pfam Desc: Cation transporter/ATPase, N-terminus
  misc_feature (450)..(779): Pfam Id: Hydrolase Pfam Desc: haloacid dehalogenase-like hydrolase
  misc_feature (875)..(1019): Pfam Id: Cation_ATPase_C Pfam Desc: Cation transporting ATPase, C-terminus
  misc_feature (1)..(1020): NCBI GI: 110832727 NCBI Desc: calcium-transporting atpase 1, plasma membrane-type (ca(2+)-atpase isoform 1) (plastid envelope atpase 1)
  misc_feature (1)..(1017): NCBI GI: 21314227 NCBI Desc: type iib calcium atpase mca5 [medicago truncatula]
  misc_feature (1)..(1019): NCBI GI: 11066056 NCBI Desc: plasma membrane ca2+-atpase [glycine max]
  misc_feature (1)..(1017): NCBI GI: 11066054 NCBI Desc: plasma membrane ca2+-atpase [glycine max]
  misc_feature (1)..(1019): NCBI GI: 30316378 NCBI Desc: calcium-transporting atpase 1, plasma membrane-type (ca(2+)-atpase isoform 1) (plastid envelope atpase 1)
  misc_feature (1)..(1020): SWISSPROT Homolog: EC 3.6.3.8 Calcium-transporting ATPase 1, plasma membrane-type
  misc_feature: Up-regulated in shoot tissues in response to methyl jasmonate treatment
  misc_feature: Up-regulated in root tissues in response to salicylic acid treatment
  misc_feature: Up-regulated in shoot tissues in response to salicylic acid treatment
MESYLEERFGGVQAKNSSEEALRRWRRLCSVVKNPKRRFRFTANLEKRGEAEAIKHANHEKLRVAVLVSKAALQFLHGLSLRSEYVVPEEVKAAGFQICADELGSIVEGHDSKKLITHGGVDGIAEKLATSKTDGLSTADDSIKRRQDIYGVNKFTESEVRSFWVFVWEALQDTTLIILAVCAFVSLVVGIVMEGWPKGAHDGLGIVASILLVVFVTATSDYRQSLQFKDLDKEKKKIQVQVTRSGFRQRLSIYDLLPGDVVHLAIGDQVPADGLFISGFSLLINESSLTGESEPVAVNEDNPFLLSGTKVQDGSCKMLVTTVGMRTQWGKLMATLSEGGDDETPLQVKLNGVATIIGQIGLFFAVITFIVLSQGLFSKKYHERMLLSWSGDDALELLEHFAIAVTIVVVAVPEGLPLAVTLSLAFAMKKMMNDKALVRHLAACETMGSATTICSDKTGTLTTNHMTVVKACICGNIKEVNGSENASKLRSEFPEIVVKTLLESIFNNTAGEVVINQDGKYQILGSPTETALLEFALSLGGDFKAKRDETKIVKVEPFNSTKKRMSVILELPGGGCRAHCKGASEIVLAACDKFLDETGGVHPLDKITADKLNGIIDSFAGEALRTLCLAFREMEEGFSTAEHIPLQGYTCIGIIGIKDPVRPGVKESVATCRAAGIMVRMVTGDNINTAKAIARECGILTEDGIAIEGPEFREKSLDELLKLVPKIQVMARSSPLDKHTLVKHLRTTFNDVVAVTGDGTNDAPALHEADIGLAMGIAGTEVAKESADVIILDDNFSTIVTVAKWGRSVYINIQKFVQFQLTVNVVALLVNFSSACFTGNAPLTAVQLLWVNMIMDTLGALALATEPPNDDLMNREPVGRTGKFITNVMWRNILGQSFYQFFVMWYLQTQGKNFFGLEDSGTDIVLNTIIFNSFVFCQVFNEISSREMEKINVLKGMTRNYVFMAVLTSTVIFQFIMVQFLGEFANTTPLTIHQWLASVLLGLAGMPIAAAVKLIPVGSS

SEQ ID NO: 7129 - DNA, 1515 bp, Sorghum bicolor
  misc_feature: Ceres ANNOT ID no. 6074552
  misc_feature: Encodes the peptide sequence at SEQ ID NO 7130
atgtcaccttcatcgcgcgccgcctcatggcagagcgcgacgaccctggcggcgtgggacgccacgtcgctcgcctcggcgctaaagaccgcggccgcgcgccgctccgcggcccacgtggggccactccatgccgtgctccggaagctcggcctctccgcgtccgcgatccacgccacctccctggcgcacctggcgctgcggagcgggctcgcgcggtacgcgcgggagctgttcgacgagatgccccgccgggacgtggtctcctggacgtccctcgtcacgggccacgcgcaccaggggctgcaccgcgacgccctcgcgctgctccggcgcatggtggggtctggtgtcgagcccaatggctactccctgtccggtggactgctggcctgtgcgggtgtcggccggagcgcgcttgctcacggcaaggagatccatgccagtgtggtcaagatgagctcgcgtggaccggtcgacccggttgtggagaatggggttcttgatatgtactcgaggtgtggaagcatagagtatgcgctgagagtgttcggggtgatgcgtgtcaggaacatggttgcttgtaactcgatgatggcagctcttcttgggaccgggcaggccgaggatgcactgaggttattcgtttccatggcttcttgtggcgttggtgtggacggtttctcattctccattgttgtggatgcgtgtggggagctggcgttattgaagcaggggatgcaggtgcatgcgcaggtcgttggtggtgggttcgaagcagatgtcgttgtcaggaactccttggtggatatgtatgcaaaatgtggctgtgtcgattcggccgagcttgtcttcaaagctgtatcatcaaatgatgctcttctttggaccacgatgatctcggcttatggcaagtttggccgtgtacgggatgcggtcagcatgtttgagaggatggcacacttgggaataaaacaggatggcatagcgtatcttgcggttttgtcagcttgtagccatggtggacttgttagagaaggctggtattacttcaatttgatgtctgatggttcgagctcagttaagatgcaacctgagcactacggatgcatggcggatctcctttgcaggaggggttacctagaagaagctctcgaattcattcagaatatgccatttgactcgagcgttgctgcttggagcgcgctactcaactcatctagaatacatgggaatgccaagttaggtcagtttgcagcatcctttttgctcaagcttgaccctgagaaccacagcaactgggttgctctatcaagtgtgcatgcgtcagggaatgattggcatgagacctggacaatcagggagagcatgagcagagtgtgtgtgaagaaagagcctgggtgtagctgggttgagttgtgtgatggcgtccatgtttttataatggccgaccagtctcatcctgaattatttcaaatattgcagagtcttgattctttttggcaattttcatag

SEQ ID NO: 7130 - protein, 504 aa, Sorghum bicolor
  misc_feature: Ceres ANNOT ID no. 6074552
  misc_feature (88)..(122): Pfam Id: PPR Pfam Desc: PPR repeat
  misc_feature (193)..(227): Pfam Id: PPR Pfam Desc: PPR repeat
  misc_feature (294)..(328): Pfam Id: PPR Pfam Desc: PPR repeat
  misc_feature (31)..(489): NCBI GI: 140070266 NCBI Desc: pentatricopeptide repeat [medicago truncatula]
  misc_feature (27)..(498): NCBI GI: 86438643 NCBI Desc: selenium binding protein [brachypodium sylvaticum]
  misc_feature (30)..(493): NCBI GI: 86439692 NCBI Desc: selenium binding protein [triticum aestivum]
  misc_feature (27)..(499): NCBI GI: 115442589 NCBI Desc: os01g0977400 [oryza sativa (japonica cultivar-group)]
  misc_feature (27)..(499): NCBI GI: 57899529 NCBI Desc: vegetative storage protein-like [oryza sativa (japonica cultivar-group)]
MSPSSRAASWQSATTLAAWDATSLASALKTAAARRSAAHVGPLHAVLRKLGLSASAIHATSLAHLALRSGLARYARELFDEMPRRDVVSWTSLVTGHAHQGLHRDALALLRRMVGSGVEPNGYSLSGGLLACAGVGRSALAHGKEIHASVVKMSSRGPVDPVVENGVLDMYSRCGSIEYALRVFGVMRVRNMVACNSMMAALLGTGQAEDALRLFVSMASCGVGVDGFSFSIVVDACGELALLKQGMQVHAQVVGGGFEADVVVRNSLVDMYAKCGCVDSAELVFKAVSSNDALLWTTMISAYGKFGRVRDAVSMFERMAHLGIKQDGIAYLAVLSACSHGGLVREGWYYFNLMSDGSSSVKMQPEHYGCMADLLCRRGYLEEALEFIQNMPFDSSVAAWSALLNSSRIHGNAKLGQFAASFLLKLDPENHSNWVALSSVHASGNDWHETWTIRESMSRVCVKKEPGCSWVELCDGVHVFIMADQSHPELFQILQSLDSFWQFS

SEQ ID NO: 7131 - DNA, 1083 bp, Sorghum bicolor
  misc_feature: Ceres ANNOT ID no. 6074553
  misc_feature: Encodes the peptide sequence at SEQ ID NO 7132
atggcactcaggcagatggttgagaaggcgtgtgagagctgcagggagtggcaggagcactactactgggatcacatggatgtgagcaagatccgcttcttcaggcgcatgaccggagattttgctcatcgcattagcataccggagaagtttgcaaagaaattcagggggcagatcaccgaagaggttcaactgaaatcacctagtagtgctgagacatggcacatcagcgtagagaagtgtgacgatgtgctgttcttcatatcaggatgggaggattttgtcaaggctcatgaactgcaggagaatgatctcctgctcttcacttgctgtggaaagtcttcctttgaggtcctagtcttcgaagcaagtggctgtgaaaaagtgtcttccctgtttgacaatggaattggttctgatgtgtgcaaacaattcaatgatatagtgggtaaacatggtgagcatcactctgtgactgtgagtgattctgaggatgccattgcgccgtcgcagctggttggatcccctcacaacgcctctccttcgaaggaacagagtgggaaggctagaccaagtgagtatgaatcaccaaaagacagcaactttattgtcaagcatgtggcaactggcgaagaggatagtgatgatgggtatgctaaatctaactactactactccaagttcgccaatcgactaagagatgaggaaaaggagcaaataataggtttggcttccatccgaccgaacaatcctgtatttgtggctgttctgatgaaaaaccatgttcagcgcagaaacaaccatctgaccatcccaattaaatttgctgctgatcatcttgtggaaagagcacatgacatcatccttcgtaggccaaataggaaagagaaatggcttgtcagctactattactcatgccgcacccggtgtttccacaacttacggttgtttaagtttatgcgcgaaagcaagcttcgtgagggtgacatctgcatctttgagctgatgaaagacaaaaggagagtgacgatgactgtccatgccatcagaaaggccaatgaccggtttattctggtaggctaa

SEQ ID NO: 7132 - protein, 360 aa, Sorghum bicolor
  misc_feature: Ceres ANNOT ID no. 6074553
  misc_feature (32)..(126): Pfam Id: B3 Pfam Desc: B3 DNA binding domain
  misc_feature (12)..(347): NCBI GI: 140069091 NCBI Desc: hmg-i and hmg-y, dna-binding; transcriptional factor b3; cupredoxin [medicago truncatula]
  misc_feature (7)..(169): NCBI GI: 20145851 NCBI Desc: auxin response factor 36 [arabidopsis thaliana]
  misc_feature (6)..(186): NCBI GI: 144924215 NCBI Desc: transcriptional factor b3; cupredoxin [medicago truncatula]
  misc_feature (12)..(133): NCBI GI: 140069093 NCBI Desc: hmg-i and hmg-y, dna-binding; transcriptional factor b3; cupredoxin [medicago truncatula]
  misc_feature (15)..(216): NCBI GI: 144924212 NCBI Desc: transcriptional factor b3; cupredoxin [medicago truncatula]
  misc_feature: The sequence is a functional homolog of SEQ ID NO. 467 in the 11/188,298 US application
MALRQMVEKACESCREWQEHYYWDHMDVSKIRFFRRMTGDFAHRISIPEKFAKKFRGQITEEVQLKSPSSAETWHISVEKCDDVLFFISGWEDFVKAHELQENDLLLFTCCGKSSFEVLVFEASGCEKVSSLFDNGIGSDVCKQFNDIVGKHGEHHSVTVSDSEDAIAPSQLVGSPHNASPSKEQSGKARPSEYESPKDSNFIVKHVATGEEDSDDGYAKSNYYYSKFANRLRDEEKEQIIGLASIRPNNPVFVAVLMKNHVQRRNNHLTIPIKFAADHLVERAHDIILRRPNRKEKWLVSYYYSCRTRCFHNLRLFKFMRESKLREGDICIFELMKDKRRVTMTVHAIRKANDRFILVG

SEQ ID NO: 7133 - DNA, 888 bp, Sorghum bicolor
  misc_feature: Ceres ANNOT ID no. 6074584
  misc_feature: Encodes the peptide sequence at SEQ ID NO 7134
atggccctgctgccgtcacccctctgctccccgtgccaccaccgggccgcgcccgcgcccttgccggcgcccactgccgcctcggcgcgccaccggaggggaagcctgcgcctcgctgcggccggctcccgctcaggccctaccgccgagacgaagccccgtcccacctccgccgacaggaggaggtgcgaatgctttgacctccatcggcagttaattccttatgctgaggcttactgttggcagaagtctatcgttgagaggaggaaagggttgatagacacccgcgaagaccactctgacaccttgattgctttgcaacatccaccagtttatacgttgggcactgatagcaagaaggaatacctccatttcgacaaggaagatgctcctttcgagattcaccatactaatcgtggtggggaagtgacgtaccatggccctggacagcttgttatgtacccgattatgaatttgaagtatcacaaagaggatgttcgctggtacttcaggtcacttgaagaagtgatcatccgtgcactgaaatccgccttctctatcaaggcaacaagagtagaaggtctcactggtgtttgggttggggatcagaaagttgctgcgatagggattcatggttcgcggatgatagtttatcatggtctcgcactaaatgtcacaactgacctagctccgtttaaaatgattgatccttgtggcataaaggaccgtggcgtggggagcattaaggagatactacagaaggcatctggtgcaagagaaattgatgatgcatcactgatggatacagcatatgattccatgatgaaagagtttgctgaacttttccaactcagtctagacttcagccctgattgcagtttccagtaa

SEQ ID NO: 7134 - protein, 295 aa, Sorghum bicolor
  misc_feature: Ceres ANNOT ID no. 6074584
  misc_feature (114)..(201): Pfam Id: BPL_LipA_LipB Pfam Desc: Biotin/lipoate A/B protein ligase family
  misc_feature (61)..(287): NCBI GI: 5668803 NCBI Desc: f16n3.14 [arabidopsis thaliana]
  misc_feature (65)..(250): NCBI GI: 109892513 NCBI Desc: lipoyltransferase (lipoyl-[acyl-carrier protein]-protein-n-lipoyltransferase) (lipoate-protein ligase b)
  misc_feature (64)..(252): NCBI GI: 119483432 NCBI Desc: lipoyltransferase [lyngbya sp. pcc 8106]
  misc_feature (65)..(250): NCBI GI: 17230677 NCBI Desc: lipoate-protein ligase b [nostoc sp. pcc 7120]
  misc_feature (73)..(250): NCBI GI: 75910087 NCBI Desc: lipoate-protein ligase b [anabaena variabilis atcc 29413]
MALLPSPLCSPCHHRAAPAPLPAPTAASARHRRGSLRLAAAGSRSGPTAETKPRPTSADRRRCECFDLHRQLIPYAEAYCWQKSIVERRKGLIDTREDHSDTLIALQHPPVYTLGTDSKKEYLHFDKEDAPFEIHHTNRGGEVTYHGPGQLVMYPIMNLKYHKEDVRWYFRSLEEVIIRALKSAFSIKATRVEGLTGVWVGDQKVAAIGIHGSRMIVYHGLALNVTTDLAPFKMIDPCGIKDRGVGSIKEILQKASGAREIDDASLMDTAYDSMMKEFAELFQLSLDFSPDCSFQ

SEQ ID NO: 7135 - DNA, 1206 bp, Sorghum bicolor
  misc_feature: Ceres ANNOT ID no. 6074589
  misc_feature: Encodes the peptide sequence at SEQ ID NO 7136
atggaggagacggcgaggcagctcatcactcgccttgccgccaccccggactccgccgtgcgagacctccccttcctccaccgcgccctcactctccccctcctctccgccgcgtccgccgcgctccgcctgtccctgctcccctcgtggctccgcccgcgccgcgcgctgcccgtgcccgtcgtcagcgtcggcaacctcacttggggtggcaatggcaagacgcccatggtcgacttcttggcccgcagcttccaccgcctcggcgtctcgccactgattctgacgaggggttatgcaggcggtgatgagccaaagatgctccggaggcgcctttccgatacttcggccaagattggggtcggtgcaaatagaacagcagtggcttcttccatgctgcaagaatatggatttatccatcattttcagaacacctgtgccgagaagaagttttcatcagcctgcaaactggaatctggtagtaggattggagtagctatattagatgatggtatgcagcattggagcttgctccgagatgttgagattgtgatggttaatgggttggctccatggggaaactcccattttattccgcgaggacccatgagagaacctctgagcgcacttggtcgagctgatattgtgatcattcataatgcagacatggcttctgaagcgcaactcaaagcaataaggtccacaatagaggagaatagcacaacatgctcagtgttctacagcagattggctccatcacatttttttgaagttaaacaaccattacagagaattccccttaatgtgttgaatgataagatcgtgctatgtgtttctgcaattggctgcccaaatgctttcattcatacagtcagagagattggtccactcaaaattgataggttggatttcagtgaccatcatttcttcaatggtcatgacctagagataatccaagaaacggtgaggaatctcatggaccagtacagcaaagataccatagtcatagttactgagaaggattatgaccgtgatccagctgcccttaggacattggatgcaaaggtttgggtgctgtcttcttcgttgcagattatgcctcacaaggaacaaggagaagatgaattcatgaggaaagttaacgagattatcacgattactgggtgtgcaaagtcacatgcggtggatcgggccacgaattgctga

SEQ ID NO: 7136 - protein, 401 aa, Sorghum bicolor
  misc_feature: Ceres ANNOT ID no. 6074589
  misc_feature (26)..(388): Pfam Id: LpxK Pfam Desc: Tetraacyldisaccharide-1-P 4'-kinase
  misc_feature (160)..(296): NCBI GI: 115470161 NCBI Desc: os07g0102000 [oryza sativa (japonica cultivar-group)]
  misc_feature (35)..(397): NCBI GI: 121535895 NCBI Desc: tetraacyldisaccharide 4'-kinase [thermosinus carboxydivorans nor1]
  misc_feature (61)..(345): NCBI GI: 89211047 NCBI Desc: tetraacyldisaccharide-1-p 4'-kinase [halothermothrix orenii h 168]
  misc_feature (165)..(341): NCBI GI: 32474757 NCBI Desc: probable tetraacyldisaccharide 4-kinase [rhodopirellula baltica sh 1]
  misc_feature (30)..(377): NCBI GI: 121541183 NCBI Desc: tetraacyldisaccharide 4'-kinase [candidatus desulfococcus oleovorans hxd3]
MEETARQLITRLAATPDSAVRDLPFLHRALTLPLLSAASAALRLSLLPSWLRPRRALPVPVVSVGNLTWGGNGKTPMVDFLARSFHRLGVSPLILTRGYAGGDEPKMLRRRLSDTSAKIGVGANRTAVASSMLQEYGFIHHFQNTCAEKKFSSACKLESGSRIGVAILDDGMQHWSLLRDVEIVMVNGLAPWGNSHFIPRGPMREPLSALGRADIVIIHNADMASEAQLKAIRSTIEENSTTCSVFYSRLAPSHFFEVKQPLQRIPLNVLNDKIVLCVSAIGCPNAFIHTVREIGPLKIDRLDFSDHHFFNGHDLEIIQETVRNLMDQYSKDTIVIVTEKDYDRDPAALRTLDAKVWVLSSSLQIMPHKEQGEDEFMRKVNEIITITGCAKSHAVDRATNC

SEQ ID NO: 7137 - DNA, 873 bp, Sorghum bicolor
  misc_feature: Ceres ANNOT ID no. 6074592
  misc_feature: Encodes the peptide sequence at SEQ ID NO 7138
atgacggcggggggcgggcggtgcttgctcgccgtggcgctcgccgccgcttggatctccggcgcggcggccgcagcctcgtcgtcggctgagcaggcagacggaaggcaaaaatccgtcaaatgcatgccctgctctaggccgtacattggtgatgcatatctagacaacaccttgacgggccagcttgctcagcgtcgtgacttagtggaaatgtctgattctggtgaattgtgcaaaggacttgctgaagatgtcaaagtgcctgtgctctcaaaattgcgccggcaactggttggtgaaggttctcaccgccgtttagtctattctatggattttggtgcctgtgatggtgctatggttaattttcttgatggctatgatgcccatctggtgatatttgaaaaactcccggatggggtgtttgctgacccatttgagctacagcattttgttgagcgcaaagttttcgtggatgttgctgtttttggagacaccaatcttgaacttcccacagctctatccaatcggtcatctgtcgagattcattttgatctcaggctaatcatttcaaccgactgtaaccttgaaatagacttgcctctccatgctagatacccgcctcttgatgccagtggctatgccacggtggagtttggtaacccagatttgttcctccagtacagaaaaaaggaaatccattctgattcctgtctttgggtgattaagaatctcaaagctgcacccctggagaaagctgcatggcggataccctgtggagatgaggcccacataggatttgtatctagcatcacgtttctttcagctcttgtttgttccatgtccatcgtcttagctgctctaattttttga

SEQ ID NO: 7138 - protein, 290 aa, Sorghum bicolor
  misc_feature: Ceres ANNOT ID no. 6074592
  misc_feature (99)..(290): Pfam Id: PIG-X Pfam Desc: PIG-X / PBN1
  misc_feature (94)..(286): NCBI GI: 23680885 NCBI Desc: gpi-mannosyltransferase subunit [homo sapiens]
  misc_feature (94)..(286): NCBI GI: 119574023 NCBI Desc: hcg40298, isoform cra_d [homo sapiens]
  misc_feature (94)..(226): NCBI GI: 119574022 NCBI Desc: hcg40298, isoform cra_c [homo sapiens]
  misc_feature (94)..(286): NCBI GI: 54260404 NCBI Desc: subunit of gpi-mannosyltransferase [rattus norvegicus]
  misc_feature (94)..(286): NCBI GI: 110815927 NCBI Desc: phosphatidylinositol-glycan biosynthesis class x protein precursor (pig-x)
MTAGGGRCLLAVALAAAWISGAAAAASSSAEQADGRQKSVKCMPCSRPYIGDAYLDNTLTGQLAQRRDLVEMSDSGELCKGLAEDVKVPVLSKLRRQLVGEGSHRRLVYSMDFGACDGAMVNFLDGYDAHLVIFEKLPDGVFADPFELQHFVERKVFVDVAVFGDTNLELPTALSNRSSVEIHFDLRLIISTDCNLEIDLPLHARYPPLDASGYATVEFGNPDLFLQYRKKEIHSDSCLWVIKNLKAAPLEKAAWRIPCGDEAHIGFVSSITFLSALVCSMSIVLAALIF

SEQ ID NO: 7139 - DNA, 3369 bp, Sorghum bicolor
  misc_feature: Ceres ANNOT ID no. 6074600
  misc_feature: Encodes the peptide sequence at SEQ ID NO 7140
atggctggcactttgactgaggacaatggtgcggatgctagatcctcatcaactgaagagatgccaagtgatcaacagagtcattctggggattctttagctgagtggaggtcgagtgagcaagttgagaatggaacaccatccacttcaccagcgtactcagacactgatgatgacgactgtggacctaggccttctgagctatatgggaagtttacatggagaattgataatttctcccaaatcaacaagagagagctaagaagtaattcctttgatgttggtggatttaagtggtatatcttaatttacccacaaggatgtgatgtctgcaatcacctctcactctttctttgtgttgccaaccatgataagctactcccaggatggagtcactttgcgcaatttacaatagctgtaattaatagagaccctaagaaatcgaagtattctgatacactgcatcggttttggaagaaagagcatgattgggggtggaaaaagtttatggagctgtcaaaattacatgatggctttattgttgaggatgttcttaccatcaaagcccaagttcaagttatcagggagaagacagaccgtccatttcgttgccttgatgggcagtaccgaagggaactaattagggtgtatctatcaaatgtggaacaaatttgccggcgctttattgatgaaagaagaagcaagcttagcaggttgattgaggataaactggggtggtccagtttcaatggattctggctagcaatggatccaagtgtgcgtcgacacatgacaagggaaaagactgaaactatattgaaagttctagtgaaacaattctttatagagaaagaagttacatcaaccttggtaattgactcactatatagcggacttaaggcacttgaataccagagcaagaacaaaaaggcgatacctaaactaacagagacagatgctcggagcactccaatggtacttattgatcaggacatgtttgttttggctgatgatgtgatacttctgcttgaaagagctgcattggacacactgccacaccaaccattgcctacaaaggatgataaaagttcacaaaaccgcacgaaggatggcaactcaggtgaggagttcagcaaagattctattgagcgtgatgatagacggcttatagagctaggctggaagacattggagctttttgccttggctcatatattcagccgaatagaagtggcacatcaagaggctgtggctttgaagcgccaagaggaactcattcgtgaagaggaagcagctggactagctgaaattgaacttaaggcaaagcgtaatgctgctgaaaaggaaaaacgtgccaagaaaaaacaggcgaaacagaagaaaaatagtcgaaaaagtaataaggggaaaagtggcaagtccgacatcaataaggaaatacttatggacagcagtccttcagatgatagaatcctggatgatttttctggacaaacggaagaaatgtcctcaaatgctgacaaccctgaagaagtttctgatatatctgacagcagagacgataattcagatgtgcttcatgttgatattgaagaccgtgaatctagtcctgttaattgggagacagatgcagaaacacaagctactgttcctggaagtagtgaggtgcaaaatgaccatgcagggaagaggacctctactgtggatgatagctcatcaacttgttcatcagactcggtcccttcagctaccgtgaacggatcatatacaggaggtgcctggacaagcgtgagatcctcatccaataggggaaacaaccggaggaataaggatactgaagcacgggcaggatttgcacaaggtggatcaagttcagcgcataatggttttataggatctggcagcaatgcctctagccactcaaaggaaagacacgaacctgaggatgataaagttgtcttgcagaggaagcaacatgcacaacggcacattgatgtcattagcccctctaagtcaagaatggcggagtcttcattttcttctgtgagccctgttaagaagcaacctaacatgtctcatcaaccaaaatttttgctagaaagcaccaatagtttgaatcaccgtgcaagcgaagtttcaggcgctgtgactgccactacaacagcaggtgcctcttcaaccccggcagctcagttagtttcgaataaaggacctgtatccagtgctgcaacccagaatgagaagccagttctagttacaagtagacccctgcaggttcttttaccatccaaatctgaagcgcagaaacaggcttccgtaactggcagtgcaaatactcaggacatttcagtatcaaggcccttgagtgccccacaagtccctgcggcgaaacaaagtgcaccagtcacttcaacagctccgaatgcacctcttctttctcgttcaatgagtgctgttgggcggttgggaaatgaaccctctgccagtgctcctagtttcattccccggtcacgaacatatcgcaatgccatgatggagaaaagttctggtggtggaagcagtttcacacatcagcaaggttcgtccgagcaagcagttacaccattgcaatcgatttttacatcgcaaccttccattccgtcatcagagaccttgtctaggaaagaggaaacatcattgagacctgggtttacatttggaactgtaaagcccgagtcactgaacccatatcagggcagagaagagacctcacaacaagcgagcagcagcagcagcagcagtagtgattgtatgccatcgaattcgaacatcagaagcgagattgcgaagctcaatttgaatggaagatcacgaagcaagcaactgttgtcagaaatttctaccagatttactccctatcagccacaaggcttggtcgctgatgagttcccacacctagacatcatcaacgacttgttggatgaggagcagagtgacaggagaagggttcttcaacctggttttgttcaacaattctctatgcctaatggtgccagcacacctgagtatggtttgtttagtgagccatacctgtttgaccagtctgagcaatactttgacgaggagcctccaaggttttatagtccattgagcagtgctcctcggaggctgagggaccggagctattcacactttgatctcccatcatactccagcagcagccagtttgatgatctgatgatgagtcagtggccatacagccgcactgacatctccatgcctagttttgagtcagacacaagtggctacccttatcaggcgcaggatttcccgagttcagctaatagagcaagcaggtacccatcgtatcgccctgccaatgggcattga

SEQ ID NO: 7140 - protein, 1122 aa, Sorghum bicolor
  misc_feature: Ceres ANNOT ID no. 6074600
  misc_feature (76)..(193): Pfam Id: MATH Pfam Desc: MATH domain
  misc_feature (1)..(989): NCBI GI: 140060703 NCBI Desc: math [medicago truncatula]
  misc_feature (1)..(835): NCBI GI: 19310439 NCBI Desc: at5g43560/k9d7_6 [arabidopsis thaliana]
  misc_feature (23)..(586): NCBI GI: 53793374 NCBI Desc: meprin and traf homology domain-containing protein-like [oryza sativa (japonica cultivar-group)]
  misc_feature (23)..(586): NCBI GI: 115440257 NCBI Desc: os01g0775300 [oryza sativa (japonica cultivar-group)]
  misc_feature (12)..(728): NCBI GI: 115464795 NCBI Desc: os05g0508700 [oryza sativa (japonica cultivar-group)]
MAGTLTEDNGADARSSSTEEMPSDQQSHSGDSLAEWRSSEQVENGTPSTSPAYSDTDDDDCGPRPSELYGKFTWRIDNFSQINKRELRSNSFDVGGFKWYILIYPQGCDVCNHLSLFLCVANHDKLLPGWSHFAQFTIAVINRDPKKSKYSDTLHRFWKKEHDWGWKKFMELSKLHDGFIVEDVLTIKAQVQVIREKTDRPFRCLDGQYRRELIRVYLSNVEQICRRFIDERRSKLSRLIEDKLGWSSFNGFWLAMDPSVRRHMTREKTETILKVLVKQFFIEKEVTSTLVIDSLYSGLKALEYQSKNKKAIPKLTETDARSTPMVLIDQDMFVLADDVILLLERAALDTLPHQPLPTKDDKSSQNRTKDGNSGEEFSKDSIERDDRRLIELGWKTLELFALAHIFSRIEVAHQEAVALKRQEELIREEEAAGLAEIELKAKRNAAEKEKRAKKKQAKQKKNSRKSNKGKSGKSDINKEILMDSSPSDDRILDDFSGQTEEMSSNADNPEEVSDISDSRDDNSDVLHVDIEDRESSPVNWETDAETQATVPGSSEVQNDHAGKRTSTVDDSSSTCSSDSVPSATVNGSYTGGAWTSVRSSSNRGNNRRNKDTEARAGFAQGGSSSAHNGFIGSGSNASSHSKERHEPEDDKVVLQRKQHAQRHIDVISPSKSRMAESSFSSVSPVKKQPNMSHQPKFLLESTNSLNHRASEVSGAVTATTTAGASSTPAAQLVSNKGPVSSAATQNEKPVLVTSRPLQVLLPSKSEAQKQASVTGSANTQDISVSRPLSAPQVPAAKQSAPVTSTAPNAPLLSRSMSAVGRLGNEPSASAPSFIPRSRTYRNAMMEKSSGGGSSFTHQQGSSEQAVTPLQSIFTSQPSIPSSETLSRKEETSLRPGFTFGTVKPESLNPYQGREETSQQASSSSSSSSDCMPSNSNIRSEIAKLNLNGRSRSKQLLSEISTRFTPYQPQGLVADEFPHLDIINDLLDEEQSDRRRVLQPGFVQQFSMPNGASTPEYGLFSEPYLFDQSEQYFDEEPPRFYSPLSSAPRRLRDRSYSHFDLPSYSSSSQFDDLMMSQWPYSRTDISMPSFESDTSGYPYQAQDFPSSANRASRYPSYRPANGH

SEQ ID NO: 7141 - DNA, 1422 bp, Sorghum bicolor
  misc_feature: Ceres ANNOT ID no. 6074605
  misc_feature: Encodes the peptide sequence at SEQ ID NO 7142
atgccgccgcctcccatcgccgccgctgccaccgcgctcccggctgcccacctcgccagggtggtggccgcttccggaaacggaggcgcgaatccgccgaggacggcccctcgtcgggggcggcgcggcaagcccgggttctcgcggcgttcggcaatcaagaagagcttccaccaggaacaggtcgtgttctccaccccggtccccgccgaccccaccgtcgccgtcatcggaggcggcgcttccggcctctcctgcgcgtctgccctcgccgcgcgcggcgtccgctccgtcgtcttcgacacgggaatgcacggcctaggcggcaggatggcgactaggttcgtcgacggcggcgagcagctggtgttcgaccacgcggcgcagttcttcaccgcgagcgacgagaggttccagagcatggtcgacgagtggctcgacagagggctggtccgtgagtggagtggcttggtcggcgagctcgaagctggcggccgtttcagggccataccttcgttgacgccgaggtacatcggtgtgaatgggatgcgcccacttgcagatgcaatgctgcctgagactgatatgattaaagttttgaggccttgttggataagcaaacttgagcccttcaatggcttgtggcgcttgtttgagaatgaaaagccccatggtgaatatgatgccattgtgatagctcataatgggaaatgtgccaaccgtctgctttctacatcaggactgccattactaacaaaacaaatgaagagactagagctcagttctgtctgggcactccttgcggcatttgaagctcctcttccggttccatgtattgattcacgtggagcatttgaaggagcatttgtgagagatgtcgattctctctcttggatgggcaacaatacccgcaaactttttccaatgcagacaggcacacccgagtgctggacatttttcagtactgctgcttatggaaaaagaaacaaagtcccacaggaaaatatcccaaaagtcacggcagaaaaggtgaaggaagacatgcttggaggagtagaacatgctttagggttatcaaaaggatctcttcagcaaccaatttacacaagagtgcagttatggggtgcagctctgccgatgaacactccaggagtatcatgcatatttgatcccctagggcgagcaggcatctgcggtgactggcttactggttcaagcatagaagcggctgttttaagtgggatgtcactcgcaaaccatatagctgactactttgtgagcaacggagatcgacctgaagagtttgcgattggtctgcacgaggacctaaatgcagttgaagggcatgatatcggccagtttcccgggttagacagtcagacaccacaagtagcggaagctcaactgacgccgagcatatga

SEQ ID NO: 7142 - protein, 473 aa, Sorghum bicolor
  misc_feature: Ceres ANNOT ID no. 6074605
  misc_feature (74)..(421): NCBI GI: 22655396 NCBI Desc: at1g55980/t6h22.19 [arabidopsis thaliana]
  misc_feature (55)..(421): NCBI GI: 32475803 NCBI Desc: probable deoxyribodipyrimidine photolyase [rhodopirellula baltica sh 1]
  misc_feature (72)..(356): NCBI GI: 83746114 NCBI Desc: nadph-dependent glutamate synthase beta chain and related oxidoreductases [ralstonia solanacearum uw551]
  misc_feature (74)..(341): NCBI GI: 87306827 NCBI Desc: amine oxidase, flavin-containing [blastopirellula marina dsm 3645]
  misc_feature (74)..(329): NCBI GI: 28851578 NCBI Desc: amine oxidase, flavin-containing [pseudomonas syringae pv. tomato str. dc3000]
MPPPPIAAAATALPAAHLARVVAASGNGGANPPRTAPRRGRRGKPGFSRRSAIKKSFHQEQVVFSTPVPADPTVAVIGGGASGLSCASALAARGVRSVVFDTGMHGLGGRMATRFVDGGEQLVFDHAAQFFTASDERFQSMVDEWLDRGLVREWSGLVGELEAGGRFRAIPSLTPRYIGVNGMRPLADAMLPETDMIKVLRPCWISKLEPFNGLWRLFENEKPHGEYDAIVIAHNGKCANRLLSTSGLPLLTKQMKRLELSSVWALLAAFEAPLPVPCIDSRGAFEGAFVRDVDSLSWMGNNTRKLFPMQTGTPECWTFFSTAAYGKRNKVPQENIPKVTAEKVKEDMLGGVEHALGLSKGSLQQPIYTRVQLWGAALPMNTPGVSCIFDPLGRAGICGDWLTGSSIEAAVLSGMSLANHIADYFVSNGDRPEEFAIGLHEDLNAVEGHDIGQFPGLDSQTPQVAEAQLTPSI

SEQ ID NO: 7143 - DNA, 1059 bp, Sorghum bicolor
  misc_feature: Ceres ANNOT ID no. 6074613
  misc_feature: Encodes the peptide sequence at SEQ ID NO 7144
atgaacaagaacgacccagatgctgctgctgctgctggaggtggtggtccctggtgctgtgacaaccagggtggcaacgccggcgaggccgccgccgccgccaccgtgcccaccacgggcgaatccggaagcttcttcgccgatgtggtcgcggactactccacagatgaactctttgagctggtgtgggagcaagaaggaaaagacggcggcggcgcatcgtcggggtcgatgcacccggcggtttcccgcctcaggtcgccgaagttcaccaagccgcccgatgtgccgttcgacgacccaccgttggaggacgagatggcggcgtggctcgcgggcaccgttgtcaaaggcgatgaggtacttgccttcaacgacgacgacggtggcagtcgtcgaccgacaagtgatgatggtcgggatgtagtgccggcggagaaagggacgtcgtcgacgacggcgatgggcaagaaagaaaaggtcgttccgacgacgacaatggaagggatgatgatggccaacaaggagatgagaaaggtgccggcagcagtaggatcttcaagaaggtctcaccacggtgaaggacacaacctgacagagaagagacggaggcacaagataaacgaaaggctcaagaccctgcagaagctcgtcccgggatgtagcaagtccaatcaagcctcgacgctggaccagaccatccattacatgaaatcgctgcagcagcaggtgcaggcgatgtccgtcggcctggcggcgcccgctgtgtatcccgtcgtgcagccacagtgcgtgcctccggggacgccggtggccatgccatttccagcagctcatccgatggtcctcggcggccaccctccgtcgacgacgatggttcccttcggggctaccatggttcagttgccccattaccctgctgcagccgtgatgatgcctctgtatccggcagcagctcctacaagcactgtagcgacacctggagatgccatgtctgccagccatcttcatggctctagcagcagaagcagcagtaaagaaaagaggaaaaggcagtag

SEQ ID NO: 7144 - protein, 352 aa, Sorghum bicolor
  misc_feature: Ceres ANNOT ID no. 6074613
  misc_feature (192)..(241): Pfam Id: HLH Pfam Desc: Helix-loop-helix DNA-binding domain
  misc_feature (142)..(327): NCBI GI: 30680903 NCBI Desc: basic helix-loop-helix (bhlh) family protein [arabidopsis thaliana]
  misc_feature (139)..(287): NCBI GI: 30689224 NCBI Desc: phytochrome-interacting factor 4 (pif4) / basic helix-loop-helix protein 9 (bhlh9) / short under red-light 2 (srl2) [arabidopsis thaliana]
  misc_feature (149)..(319): NCBI GI: 115454269 NCBI Desc: os03g0639300 [oryza sativa (japonica cultivar-group)]
  misc_feature (139)..(317): NCBI GI: 145348053 NCBI Desc: transcription factor [arabidopsis thaliana]
  misc_feature (186)..(345): NCBI GI: 115436034 NCBI Desc: os01g0286100 [oryza sativa (japonica cultivar-group)]
  misc_feature: The sequence is a functional homolog of SEQ ID NO. 414 in the 11/188,298 US application
  misc_feature: The sequence is a functional homolog of SEQ ID NO. 483 in the 11/188,298 US application
MNKNDPDAAAAAGGGGPWCCDNQGGNAGEAAAAATVPTTGESGSFFADVVADYSTDELFELVWEQEGKDGGGASSGSMHPAVSRLRSPKFTKPPDVPFDDPPLEDEMAAWLAGTVVKGDEVLAFNDDDGGSRRPTSDDGRDVVPAEKGTSSTTAMGKKEKVVPTTTMEGMMMANKEMRKVPAAVGSSRRSHHGEGHNLTEKRRRHKINERLKTLQKLVPGCSKSNQASTLDQTIHYMKSLQQQVQAMSVGLAAPAVYPVVQPQCVPPGTPVAMPFPAAHPMVLGGHPPSTTMVPFGATMVQLPHYPAAAVMMPLYPAAAPTSTVATPGDAMSASHLHGSSSRSSSKEKRKRQ

SEQ ID NO: 7145 - DNA, 1263 bp, Sorghum bicolor
  misc_feature: Ceres ANNOT ID no. 6074652
  misc_feature: Encodes the peptide sequence at SEQ ID NO 7146
atggcaccggcctccaaaccctcggattcgtatgtcgtgctccaggccgccctcgatggcaacctcaggctcctcaagatgatggcgaggaaggtgaacctgcgggaagccaagggcgacaagggccggaacgcgctgcacgccgctgcggccggggaccacctcgatgtctgcaggttcctggtggaggaactgggcctcaacgtcaactacaccaccgaggaaggaatgtcgccggtgcacttcgccgccaccgctgggagcatgtgcgtcttgaagtaccttctggagtgcggtgttgaccctgcaatgcctgactcctccagaggctgcacgccgctgcattgtgcggcagaggaaggccgctgtgaggctgtgaggcttctgctgtccaaaggcattgatgtggatccagtcaattaccgtgggacacccctgcacttggctgtctctaaagaccaggatcaggttgtcaagatcctgctggagcatggtgctgatcccaacaaagttgtcaatcatgtcttctcaccactcatggtggcatgttgtgcgcattccttgaagtgcatgaagctactggttgagggcggtgctgatgtcaacttgataactccctatggacaaactatcttaacagaggcagttgacgatggcttaactgagattgtcaagttcttgctagaggctggagctgatcctaacattgccgatgaggatgggaaaataccaatcatgtgcgcagcaggtcatgcgcaacgtgagctaattgaaatgctgtttcctaagacaagaccaattccatctgtgccagattggagtattgatgggataataagaagtatagactctctgtgtttcaagactagggatgaagccctgctggaagaacagatagctgatgtcaagttacaaggaaaggaggcttttgcaaaaggagagtaccttacagcaatttacttctattgccaggcaatgaacagagatccatttgatgccacattgtttgccaaccggagcatatgctggttgcggcagagagaaggggaccgagctctgttagatgctcaacagtgcacaatgatgcgtcctgattggtcgaagggatggtaccgtgagggtgcagctctcgcctttctgaaggactacaaaagagcggtggttgcattcgagcgagcactgaaacttgaccctgcgagtgacgagatcaagaaagcgttaaggcaaatcctcttgttatcttctgttaaaaccttcggttaa

SEQ ID NO: 7146 - protein, 420 aa, Sorghum bicolor
  misc_feature: Ceres ANNOT ID no. 6074652
  misc_feature (41)..(74): Pfam Id: Ank Pfam Desc: Ankyrin repeat
  misc_feature (75)..(107): Pfam Id: Ank Pfam Desc: Ankyrin repeat
  misc_feature (109)..(141): Pfam Id: Ank Pfam Desc: Ankyrin repeat
  misc_feature (144)..(173): Pfam Id: Ank Pfam Desc: Ankyrin repeat
  misc_feature (174)..(206): Pfam Id: Ank Pfam Desc: Ankyrin repeat
  misc_feature (207)..(239): Pfam Id: Ank Pfam Desc: Ankyrin repeat
  misc_feature (367)..(400): Pfam Id: TPR_2 Pfam Desc: Tetratricopeptide repeat
  misc_feature (367)..(400): Pfam Id: TPR_1 Pfam Desc: Tetratricopeptide repeat
  misc_feature (4)..(411): NCBI GI: 77556983 NCBI Desc: ankyrin-like protein-like protein [oryza sativa (japonica cultivar-group)]
  misc_feature (6)..(408): NCBI GI: 47496993 NCBI Desc: ankyrin repeat protein-like [oryza sativa (japonica cultivar-group)]
  misc_feature (45)..(411): NCBI GI: 77556984 NCBI Desc: ankyrin-like protein-like protein [oryza sativa (japonica cultivar-group)]
  misc_feature (12)..(411): NCBI GI: 47497788 NCBI Desc: ankyrin repeat protein e4_8-like [oryza sativa (japonica cultivar-group)]
  misc_feature (16)..(411): NCBI GI: 27542766 NCBI Desc: ankyrin-like protein-like protein [sorghum bicolor]
  misc_feature: The sequence is a functional homolog of SEQ ID NO 1843 in the 10/374,780US patent application
  misc_feature: The sequence is a functional homolog of SEQ ID NO 1844 in the 10/374,780US patent application
  misc_feature: The sequence is a functional homolog of SEQ ID NO 1845 in the 10/374,780US patent application
  misc_feature: Useful for making plants with modulated growth and phenotype characteristics
  misc_feature: The sequence is a functional homolog of SEQ ID NO 1843 in the 20060162006 US patent application
  misc_feature: The sequence is a functional homolog of SEQ ID NO 1844 in the 20060162006 US patent application
  misc_feature: The sequence is a functional homolog of SEQ ID NO 1845 in the 20060162006 US patent application
MAPASKPSDSYVVLQAALDGNLRLLKMMARKVNLREAKGDKGRNALHAAAAGDHLDVCRFLVEELGLNVNYTTEEGMSPVHFAATAGSMCVLKYLLECGVDPAMPDSSRGCTPLHCAAEEGRCEAVRLLLSKGIDVDPVNYRGTPLHLAVSKDQDQVVKILLEHGADPNKVVNHVFSPLMVACCAHSLKCMKLLVEGGADVNLITPYGQTILTEAVDDGLTEIVKFLLEAGADPNIADEDGKIPIMCAAGHAQRELIEMLFPKTRPIPSVPDWSIDGIIRSIDSLCFKTRDEALLEEQIADVKLQGKEAFAKGEYLTAIYFYCQAMNRDPFDATLFANRSICWLRQREGDRALLDAQQCTMMRPDWSKGWYREGAALAFLKDYKRAVVAFERALKLDPASDEIKKALRQILLLSSVKTFG

SEQ ID NO: 7147 - DNA, 1299 bp, Sorghum bicolor
  misc_feature: Ceres ANNOT ID no. 6074656
  misc_feature: Encodes the peptide sequence at SEQ ID NO 7148
atggcccttagtctctccgtccttgccatcatcaacgcggccctagacggcaacctcggcgtcctcaagcaaatggcgagtcagacggacctgcgggaagccaaggacaacgtggggcggaacgcgttgcacttcgccgcgatgaagggccacctcgaggtctgtagcttcttggtggaggaattgggcatcgatgtcaactgcaccaacacagatggcgtgacgccggtaaaatacgccgcggccacgggagaggtgggcgtcctaaggtaccttctcgaccacggcggcgacccagaaatgcccgacgctagggacaccacgccgctgcactttgcggctgagcaggggcactgcgaagctctaaggctgctgttgtccaagggtgttgatgtggatgccctccactgccgtcgtttatcgccactgctgttcgctgtagggaaaggccatgatcaggctgtgaatgtcctgctagagcatggcgctgatcccaatatagttgctcataataggttttcaccactcataatggcatgcattggaggctccttgaaatgcatgaggctattagttgaggctggtgctgatgtgaatctaaaaaatcactatggaacaactgctttaataattgcagttcaaggtggctttgctgacattgtcaggttcttgctagaggctggagctgaccctaacatttctgatgcgaatgggaaaattgcaatcatgtatgcagcaaataagagactacgtgaccttgttcaaattctttttcctcacacaaaaccaattacatctctgcccaattggagtattgatgggataattgatactatgacatctacgtccttcaagtctatggataaagagcatatcatagctggtgcaaaaccacgaggaaatgaagcatttgcgaaaggggactacctcgcagcaaccctctgctatgatatggcattgctcgaagatccacttgatgctaccttgttttccaacagaagcttgtgctggttgcggctgggagatggaaagcttgctctgttagatgctcaacaatgcaaagccatgcgccctcggtggccgaaggcatggtaccgtgagggtgcagctctcagcttgctgaaggactacaaaggggcagttaatgctttcctggatgcactgatgcttgatcctgcaaatgatgagataaagacagcgttaaggcaatgctcttgttttgattgtttctatctaatgctactttttagttatctccctaaaactgataatattattcgttggagtatgaatgtatag

SEQ ID NO: 7148 - protein, 432 aa, Sorghum bicolor
  misc_feature: Ceres ANNOT ID no. 6074656
  misc_feature (38)..(71): Pfam Id: Ank Pfam Desc: Ankyrin repeat
  misc_feature (72)..(104): Pfam Id: Ank Pfam Desc: Ankyrin repeat
  misc_feature (105)..(137): Pfam Id: Ank Pfam Desc: Ankyrin repeat
  misc_feature (138)..(170): Pfam Id: Ank Pfam Desc: Ankyrin repeat
  misc_feature (171)..(203): Pfam Id: Ank Pfam Desc: Ankyrin repeat
  misc_feature (204)..(236): Pfam Id: Ank Pfam Desc: Ankyrin repeat
  misc_feature (361)..(394): Pfam Id: TPR_2 Pfam Desc: Tetratricopeptide repeat
  misc_feature (361)..(394): Pfam Id: TPR_1 Pfam Desc: Tetratricopeptide repeat
  misc_feature (1)..(403): NCBI GI: 77556983 NCBI Desc: ankyrin-like protein-like protein [oryza sativa (japonica cultivar-group)]
  misc_feature (10)..(402): NCBI GI: 47496993 NCBI Desc: ankyrin repeat protein-like [oryza sativa (japonica cultivar-group)]
  misc_feature (10)..(402): NCBI GI: 47497788 NCBI Desc: ankyrin repeat protein e4_8-like [oryza sativa (japonica cultivar-group)]
  misc_feature (12)..(403): NCBI GI: 27542766 NCBI Desc: ankyrin-like protein-like protein [sorghum bicolor]
  misc_feature (1)..(281): NCBI GI: 6175185 NCBI Desc: ankyrin-like protein [arabidopsis thaliana]
  misc_feature: The sequence is a functional homolog of SEQ ID NO 1843 in the 10/374,780US patent application
  misc_feature: The sequence is a functional homolog of SEQ ID NO 1844 in the 10/374,780US patent application
  misc_feature: Useful for making plants with modulated growth and phenotype characteristics
  misc_feature: The sequence is a functional homolog of SEQ ID NO 1843 in the 20060162006 US patent application
  misc_feature: The sequence is a functional homolog of SEQ ID NO 1844 in the 20060162006 US patent application
MALSLSVLAIINAALDGNLGVLKQMASQTDLREAKDNVGRNALHFAAMKGHLEVCSFLVEELGIDVNCTNTDGVTPVKYAAATGEVGVLRYLLDHGGDPEMPDARDTTPLHFAAEQGHCEALRLLLSKGVDVDALHCRRLSPLLFAVGKGHDQAVNVLLEHGADPNIVAHNRFSPLIMACIGGSLKCMRLLVEAGADVNLKNHYGTTALIIAVQGGFADIVRFLLEAGADPNISDANGKIAIMYAANKRLRDLVQILFPHTKPITSLPNWSIDGIIDTMTSTSFKSMDKEHIIAGAKPRGNEAFAKGDYLAATLCYDMALLEDPLDATLFSNRSLCWLRLGDGKLALLDAQQCKAMRPRWPKAWYREGAALSLLKDYKGAVNAFLDALMLDPANDEIKTALRQCSCFDCFYLMLLFSYLPKTDNIIRWSMNV

SEQ ID NO: 7149 - DNA, 1254 bp, Sorghum bicolor
  misc_feature: Ceres ANNOT ID no. 6074657
  misc_feature: Encodes the peptide sequence at SEQ ID NO 7150
atggccgcgctctccgccgtcgcgctccaggccgcgctctccggcagcctccgcctcctcaagctggttgcgagcaagatgaaccttcgtgaagctaaggacgacgacgggtggaacgcgctccacctggccgcggagatgggccatctgcatgtctgcaggtttctggtggaggaatcgggcttcgatgtcaactccacctgcgctgaaggtaggacgccgatccactgcgctgcggctgggggcagcgagagcgtcttgaggtaccttctggaccgcgggggcgacccagcgatgcctgacttcgtgggctcaacgccactgcatgatgcggcggaggaagggcactgcgcggctgtgaggatgctgctgtccaagggtgttgatgtcgatatacacggttgttgtgggacgccgctgcacttggcctgctccaacgaccgggatcaggttgtcaagatcctgctggaacatggcgcggatcccagcaaggttgtcgggcatgtcctcccaccactcacgatggcatactgtgggggttctttgagatgcatgaagctactgattgaggctggtgcagatgtgaacttgattgctccctctggagtaattttggctcaagcagtttgtgatggcagaactgacattgtcaagttcttgctagaggctggagctgatcctaacattcctgatgaggatgggagaatcccgatcatgtacccagcagttaatgggaatcgggagcttgttgaaattctgtttcctaagacaagaccagttccatctttgccagactggagcgttgatgggattattagaagtatagaatatccttttttcaagcctcaggatgcagctgtggtggaaaaaaagatagctgatgccaagtcacaaggaaaggaagctttcgcaaagggagagtaccttgcggcagaatacttctataccatggtactagagaacgaccttgatgctaccgcgtttgccaaccggagcctatgctggttgcggatgagggatggggccaaagctctgttagatgcccgacagtgcaaaatgatacgacctcgttggtcgaaggcatggtatcgtgagggcgcagctctcagcttgctgaaggactacaaaggggcagccaattcattcatggaagcattgaaacttgaccctgcaagtgatgagatcaagagagccttaagggaggccaccgatgctctggcgaacgttggctgctctggagaacagaacccatga

SEQ ID NO: 7150 - protein, 417 aa, Sorghum bicolor
  misc_feature: Ceres ANNOT ID no. 6074657
  misc_feature (36)..(69): Pfam Id: Ank Pfam Desc: Ankyrin repeat
  misc_feature (70)..(102): Pfam Id: Ank Pfam Desc: Ankyrin repeat
  misc_feature (103)..(135): Pfam Id: Ank Pfam Desc: Ankyrin repeat
  misc_feature (359)..(392): Pfam Id: TPR_2 Pfam Desc: Tetratricopeptide repeat
  misc_feature (359)..(392): Pfam Id: TPR_1 Pfam Desc: Tetratricopeptide repeat
  misc_feature (5)..(417): NCBI GI: 77556983 NCBI Desc: ankyrin-like protein-like protein [oryza sativa (japonica cultivar-group)]
  misc_feature (9)..(406): NCBI GI: 47496993 NCBI Desc: ankyrin repeat protein-like [oryza sativa (japonica cultivar-group)]
  misc_feature (9)..(411): NCBI GI: 47497788 NCBI Desc: ankyrin repeat protein e4_8-like [oryza sativa (japonica cultivar-group)]
  misc_feature (44)..(406): NCBI GI: 77556984 NCBI Desc: ankyrin-like protein-like protein [oryza sativa (japonica cultivar-group)]
  misc_feature (11)..(406): NCBI GI: 27542766 NCBI Desc: ankyrin-like protein-like protein [sorghum bicolor]
  misc_feature: The sequence is a functional homolog of SEQ ID NO 1843 in the 10/374,780US patent application
  misc_feature: The sequence is a functional homolog of SEQ ID NO 1844 in the 10/374,780US patent application
  misc_feature: Useful for making plants with modulated growth and phenotype characteristics
  misc_feature: The sequence is a functional homolog of SEQ ID NO 1843 in the 20060162006 US patent application
  misc_feature: The sequence is a functional homolog of SEQ ID NO 1844 in the 20060162006 US patent application
MAALSAVALQAALSGSLRLLKLVASKMNLREAKDDDGWNALHLAAEMGHLHVCRFLVEESGFDVNSTCAEGRTPIHCAAAGGSESVLRYLLDRGGDPAMPDFVGSTPLHDAAEEGHCAAVRMLLSKGVDVDIHGCCGTPLHLACSNDRDQVVKILLEHGADPSKVVGHVLPPLTMAYCGGSLRCMKLLIEAGADVNLIAPSGVILAQAVCDGRTDIVKFLLEAGADPNIPDEDGRIPIMYPAVNGNRELVEILFPKTRPVPSLPDWSVDGIIRSIEYPFFKPQDAAVVEKKIADAKSQGKEAFAKGEYLAAEYFYTMVLENDLDATAFANRSLCWLRMRDGAKALLDARQCKMIRPRWSKAWYREGAALSLLKDYKGAANSFMEALKLDPASDEIKRALREATDALANVGCSGEQNP

SEQ ID NO: 7151 - DNA, 1305 bp, Sorghum bicolor
  misc_feature: Ceres ANNOT ID no. 6074659
  misc_feature: Encodes the peptide sequence at SEQ ID NO 7152
atgccccccagccccctcgaggtcgccgtccgggccgccgtcgctggcgacctccggctcatcaaggaaatggcgaccactatggacctgcggcgaggcatggggagaaacggccgcaacatgctccacttctcggcgaccgcgggggtgctggacttctgcaggttcctcgtcgaggaggcgggcttccatcccaactccgtctcggcggaaggcgagacgcccatcttcaccgccaccgaggccgacggcggtggcgccgcaatcgtctctgtcgtgcggtacctcatcgagcgtggtggcgacccggcgaagcccgacgccaaggggtgcacgccgctgcacaaagccgcggagtttgggcacgtcgaggttgtgaggctgctgctgtccaagggtgttcccgtggatcctatcgaacgtcgcggcacgccgctgcacttggccgcggtgactgacaatcaccagtctctcaagctcctgctggatcatggcgctgatcccaatagagttgtcactcgtatattttctccgctccttatggcatgcattggtcactccttcaaatgcttgaagctattagtcgaggctggtgctgatgtgaattttgtaagtccaactgggcgaactgtgttgttcaatgtagttgaagatggcttaatcgactttgtcaagttcctgttggaggctggagctgaccctaatattcctgatgggaatggcagactcccaatcatgctagcagctactcgtgagaaacgtgagcttgttgagattctacttcctcagacaaagccaattccatttgtgccagactggagtgttgatgggattatcagggctatgaaattgatacagtcgtccgagcctcgggagttggtggaaaaacgattagctgatgccaaggcacaaggaaaggaagcatttgcagatgggcactatgtggctgccgcctactactatatgcgggcaaaagagattgatccaaatgatgccaccgtattctccaacctgagcctatgctggttgcggctgagagaaggggaacaggctttggcatacgctcggcaatgcaaagcgttgcgtcctgattggtccaaggcatggtaccgtgagggcatggctctcagcttcctcgagaactatgaaggagcggtcaatgcgctccatgaagcgctaaaacttgaccctgcaagcaacgagatcaaggaagcattacgtggttaccctaagcaagagtcggcatccattggggcagggacatgtgaaccccaggccttgggtacggctttctgtggtgtgtga

SEQ ID NO: 7152 - protein, 434 aa, Sorghum bicolor
  misc_feature: Ceres ANNOT ID no. 6074659
  misc_feature (109)..(141): Pfam Id: Ank Pfam Desc: Ankyrin repeat
  misc_feature (366)..(399): Pfam Id: TPR_2 Pfam Desc: Tetratricopeptide repeat
  misc_feature (366)..(399): Pfam Id: TPR_1 Pfam Desc: Tetratricopeptide repeat
  misc_feature (1)..(407): NCBI GI: 77556983 NCBI Desc: ankyrin-like protein-like protein [oryza sativa (japonica cultivar-group)]
  misc_feature (7)..(407): NCBI GI: 47496993 NCBI Desc: ankyrin repeat protein-like [oryza sativa (japonica cultivar-group)]
  misc_feature (12)..(421): NCBI GI: 27542766 NCBI Desc: ankyrin-like protein-like protein [sorghum bicolor]
  misc_feature (7)..(407): NCBI GI: 47497788 NCBI Desc: ankyrin repeat protein e4_8-like [oryza sativa (japonica cultivar-group)]
  misc_feature (94)..(407): NCBI GI: 77556984 NCBI Desc: ankyrin-like protein-like protein [oryza sativa (japonica cultivar-group)]
  misc_feature: The sequence is a functional homolog of SEQ ID NO 1843 in the 10/374,780US patent application
  misc_feature: The sequence is a functional homolog of SEQ ID NO 1844 in the 10/374,780US patent application
  misc_feature: Useful for making plants with modulated growth and phenotype characteristics
  misc_feature: The sequence is a functional homolog of SEQ ID NO 1843 in the 20060162006 US patent application
  misc_feature: The sequence is a functional homolog of SEQ ID NO 1844 in the 20060162006 US patent application
MPPSPLEVAVRAAVAGDLRLIKEMATTMDLRRGMGRNGRNMLHFSATAGVLDFCRFLVEEAGFHPNSVSAEGETPIFTATEADGGGAAIVSVVRYLIERGGDPAKPDAKGCTPLHKAAEFGHVEVVRLLLSKGVPVDPIERRGTPLHLAAVTDNHQSLKLLLDHGADPNRVVTRIFSPLLMACIGHSFKCLKLLVEAGADVNFVSPTGRTVLFNVVEDGLIDFVKFLLEAGADPNIPDGNGRLPIMLAATREKRELVEILLPQTKPIPFVPDWSVDGIIRAMKLIQSSEPRELVEKRLADAKAQGKEAFADGHYVAAAYYYMRAKEIDPNDATVFSNLSLCWLRLREGEQALAYARQCKALRPDWSKAWYREGMALSFLENYEGAVNALHEALKLDPASNEIKEALRGYPKQESASIGAGTCEPQALGTAFCGV

SEQ ID NO: 7153 - DNA, 1470 bp, Sorghum bicolor
  misc_feature: Ceres ANNOT ID no. 6074660
  misc_feature: Encodes the peptide sequence at SEQ ID NO 7154
  misc_feature: Up-regulated in shoot tissues in response to salicylic acid treatment
atgcagaccaccgggcccgcatcgccggataagccgccgccggctgtcgagccggcggaggccgaggacaaggtggagagggagggggcgcaggcgaaggaggaggacgaggcggcggtggtgaaggcgggcggcgaggatgaggaggatgaggaggaggaggaggaggatgggaggggaggcaagcggcagcggcgccgtgcggcgggggacagcgccgtggccatggtgaagcgggacctgctgttgcgctgcttgacgtgcccgctctgcgaccgcctgctccgcaaggccaccaccatctccgagtgcctgcacacattttgtagaaagtgtatttataagaagctcaacgatgaggatcttgaccactgtccagtatgtaacattgatctgggctgcactccagtcgacaagcttagagctgatcacaatatacaagatgtgaggtcaaaagtttttccattcaaaaggaagaaggttaatgctgaagaagccgaatctcccattacgctacctgttaaagttaaagagaggtctatctcatcgttggtggtcaatacacctagagtagccccagcagcttcaacaaggaggcgaacaagagcggttaccaggaaggctgctgcattacgtggccttggtcctatcattgtggatcctttaaaaaaggataatgataactcaaataagcaaaccgataattcaagcttgctagatagcttgagcaaaatacctcaaacaagaagacagttattgtcgaatggggacacatcaggtcatccctctgttaaagataaagcaggtgataataaagacttggataagtccgagctctggaaacctttgaatcgtcttgtagacgctgcaagcaaaacaaaggccctgacaagtgcacaaagtccagctttgaagggagataagcccagagaatctcccagtagtgaacattctagcagaacagaggctagggagtctcttcagaagtccaaagctgaagatgacaaaagtgatgatcctgagccaatagtgctgcttagaaagagagggcggcctgcccggaagaggaaagattccctacctgaaacaaatgcagcttcagctgctacagctatccaggccaggaaggcattgagcccaatatggttttcattgatcgcctcgtttgaccagaaaggcgatcctcctttgcctcagatacctgcccactatttgagaataaaggatgggagcatacctgcatcatccatccaaaggtacatcatgcagaagctcagtcttctaagcgaatctgaggttgaaatacgctgctgtgggcagacagtgaacctcgggcaacctgtgcgcaacttggtggagcggtggcttagggttggcccggcacgcccgctgcacacagtgataggctcctctgggggagattatgtgatggtgataagctatgggcggccaaagtctgtgtcttcttaa

SEQ ID NO: 7154 - protein, 489 aa, Sorghum bicolor
  misc_feature: Ceres ANNOT ID no. 6074660
  misc_feature (88)..(128): Pfam Id: zf-C3HC4 Pfam Desc: Zinc finger, C3HC4 type (RING finger)
  misc_feature (77)..(483): NCBI GI: 42561762 NCBI Desc: zinc finger (c3hc4-type ring finger) family protein [arabidopsis thaliana]
  misc_feature (115)..(485): NCBI GI: 115455251 NCBI Desc: os03g0741700 [oryza sativa (japonica cultivar-group)]
  misc_feature (100)..(252): NCBI GI: 115489434 NCBI Desc: os12g0600200 [oryza sativa (japonica cultivar-group)]
  misc_feature (192)..(483): NCBI GI: 42571369 NCBI Desc: zinc finger (c3hc4-type ring finger) family protein [arabidopsis thaliana]
  misc_feature (11)..(273): NCBI GI: 145358843 NCBI Desc: protein binding / zinc ion binding [arabidopsis thaliana]
  misc_feature: Up-regulated in shoot tissues in response to salicylic acid treatment
MQTTGPASPDKPPPAVEPAEAEDKVEREGAQAKEEDEAAVVKAGGEDEEDEEEEEEDGRGGKRQRRRAAGDSAVAMVKRDLLLRCLTCPLCDRLLRKATTISECLHTFCRKCIYKKLNDEDLDHCPVCNIDLGCTPVDKLRADHNIQDVRSKVFPFKRKKVNAEEAESPITLPVKVKERSISSLVVNTPRVAPAASTRRRTRAVTRKAAALRGLGPIIVDPLKKDNDNSNKQTDNSSLLDSLSKIPQTRRQLLSNGDTSGHPSVKDKAGDNKDLDKSELWKPLNRLVDAASKTKALTSAQSPALKGDKPRESPSSEHSSRTEARESLQKSKAEDDKSDDPEPIVLLRKRGRPARKRKDSLPETNAASAATAIQARKALSPIWFSLIASFDQKGDPPLPQIPAHYLRIKDGSIPASSIQRYIMQKLSLLSESEVEIRCCGQTVNLGQPVRNLVERWLRVGPARPLHTVIGSSGGDYVMVISYGRPKSVSS

SEQ ID NO: 7155 - DNA, 933 bp, Sorghum bicolor
  misc_feature: Ceres ANNOT ID no. 6074661
  misc_feature: Encodes the peptide sequence at SEQ ID NO 7156
atggcgcggccgccgatcctgtccgtcgcgctgccgtccgacaccggccgcgtgctcagcatccagtcccacaccgtacaggggtatgttggcaacaaatcggctgtctttcccctgcaactccttggctttgatgtggatccaataaactctgtacagttttctaatcatacaggatacccaacatttagaggtcaggttctcgatggcaaacagctctgggaccttattgaaggactggaggaaaatcagttgcttcattatacccatttattaacaggttatataggctcagtttcctttctagagactgtgctacaagttgttgacaaattacgatcagtcaatcctgatcttttatatgtttgcgacccagttctaggtgacgaaggaaaactatacgttcctcaggagctaatatctgtttatcaacagaaggttgttccagttgcttcgatgcttacacctaaccaatttgaagttgaactacttactggattgaggatcacctccgaacaagatggcttgacagcttgtaataccctccacagtgccggaccacggaaggtggttataactagtgcacttattgaaggcaagctgctccttatcggaagtcacaaaaaaacagaggaacaaccgccggaacaatttaagattgagataccaaagatacctgcatatttcacgggaactggagatttaatgactgctctcctactaggatggagtaataaatatcctgataacctcgagaaagcggcagaactggcagtttccagtttgcaggcacttctgaaaagaactgtggaagactataagatggccggcttcgacccatcgaccagcagcttggagatccggctgatccaaagccaggacgagatccgaaacccatccattacatgcaaggctgtgaagtatggaagctga

SEQ ID NO: 7156 - protein, 310 aa, Sorghum bicolor
  misc_feature: Ceres ANNOT ID no. 6074661
  misc_feature (1)..(276): Pfam Id: PfkB Pfam Desc: pfkB family carbohydrate kinase
  misc_feature (1)..(308): NCBI GI: 37695546 NCBI Desc: pyridoxal kinase [triticum aestivum]
  misc_feature (1)..(308): NCBI GI: 115489436 NCBI Desc: os12g0600400 [oryza sativa (japonica cultivar-group)]
  misc_feature (1)..(308): NCBI GI: 15277979 NCBI Desc: pyridoxal kinase-like protein sos4 [arabidopsis thaliana]
  misc_feature (1)..(308): NCBI GI: 31711796 NCBI Desc: at5g37850 [arabidopsis thaliana]
  misc_feature (4)..(308): NCBI GI: 68131817 NCBI Desc: pyridoxal kinase [glycine max]
  misc_feature (1)..(308): SWISSPROT Homolog: EC 2.7.1.35 Pyridoxal kinase
  misc_feature: Useful for making plants with modulated salt sensitivity
  misc_feature: Useful for making plants with modulated nitrogen use efficiency
  misc_feature: GREAT-hit functional homolog of the protein sequence given in SEQ ID NO 12886
  misc_feature: Useful for making plants with modulated nitrogen use efficiency
  misc_feature: Useful for making plants with modulated salt sensitivity
  misc_feature: Functional homolog of the protein sequence given in SEQ ID NO 12886
MARPPILSVALPSDTGRVLSIQSHTVQGYVGNKSAVFPLQLLGFDVDPINSVQFSNHTGYPTFRGQVLDGKQLWDLIEGLEENQLLHYTHLLTGYIGSVSFLETVLQVVDKLRSVNPDLLYVCDPVLGDEGKLYVPQELISVYQQKVVPVASMLTPNQFEVELLTGLRITSEQDGLTACNTLHSAGPRKVVITSALIEGKLLLIGSHKKTEEQPPEQFKIEIPKIPAYFTGTGDLMTALLLGWSNKYPDNLEKAAELAVSSLQALLKRTVEDYKMAGFDPSTSSLEIRLIQSQDEIRNPSITCKAVKYGS

SEQ ID NO: 7157 - DNA, 981 bp, Sorghum bicolor
  misc_feature: Ceres ANNOT ID no. 6074685
  misc_feature: Encodes the peptide sequence at SEQ ID NO 7158
atgcatccattggagctcttcctggtggtcttggttaccaccggtgccgcctctgcggtgtacagccatcctgccgccgctggtactccagcggcacggttttgggaggaggccctccctggcacacccatgccggaggccatcgccgacctcatccaacaaggcattgaccattcccctctcgtggagcatttcacttctagcggccacacccctgtcatgaacataaactacggctacggggcctacgccggcagctctctaatgaacgcagcagtgcccccaggctccttcttcctccagtctcagctgcgcgtgggaaccgccatgaccgtctcctccgagtcggcagctaccgtgccacccatcctcccacgcgacgtcgcccagaaggtcccattcagcaacctagcggacgtgctcgccgcgttccacatctcgccaagctccgccgaggcgacgacggtgagcgacaccctgagcctgtgcggagccccgccgtcactcgccggtgagcagaaggcctgcaccacgtcgctggaggacaccgtggagagcgccacgcacatgctcgtcgtcggcagcagcgttcgtcatggggtggtgtatttgtgggcggcctcgtcggcggcggcggtgccgccggcggcacaccaccaccagcagcagtacgttgtccaggcggtcacctcgctcgacggcgatcgccacgtcggctgccacgccatgccgttcccgtacgccgtctactactgtcacatgacggggcggccgtccaaggcgtacgcggtcttgctccgcagcgtcaccggcggcagcagtgcgccggtcaccaaggcggcgatctgccacctcgacacctccaactgggacccggcgcacccggccttcgagatgctgcacacacggccgggcggcgagccggtttgccacttcatgtcctatgccagtttgctctttggtgagaaggcagccaattaa

SEQ ID NO: 7158 - protein, 326 aa, Sorghum bicolor
  misc_feature: Ceres ANNOT ID no. 6074685
  misc_feature (96)..(323): Pfam Id: BURP Pfam Desc: BURP domain
  misc_feature (98)..(322): NCBI GI: 38567627 NCBI Desc: raftin1a protein [triticum aestivum]
  misc_feature (79)..(322): NCBI GI: 38567631 NCBI Desc: raftin1b protein [triticum aestivum]
  misc_feature (16)..(313): NCBI GI: 115457360 NCBI Desc: os04g0225700 [oryza sativa (japonica cultivar-group)]
  misc_feature (94)..(323): NCBI GI: 53748411 NCBI Desc: burp-domain containing protein [plantago major]
  misc_feature (98)..(313): NCBI GI: 92875447 NCBI Desc: burp [medicago truncatula]
MHPLELFLVVLVTTGAASAVYSHPAAAGTPAARFWEEALPGTPMPEAIADLIQQGIDHSPLVEHFTSSGHTPVMNINYGYGAYAGSSLMNAAVPPGSFFLQSQLRVGTAMTVSSESAATVPPILPRDVAQKVPFSNLADVLAAFHISPSSAEATTVSDTLSLCGAPPSLAGEQKACTTSLEDTVESATHMLVVGSSVRHGVVYLWAASSAAAVPPAAHHHQQQYVVQAVTSLDGDRHVGCHAMPFPYAVYYCHMTGRPSKAYAVLLRSVTGGSSAPVTKAAICHLDTSNWDPAHPAFEMLHTRPGGEPVCHFMSYASLLFGEKAAN

SEQ ID NO: 7159 - DNA, 531 bp, Sorghum bicolor
  misc_feature: Ceres ANNOT ID no. 6074721
  misc_feature: Encodes the peptide sequence at SEQ ID NO 7160
atggatctgctgaacgctgagcagatctcggagttccgcgaggcgttcgcgttcttcgacaaggacggcgacgggtgcatcacggtggaggagctggcgacggtgatggggtcgctgcaggggcaccgccccagcgaggacgagctgggcgagatgatccgcgacgccgacgccgacggcaacggcaccatcgacttccccgagttcctggccctcatggcgcgcaagaccgccgcgtcgtccgcggcgtccggcgccgggggaggcgatggggactacgaccccgacgaggagctccgcgaggcgttcaaggtgttcgacaaggaccagaacgggtacatctccgccaccgagctccgccacgtcatgatcaacctcggcgagaagctcaccgacgaggaggtcgagcagatgatccgcgaggctgaccttgacggcgacggccaggtcaactacgatgagttcgtcaggatgatgatgctttccgatggcgccggccacgccggtgccggagccggtcaccaccaatga

SEQ ID NO: 7160 - protein, 176 aa, Sorghum bicolor
  misc_feature: Ceres ANNOT ID no. 6074721
  misc_feature (11)..(39): Pfam Id: efhand Pfam Desc: EF hand
  misc_feature (48)..(76): Pfam Id: efhand Pfam Desc: EF hand
  misc_feature (98)..(126): Pfam Id: efhand Pfam Desc: EF hand
  misc_feature (134)..(162): Pfam Id: efhand Pfam Desc: EF hand
  misc_feature (2)..(160): NCBI GI: 170076 NCBI Desc: calmodulin
  misc_feature (2)..(160): NCBI GI: 50299513 NCBI Desc: caomodulin cam-207 [daucus carota]
  misc_feature (4)..(160): NCBI GI: 21105716 NCBI Desc: calmodulin 1 [ceratopteris richardii]
  misc_feature (2)..(160): NCBI GI: 1402947 NCBI Desc: calmodulin-2 [capsicum annuum]
  misc_feature (2)..(160): NCBI GI: 14625425 NCBI Desc: calmodulin ntcam13 [nicotiana tabacum]
MDLLNAEQISEFREAFAFFDKDGDGCITVEELATVMGSLQGHRPSEDELGEMIRDADADGNGTIDFPEFLALMARKTAASSAASGAGGGDGDYDPDEELREAFKVFDKDQNGYISATELRHVMINLGEKLTDEEVEQMIREADLDGDGQVNYDEFVRMMMLSDGAGHAGAGAGHHQ

SEQ ID NO: 7161 - DNA, 1452 bp, Sorghum bicolor
  misc_feature: Ceres ANNOT ID no. 6074731
  misc_feature: Encodes the peptide sequence at SEQ ID NO 7162
atgaccgacgcgggcgccgccaggacacggagggcgggcagcggcggcggtggcggcggggacctcccgctgcggccgccggagccgccgcgggacccgctggagttcctgtcccgctcctggagcgcgtcggcggccgacgtctcccgcgcgctcggcggcgcgcccgcgccggcagtggcagtggccgccgccatctccgaggacgtcgccgcggagctcgacgccgactccgccgccggaccggcctccgggacctccttctccttcgcgtccgcggccacctcgcagctcgtcttggaccggatcatgacgccatcggaagtgtcgccgctgacctccggccggctctcacacagcagcgggcctctcaacggcggcgggtcgctctccgacagcccacccgtgtcgccggagatcgacgacaccaagttctgcagggcggtgagcacgccgaagccgcagccgtacgcccgcggcgggagcaagacggtggggcggtggctcaaggaccgcaaggagaagaggaaggaggagacgcgggcgcacaacgcgcaggtgcacgccgccgtgtccgtggccgccgtggccgcggccgtcgccgccgtggctgctgccaccgccgcggcttcctcctcgtcgtcgggcaaggacaacggccgcggcgcgcgcacggacatggcggtggcgtcggccgcgacgctggtggccgcgcagtgcgtggaagccgcggaggctctcgggccccaaccgcagcactggacggccgccgtcgggtccccggttaacgtccgcacccccggggacgtcgtccacattatggcgttgcgaggggcggcgacgctcagggcgagggcgctgaaggaggtgtggaacgtggcggcggtgatccccgtggagaagggcgcggtgggcggaggaggcggaggtgggcagcatcaccagcacggcggccacaagcacgacgggcagccgaagcatcaccatcatcatcagcagcagagggaggtggagagcagcaacagcagcagcagctgcttcagcgacgagctgttgctgggcgaggagaacaacttcctgggcatctgcacgcaggacctgctggcgcgcggcaccgagctcctcaagcgcacccgcaaaggatcgctgcattggaaggtcgtctctgtgtacatcaaccgggcgggcctggtgatgctgaagatgaagagcaaacatgtgggtggcaccatcacgaagaagaagaagagcgaggtggtggacgtgtgccgggacgtggcggcgtggccggggcggcacctgctggagggcggcgagcagcggcgctacttcgggctgcggacggcggagcagcgggtgatcgagttcgagtgcggcagccagcgggagtacgagttgtggaccaagggcgtcgcgcgcctcctcgccatcgtcgacggacggaagcgctga

SEQ ID NO: 7162 - protein, 483 aa, Sorghum bicolor
  misc_feature: Ceres ANNOT ID no. 6074731
  misc_feature (372)..(482): Pfam Id: PH_2 Pfam Desc: Plant pleckstrin homology-like region
  misc_feature (144)..(483): NCBI GI: 115489460 NCBI Desc: os12g0604200 [oryza sativa (japonica cultivar-group)]
  misc_feature (154)..(285): NCBI GI: 116310721 NCBI Desc: osigba0092e01.13 [oryza sativa (indica cultivar-group)]
  misc_feature (154)..(319): NCBI GI: 38345392 NCBI Desc: osjnba0067k08.21 [oryza sativa (japonica cultivar-group)]
  misc_feature (163)..(281): NCBI GI: 79494795 NCBI Desc: ice binding [arabidopsis thaliana]
  misc_feature (173)..(286): NCBI GI: 115483542 NCBI Desc: os10g0568300 [oryza sativa (japonica cultivar-group)]
  misc_feature: The sequence is a functional homolog of SEQ ID NO 22 in the 10/225,066US patent application
  misc_feature: The sequence is a functional homolog of SEQ ID NO 224 in the 10/225,066US patent application
  misc_feature: The sequence is a functional homolog of SEQ ID NO 2372 in the 10/374,780US patent application
  misc_feature: The sequence is a functional homolog of SEQ ID NO 2870 in the 10/374,780US patent application
  misc_feature: The sequence is a functional homolog of SEQ ID NO 886 in the 11/435,388US patent application
  misc_feature: The sequence is a functional homolog of SEQ ID NO 929 in the 11/479,226US patent application
  misc_feature: Useful for making plants with modulated growth and phenotype characteristics
  misc_feature: The sequence is a functional homolog of SEQ ID NO 22 in the 20050160493 US patent application
  misc_feature: The sequence is a functional homolog of SEQ ID NO 224 in the 20050160493 US patent application
MTDAGAARTRRAGSGGGGGGDLPLRPPEPPRDPLEFLSRSWSASAADVSRALGGAPAPAVAVAAAISEDVAAELDADSAAGPASGTSFSFASAATSQLVLDRIMTPSEVSPLTSGRLSHSSGPLNGGGSLSDSPPVSPEIDDTKFCRAVSTPKPQPYARGGSKTVGRWLKDRKEKRKEETRAHNAQVHAAVSVAAVAAAVAAVAAATAAASSSSSGKDNGRGARTDMAVASAATLVAAQCVEAAEALGPQPQHWTAAVGSPVNVRTPGDVVHIMALRGAATLRARALKEVWNVAAVIPVEKGAVGGGGGGGQHHQHGGHKHDGQPKHHHHHQQQREVESSNSSSSCFSDELLLGEENNFLGICTQDLLARGTELLKRTRKGSLHWKVVSVYINRAGLVMLKMKSKHVGGTITKKKKSEVVDVCRDVAAWPGRHLLEGGEQRRYFGLRTAEQRVIEFECGSQREYELWTKGVARLLAIVDGRKR

SEQ ID NO: 7163 - DNA, 1230 bp, Sorghum bicolor
  misc_feature: Ceres ANNOT ID no. 6074749
  misc_feature: Encodes the peptide sequence at SEQ ID NO 7164
atggacgcggaggtgggggcgccgaatctcccgctgccggaggagccagccggatcggagcccgacgacgcgcgcctctccccgcctcgtcctgctcctgctccgcctccgcccccgccacctcccgcccccgcccccgcgcccgcgccggtccaggccctgacccccgccgccgaggctgccgcgcccaccgcctcggcggccgtctcgccgccggctccagctccagcgccggcgccggcggaggccaacggcacctccgacaggaagaggaggaggaaggcggaggacggggacgggtgcaagacctgcagctgcaagaagtccaggtgcatgaagctttattgtgtatgctttgcttctgggtcacgttgtactgagtcatgtggatgcgaaccttgtgaaaacaagcaaccactgcaagttgctccacggactgcactgattttacctctgaaacctgtccaaacatcagaagctggtcaagacatagtggaacaagtcataaggtcccctatggatcttattagaagaaaatgcacctgcaagaagtcaggctgccttaagaagtactgtgactgctaccagggaggggcaggatgctccatcaactgtaaatgcgatgattgtagaaacccatttgggagaaaagttggtgttattttggatggtaaaagcagtgttgctgcacctatactgcaagaaagaaatgggactgaagttgactcaagcgacgacgaagatgacttctacatgaaccgacaactctccccaatacctccgtctccagtgtccagggagtcttcattccaacaggagactctagtcggcgtggaagtccagaccatgaatgggcacctgtaccctaaaccactggctcaggtgcgtcccgagccaccctcctggcagctctccaggaggccagttgaggaaccgcgtggagaaatatggcgcttctccaggaggcccagcgaggatgggacctctgatgctatggaagcgcatgccattgccccgagagagagcaagaagccagagatccatggggacaacaggttcagcatcccgcggtgcatcgaggtgatgagcgccatggcggagctgtcgccggtcgagaagtcgctggcgcccgacgtcttcttggacgcgagcaaccgggagattttcctctcgctgagtgtagatattaggccaatgtggctgaggcgtaagatgaagagccttgtctag

SEQ ID NO: 7164 - protein, 409 aa, Sorghum bicolor
  misc_feature: Ceres ANNOT ID no. 6074749
  misc_feature (99)..(140): Pfam Id: CXC Pfam Desc: Tesmin/TSO1-like CXC domain
  misc_feature (175)..(216): Pfam Id: CXC Pfam Desc: Tesmin/TSO1-like CXC domain
  misc_feature (79)..(223): NCBI GI: 7767427 NCBI Desc: cxc domain containing tso1-like protein 1 [arabidopsis thaliana]
  misc_feature (50)..(261): NCBI GI: 9279696 NCBI Desc: dna binding protein-like [arabidopsis thaliana]
  misc_feature (89)..(273): NCBI GI: 51949820 NCBI Desc: cysteine-rich polycomb-like protein 1 [lotus corniculatus var. japonicus]
  misc_feature (89)..(273): NCBI GI: 40241253 NCBI Desc: cysteine-rich polycomb-like protein [lotus corniculatus var. japonicus]
  misc_feature (115)..(265): NCBI GI: 92886891 NCBI Desc: calcium-binding ef-hand; tesmin/tso1-like, cxc [medicago truncatula]
MDAEVGAPNLPLPEEPAGSEPDDARLSPPRPAPAPPPPPPPPAPAPAPAPVQALTPAAEAAAPTASAAVSPPAPAPAPAPAEANGTSDRKRRRKAEDGDGCKTCSCKKSRCMKLYCVCFASGSRCTESCGCEPCENKQPLQVAPRTALILPLKPVQTSEAGQDIVEQVIRSPMDLIRRKCTCKKSGCLKKYCDCYQGGAGCSINCKCDDCRNPFGRKVGVILDGKSSVAAPILQERNGTEVDSSDDEDDFYMNRQLSPIPPSPVSRESSFQQETLVGVEVQTMNGHLYPKPLAQVRPEPPSWQLSRRPVEEPRGEIWRFSRRPSEDGTSDAMEAHAIAPRESKKPEIHGDNRFSIPRCIEVMSAMAELSPVEKSLAPDVFLDASNREIFLSLSVDIRPMWLRRKMKSLV

SEQ ID NO: 7165 - DNA, 2304 bp, Sorghum bicolor
  misc_feature: Ceres ANNOT ID no. 6074750
  misc_feature: Encodes the peptide sequence at SEQ ID NO 7166
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
atggacacgccggataggccccgcgccgccgccgccgccgggttcgaggattctcctgtcttcaatttcatcaacaatctctcgcctataccaccgcctaaacctttagacacagcacataatgtgcagctattcaagtcatcagatttggcgcctgtttcttcgatctttgcctcaccacatgttaatccagcaaaggaaactaaagttttgatcagggatgaatctgttcagcttcctcaagaattgcactcacctagcagtgtcaggactcgaatatgtccctcaggctcttttagaatgatcagatgcaaagacattgtgtcagagagttgcaatatcacttgtcaactaaacgaggcatctattgattcttcagatcatacatcaaactctacaggccaattgagtcaatccatacaggatgctgctggcagtatggaaagcaataaggatcagtgcggtgacggtaaaacagaccttaccatgtcccaggagtgcacaggactagaaggtatgaaccttgatgagagtggcctagacaaaatggattcatcacattctgggatagttgttcatgaaaaccagctatctgaacaaaacaatgatgaacctgcagcatataatggggattacatgattacacaccaatcaagtagtgatatgctgactttagctgtaacatctggcacagaaacacaaccagtggatgatacacaaaagtctgatgatccctactcttgtgaatcctttttggatgatcagccaagtggatattgcgcccaaaattctgtgcatgaaccccatctgtactggactggggcagttgaaggggctgcagtagcttatactccccaaacactccctggtgctttgcaaagtcagttgatgccatgtaacaagctcaatgagccaaaagatcacatgcctactgagcaaaatgccttgccacagcatttacgtggcatgcgtaggcgcagccttttcaacgaaaaggctggggttagtaataaaggtgtagacaaagcttcagatcatcatcctgtaaattcaactacccccaaatgcaaaactatttctggtgacaactcaaagcctctaagaacccctccatgtgcattgcctggtattggcttgcacttgaatgcccttgctgcaatacctaaagagaaactagagattcagtctactataaatgaattgagtaacttgataggcccttctggatcttctccagcaccttctgagcaaatcattattaatgatgatttcaatcaaacaactgatgttgcaactgccgaagcttctagtcagggtagtcccaagaagaaaaggcagaagtttgataatggtgatggcacttcatgcaagcgttgtagttgtaagaagtcaaaatgcctgaaactttactgtgagtgttttgccgctggagtctattgttctgagccttgttcgtgtatcggctgtctgaacaaccagagtcatacagaaacagttctatctacacgtcaacagattgaatctcgcaatccattagcatttgctcctaaagtaattcatacatctgagtctggtctggaattaggggacttctctaataaaactcctgcttcagctcgtcacaaaagaggatgcaattgcaagaagtcgtcgtgtctaaaaaaatactgtgaatgttttcagggcggtgtgggatgctccataagttgcagatgcgagggctgtaagaatgcttttggaaaacgggagggggctgctgtgctaggcatagaggaacctaagcagggattggaaaaaaagaatgtttgtgtgaaagaagaaaaaagtgaaatcgataaacagcttgtcatctaccaaactgctgacactgctcctgctgagaatgtactgaccacaccttccatggtggagtgcagacccttggcttgtcttccacccccaagctccaagaaaagctccaaaaaaccacgatcttcaacaaaactcactggacatccttctcggctgtgcaacttacaagctcctccaaagactgacattatgctctctccattcgaaaactacccagaaatggtacttggcgatagcacatcagatatcctaaatggaaattcatctcctcaaacttctgttaaagtcgtgtcaccaaacaagaagcgaatctctcccccacgaatgggtactcggctatctccaatctgtacgattggcaggaagctgattctcaagtccatcccttctttcccttcccttggtggcgacgtaaacaatgaggatcccaaggccaaattgccagcgccttga

SEQ ID NO: 7166 - protein, 767 aa, Sorghum bicolor
  misc_feature: Ceres ANNOT ID no. 6074750
  misc_feature (454)..(495): Pfam Id: CXC Pfam Desc: Tesmin/TSO1-like CXC domain
  misc_feature (540)..(581): Pfam Id: CXC Pfam Desc: Tesmin/TSO1-like CXC domain
  misc_feature (470)..(751): NCBI GI: 92886891 NCBI Desc: calcium-binding ef-hand; tesmin/tso1-like, cxc [medicago truncatula]
  misc_feature (181)..(751): NCBI GI: 9279696 NCBI Desc: dna binding protein-like [arabidopsis thaliana]
  misc_feature (359)..(711): NCBI GI: 7767427 NCBI Desc: cxc domain containing tso1-like protein 1 [arabidopsis thaliana]
  misc_feature (381)..(638): NCBI GI: 4218187 NCBI Desc: cysteine-rich polycomb-like protein [glycine max]
  misc_feature (428)..(608): NCBI GI: 51949820 NCBI Desc: cysteine-rich polycomb-like protein 1 [lotus corniculatus var. japonicus]
  misc_feature: Up-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
MDTPDRPRAAAAAGFEDSPVFNFINNLSPIPPPKPLDTAHNVQLFKSSDLAPVSSIFASPHVNPAKETKVLIRDESVQLPQELHSPSSVRTRICPSGSFRMIRCKDIVSESCNITCQLNEASIDSSDHTSNSTGQLSQSIQDAAGSMESNKDQCGDGKTDLTMSQECTGLEGMNLDESGLDKMDSSHSGIVVHENQLSEQNNDEPAAYNGDYMITHQSSSDMLTLAVTSGTETQPVDDTQKSDDPYSCESFLDDQPSGYCAQNSVHEPHLYWTGAVEGAAVAYTPQTLPGALQSQLMPCNKLNEPKDHMPTEQNALPQHLRGMRRRSLFNEKAGVSNKGVDKASDHHPVNSTTPKCKTISGDNSKPLRTPPCALPGIGLHLNALAAIPKEKLEIQSTINELSNLIGPSGSSPAPSEQIIINDDFNQTTDVATAEASSQGSPKKKRQKFDNGDGTSCKRCSCKKSKCLKLYCECFAAGVYCSEPCSCIGCLNNQSHTETVLSTRQQIESRNPLAFAPKVIHTSESGLELGDFSNKTPASARHKRGCNCKKSSCLKKYCECFQGGVGCSISCRCEGCKNAFGKREGAAVLGIEEPKQGLEKKNVCVKEEKSEIDKQLVIYQTADTAPAENVLTTPSMVECRPLACLPPPSSKKSSKKPRSSTKLTGHPSRLCNLQAPPKTDIMLSPFENYPEMVLGDSTSDILNGNSSPQTSVKVVSPNKKRISPPRMGTRLSPICTIGRKLILKSIPSFPSLGGDVNNEDPKAKLPAP

SEQ ID NO: 7167 - DNA, 1149 bp, Sorghum bicolor
  misc_feature: Ceres ANNOT ID no. 6074784
  misc_feature: Encodes the peptide sequence at SEQ ID NO 7168
atggcggcctccctcctctcccgcgccgccgccggggcgctgcgcggcgcggcacggccgaaccacctcctcactcggggtcgggtcgggtgggcggtccgcgcggcggagggcgccggtgggtcccggtgcgggccgtcgccgctggcgggagcggtcgggatcgcggcgcggtgcaacgccacgtcgtcgtcgtcgtcgtcgtccgcggtgtccgaggccgccggcgtccacacgctgccccggacggagcccgtggtgtcggccgagtggctgcacgccaacctcaaggaccccgacgtcaaggtacttgatgcctcttggtacatgcctgcagaacaaaggaatccattacaggagtaccaggtggcccatattcctggtgctttgttctttgatgttgatggaatatctgacagaacatctagtttaccacacatgctgccatctgaaaaggcattttcagctgctgtatctgctcttggaatctacaacaatgatgggatagtagtttatgatggaaaggggctgttcagtgctgctcgtgtttggtggatgttccgtgtatttggacatgataaaatttgggtgttagatggaggtttgccacaatggcgtgcttctggatacgatgttgaatcaagtgcctccagtgatgccatcctaaaggctagtgcggctggtgaagcaattgagaaagtgtacctgggtcaatcggttggtcgaaccacatttgaagcaaagctgcagcctcatcttctttggagtcttgatcaggtgaaagagaacatcaagacccagacacatcaacttatagatgctcgatcaaaacctagatttgatggcgcagttcccgagccacgaaagggcattagaagtgggcatgtgcctgggagcaaatgtgttccgtttcctcaggttcttgacagctcacaaaagctattgcctccagatgagctccgtaaacggtttgagcaagaaggaatatcacttgatcaacctcttgtgacctcttgcggcactggtgtgacagcatgtgtgttagccttgggccttcatcgtcttggcaaaaccgaggtcgcaatttatgacggatcatggactgaatggggcgcccatcctgacactccagttgcaactgctgtttag

SEQ ID NO: 7168 - protein, 382 aa, Sorghum bicolor
  misc_feature: Ceres ANNOT ID no. 6074784
  misc_feature (88)..(208): Pfam Id: Rhodanese Pfam Desc: Rhodanese-like domain
  misc_feature (256)..(373): Pfam Id: Rhodanese Pfam Desc: Rhodanese-like domain
  misc_feature (1)..(381): NCBI GI: 115489500 NCBI Desc: os12g0608600 [oryza sativa (japonica cultivar-group)]
  misc_feature (1)..(380): NCBI GI: 4406372 NCBI Desc: thiosulfate sulfurtransferase [datisca glomerata]
  misc_feature (110)..(381): NCBI GI: 77556476 NCBI Desc: thiosulfate sulfurtransferase [oryza sativa (japonica cultivar-group)]
  misc_feature (67)..(378): NCBI GI: 145327745 NCBI Desc: st1 (mercaptopyruvate sulfurtransferase 1) [arabidopsis thaliana]
  misc_feature (67)..(378): NCBI GI: 6686778 NCBI Desc: 3-mercaptopyruvate sulfurtransferase [arabidopsis thaliana]
MAASLLSRAAAGALRGAARPNHLLTRGRVGWAVRAAEGAGGSRCGPSPLAGAVGIAARCNATSSSSSSSAVSEAAGVHTLPRTEPVVSAEWLHANLKDPDVKVLDASWYMPAEQRNPLQEYQVAHIPGALFFDVDGISDRTSSLPHMLPSEKAFSAAVSALGIYNNDGIVVYDGKGLFSAARVWWMFRVFGHDKIWVLDGGLPQWRASGYDVESSASSDAILKASAAGEAIEKVYLGQSVGRTTFEAKLQPHLLWSLDQVKENIKTQTHQLIDARSKPRFDGAVPEPRKGIRSGHVPGSKCVPFPQVLDSSQKLLPPDELRKRFEQEGISLDQPLVTSCGTGVTACVLALGLHRLGKTEVAIYDGSWTEWGAHPDTPVATAV

SEQ ID NO: 7169 - DNA, 921 bp, Sorghum bicolor
  misc_feature: Ceres ANNOT ID no. 6074785
  misc_feature: Encodes the peptide sequence at SEQ ID NO 7170
atggcggcggctccggcgtccgcaccaactcattcgcccgcgtcctcgtcttcctcagcgtgccgcgcgggaatctgctccggcgggacaacccgccccaatctccactccgccgctgcttcggcccctggatggaggaggcgcagggagccgtacccggcagtctccgtggcggcgggctccgcacagtctgcgccaggagctgtacccgtcgtcgaccccaaggttgacgtgttactagacagtgtgaagtgggatagcaaagggttggctgttgctattgcacagaacgtggatactggagccatacttatgcagggttttgctaacaaagaagcccttgcaaaaactatatcgaccaggaaagctacattctttagccgctcacggtcttccctgtggacaaaaggggagacatccatgaacttcattaatgtccatgacattttccttgattgtgaccgtgattctataatataccttggcaagccagatggacctacctgccatacaggagcagaaacctgttactatacttcagtttatgatgctctacaaagttcaaagcccaatgaaggcaggcaggttgtgacaaccctatactcacttgaagatacaattagtagacggcaggaggagatagttactgaaggaggtggcaagccatcatggaccaaaaaactactgcttgacaaccagctactttgctcgaaaatacgtgaagaagctggcgaactaattcaaacgctgctcgagaacgaggaccaatctcgtgcagcttcggagatggctgatctgctgtaccatgccatggtgctgctcagagtcaaggatgtaaagatggaagaagtccttgaggtcctgaggaagagattttcgcagtctggtattgaggagaaggccagtcgcagtaaatcttag

SEQ ID NO: 7170 - protein, 306 aa, Sorghum bicolor
  misc_feature: Ceres ANNOT ID no. 6074785
  misc_feature (105)..(179): Pfam Id: PRA-CH Pfam Desc: Phosphoribosyl-AMP cyclohydrolase
  misc_feature (200)..(293): Pfam Id: PRA-PH Pfam Desc: Phosphoribosyl-ATP pyrophosphohydrolase
  misc_feature (230)..(292): Pfam Id: MazG Pfam Desc: MazG nucleotide pyrophosphohydrolase domain
  misc_feature (107)..(285): NCBI GI: 50313439 NCBI Desc: phosphoribosyl-atp pyrophosphohydrolase/phosphoribosyl-amp cyclohydrolase [alyssum lesbiacum]
  misc_feature (75)..(294): NCBI GI: 89210594 NCBI Desc: phosphoribosyl-amp cyclohydrolase:phosphoribosyl-atp pyrophosphohydrolase [halothermothrix orenii h 168]
  misc_feature (90)..(177): NCBI GI: 88857352 NCBI Desc: bifunctional: phosphoribosyl-amp cyclohydrolase (n-terminal); phosphoribosyl-atp pyrophosphatase (c-terminal) [pseudoalteromonas tunicata d2]
  misc_feature (76)..(177): NCBI GI: 126647725 NCBI Desc: phosphoribosyl-amp cyclohydrolase/phosphoribosyl-atp pyrophosphohydrolase [algoriphagus sp. pr1]
  misc_feature (89)..(291): NCBI GI: 146300620 NCBI Desc: phosphoribosyl-amp cyclohydrolase [flavobacterium johnsoniae uw101]
  misc_feature: The plant is abnormally small.
  misc_feature: Useful for making plants with modulated biomass
  misc_feature: GREAT-hit functional homolog of the protein sequence given in SEQ ID NO 13030
  misc_feature: Useful for making plants with modulated biomass
  misc_feature: Functional homolog of the protein sequence given in SEQ ID NO 13030
MAAAPASAPTHSPASSSSSACRAGICSGGTTRPNLHSAAASAPGWRRRREPYPAVSVAAGSAQSAPGAVPVVDPKVDVLLDSVKWDSKGLAVAIAQNVDTGAILMQGFANKEALAKTISTRKATFFSRSRSSLWTKGETSMNFINVHDIFLDCDRDSIIYLGKPDGPTCHTGAETCYYTSVYDALQSSKPNEGRQVVTTLYSLEDTISRRQEEIVTEGGGKPSWTKKLLLDNQLLCSKIREEAGELIQTLLENEDQSRAASEMADLLYHAMVLLRVKDVKMEEVLEVLRKRFSQSGIEEKASRSKS

SEQ ID NO: 7171 - DNA, 897 bp, Sorghum bicolor
  misc_feature: Ceres ANNOT ID no. 6074797
  misc_feature: Encodes the peptide sequence at SEQ ID NO 7172
atgatgccctatggcacggcggcgggggcggaggcggcgctggggcgttccatgagctgggcggaggccctgtggttccggtactcggcggcgatgccggagctgtggctcacgtcgcacatcgctctcgtctaccttgtcatgtacgcggtggcgccgctgcccgtcatggttctccagcagctcgcgccggcctacgcactgcggcacaagctgcagcccggggtgccgcagccctcgccggtttctgtctacctaagctacataagcgaaagcaagggtctcaccctgtccgtcttgggccctttcccacttatctactccgctgcattcaagttgtttggggtccggacggggctccctttgccgtccgtatgggagacagcgatgcacctggtggtgtactcgttggtggaggactacctgtcctactggctccaccgcttcctgcacaccaagtggggctacgagaagatccactcggcccaccacgagaagacggcgccgtccgggttcgccgggtcctatgccaccggcaccgacctcaccttgtacaccatcacgctcttctttgggccagcgatcgtgccaagccacgtcaccacacactggctctggttctccatccgcataatggaagccttcgacgcacactgcggttacgacttcccatttagcctcgcaaggttcatcccatttttcggtggcgcagagttccatgactatcatcactatgccggaaagaaaaccaagagcaattttagttctgtgtttagatattgtgattatatatatgggacaaacaaaggctacatgtaccacaagagaagcctagccaagctgaagatgaaggaggtcaaacacaacatgaagggcagcagcgggaaagaggattga

SEQ ID NO: 7172 - protein, 298 aa, Sorghum bicolor
  misc_feature: Ceres ANNOT ID no. 6074797
  misc_feature (132)..(245): Pfam Id: FA_hydroxylase Pfam Desc: Fatty acid hydroxylase
  misc_feature (1)..(298): NCBI GI: 23308291 NCBI Desc: at4g12110/f16j13_180 [arabidopsis thaliana]
  misc_feature (1)..(282): NCBI GI: 92884635 NCBI Desc: sterol desaturase [medicago truncatula]
  misc_feature (1)..(298): NCBI GI: 33337546 NCBI Desc: sterol-4-methyl-oxidase [arabidopsis thaliana]
  misc_feature (1)..(278): NCBI GI: 18416002 NCBI Desc: sterol desaturase family protein [arabidopsis thaliana]
  misc_feature (1)..(276): NCBI GI: 37591406 NCBI Desc: sterol-4-alpha methyl oxidase [arabidopsis thaliana]
  misc_feature: Useful for making plants with modulated cold sensitivity
  misc_feature: Functional homolog of the protein sequence given in SEQ ID NO 13234
MMPYGTAAGAEAALGRSMSWAEALWFRYSAAMPELWLTSHIALVYLVMYAVAPLPVMVLQQLAPAYALRHKLQPGVPQPSPVSVYLSYISESKGLTLSVLGPFPLIYSAAFKLFGVRTGLPLPSVWETAMHLVVYSLVEDYLSYWLHRFLHTKWGYEKIHSAHHEKTAPSGFAGSYATGTDLTLYTITLFFGPAIVPSHVTTHWLWFSIRIMEAFDAHCGYDFPFSLARFIPFFGGAEFHDYHHYAGKKTKSNFSSVFRYCDYIYGTNKGYMYHKRSLAKLKMKEVKHNMKGSSGKED

SEQ ID NO: 7173 - DNA, 2400 bp, Sorghum bicolor
  misc_feature: Ceres ANNOT ID no. 6074808
  misc_feature: Encodes the peptide sequence at SEQ ID NO 7174
atgatcaccggcggccagagctacgtctccgcgccgccggccttctcggccgacgggcgcctcctcctcgtctgctccggccgcgccgtctccgtcttcagcaccgccaccgccatgctggtgtcggagctggaggggcacgagggggacgtcaccgccgtagtggtggtggcgccgccagcgcaggcgaccgcggcggctaagctcgccagctactgctggacggcggggctcgacggggtgctcatctactgggacttcctggccgcggaggtggtgcggaaggtccaggtcgggctccccgtccactccatggtggttcctaacatttgtaggacctcaaaaggagccgaggtgccgaccccctttgcattcatctctgtggaagatacgagtaagccggcaagtgaagcaaaagcgctgcgtgggcagatgaaaatttatgacctgacaaaggggcgtcaagtgggtggtctcctggctgagacacgtaaaccagaaaatatcgttgcaagtagttctggagaattcttgggcattgcaaataaaagaaagctccatatatggagcataccaacaaaagatttcaagcctgataagattaggaagataaagctccggcacaccaaaaacttgaccactctggctttccatccaaccgagagaactgtggcaggtggtgatgtaacagggcggatcttgatttggagatgttttggaaaatcaaagttctctgaaagcagtgtaaaatcgaaagaggatgaaggaagggatggtgttaggggtgatgatgatgcagatacttgcacgacatggcattggcattcaagcagtgtgaagtttctcaaattttcttctgacggagcatacttgttctcaggtggtttggagggagttattgttgtgtggcaactagatactggaaagagaaggtataaaccacgtctggggtctcctcttttgttctttgtagattctccagattcttctatttcctgtgtgtcgtgtacaaataatcaagtctatctcctaaaaatgcctaatatggaggtcatgagatctattgctggaatcaagctgccaattgcttctcggaacttgggtggagctggtagggctgtgtatggatttgattatactaatagacttgttgctataccaacggaagattactgcatacagttctacaatttgtttgacaacactgagatttcagagatgcaagtatgtgaaagaaattttcagcctaatgatgatatcacaatgtacatttccttggtttcattgtcaatcgatggcaatttgatgtgcactgtggatgtcaagcttcctgaagaagaattaggtggccttgttacactgaaattttggaatcatgggtctagagctggacattattctttgtccaccattatttatgagccacacagtgatgctggggtttcttctgttgcttttcgcccaggaaggaatatggctgtgagctcttcttttggtggtaactttaaggtttgggttcagagtttgtcttcacaatcaagtgatgaaaaaaaatgttctggttggagatgccaatcagttggctcatacaagaagaaacctatgacatcagcagtcttctcagccgatggatctgttcttgcagttgcagccgagaatgtcatcacattgtgggatcctgataataacgcgcttgttggtgtcattgcagaaacactatcgccggtgacaaatctttctttcgttgggacatcagtgtttttgatgtctctatgtcagagttcaaaaccccagattgctctatggaatgtttcaaatctttccatgcaatggtcttacagcatttatgcagaagctgcatgctgttcgccagatgggagtgaatttgcagttcttgctcttctgagttgtcctgatggagaaacattaacgcagcaagatggagtaattctactttttgatgcagaaagcccaaaccccattgcctcctggtcggtaaagaaggcatcgggtggcagcatttcttttgtaaaaggtgacgtctctttggatgcaaatgctgatagttcaagagacaaagaggcaatgttgctagtttatgtaaatggttctcatgaatacgccatctttgatccccggaagagtgaggtggttgttagcaagaacacgcacaagaagattcaagctgaggaatctgcaccaattggctacgcttctatttatggagaccttcaaaaactggagtcaaagaaagaggtctcagatgtcccattcatcccttcagacaggccttgggagaccatattcagtggatcgtctcatgttcttccgcctctcacaaaactatgttccgcgttcttgtcatcgttgctggagaatagacctgttggaaacgagtga

SEQ ID NO: 7174 - protein, 799 aa, Sorghum bicolor
  misc_feature: Ceres ANNOT ID no. 6074808
  misc_feature (1)..(794): NCBI GI: 30680505 NCBI Desc: transducin family protein / wd-40 repeat family protein [arabidopsis thaliana]
  misc_feature (4)..(794): NCBI GI: 92882115 NCBI Desc: quinonprotein alcohol dehydrogenase-like [medicago truncatula]
  misc_feature (273)..(794): NCBI GI: 89273386 NCBI Desc: wd repeat domain 75 [xenopus tropicalis]
  misc_feature (268)..(791): NCBI GI: 49899083 NCBI Desc: mgc83781 protein [xenopus laevis]
  misc_feature (241)..(791): NCBI GI: 115528879 NCBI Desc: wd repeat domain 75 [mus musculus]
MITGGQSYVSAPPAFSADGRLLLVCSGRAVSVFSTATAMLVSELEGHEGDVTAVVVVAPPAQATAAAKLASYCWTAGLDGVLIYWDFLAAEVVRKVQVGLPVHSMVVPNICRTSKGAEVPTPFAFISVEDTSKPASEAKALRGQMKIYDLTKGRQVGGLLAETRKPENIVASSSGEFLGIANKRKLHIWSIPTKDFKPDKIRKIKLRHTKNLTTLAFHPTERTVAGGDVTGRILIWRCFGKSKFSESSVKSKEDEGRDGVRGDDDADTCTTWHWHSSSVKFLKFSSDGAYLFSGGLEGVIVVWQLDTGKRRYKPRLGSPLLFFVDSPDSSISCVSCTNNQVYLLKMPNMEVMRSIAGIKLPIASRNLGGAGRAVYGFDYTNRLVAIPTEDYCIQFYNLFDNTEISEMQVCERNFQPNDDITMYISLVSLSIDGNLMCTVDVKLPEEELGGLVTLKFWNHGSRAGHYSLSTIIYEPHSDAGVSSVAFRPGRNMAVSSSFGGNFKVWVQSLSSQSSDEKKCSGWRCQSVGSYKKKPMTSAVFSADGSVLAVAAENVITLWDPDNNALVGVIAETLSPVTNLSFVGTSVFLMSLCQSSKPQIALWNVSNLSMQWSYSIYAEAACCSPDGSEFAVLALLSCPDGETLTQQDGVILLFDAESPNPIASWSVKKASGGSISFVKGDVSLDANADSSRDKEAMLLVYVNGSHEYAIFDPRKSEVVVSKNTHKKIQAEESAPIGYASIYGDLQKLESKKEVSDVPFIPSDRPWETIFSGSSHVLPPLTKLCSAFLSSLLENRPVGNE

SEQ ID NO: 7175 - DNA, 1221 bp, Sorghum bicolor
  misc_feature: Ceres ANNOT ID no. 6074814
  misc_feature: Encodes the peptide sequence at SEQ ID NO 7176
atggcaacggcggcggatctccccgttgatctcgtggagaagatcttgctccgcctcgacgatgcggccgacctcgtccgcgcctccgctgcctgcactgccttccgccgtgtcgtcaccgacggccgtttcctccgccgcttcaggtccctgcaccgcccacccgtcctcggattgctcagccgtcgcaccggcaccagtgcaagcgtggggttccgtttcaacccagccgcgccgccgcgccgctccgcacaggcagctcgcgccgtcgcacgcgcccctgccttctcctcctcctcctccttcctccctgcagacacgaccaagaattgctggcacttccacgacgcccgcgacggccgcgtcctcgccggcggcgccaccaccaccaccacctgcttctcgtccttcccgtacctagtggtctacgatcccttgtaccacaagcatgttcagatacctcccatccccaaagacgacattgtggctcagctcggtgaatgccagttcaagcctttcctcgtaccggccgccgccgccgacgacgacgacgatttgtcgttccgggtgatgtgtaatgtgctgtccaaagacatggaataccactatgtggtcgagaccttcgactactcctcggtcaccggaaaatggcgtggcgtggcgtctcttagcgatgcagactatgaacctctatctaacctcttctactacatggagcaccactatgcccacggctgcttctactgggtggattcttatgggggagcagacatgctcgtgcttgacatgaaagagatgaaattcttcgtcgttaacatcccgcctaaaacaagtggaaaccgaagattgttgtggaggcagcagctgaagaagaagaagaagacaggattggcttgttgcggcaaggccttcagcagtgcatcaaacaatggttgctggcaatggcgacacgatgatgaagttaccttggtcgactcttatgagtgggtgtttggtggtgctgctgatcagggctacgcggtcttacaaggggttccgtcagacgagtacaagacttggttgtactgtgacccggcgatgggtcgaaaaacaaacgcacactgtttcaccgtggagctccagacgttggtggttgagcagctatgcgtgaaggatttctacaatgatcctgctttcctatttgcaagctttccaccgccgtttgcaccaccaagtatatga

SEQ ID NO: 7176 - protein, 406 aa, Sorghum bicolor
  misc_feature: Ceres ANNOT ID no. 6074814
  misc_feature (2)..(50): Pfam Id: F-box Pfam Desc: F-box domain
  misc_feature (7)..(406): NCBI GI: 115481050 NCBI Desc: os10g0135300 [oryza sativa (japonica cultivar-group)]
  misc_feature (1)..(406): NCBI GI: 116308909 NCBI Desc: osigba0107a02.1 [oryza sativa (indica cultivar-group)]
  misc_feature (2)..(196): NCBI GI: 115462089 NCBI Desc: os05g0147700 [oryza sativa (japonica cultivar-group)]
  misc_feature (3)..(274): NCBI GI: 115478659 NCBI Desc: os09g0341500 [oryza sativa (japonica cultivar-group)]
  misc_feature (6)..(154): NCBI GI: 38567955 NCBI Desc: osjnbb0115i21.11 [oryza sativa (japonica cultivar-group)]
MATAADLPVDLVEKILLRLDDAADLVRASAACTAFRRVVTDGRFLRRFRSLHRPPVLGLLSRRTGTSASVGFRFNPAAPPRRSAQAARAVARAPAFSSSSSFLPADTTKNCWHFHDARDGRVLAGGATTTTTCFSSFPYLVVYDPLYHKHVQIPPIPKDDIVAQLGECQFKPFLVPAAAADDDDDLSFRVMCNVLSKDMEYHYVVETFDYSSVTGKWRGVASLSDADYEPLSNLFYYMEHHYAHGCFYWVDSYGGADMLVLDMKEMKFFVVNIPPKTSGNRRLLWRQQLKKKKKTGLACCGKAFSSASNNGCWQWRHDDEVTLVDSYEWVFGGAADQGYAVLQGVPSDEYKTWLYCDPAMGRKTNAHCFTVELQTLVVEQLCVKDFYNDPAFLFASFPPPFAPPSI

SEQ ID NO: 7177 - DNA, 1227 bp, Sorghum bicolor
  misc_feature: Ceres ANNOT ID no. 6074815
  misc_feature: Encodes the peptide sequence at SEQ ID NO 7178
atggcgtccgacctcccgactgatctgctggagcagatcttcctccacctagaggacgccgccgacctcgcccgcgcctcggctgcctgcgcttccttccgccgcgtcatctccaacggccgcttcctgcgccgcttcaggtcccgccaccgcccgccagtcctagggctactcgagaatcgtggcggtggtaagatccgattccgccccatccagtcgccgcgccgctccgcgctggccgccggcgcctgcgcagacgccgcggacttcaccttccgtttcatccctggccccaaccgctgctgctggggcgtcgtccgcgacgctcgtgacggccgcgtcctcctctcccgctacaaacgtctttggcacaccttgcaccggcgtcctcctctcctcattgtctgcgaccccctccaccggcggcatgtcgagattccgccgatccccgacgatctccttgacgcggcggcgacgacctccactgaccatgatggtggtgatcctgatgacctacgacgactcgagttcgagccgttcctcgcaccagcgccatcagcggccgacgaggatcaggtcgtcgatgaattgtcgtcgttccaggtgatatgcaatgctctgtcgggaaccatgttggtgaccttcgccttctcttcagccagcagacaatggcgagccgtggcgtcattcagcaacccaaactatgtgatgaagaatctgtgctcgctctggtttcgacagcctgcaaatggcttctactggacgtgtttttcagaaaattttatgctcgtgcttgacacgcgtgagatgaaattcttcgtcgtcagtgacatcccggagaaaagcaatggacgatctaaaatcgttgtggaggcagctggggaaggcaggcttggtctattgttacttcttgaagataagttagagctgtatagtagagcttggcaaggcaataataatggtggtgtggtcgttgatcaagagtggcggcacgacaaaacagtccgaatgtttgctggtctatggaacctcagtggaacaaccaatggctacgctttcctacgatggcttccacgggaccatgttcagcgctgggaagaagcacattatttcaccgtggacctcaagacattgctagttgagaggctgtgtgtgttggaatttattaatgtccccaaatttctctatgcaagcttcccgccaccgctttcgccgccaactgtatga

SEQ ID NO: 7178 - protein, 408 aa, Sorghum bicolor
  misc_feature: Ceres ANNOT ID no. 6074815
  misc_feature (5)..(408): NCBI GI: 116308909 NCBI Desc: osigba0107a02.1 [oryza sativa (indica cultivar-group)]
  misc_feature (5)..(318): NCBI GI: 115481050 NCBI Desc: os10g0135300 [oryza sativa (japonica cultivar-group)]
  misc_feature (5)..(150): NCBI GI: 115462089 NCBI Desc: os05g0147700 [oryza sativa (japonica cultivar-group)]
  misc_feature (133)..(228): NCBI GI: 115472723 NCBI Desc: os07g0555400 [oryza sativa (japonica cultivar-group)]
  misc_feature (8)..(150): NCBI GI: 38347670 NCBI Desc: osjnba0054d14.5 [oryza sativa (japonica cultivar-group)]
MASDLPTDLLEQIFLHLEDAADLARASAACASFRRVISNGRFLRRFRSRHRPPVLGLLENRGGGKIRFRPIQSPRRSALAAGACADAADFTFRFIPGPNRCCWGVVRDARDGRVLLSRYKRLWHTLHRRPPLLIVCDPLHRRHVEIPPIPDDLLDAAATTSTDHDGGDPDDLRRLEFEPFLAPAPSAADEDQVVDELSSFQVICNALSGTMLVTFAFSSASRQWRAVASFSNPNYVMKNLCSLWFRQPANGFYWTCFSENFMLVLDTREMKFFVVSDIPEKSNGRSKIVVEAAGEGRLGLLLLLEDKLELYSRAWQGNNNGGVVVDQEWRHDKTVRMFAGLWNLSGTTNGYAFLRWLPRDHVQRWEEAHYFTVDLKTLLVERLCVLEFINVPKFLYASFPPPLSPPTV

SEQ ID NO: 7179 - DNA, 1182 bp, Sorghum bicolor
  misc_feature: Ceres ANNOT ID no. 6074823
  misc_feature: Encodes the peptide sequence at SEQ ID NO 7180
atgtcctcgccggcggcgcatcaggtcgccggcgccccggcgtcgcagccgatcttccccgacgagatcctcgaggagatctttctccgcctcgacgccggggaagacctcgtccgcgcctccgccgcctgcacgaccttccgccgcgtcgtctccgcgcgtcgcttccttgaccgcttcaggtgcctccaccccccgcccgtcctcggattcctcgagttcgacgcactgggaacattccaccccgcggagccgccccaccgcgccgcccccgccgcacgcgccctcgcgcaggcctccgacttcaccttctccttcctcggcaggcctcactactggcgggtctgcgatgcccgcgactcccgcgtcctcctccgtcgcgtcagagtcaccaccgtgttagctggcctcgtggtctgcgaccccttgcaccgccggcacgtcgagctacctgccatccccgacaaacttgcggctgctactgggtgccggggcttgcaggaattcgatcccttcctcgatccagacactggcaaggacaaggagaagcaggatttgtcattccgggtgatctgcgccgttcagtgcgaacacatgctcgtgaccttcgacttctcttcagtcaccgggcaatggcgaggcatgacgttcaatagaccagttcctttgaacgatacctctgttaggtttccgaagctgttcgagcgccactatgcacacagctgctacttctggacgatcgctctcggcggcaattttatgttcatgctcaacatgcatgatttggaactctctgttgttgacctgcctcctggtgtattttgccctcgagaacaggccattgtggaggcaggggaagacatgataggtctgttcaatcttagtgatggcatgctgcagctctactataagtcattgcgaggaactgagtggcaccacgaaaggataatccccttgcccagactgaacagttactggagcatcctcgatgcagctgcagggcacttactcctacaagcgacgccacaggattgttccccttatgcaaagccggagtcacagtatttcacactcaatctcaagacattccttgttgaggggctttgcgtttcgaatcggcacattacaggtgctcacctgtatgcgagttttctgttaccattgtcacagccaagcatatga

SEQ ID NO: 7180 - protein, 393 aa, Sorghum bicolor
  misc_feature: Ceres ANNOT ID no. 6074823
  misc_feature (14)..(62): Pfam Id: F-box Pfam Desc: F-box domain
  misc_feature (4)..(369): NCBI GI: 115481050 NCBI Desc: os10g0135300 [oryza sativa (japonica cultivar-group)]
  misc_feature (14)..(271): NCBI GI: 116308909 NCBI Desc: osigba0107a02.1 [oryza sativa (indica cultivar-group)]
  misc_feature (6)..(308): NCBI GI: 115462089 NCBI Desc: os05g0147700 [oryza sativa (japonica cultivar-group)]
  misc_feature (137)..(219): NCBI GI: 115472723 NCBI Desc: os07g0555400 [oryza sativa (japonica cultivar-group)]
  misc_feature (12)..(178): NCBI GI: 38347670 NCBI Desc: osjnba0054d14.5 [oryza sativa (japonica cultivar-group)]
MSSPAAHQVAGAPASQPIFPDEILEEIFLRLDAGEDLVRASAACTTFRRVVSARRFLDRFRCLHPPPVLGFLEFDALGTFHPAEPPHRAAPAARALAQASDFTFSFLGRPHYWRVCDARDSRVLLRRVRVTTVLAGLVVCDPLHRRHVELPAIPDKLAAATGCRGLQEFDPFLDPDTGKDKEKQDLSFRVICAVQCEHMLVTFDFSSVTGQWRGMTFNRPVPLNDTSVRFPKLFERHYAHSCYFWTIALGGNFMFMLNMHDLELSVVDLPPGVFCPREQAIVEAGEDMIGLFNLSDGMLQLYYKSLRGTEWHHERIIPLPRLNSYWSILDAAAGHLLLQATPQDCSPYAKPESQYFTLNLKTFLVEGLCVSNRHITGAHLYASFLLPLSQPSI

SEQ ID NO: 7181 - DNA, 534 bp, Sorghum bicolor
  misc_feature: Ceres ANNOT ID no. 6074827
  misc_feature: Encodes the peptide sequence at SEQ ID NO 7182
atgcagagccagatcgtgtgccacgggtgcaggaccgttctgctctacccaagaggtgctccgagcgtgtgttgcgcggtatgccatgcagtcaccaatgtgccgcctccagcaatagagatggctcgacttatatgtggtggttgccagacattattgatgtatactcgcagtgcaacaactgtaagatgctcatgttgtgacacagtcaatcttgtcagaccagtgagtagcatagctcatgtgaactgtggccagtgccaaacagtgttgatgtatccatatggagcaccgtctgtcaaatgtgctatttgcaacttcattacaaatgttggcggggtgactccggtgagacctttgccacctgcactacctgcatcaagtggaaattcatatagcatcccgtcaacttctgtgccaatgaatcaatcgcagaatgtaactgttgttgttgaaaacccaatgacagtagatgacaagggaaaattggtgagcaatgttgtagtaggggttacaagtggtgggaaaaagtaa

SEQ ID NO: 7182 - protein, 177 aa, Sorghum bicolor
  misc_feature: Ceres ANNOT ID no. 6074827
  misc_feature (7)..(31): Pfam Id: zf-LSD1 Pfam Desc: LSD1 zinc finger
  misc_feature (46)..(70): Pfam Id: zf-LSD1 Pfam Desc: LSD1 zinc finger
  misc_feature (84)..(108): Pfam Id: zf-LSD1 Pfam Desc: LSD1 zinc finger
  misc_feature (1)..(177): NCBI GI: 77556573 NCBI Desc: zinc finger protein lsd1 [oryza sativa (japonica cultivar-group)]
  misc_feature (41)..(177): NCBI GI: 32400832 NCBI Desc: 18s subunit ribosomal protein [triticum aestivum]
  misc_feature (1)..(176): NCBI GI: 7268834 NCBI Desc: zinc-finger protein lsd1 [arabidopsis thaliana]
  misc_feature (1)..(177): NCBI GI: 17981380 NCBI Desc: zinc finger protein lsd2 [brassica oleracea]
  misc_feature (2)..(115): NCBI GI: 62751057 NCBI Desc: lsd-one-like 1 [brassica rapa]
  misc_feature: Useful for making plants with modulated drought sensitivity
  misc_feature: Useful for making plants with modulated oxidative stress sensitivity
  misc_feature: Useful for making plants with modulated cold sensitivity
  misc_feature: Functional homolog of the protein sequence given in SEQ ID NO 13486
  misc_feature: Functional homolog of the protein sequence given in SEQ ID NO 13490
  misc_feature: Useful for making plants with modulated oxidative stress sensitivity
  misc_feature: Functional homolog of the protein sequence given in SEQ ID NO 13490
  misc_feature: The sequence is a functional homolog of SEQ ID NO. 330 in the 11/188,298 US application
MQSQIVCHGCRTVLLYPRGAPSVCCAVCHAVTNVPPPAIEMARLICGGCQTLLMYTRSATTVRCSCCDTVNLVRPVSSIAHVNCGQCQTVLMYPYGAPSVKCAICNFITNVGGVTPVRPLPPALPASSGNSYSIPSTSVPMNQSQNVTVVVENPMTVDDKGKLVSNVVVGVTSGGKK

SEQ ID NO: 7183 - DNA, 2532 bp, Sorghum bicolor
  misc_feature: Ceres ANNOT ID no. 6074828
  misc_feature: Encodes the peptide sequence at SEQ ID NO 7184
atggcggaggaggcggaggggatggaccggttcgacatggagggggacttcgagggcgggcagttcggccgcgacggggagttctactaccggagccggcgggagcgggcgccgcagacccgggacgacgccatctacggggtgttcgcggagggcgactcggactacgactcggaggaggatgaagggtcccgccgccgccgccggaagcgccgcaaggacggcggcggcggggaggccgatctcaccaagcccgtccagttcgtctccaccggcaagttcatgcccacccaggagcccgagcctgaggagaggccggggctcgggcgctctgccgctgccgctgatgataaggcggaggaagcggaggaggaggagcaggacgatgagggggacaccgagatgctgccggcgatgttcggcaagatcagggacggcgcgcgcgcgaggcgggaggagaaggagcgggagcgcgaggcggcggcgcgctggcgacaggtggcggggctcggggcgggggagccggctgcggctcctgggagcctggagtcaaactccaaggtggccaagatgatgttgatgatggggtacaagaaaggcatgggccttggcaagaatcagcaggggatcactgcgccggtggagtccattctgcgacccaagaatgctggcctggggagcgtcgaggggttcaaggagcccaagaccttgttgcctaaggagaacgtaccagccccgccgccgccaccagcatctgcgaagaaggagaagcgttggtccaagaaggctgccacaaagaaggctccaatcttgacaaagaatgagctcctggccatgcgtgctgagcaggaacacgaggagcagcctgctgttgtccagaaggtgattgacatgcgagggccgcaggcgcgggtgctgacagacttgaaggggctcaatgaagaacaagagatggaggcgaatgatgtgcccatgccagagctgcagtacaatgtgcgcctgcttgttgatgaggctagggctgatattgtgaggttggatgcgcagctgcggcgggagcaggagaaggtggctagcttggtgcgggagaaggaaaaagtggctaggcaagaggcatcgcagaaacgtcagctgctggtgatggaaagaattgcagagacactggagaaggtcagggaggatgatacagctggcatgctcactctggatggtttgattcagacattccacgggttgaaggtgcagtttgaggaggagttcaagatgtgtagcattgcatggattgcttgccgatatgctcatccgctgctaatccgcatcttccaagggtggcagcccctgcaggatccaaagtttgggttagaagtcatgaaaaaatggaaggacctgctgcagggtgaccaaccatatgacttctcagatagtgctgcatcaatgacgccatatgtgcagcttgttagtgaagtcatcctaccagctgtgagaatatcaggaaccaattcgtgggaggctagggaaccagaaccaatgctccactttcttgagttatgggataataagaagttgctgcctcctgttttgcttcaatcaatactagagcatgtaatcatgccaaagctctcagctgccgtggattcatgggatcctcgcagggaaagtgtaccaatccatgtctgggtgcatccatggctgccaatgctaagggaaaggatagagaccttgtgtcattctattcgatacaagttgagcactgtcctccatgtatggcaagcacatgatgcttcagcatatgcagtgttgtctccgtggaaagacgtgtttgattcagcaagctgggaagacctgattgtgcggtatatcattcctaaactgagattggcactgcaagactttcagatcaacccagcaaaccagaagcttgatcagttcaactgggtgatgttgtgggcatctgcaatcccagtacacctcatggtccatatgttggaagtttatttcttcagcaagtggcagcaggtcctgtaccattggttgtgctcaccaaatcctgatttcaacgagataatgaactggtataagggatggaagggtcttttcccaccagagttacttgccaatgagcgcatacggatgctgctaactgctggtcttgacatgatgaaccaagctgctgaaggacttgaggtggtgcagcctggggctagggagaatgtgggttacttgagggcaactgagaagcggcagtttgatgcagcacagcaagcttaccatgctgcgccaggagctgccatggcagatttgagcttcaaggagtctatacaggcatatgcaatggagcaaggtttgttatttatgcctagagttggcaagttctacaatggcatgccagtgtatgagtttggctccgttagtatttgcatagactctgtgaagcgactactgtatgcacaacttcaagatggagttgagagatggagtgctgtaactcttacacaattgatggacatgaaccgaatgggaagaccacactag

SEQ ID NO: 7184 - protein, 843 aa, Sorghum bicolor
  misc_feature: Ceres ANNOT ID no. 6074828
  misc_feature (397)..(634): Pfam Id: TFP11 Pfam Desc: Tuftelin interacting protein 11
  misc_feature (184)..(228): Pfam Id: G-patch Pfam Desc: G-patch domain
  misc_feature (3)..(837): NCBI GI: 5734758 NCBI Desc: similar to tuftelin-interacting protein [arabidopsis thaliana]
  misc_feature (316)..(836): NCBI GI: 21619831 NCBI Desc: tuftelin interacting protein 11 [homo sapiens]
  misc_feature (316)..(836): NCBI GI: 61362057 NCBI Desc: tuftelin interacting protein 11 [synthetic construct]
  misc_feature (316)..(836): NCBI GI: 121949758 NCBI Desc: stip [pan troglodytes]
  misc_feature (316)..(836): NCBI GI: 119580127 NCBI Desc: tuftelin interacting protein 11, isoform cra_b [homo sapiens]
MAEEAEGMDRFDMEGDFEGGQFGRDGEFYYRSRRERAPQTRDDAIYGVFAEGDSDYDSEEDEGSRRRRRKRRKDGGGGEADLTKPVQFVSTGKFMPTQEPEPEERPGLGRSAAAADDKAEEAEEEEQDDEGDTEMLPAMFGKIRDGARARREEKEREREAAARWRQVAGLGAGEPAAAPGSLESNSKVAKMMLMMGYKKGMGLGKNQQGITAPVESILRPKNAGLGSVEGFKEPKTLLPKENVPAPPPPPASAKKEKRWSKKAATKKAPILTKNELLAMRAEQEHEEQPAVVQKVIDMRGPQARVLTDLKGLNEEQEMEANDVPMPELQYNVRLLVDEARADIVRLDAQLRREQEKVASLVREKEKVARQEASQKRQLLVMERIAETLEKVREDDTAGMLTLDGLIQTFHGLKVQFEEEFKMCSIAWIACRYAHPLLIRIFQGWQPLQDPKFGLEVMKKWKDLLQGDQPYDFSDSAASMTPYVQLVSEVILPAVRISGTNSWEAREPEPMLHFLELWDNKKLLPPVLLQSILEHVIMPKLSAAVDSWDPRRESVPIHVWVHPWLPMLRERIETLCHSIRYKLSTVLHVWQAHDASAYAVLSPWKDVFDSASWEDLIVRYIIPKLRLALQDFQINPANQKLDQFNWVMLWASAIPVHLMVHMLEVYFFSKWQQVLYHWLCSPNPDFNEIMNWYKGWKGLFPPELLANERIRMLLTAGLDMMNQAAEGLEVVQPGARENVGYLRATEKRQFDAAQQAYHAAPGAAMADLSFKESIQAYAMEQGLLFMPRVGKFYNGMPVYEFGSVSICIDSVKRLLYAQLQDGVERWSAVTLTQLMDMNRMGRPH

SEQ ID NO: 7185 - DNA, 1191 bp, Sorghum bicolor
  misc_feature: Ceres ANNOT ID no. 6074830
  misc_feature: Encodes the peptide sequence at SEQ ID NO 7186
atgtcctcgccgccggcgcattcggtcgcctgcgccccggcatcgcagccggtcttccccgacgagatcctggaggagatcttcctccgcctcgacgccgcggaagacctcgcccgcgcctccgccgcctgcacggccttccaccgcgtcgtgtccgcgcgccgcttccttcaccgcttcaggtgcctccaccccccgccagtcctaggcttcctcgagttcgacgcactggggacattccgccccgcggaaccgccccaccgcgccgcccctgccgcacgcgccctcgcgcaggccgccgacttcaccttctccttcctcggcaacccttacagctggcatgtctgcgatgcccgcgactcccgcgtcctcctctaccgtcgcgtcagaatcacctccgtgttcgctgacctcatggtctgcgaccccttgcaccgccggcacgtcgagctacccgccatccccgacgacctagcagctgctactgggggctggggcatgcaggtattcgatcccttcctcgatccagacagtgacaaggtcaaggagaaacaggatttgtcattccgggtcatctgcgctgtgcagtgccgctacaagctcgtgactttccacttctcttcagtcaccggacaatggcgaggcatcacgttcaatagaccagttcctttggacgctaccttggtttggtttcaggggttgtttgagcgccactatgctcacggctgctacttctggacgatcggtgtcgacaccagttttatgatcatgctcaacatgcatgatatggaactctctgttgttgacctccctcctggcatacataacagcccgcaagcactagccgttgtggaggcaggggaaggcatgataggtctgttctctattagtggtgacatgctacagctctactacaagtctttgcaagaaactgagtggcaccaccaaaggataatccccttgcccaaaccaaacagttactgggacatctttgctgcagctgcagggtacttgctcctaaaagcgaaaccacgggattcttcgcaaatagcaaagtgggagtcacagtatttcacactcaacctcaagacattcctagttgagaggctgtgtgtttcaaattttcagtacactagaggtgctctcctgtatgctagtttcctatcaccattctcactgccaagcatatga

SEQ ID NO: 7186 - protein, 396 aa, Sorghum bicolor
  misc_feature: Ceres ANNOT ID no. 6074830
  misc_feature (14)..(62): Pfam Id: F-box Pfam Desc: F-box domain
  misc_feature (2)..(396): NCBI GI: 115481050 NCBI Desc: os10g0135300 [oryza sativa (japonica cultivar-group)]
  misc_feature (14)..(272): NCBI GI: 116308909 NCBI Desc: osigba0107a02.1 [oryza sativa (indica cultivar-group)]
  misc_feature (6)..(196): NCBI GI: 115462089 NCBI Desc: os05g0147700 [oryza sativa (japonica cultivar-group)]
  misc_feature (137)..(220): NCBI GI: 115472723 NCBI Desc: os07g0555400 [oryza sativa (japonica cultivar-group)]
  misc_feature (12)..(213): NCBI GI: 115481344 NCBI Desc: os10g0188000 [oryza sativa (japonica cultivar-group)]
MSSPPAHSVACAPASQPVFPDEILEEIFLRLDAAEDLARASAACTAFHRVVSARRFLHRFRCLHPPPVLGFLEFDALGTFRPAEPPHRAAPAARALAQAADFTFSFLGNPYSWHVCDARDSRVLLYRRVRITSVFADLMVCDPLHRRHVELPAIPDDLAAATGGWGMQVFDPFLDPDSDKVKEKQDLSFRVICAVQCRYKLVTFHFSSVTGQWRGITFNRPVPLDATLVWFQGLFERHYAHGCYFWTIGVDTSFMIMLNMHDMELSVVDLPPGIHNSPQALAVVEAGEGMIGLFSISGDMLQLYYKSLQETEWHHQRIIPLPKPNSYWDIFAAAAGYLLLKAKPRDSSQIAKWESQYFTLNLKTFLVERLCVSNFQYTRGALLYASFLSPFSLPSI

SEQ ID NO: 7187 - DNA, 1857 bp, Sorghum bicolor
  misc_feature: Ceres ANNOT ID no. 6074848
  misc_feature: Encodes the peptide sequence at SEQ ID NO 7188
atgtacgccgccctccgccgcgcggcgccactcaggcggcgcgccgtgtccgcactcgcggccgcgctgctccagcaccagccggcggcgctgggcgccgctgtggcaccacgcgcgccgacgcttctccccgcggccgcgtggttccactcctcgccggcgtggctcgggttccgggagacgggggccgcaggggcggcggcgcgcgcggagttcgcggcggaggaagggtcgttctacgaggaggataagagggcgccggctaccgggggcgccgcggcggaggagggactcgagattgccaagctcgggatctctaacaagatcgtcgaaaggctcgccaaaaagggcatcaccaagctgttccccatccagagagctgtccttgagccagcaatgcaaggacgggacatggttggtcgtgccaaaactgggactggtaaaactttggcctttggaatccccatattggatgcaattatccgccacaatgagaagtacaagcctggtaagttccccttggctattgttttggcgccaacaagagaacttgcaaaacaggttgagagggagttccttgattcctccccattggaaacactgtgtgtatacggagggactccaattatgcagcaaataaggcaacttaattatggtgttgatgtggtcattggaacacctggacgcgtgattgatctgctgaaaagaggtgctctgagtttggcagagatccgatttgttgttcttgacgaagcagaccagatgttgtctgttgggtttgatcaagatgttgagacaattttggagagagtgcctccgcaacgtcaaacattgatgttctctgcaacaatgccaacatggatacggaagctcacacagaagtaccttaacagtcctgttacagtagaccttgttggtgaggacgaccagaagctggctgaaggaattagtctgctctctgtctcttcagagaaccgtcaaaaaccagctgtccttggggaattgattaaggaacatgcaaaaggtggtaaatgcattgtttttacacaaacaaaaagggatgcagatagattgtcacacagtatgagtcgaagtttccaatgtgaagctcttcatggggatatctctcaatcccaaagagagagaacactgggaggatttcgagatgggcggtttaatatattgattgccactgatgttgctgctcgtggattggacattccaaatgtagatctggtgatacattatgaattgccaaactcgtcagagatattcgttcacagatctggccgaactggacgtgctggaaagaagggcactgcaattgtgatgtacaactatgaacaaagtagagctgtacgggtcattgaacgtgacgttggatgcaagtttacagagcttccaaaaattaatgtcgaggggtctgtcttgctggacgctggatttgactccttcgggggtggaggtggagggtatggcggttcaaactatgggcgctcacggggctttggtggacgtgggggtggtggttttggccgatcaggcggcggcggcggattcggcaattctggatttggccgctcaagtggtggatttggtgactcaggatttgaccgttctggtggtggagggtttggcaggtcaggtggaggtggtggattcggtgactcaggatttggccgctcaggtggcagtggaggattcggtgactcagggtttggtcgttcaagtggtggtgggtctggttttggtcgttctggtggatttggtgaatctggttcaggccggtttggtggtggttttggtagttctggctcaggtagtttcggtggctttggtgacaagaactcacgatag

SEQ ID NO: 7188 - protein, 618 aa, Sorghum bicolor
  misc_feature: Ceres ANNOT ID no. 6074848
  misc_feature (122)..(291): Pfam Id: DEAD Pfam Desc: DEAD/DEAH box helicase
  misc_feature (360)..(436): Pfam Id: Helicase_C Pfam Desc: Helicase conserved C-terminal domain
  misc_feature (1)..(617): NCBI GI: 122227760 NCBI Desc: dead-box atp-dependent rna helicase 9
  misc_feature (11)..(616): NCBI GI: 143456572 NCBI Desc: dead-box atp-dependent rna helicase 53
  misc_feature (82)..(473): NCBI GI: 87240993 NCBI Desc: helicase, c-terminal; zinc finger, cchc-type [medicago truncatula]
  misc_feature (75)..(464): NCBI GI: 115456345 NCBI Desc: os03g0827700 [oryza sativa (japonica cultivar-group)]
  misc_feature (65)..(464): NCBI GI: 47827092 NCBI Desc: atp-dependent rna helicase [hordeum vulgare subsp. vulgare]
MYAALRRAAPLRRRAVSALAAALLQHQPAALGAAVAPRAPTLLPAAAWFHSSPAWLGFRETGAAGAAARAEFAAEEGSFYEEDKRAPATGGAAAEEGLEIAKLGISNKIVERLAKKGITKLFPIQRAVLEPAMQGRDMVGRAKTGTGKTLAFGIPILDAIIRHNEKYKPGKFPLAIVLAPTRELAKQVEREFLDSSPLETLCVYGGTPIMQQIRQLNYGVDVVIGTPGRVIDLLKRGALSLAEIRFVVLDEADQMLSVGFDQDVETILERVPPQRQTLMFSATMPTWIRKLTQKYLNSPVTVDLVGEDDQKLAEGISLLSVSSENRQKPAVLGELIKEHAKGGKCIVFTQTKRDADRLSHSMSRSFQCEALHGDISQSQRERTLGGFRDGRFNILIATDVAARGLDIPNVDLVIHYELPNSSEIFVHRSGRTGRAGKKGTAIVMYNYEQSRAVRVIERDVGCKFTELPKINVEGSVLLDAGFDSFGGGGGGYGGSNYGRSRGFGGRGGGGFGRSGGGGGFGNSGFGRSSGGFGDSGFDRSGGGGFGRSGGGGGFGDSGFGRSGGSGGFGDSGFGRSSGGGSGFGRSGGFGESGSGRFGGGFGSSGSGSFGGFGDKNSR

SEQ ID NO: 7189 - DNA, 1653 bp, Sorghum bicolor
  misc_feature: Ceres ANNOT ID no. 6074856
  misc_feature: Encodes the peptide sequence at SEQ ID NO 7190
  misc_feature: Up-regulated in shoot tissues in response to salicylic acid treatment
atggcgactgcccagataaagagtagatttcttgttctttatgtcattgtctgtctcatggctcagatgggagatgccaatgtcgtgctattggggaataatctgaccttgtcctttgatgacattgaggcaagcttttctccaggagtgaaagggtcaggagtcaatggcgtagtttatgcttctgaacctttggatgcctgcagcccgttaacaatcaaggcagtcaagggcccaccatccccctttgcattaattgtaagaggcggttgcacattcgatgagaaagtaaaaaatgcacaggatgctggattcaaagctgcaattgtgtatgacaatgaaaatagcggggtcctggtttcaatggctggaagctcaagtggcatacatatatatgctgttttcgtttcgaaggcctcaggagaggtgttgaagaatttttcaggccatactgatgtagaggtgtggatactacctacagttgagaactcagcctggtcgatcatgggaatctcattcatatcgctgcttgccatgtctgctgtattagctacgtgtttctttgtgagaaggcatcggataaggagagaccaccctagaatcccagaagctagagagttccatggaatgagcagtcaattagttaaggcaatgccaagtcttattttcacaaaggtgcaagaagataactgtacatcgtcaatgtgtgccatttgtttggaagactatagtgtcggagaaaagctaagagtgctgccttgtcgtcacaagttccatgcagcttgtgtggacttgtggctaacttcttggagaacattctgtcctgtatgcaagcgagatgcgatgagtggagtatcagaatttcctgccacagaggctacccccttgctttcttctgctgttcggttaccttctcggccatcttcattcaggtccagtgtggcagcctcccctccaaggccaataagccgtcatccttcatcacactcagtttctcgtgcttactctgtttctagtacgccccagtctcccaacccctttagatctcgcacaaacttacctggcatccatacaagcagaagcactgcagaccttgcaaatatgtcatctccccaccctcgcatctcacatttgtcatcggcgcactcccttgttggcagccacctgtctccaccaatcagcataaggtattcattgccccaattggcccagtctgggcatggatcactcagtccacatgtcagttcatcctacatctcgaattctgggtatggttcttcaagctactactatcttggaggatccagccagcatgggtcatacctaaggcgatgtggagaatcagggccaagcctgtctaccatggcccctcagtcgccacagcagtttcagtcggaggcaaatgtggtagcaggcacatcatcagctcagtcctttcggcagtcctacctgagacactgtggggattcagatgccagtctgtctgacatgatgtcagcccagtcattgccacagcagtttcagtcggatgcaaatgtggcggcaggcgcatcatcagctcagtccttgcggcagtcctacctgagacgctgtggcgattcagatgccagtttgtctgacatgacatcagcccagtcattgccagggtgctga

SEQ ID NO: 7190 - protein, 550 aa, Sorghum bicolor
  misc_feature: Ceres ANNOT ID no. 6074856
  misc_feature (49)..(148): Pfam Id: PA Pfam Desc: PA domain
  misc_feature (236)..(277): Pfam Id: zf-C3HC4 Pfam Desc: Zinc finger, C3HC4 type (RING finger)
  misc_feature (11)..(421): NCBI GI: 6942149 NCBI Desc: remembr-h2 protein jr702 [arabidopsis thaliana]
  misc_feature (15)..(312): NCBI GI: 42562538 NCBI Desc: protease-associated zinc finger (c3hc4-type ring finger) family protein [arabidopsis thaliana]
  misc_feature (11)..(422): NCBI GI: 15219930 NCBI Desc: protease-associated zinc finger (c3hc4-type ring finger) family protein [arabidopsis thaliana]
  misc_feature (15)..(312): NCBI GI: 8778343 NCBI Desc: f15o4.19 [arabidopsis thaliana]
  misc_feature (47)..(298): NCBI GI: 15219668 NCBI Desc: protease-associated zinc finger (c3hc4-type ring finger) family protein [arabidopsis thaliana]
  misc_feature: Up-regulated in shoot tissues in response to salicylic acid treatment
  misc_feature: The sequence is a functional homolog of SEQ ID NO. 329 in the 11/188,298 US application
  misc_feature: The sequence is a functional homolog of SEQ ID NO. 271 in the 11/188,298 US application
MATAQIKSRFLVLYVIVCLMAQMGDANVVLLGNNLTLSFDDIEASFSPGVKGSGVNGVVYASEPLDACSPLTIKAVKGPPSPFALIVRGGCTFDEKVKNAQDAGFKAAIVYDNENSGVLVSMAGSSSGIHIYAVFVSKASGEVLKNFSGHTDVEVWILPTVENSAWSIMGISFISLLAMSAVLATCFFVRRHRIRRDHPRIPEAREFHGMSSQLVKAMPSLIFTKVQEDNCTSSMCAICLEDYSVGEKLRVLPCRHKFHAACVDLWLTSWRTFCPVCKRDAMSGVSEFPATEATPLLSSAVRLPSRPSSFRSSVAASPPRPISRHPSSHSVSRAYSVSSTPQSPNPFRSRTNLPGIHTSRSTADLANMSSPHPRISHLSSAHSLVGSHLSPPISIRYSLPQLAQSGHGSLSPHVSSSYISNSGYGSSSYYYLGGSSQHGSYLRRCGESGPSLSTMAPQSPQQFQSEANVVAGTSSAQSFRQSYLRHCGDSDASLSDMMSAQSLPQQFQSDANVAAGASSAQSLRQSYLRRCGDSDASLSDMTSAQSLPGC

SEQ ID NO: 7191 - DNA, 1212 bp, Sorghum bicolor
  misc_feature: Ceres ANNOT ID no. 6074874
  misc_feature: Encodes the peptide sequence at SEQ ID NO 7192
atggcgtctcgtgctctgccggtcctgccctgcatcgaagccaaggagccggagaggccaccgccggcactcgtcagcgatgtcctcgaggagatcttcctgcgcgtggcctccccagcggacctcgcccgcgcctccgccgcgtgcgtctccttccacggcgtcatcagcaacccatctttcctccgccggtaccgctccgtccacccgccgctacttgtcggcttcatcaaccgagacggcttccaccccgtcgaggcgacgcatccctccgctgccatcgcccgtggtgtcgcccggaccgtcgacatctccttcctccctcatggtccgcagggttggtgtgcgaacgatgtccgtgatgggcgtgtcctcgtcgcatgctggtaccggcgccggctccgcgaatactgtgacctcgctgtgtacgacccactgttccggcaattcctgctgctgcctcccatgaccgacgacctactcgcctccgtcggcatcgataacgaaacaaagaacaattataccggcgaggcctccttcatcccttgtggaggcacggaggaggacacgtcgttcagtgtgatctgctggatgttttccaagacaagattggcggtgtttatcttctcaacaaaaacaagctctgctcactgggatgcagttaaatctatcagttgggctgatctaggcttgcctcaagaaattaaacagtgcctaaatggtccagcaggccaatgcgtgtatggttgcttctactggaaattatactgcagaagggagttgctcaagtttgacatggacactttcgagttctccaaatatgaactccctcctggtcataaccacagaagtatcgtcattgtggagtcaggggaaggcaaggttgccatgtttagtaaacttgttggtgaagggtctgtggactactacacctttatgcaaaatggcgctgatgatcagaagtcctataagtggcatttgaagagtaccatcccattgtctgtccatggtcctaatttttctattcgtggtcaagctggaggatatgttttcctagaaagcattatagaagaacaggataaaacatatttagagtatttctctctcgacattaagtcttgcaatattgagagagcctgtaggacaagtggtagaattatttcctgcccgtattttggttacccaccatctatgtcaccaaggaggatttaa

SEQ ID NO: 7192 - protein, 403 aa, Sorghum bicolor
  misc_feature: Ceres ANNOT ID no. 6074874
  misc_feature (12)..(399): NCBI GI: 115481050 NCBI Desc: os10g0135300 [oryza sativa (japonica cultivar-group)]
  misc_feature (22)..(286): NCBI GI: 116308909 NCBI Desc: osigba0107a02.1 [oryza sativa (indica cultivar-group)]
  misc_feature (23)..(292): NCBI GI: 115462089 NCBI Desc: os05g0147700 [oryza sativa (japonica cultivar-group)]
  misc_feature (21)..(93): NCBI GI: 115470391 NCBI Desc: os07g0122900 [oryza sativa (japonica cultivar-group)]
  misc_feature (21)..(158): NCBI GI: 115437584 NCBI Desc: os01g0557400 [oryza sativa (japonica cultivar-group)]
MASRALPVLPCIEAKEPERPPPALVSDVLEEIFLRVASPADLARASAACVSFHGVISNPSFLRRYRSVHPPLLVGFINRDGFHPVEATHPSAAIARGVARTVDISFLPHGPQGWCANDVRDGRVLVACWYRRRLREYCDLAVYDPLFRQFLLLPPMTDDLLASVGIDNETKNNYTGEASFIPCGGTEEDTSFSVICWMFSKTRLAVFIFSTKTSSAHWDAVKSISWADLGLPQEIKQCLNGPAGQCVYGCFYWKLYCRRELLKFDMDTFEFSKYELPPGHNHRSIVIVESGEGKVAMFSKLVGEGSVDYYTFMQNGADDQKSYKWHLKSTIPLSVHGPNFSIRGQAGGYVFLESIIEEQDKTYLEYFSLDIKSCNIERACRTSGRIISCPYFGYPPSMSPRRI

SEQ ID NO: 7193 - DNA, 1638 bp, Sorghum bicolor
  misc_feature: Ceres ANNOT ID no. 6074897
  misc_feature: Encodes the peptide sequence at SEQ ID NO 7194
atggcggatttggggctgtggaagcaggcgtggatgtgggtgctgtcccagaagcacatcctggcgtgggcgcacacggcggcgtgcggcagcagggagcgcctcgccttcctggtcgaccgccactggcccgccgtgtcccgggcctgcgccacctcctcgcgcctcgcgctcgccgcgctgcggcaatggcgcgggtgtaccgcgcgcggggtgctggcggtggccagcctcggccccgccgccgtcttcgtcatcctctggagcttcttcgtctgcatgacctcgccggcgtgcgcactctacgcgcttcttagcctgggggctgctgctgcagttgttcactatatgggctatacacctggccttttcattgttgggctgtttgggatattaattatgtggatgtatggctacttttggattacaggaatgcttctagttgctggaggttgtatgtgctctttgaaacatgctcgctatgtgatacctgttttgacttcatatgctatttattctgtggctgttcgtgttgggtggcttggagtcttcttgacactcaacctttctttcttgacaaatgatcttcttaataagttagcgcaaggatatgaaggaagcactgaagaaagccagtttgaagacatcaagggttctgatccagtgatggatgagttttatcgtagttgtgaattcccaccggttcctgacagtgaacctgagaccgtgtcttctgcgaagccatactgcacagcacccgtccaagatgtgttacatgtacaaaaagaggaacctcctagtaaagtagtgaaatctgattctagttccttggatgagattaagaggataatggatggttcaaaccattatgaagttttgggtgtacctcgtaatagaagcattgatcaaaagaccttgaaaaaagaatatcacagaatggtcctgcttgtacatcctgataaaaatatgggaaatccattggcttgtgaatcattcaaaaaacttcaatcagcttatgaggttctctctgatttcacaaagaaaaacagctatgatgaacaactgaggaaagaagaatcactgaaaatgaccccaagatcacgtgttgtttctcaacagagtggtgtagagtttctctcagaagagtccaggcggatacagtgcactaagtgtggtaatttccatatatggatatgcaccaagagaagcaaaacaagagcaagattctgtcagggctgtgatcagtttcatcaagccaaggatggagatggatgggttgaaaccagattttcatcctccatcaagatggaaataccacgagcctttgtttgtgctgagagcaaaatatttgatgtgtctgagtgggctacctgccagggaatggagtgtaagcctaacactcatggtccaacttttatggtaaacatggttggcacagataggatgcctcagagatcctacagttcccgttatcccttcagcttggacgcagagatgatccctgaagatgaatttgagctatggcttcagcaggcattggcatcaggcgtattcgctgacagcccaaagcgcaggaaaagctggagcccattcaaactgcctcaaaagggaatcaaaagttggcgaagatcatcatga

SEQ ID NO: 7194 - protein, 545 aa, Sorghum bicolor
  misc_feature: Ceres ANNOT ID no. 6074897
  misc_feature (288)..(352): Pfam Id: DnaJ Pfam Desc: DnaJ domain
  misc_feature (1)..(545): NCBI GI: 77556586 NCBI Desc: s-locus protein 5 [oryza sativa (japonica cultivar-group)]
  misc_feature (159)..(545): NCBI GI: 6069485 NCBI Desc: s-locus protein 5 [brassica rapa]
  misc_feature (169)..(536): NCBI GI: 9989051 NCBI Desc: similar to dnaj proteins [arabidopsis thaliana]
  misc_feature (4)..(427): NCBI GI: 124361108 NCBI Desc: heat shock protein dnaj [medicago truncatula]
  misc_feature (367)..(545): NCBI GI: 32400881 NCBI Desc: s-locus protein 5 [triticum aestivum]
MADLGLWKQAWMWVLSQKHILAWAHTAACGSRERLAFLVDRHWPAVSRACATSSRLALAALRQWRGCTARGVLAVASLGPAAVFVILWSFFVCMTSPACALYALLSLGAAAAVVHYMGYTPGLFIVGLFGILIMWMYGYFWITGMLLVAGGCMCSLKHARYVIPVLTSYAIYSVAVRVGWLGVFLTLNLSFLTNDLLNKLAQGYEGSTEESQFEDIKGSDPVMDEFYRSCEFPPVPDSEPETVSSAKPYCTAPVQDVLHVQKEEPPSKVVKSDSSSLDEIKRIMDGSNHYEVLGVPRNRSIDQKTLKKEYHRMVLLVHPDKNMGNPLACESFKKLQSAYEVLSDFTKKNSYDEQLRKEESLKMTPRSRVVSQQSGVEFLSEESRRIQCTKCGNFHIWICTKRSKTRARFCQGCDQFHQAKDGDGWVETRFSSSIKMEIPRAFVCAESKIFDVSEWATCQGMECKPNTHGPTFMVNMVGTDRMPQRSYSSRYPFSLDAEMIPEDEFELWLQQALASGVFADSPKRRKSWSPFKLPQKGIKSWRRSS

SEQ ID NO: 7195 - DNA, 1125 bp, Sorghum bicolor
  misc_feature: Ceres ANNOT ID no. 6074899
  misc_feature: Encodes the peptide sequence at SEQ ID NO 7196
atggccatgctcgccctctccctctccctctccctctcctcccgccccctctcctcctcctccgccttcctccgctcgaagcagcgcgcaccccacctccacctccaccgcctcctcctccccaaacccctctcctccgcctcgacctccgcctgcgcgctcacgccgccgactcccctagccgacaccactcctgccccggacgcggaccccaccccgctcttcctccgcccagcgacgcaccgtgtcccacccacggccctcgccgcgttccgccgccgcgcgtccgcgctcgtcccgccctccgcgccccacctccaccgccacctccgctggctcctcgccgacgccaccgacccatcctcctccgccgccgccgcgtccgacggcgatggcccggcgctcctccgcgcgccgctcgaggacctcgaggcgatgtggctgcgccacgtccgggagcgcacgccgttccagtacgtggtcgggaacgagcactggcgggacctggtggtcgccgtcgcggagggcgtcctcatcccgcgccccgagacggaggccgtcgtcgacatggtgcgcgccgtcgagggattcgcggatgggtggtgggctgacctcggcacagggagcggcgccatcgccgtggctgtggccagggagctcggtgcccatgggagggtgttcgccacggatgtcagcgaggtggccattgacgtcgccaggctcaacgtccagaggtacggggtgcaggataaagttgaaataaggcatggctcatggtttgaacctctgcaagatttgaaaggaaaacttatgggtgtgattagtaaccctccatacataccaaccgatgacctaccgggtctgcaacctgaggttggatggcatgaaccaaagttggcgctcgatggtggtaaggatggccttgagcatctgctccatctctgtgaagggttatcctcagttctggaacctgggggtttctttgtttttgagacaaatggtgacaaacagtcggagttccttgttgatttgataagcacaaagtggagttcttcttttcacaatgtcaaagcagttttagactttgcagacatcaagcgttttgtaacgggatatcgaagatga

SEQ ID NO: 7196 - protein, 374 aa, Sorghum bicolor
  misc_feature: Ceres ANNOT ID no. 6074899
  misc_feature (184)..(361): Pfam Id: MTS Pfam Desc: Methyltransferase small domain
  misc_feature (112)..(373): NCBI GI: 23124041 NCBI Desc: cog2890: methylase of polypeptide chain release factors [nostoc punctiforme pcc 73102]
  misc_feature (103)..(370): NCBI GI: 81300672 NCBI Desc: modification methylase, hemk family [synechococcus elongatus pcc 7942]
  misc_feature (103)..(370): NCBI GI: 56752240 NCBI Desc: protoporphyrinogen ix oxidase [synechococcus elongatus pcc 6301]
  misc_feature (112)..(368): NCBI GI: 119509583 NCBI Desc: protoporphyrinogen oxidase [nodularia spumigena ccy9414]
  misc_feature (110)..(370): NCBI GI: 16330666 NCBI Desc: protoporphyrinogen oxidase [synechocystis sp. pcc 6803]
MAMLALSLSLSLSSRPLSSSSAFLRSKQRAPHLHLHRLLLPKPLSSASTSACALTPPTPLADTTPAPDADPTPLFLRPATHRVPPTALAAFRRRASALVPPSAPHLHRHLRWLLADATDPSSSAAAASDGDGPALLRAPLEDLEAMWLRHVRERTPFQYVVGNEHWRDLVVAVAEGVLIPRPETEAVVDMVRAVEGFADGWWADLGTGSGAIAVAVARELGAHGRVFATDVSEVAIDVARLNVQRYGVQDKVEIRHGSWFEPLQDLKGKLMGVISNPPYIPTDDLPGLQPEVGWHEPKLALDGGKDGLEHLLHLCEGLSSVLEPGGFFVFETNGDKQSEFLVDLISTKWSSSFHNVKAVLDFADIKRFVTGYRR

SEQ ID NO: 7197 - DNA, 2574 bp, Sorghum bicolor
  misc_feature: Ceres ANNOT ID no. 6074900
  misc_feature: Encodes the peptide sequence at SEQ ID NO 7198
  misc_feature: Up-regulated in shoot tissues in response to methyl jasmonate treatment
  misc_feature: Up-regulated in root tissues in response to methyl jasmonate treatment
atggcgatggtcgcgagcagggagaggcggctctccccgccgggcggcgccgcccagggcgcgccgcaggtggacgcgggcaagtacgtgcggtacacgccggagcaggtggaggcgctggagcgcgtctacagcgagtgccccaagcccagctcgctccgccggcagcagctcatccgcgactgccccatcctcagcaacatcgagcccaagcagatcaaggtctggttccagaaccgcagatgccgggagaagcagcgcaaggagtcttctcgtctacaaaccgtgaaccggaagctgagcgcgatgaataagctgctgatggaggagaatgaccggctgcagaagcaggtgtcccgtctcgtctttgacaacgggtatatgaagaatcgactccacagtccttctgtagccaccaccgacacaagctgtgagtctgtggtgacaagtggtcaccacaaccaacagcaaaacccagcagttctgcatcctccacaaagggatgcgaacaacccagcaggtctactcgctattgctgaggagacattggcagagttcatgtccaaggcgactggaactgctgtcaactgggtgcaaatggttgggatgaagcctggtccggattccgttggaatcatcgctgtttcgcacaactgcagtggcgtagcagcacgagcttgcggccttgtgagccttgagcccacaaaggttgctgagatccttaaggatcgcgcatcgtggtatcgagattgtcggcatgttgatatcctccatgttatccctacgggtaacggtggaacaattgagctgatctatatgcagacttatgcactgacaactctggcggaaccgcgcgacttttggacgctccgatacactagtggtcttgatgatggcagtcttgtgatctgcgaaaggtcattgactcagtccactggaggtccttctggacctaacactccaaattttatcagagctgaggtgcttcctagtggttatctgattcgaccttgtgatgggggaggttccatgatttacattgtggatcatgttgatctgaatgcttctagtgtgcccgaggttcttcggccactctatgaatctcctaagatactggcacagaagatgactgctgcggcattgcgacacattaggcaaattgcacatgaatcaagtggtgaaatgccctatggtgttggtcgacagccggctgttctcagaactttcagtcaaaggctcagcagaggcttcaatgatgctgtgagcggctttccagacgatggctggtcttctttgttgagtagtgatggtgctgaggatattacaatttcaatcaactcatctccaaacaaacttattggatctcatgtcagcccttccccattcttttctgctatggggggtggcatcatgtgtgcaaaagcatcaatgttactgcagaatgtgccacctgctatacttgtgcgatttttgagggagcatcgctctgaatgggctgatcctggtgttgatgcttattctgctgcctctttgagggccaacccatatgctgttccaggtttaagggctggtgggtttatgggcaaccaggttatactaccccttgcacgcaccttggagcatgaagagtgcttggaggttattaggcttgaaggacatggctttagccatgaggaggtgctcatgtctcgggatatgtttcttctgcagttgtgcagtggtgttgatgagaatgcacctggtgcatgtgcacagcttgtctttgctcctattgatgaatcttttgctgatgatgcaccgttgctaccctcaggcttccgtgtgataccacttgatgctaagacggatgtgccatctgccacacgcacactcgaccttgcttctgcactggaggttggatcaggtggaggtctgcgtgctttaagcgatagttccggcacatgcaccacgagatctgtcctgaccatcgccttccagttttcgttcgagaatcaccttcgcgatagtgtggcagcaatggccaggcagtatgtcaggggtgtgatggcgtctgtgcagagggtggccatggcaattgctccttctcgccttggcccgcatatcgaactgaagcatccaccgggctctcctgaggcacttgctctagctacgtggatcggcaggagctacagggcgcacactggaacggagatccgctggtcggacactgaaggcgcggattctcccctgatgccattctggaagcacagcgacgcaatactctgctgctctctgaagccggctttcacgctcaagttcgccaacagtgccggcttcgacatcctggagacgaccctggtgaacatccaggacctgccgctggaggctgtcctcgacgacgacggccagaaggccctgtttgcgcagctctccaagatcatgcagcagggcctggcgtacctccccggcggcgtgtgcagatcgagcatggggcggcaggcatcgtacgagcaggcggtggcgtggaaggtggttggtgacgacggtgcccctcagtgcctggcgctcatgctcgtcaactggaccttcatctga

SEQ ID NO: 7198 - protein, 857 aa, Sorghum bicolor
  misc_feature: Ceres ANNOT ID no. 6074900
  misc_feature (710)..(857): Pfam Id: MEKHLA Pfam Desc: MEKHLA domain
  misc_feature (177)..(387): Pfam Id: START Pfam Desc: START domain
  misc_feature (26)..(86): Pfam Id: Homeobox Pfam Desc: Homeobox domain
  misc_feature (2)..(857): NCBI GI: 77556590 NCBI Desc: homeodomain transcription factor [oryza sativa (japonica cultivar-group)]
  misc_feature (24)..(857): NCBI GI: 60327627 NCBI Desc: class iii hd-zip protein 4 [populus trichocarpa]
  misc_feature (23)..(857): NCBI GI: 60327625 NCBI Desc: class iii hd-zip protein 3 [populus trichocarpa]
  misc_feature (19)..(857): NCBI GI: 89514873 NCBI Desc: class iii homeodomain-leucine zipper protein c3hdz1 [taxus globosa]
  misc_feature (24)..(857): NCBI GI: 89514863 NCBI Desc: class iii homeodomain-leucine zipper protein c3hdz1 [ginkgo biloba]
  misc_feature: The sequence is a functional homolog of SEQ ID NO 110 in the 10/412,699US patent application
  misc_feature: The sequence is a functional homolog of SEQ ID NO 1109 in the 10/412,699US patent application
  misc_feature: The sequence is a functional homolog of SEQ ID NO 1110 in the 10/412,699US patent application
  misc_feature: The sequence is a functional homolog of SEQ ID NO 1111 in the 10/412,699US patent application
  misc_feature: The sequence is a functional homolog of SEQ ID NO 1390 in the 10/666,642US patent application
  misc_feature: The sequence is a functional homolog of SEQ ID NO 1392 in the 10/666,642US patent application
  misc_feature: The sequence is a functional homolog of SEQ ID NO 1770 in the 10/412,699US patent application
  misc_feature: The sequence is a functional homolog of SEQ ID NO 1772 in the 10/412,699US patent application
  misc_feature: The sequence is a functional homolog of SEQ ID NO 250 in the 10/412,699US patent application
  misc_feature: The sequence is a functional homolog of SEQ ID NO 259 in the 11/479,226US patent application
  misc_feature: The sequence is a functional homolog of SEQ ID NO 26 in the 10/225,066US patent application
  misc_feature: The sequence is a functional homolog of SEQ ID NO 28 in the 10/225,066US patent application
  misc_feature: The sequence is a functional homolog of SEQ ID NO 534 in the 11/479,226US patent application
  misc_feature: The sequence is a functional homolog of SEQ ID NO 538 in the 11/479,226US patent application
  misc_feature: The sequence is a functional homolog of SEQ ID NO 666 in the 10/374,780US patent application
  misc_feature: The sequence is a functional homolog of SEQ ID NO 667 in the 10/374,780US patent application
  misc_feature: The sequence is a functional homolog of SEQ ID NO 668 in the 10/374,780US patent application
  misc_feature: The sequence is a functional homolog of SEQ ID NO 70 in the 10/374,780US patent application
  misc_feature: The sequence is a functional homolog of SEQ ID NO 72 in the 10/374,780US patent application
  misc_feature: The sequence is a functional homolog of SEQ ID NO 721 in the 10/374,780US patent application
  misc_feature: The sequence is a functional homolog of SEQ ID NO 783 in the 10/666,642US patent application
  misc_feature: The sequence is a functional homolog of SEQ ID NO 784 in the 10/666,642US patent application
  misc_feature: The sequence is a functional homolog of SEQ ID NO 785 in the 10/666,642US patent application
  misc_feature: Useful for making plants with modulated growth and phenotype characteristics
  misc_feature: The sequence is a functional homolog of SEQ ID NO 110 in the 20040045049 US patent application
  misc_feature: The sequence is a functional homolog of SEQ ID NO 1109 in the 20040045049 US patent application
  misc_feature: The sequence is a functional homolog of SEQ ID NO 1110 in the 20040045049 US patent application
  misc_feature: The sequence is a functional homolog of SEQ ID NO 1111 in the 20040045049 US patent application
  misc_feature: The sequence is a functional homolog of SEQ ID NO 1770 in the 20040045049 US patent application
  misc_feature: The sequence is a functional homolog of SEQ ID NO 1772 in the 20040045049 US patent application
  misc_feature: Useful for making plants with altered carbohydrate content
  misc_feature: Functional homolog of the protein sequence given in SEQ ID NO 13708
  misc_feature: The sequence is a functional homolog of SEQ ID NO 1392 in the 10/666,642 US patent application
  misc_feature: The sequence is a functional homolog of SEQ ID NO 1772 in the 10/412,699 US patent application
  misc_feature: The sequence is a functional homolog of SEQ ID NO 28 in the 10/225,066 US patent application
  misc_feature: The sequence is a functional homolog of SEQ ID NO 538 in the 11/479,226 US patent application
  misc_feature: The sequence is a functional homolog of SEQ ID NO 72 in the 10/374,780 US patent application
  misc_feature: The sequence is a functional homolog of SEQ ID NO 1390 in the 10/666,642 US patent application
  misc_feature: The sequence is a functional homolog of SEQ ID NO 1770 in the 10/412,699 US patent application
  misc_feature: The sequence is a functional homolog of SEQ ID NO 250 in the 10/412,699 US patent application
  misc_feature: The sequence is a functional homolog of SEQ ID NO 26 in the 10/225,066 US patent application
  misc_feature: The sequence is a functional homolog of SEQ ID NO 534 in the 11/479,226 US patent application
  misc_feature: The sequence is a functional homolog of SEQ ID NO 70 in the 10/374,780 US patent application
  misc_feature: The sequence is a functional homolog of SEQ ID NO 1454 in the 10/666,642 US patent application
  misc_feature: The sequence is a functional homolog of SEQ ID NO 162 in the 10/225,066 US patent application
  misc_feature: The sequence is a functional homolog of SEQ ID NO 1868 in the 10/412,699 US patent application
  misc_feature: The sequence is a functional homolog of SEQ ID NO 2124 in the 10/374,780 US patent application
  misc_feature: The sequence is a functional homolog of SEQ ID NO 2 in US patent 7056739
  misc_feature: Useful for making plants with altered lignin content
  misc_feature: The sequence is a functional homolog of SEQ ID NO 1110 in the 10/412,699 US patent application
  misc_feature: The sequence is a functional homolog of SEQ ID NO 667 in the 10/374,780 US patent application
  misc_feature: The sequence is a functional homolog of SEQ ID NO 721 in the 10/374,780 US patent application
  misc_feature: The sequence is a functional homolog of SEQ ID NO 784 in the 10/666,642 US patent application
  misc_feature: The sequence is a functional homolog of SEQ ID NO 1394 in the 10/666,642 US patent application
  misc_feature: The sequence is a functional homolog of SEQ ID NO 1774 in the 10/412,699 US patent application
  misc_feature: The sequence is a functional homolog of SEQ ID NO 1994 in the 10/374,780 US patent application
  misc_feature: The sequence is a functional homolog of SEQ ID NO 1109 in the 10/412,699 US patent application
  misc_feature: The sequence is a functional homolog of SEQ ID NO 666 in the 10/374,780 US patent application
  misc_feature: The sequence is a functional homolog of SEQ ID NO 783 in the 10/666,642 US patent application
  misc_feature: The sequence is a functional homolog of SEQ ID NO 669 in the 10/374,780 US patent application
  misc_feature: The sequence is a functional homolog of SEQ ID NO 720 in the 10/374,780 US patent application
  misc_feature: Up-regulated in shoot tissues in response to methyl jasmonate treatment
  misc_feature: Up-regulated in root tissues in response to methyl jasmonate treatment
MAMVASRERRLSPPGGAAQGAPQVDAGKYVRYTPEQVEALERVYSECPKPSSLRRQQLIRDCPILSNIEPKQIKVWFQNRRCREKQRKESSRLQTVNRKLSAMNKLLMEENDRLQKQVSRLVFDNGYMKNRLHSPSVATTDTSCESVVTSGHHNQQQNPAVLHPPQRDANNPAGLLAIAEETLAEFMSKATGTAVNWVQMVGMKPGPDSVGIIAVSHNCSGVAARACGLVSLEPTKVAEILKDRASWYRDCRHVDILHVIPTGNGGTIELIYMQTYALTTLAEPRDFWTLRYTSGLDDGSLVICERSLTQSTGGPSGPNTPNFIRAEVLPSGYLIRPCDGGGSMIYIVDHVDLNASSVPEVLRPLYESPKILAQKMTAAALRHIRQIAHESSGEMPYGVGRQPAVLRTFSQRLSRGFNDAVSGFPDDGWSSLLSSDGAEDITISINSSPNKLIGSHVSPSPFFSAMGGGIMCAKASMLLQNVPPAILVRFLREHRSEWADPGVDAYSAASLRANPYAVPGLRAGGFMGNQVILPLARTLEHEECLEVIRLEGHGFSHEEVLMSRDMFLLQLCSGVDENAPGACAQLVFAPIDESFADDAPLLPSGFRVIPLDAKTDVPSATRTLDLASALEVGSGGGLRALSDSSGTCTTRSVLTIAFQFSFENHLRDSVAAMARQYVRGVMASVQRVAMAIAPSRLGPHIELKHPPGSPEALALATWIGRSYRAHTGTEIRWSDTEGADSPLMPFWKHSDAILCCSLKPAFTLKFANSAGFDILETTLVNIQDLPLEAVLDDDGQKALFAQLSKIMQQGLAYLPGGVCRSSMGRQASYEQAVAWKVVGDDGAPQCLALMLVNWTFI

SEQ ID NO: 7199 - DNA, 642 bp, Sorghum bicolor
  misc_feature: Ceres ANNOT ID no. 6074903
  misc_feature: Encodes the peptide sequence at SEQ ID NO 7200
atgacctctgttgttcagagtgtttcaggtgaccacagggctgaggatcaacaccatcagaagaagcaagctgaacctggggaccagcaagaagcaccagttactagttcagatagccaaccaacagtgggcacaccatcaacagattatgtggcaccctatgcccctcatgacatgagccatgcaatgggtcaatatgcttatccaaatattgatccatactatggaagcctttatgcggcttacggtggacagccattgatgcatccaccgttagtcggaatgcatccggctggcttacctttgcctactgatgcaatcgaagagcctgtgtatgtaaatgcaaaacaatacaatgccatattaagaaggcgtcaatcccgggctaaagctgaatcagaacggaagcttgtcaagggccgtaagccctatcttcatgagtcacggcatcagcatgccttgaaaagggccaggggagctggaggtcggtttctcaattcaaagtcagacgacaaggaagagaactccgactcaagtcacaaagagaaacagaacggagttgcgcccaacaatggccaaccgtcaacccctccgtctcccaacggtgcatcatcagctaatcaggcaggcagtcgtgaatga

SEQ ID NO: 7200 - protein, 213 aa, Sorghum bicolor
  misc_feature: Ceres ANNOT ID no. 6074903
  misc_feature (108)..(164): Pfam Id: CBFB_NFYA Pfam Desc: CCAAT-binding transcription factor (CBF-B/NF-YA) subunitB
  misc_feature (21)..(185): NCBI GI: 6634774 NCBI Desc: contains similarity to gby13720 hap2a transcription factor from arabidopsis thaliana
  misc_feature (9)..(185): NCBI GI: 30691791 NCBI Desc: ccaat-binding transcription factor (cbf-b/nf-ya) family protein [arabidopsis thaliana]
  misc_feature (42)..(192): NCBI GI: 45861211 NCBI Desc: ccaat-box transcription factor complex whap8 [triticum aestivum]
  misc_feature (42)..(192): NCBI GI: 45861207 NCBI Desc: ccaat-box transcription factor complex whap6 [triticum aestivum]
  misc_feature (42)..(192): NCBI GI: 45861205 NCBI Desc: ccaat-box transcription factor complex whap5 [triticum aestivum]
  misc_feature: The sequence is a functional homolog of SEQ ID NO 112 in the 10/225,068US patent application
  misc_feature: The sequence is a functional homolog of SEQ ID NO 1263 in the 10/374,780US patent application
  misc_feature: The sequence is a functional homolog of SEQ ID NO 1342 in the 11/479,226US patent application
  misc_feature: The sequence is a functional homolog of SEQ ID NO 156 in the 10/666,642US patent application
  misc_feature: The sequence is a functional homolog of SEQ ID NO 192 in the 10/374,780US patent application
  misc_feature: The sequence is a functional homolog of SEQ ID NO 2852 in the 10/374,780US patent application
  misc_feature: The sequence is a functional homolog of SEQ ID NO 290 in the 10/374,780US patent application
  misc_feature: The sequence is a functional homolog of SEQ ID NO 6 in the 10/225,066US patent application
  misc_feature: The sequence is a functional homolog of SEQ ID NO 624 in the 10/412,699US patent application
  misc_feature: The sequence is a functional homolog of SEQ ID NO 696 in the 10/225,066US patent application
  misc_feature: Useful for making plants with modulated growth and phenotype characteristics
  misc_feature: The sequence is a functional homolog of SEQ ID NO 624 in the 20040045049 US patent application
  misc_feature: The sequence is a functional homolog of SEQ ID NO 112 in the 20050120408 US patent application
  misc_feature: The sequence is a functional homolog of SEQ ID NO 6 in the 20050160493 US patent application
  misc_feature: The sequence is a functional homolog of SEQ ID NO 696 in the 20050160493 US patent application
  misc_feature: The sequence is a functional homolog of SEQ ID NO 1263 in the 20060162006 US patent application
  misc_feature: The sequence is a functional homolog of SEQ ID NO 1518 in the 10/666,642 US patent application
  misc_feature: The sequence is a functional homolog of SEQ ID NO 472 in the 10/666,642 US patent application
  misc_feature: The sequence is a functional homolog of SEQ ID NO 112 in the 10/225,068 US patent application
  misc_feature: The sequence is a functional homolog of SEQ ID NO 156 in the 10/666,642 US patent application
  misc_feature: The sequence is a functional homolog of SEQ ID NO 192 in the 10/374,780 US patent application
MTSVVQSVSGDHRAEDQHHQKKQAEPGDQQEAPVTSSDSQPTVGTPSTDYVAPYAPHDMSHAMGQYAYPNIDPYYGSLYAAYGGQPLMHPPLVGMHPAGLPLPTDAIEEPVYVNAKQYNAILRRRQSRAKAESERKLVKGRKPYLHESRHQHALKRARGAGGRFLNSKSDDKEENSDSSHKEKQNGVAPNNGQPSTPPSPNGASSANQAGSRE

SEQ ID NO: 7201 - DNA, 1380 bp, Sorghum bicolor
  misc_feature: Ceres ANNOT ID no. 6074932
  misc_feature: Encodes the peptide sequence at SEQ ID NO 7202
atgctcttcgtcccgcgccaagtcgcactcgccgccgcctcctcgcagccccgcgccgccgcttccgccatggccaaggaagagcccaagaaggagaagaggagcaagagaaaggcggcggccaatggaggggccgccgtcgccgtcgcccccggcgcgagggccgcggtggtcgcttccgtcgccgcctttctcgagtcagccgggctcccgcgcacgctcgccgccctccagtccgaggccggccttgaggccggcgcgtgtgggacgtcgcaggtgaacttggaggagctggttgccaaattcttggagtcgagcaatttaactccagcggctgttgtcctgggaagcagtgaacaagcagaagttagcaaggaaaataagaaaaatggcacagaagcaggtgaggcagagagcaaggtgagtgagccttcagctgaggaaaagccgagtgaaaatatggatggtgaggccaaagagaagaaacagaagaagaagaagaagaagaaagacaatgctaggctggaaaaggcagaattagcaataattaacaaatttgagtcagcagaaaaggtcaatggagatggcaatgaatctagagaggaagaaccaaaaaatcagaatgatggtgctgatgacagaagtggtgctgtggaaaagaaaaagaagaagaaagataagtcatctgtcaagacttcagagaagactggtgcaggaagtgcacctgctgaggctgatggcgccaaggaaaagaatggtgctgtagaaacagtgaagaatgataatgagaaaaaggccaaaaagaagtggaagaagtctaaccaggaagaaaatgttcaggtggaaggtaaagaagctgcagagaaagattcagtcccaaaaccagatgatgggaacaagagtgggatggatgttgacgaagaacaccaaggaaagtcgtcaaatgaaaatgcagttgctggcaaaaaacggaagctagaagaagttgaaggaagcattgcccctgtgactccgaaagaagatagcaccgctaaccaaagtctaagcaatggctttgctgaggataaaacaaatgaagatagtaacataaaaccaagtaaaaggccgaaaaaatcatctgaacctaagagtgtgactccttttcaacggatcaaggtggatagtgtcacatttgcagatgataggcttcaggataactcgtactgggctaagggtggtgcagacactggttatggcgcaaaggcacaggagatccttggccaagtcaagggaaggggttttaggcacgagaagaccaagaagaagcgtggaacctacaggggcgggcaaatcgacctacaaacccactcgatcaagtttgagaattcagatgacgagtga

SEQ ID NO: 7202 - protein, 459 aa, Sorghum bicolor
  misc_feature: Ceres ANNOT ID no. 6074932
  misc_feature (354)..(453): Pfam Id: SRP40_C Pfam Desc: SRP40, C-terminal domain
  misc_feature (165)..(459): NCBI GI: 42733524 NCBI Desc: bri1-kd interacting protein 132 [oryza sativa (japonica cultivar-group)]
  misc_feature (95)..(459): NCBI GI: 140041586 NCBI Desc: lissencephaly type-1-like homology motif; srp40, c-terminal [medicago truncatula]
  misc_feature (136)..(459): NCBI GI: 144925005 NCBI Desc: srp40, c-terminal [medicago truncatula]
  misc_feature (267)..(459): NCBI GI: 15810103 NCBI Desc: at5g57120/mul3_6 [arabidopsis thaliana]
  misc_feature (8)..(455): NCBI GI: 205752 NCBI Desc: nopp140
MLFVPRQVALAAASSQPRAAASAMAKEEPKKEKRSKRKAAANGGAAVAVAPGARAAVVASVAAFLESAGLPRTLAALQSEAGLEAGACGTSQVNLEELVAKFLESSNLTPAAVVLGSSEQAEVSKENKKNGTEAGEAESKVSEPSAEEKPSENMDGEAKEKKQKKKKKKKDNARLEKAELAIINKFESAEKVNGDGNESREEEPKNQNDGADDRSGAVEKKKKKKDKSSVKTSEKTGAGSAPAEADGAKEKNGAVETVKNDNEKKAKKKWKKSNQEENVQVEGKEAAEKDSVPKPDDGNKSGMDVDEEHQGKSSNENAVAGKKRKLEEVEGSIAPVTPKEDSTANQSLSNGFAEDKTNEDSNIKPSKRPKKSSEPKSVTPFQRIKVDSVTFADDRLQDNSYWAKGGADTGYGAKAQEILGQVKGRGFRHEKTKKKRGTYRGGQIDLQTHSIKFENSDDE

SEQ ID NO: 7203 - DNA, 1383 bp, Sorghum bicolor
  misc_feature: Ceres ANNOT ID no. 6074933
  misc_feature: Encodes the peptide sequence at SEQ ID NO 7204
atggggtacgagaggatacacaaagttcagatgggggtcatctctccaaccaagctcaggatgaagctgctcggctccggcaacaaggacgagcctactcgcaagtcgccgcgggcgtcgccgccgccgtccaggctcgatgacgacgacgatgaccaccccaacaacagcctcttgccgcaagagctcgacgaagagtaccccaaggaccaccggtcagactcttcccggtcgcgctccgacgccagccacggcagggcggcgcgcagccgcagctgcggtgggagtgggagtggcagcgacagcggcgtcgagaacggcgcctccgccggcggcggcaacttcgagttctgcaaagaggagagggcggccctgcctgggactgcgactgcgactgcgacggcggcggtgtccgcgccgttcttccggcagcaggtgccgtccaagtggaacgacgcggagaagtggatcgcagggcgccacgtcgtgcactccaaccccatcttctccaagaagcccgccgccgccgcgatggcgtccagggccagcggcgcggccgcgagcgcgctgaccgagctgtcgtccaagtcctcgtcgccgtcgtcgtcggtgaccggcccggcgagcaagccgccgcagaagaagctccggttctcgccgtcgacgatcgccgccgcggcgccggcggtggccgtgtccgtgtcgatgcgcgacgtcgggacggagatgacgccgatcgcgagccaggagcagtcgcgcagcggcacccccgccggcgccgcgacgccgtctctcagcccgctctgctcggtgccgtccagcccgagaggcggcggcagcggcgcgtcctcggcctcctcttcctccgcgtcggagcgggagctccggctcaggacccggcgggagatcgccgcgctcggcctgcagctcggcaagatgaacatcgcgtcgtgggcctgcaaggaggagagcctcctcgccgccgcgtcgctggataagggcgccggtgacatcgacgaggagatcaagaggaaggccttcgaagctcgcgccaccgcgtgggaagagtccaacaagtgtaaactcgcgtcaagataccagaggaaggaggtgaagatacaggaatgggaaagcttgcagaaatccaaattcgaagccaagctgaggcaggccgaggcacaggcagagcagatgaaagcccgggcgaagcaggacctggccaggaggctgtcggccctgagccacaaggtggaagggaagcaggcgagggtggaggcgcgccggagccggcagtcgtcccgcctggcgcggcaggtggagcgcatccgcaagaccggccgtgagccgtgccggctccgtcgctgctgcgcctggttcctgtag

SEQ ID NO: 7204 - protein, 460 aa, Sorghum bicolor
  misc_feature: Ceres ANNOT ID no. 6074933
  misc_feature (342)..(453): Pfam Id: Remorin_C Pfam Desc: Remorin, C-terminal region
  misc_feature (158)..(457): NCBI GI: 38344336 NCBI Desc: osjnba0058k23.18 [oryza sativa (japonica cultivar-group)]
  misc_feature (158)..(457): NCBI GI: 116309948 NCBI Desc: h0714h04.6 [oryza sativa (indica cultivar-group)]
  misc_feature (226)..(457): NCBI GI: 115460610 NCBI Desc: os04g0620200 [oryza sativa (japonica cultivar-group)]
  misc_feature (107)..(455): NCBI GI: 53850525 NCBI Desc: at1g53860 [arabidopsis thaliana]
  misc_feature (234)..(442): NCBI GI: 92884019 NCBI Desc: remorin, c-terminal region [medicago truncatula]
  misc_feature: The sequence is a functional homolog of SEQ ID NO 104 in the 10/666,642US patent application
  misc_feature: The sequence is a functional homolog of SEQ ID NO 1040 in the 10/666,642US patent application
  misc_feature: The sequence is a functional homolog of SEQ ID NO 1041 in the 10/666,642US patent application
  misc_feature: The sequence is a functional homolog of SEQ ID NO 1042 in the 10/666,642US patent application
  misc_feature: Useful for making plants with modulated growth and phenotype characteristics
  misc_feature: The sequence is a functional homolog of SEQ ID NO 104 in the 20070033671 US patent application
  misc_feature: The sequence is a functional homolog of SEQ ID NO 1040 in the 20070033671 US patent application
  misc_feature: The sequence is a functional homolog of SEQ ID NO 1041 in the 20070033671 US patent application
  misc_feature: The sequence is a functional homolog of SEQ ID NO 1042 in the 20070033671 US patent application
MGYERIHKVQMGVISPTKLRMKLLGSGNKDEPTRKSPRASPPPSRLDDDDDDHPNNSLLPQELDEEYPKDHRSDSSRSRSDASHGRAARSRSCGGSGSGSDSGVENGASAGGGNFEFCKEERAALPGTATATATAAVSAPFFRQQVPSKWNDAEKWIAGRHVVHSNPIFSKKPAAAAMASRASGAAASALTELSSKSSSPSSSVTGPASKPPQKKLRFSPSTIAAAAPAVAVSVSMRDVGTEMTPIASQEQSRSGTPAGAATPSLSPLCSVPSSPRGGGSGASSASSSSASERELRLRTRREIAALGLQLGKMNIASWACKEESLLAAASLDKGAGDIDEEIKRKAFEARATAWEESNKCKLASRYQRKEVKIQEWESLQKSKFEAKLRQAEAQAEQMKARAKQDLARRLSALSHKVEGKQARVEARRSRQSSRLARQVERIRKTGREPCRLRRCCAWFL

SEQ ID NO: 7205 - DNA, 2667 bp, Sorghum bicolor
  misc_feature: Ceres ANNOT ID no. 6074934
  misc_feature: Encodes the peptide sequence at SEQ ID NO 7206
  misc_feature: Down-regulated in shoot tissues in response to aminocyclopropane carboxylic treatment
atgtcggagccatcccctgaaagtgacggggaacaaaggtgtctgaactcagagctatggcatgcatgcgcagggccccttgtgtccctgcctgtggttgggagccgggtcgtctactttcctcagggccatagtgagcaggttgctgcatcaactaataaagaagttgatgctcagatcccaaactacccaaacctacctccacaattaatctgccagcttcataatgtcacaatgcatgctgatgcggagactgaagaggtgtatgcccaaatgacactgcaaccattgagcccggaagaacaaaaggaaccttttcttccaatcgaattgggtgctggtagcaagcagccaactaattacttctgcaagacgttgactgcaagtgatacgagtacccatggtggattctctgttccgcgccgagcagctgagaaagtcttccccccattggatttttcacaacagcctccagttcaagagctggttgcaagagatctgcatgataatgagtggaaatttcggcacatttttcgtggtcagccaaaaaggcatctactgacgactggttggagtgtttttgtaagcgcaaaaagactagtagcaggggattcaatcatctttatctggaatgataataaccaacttctcttgggaattcgtcgtgcaaatcgtccacagactgtaatgccctcttctgtgctttcaagtgatagcatgcacattggtcttcttgctgcagcagctcatgctgcagccacaaacagtcgtttcactattttctacaacccccgggctagcccctctgagtttgtcattccactggctaagtatgtgaaagctgtttaccacacgcgtgtgtctgttggaatgcggttccggatgctttttgagacagaggaatcaagtgttagacgatacatgggtacaataacaggcataagtgatctggactcagagcgttggccaaactcgcactggcgttctgtgaaggttggttgggatgagtctacagctggtgataaacagccaagagtttcactatgggagattgagccactgacgacctttccgatgtacccaactgcctttccattaaggctaaagcgtccgtgggcttcaggactacctatgttcaatggtgggaggagcgatgagttcgctcgttattcttctctcatgtggcttcgagatggaaacagaggggctcagtcactgaacttccagggacttggagcatcaccatggcttcagccaagaatagattatccattgatgggtctgaagccagatacttaccagcagatggctgctgccgcactggaagaaattagagctggggatcatttgaagcaaacatcttctctactgccagtccaacagactcaaaatttgaatggtggattagatcctttgtatggaaatcctgttctacagcagatgcaattccaatctcagcagtcacccctgcaagctgtgcagcaaggttatggtcagaatgcaagcgaatctggtttccttcaaaatcagctgcagcagctgcagctgcaaaagcagcaggagccaccacagcagcagcagcagcagacacaagttctgcagcaacaatcgcatcaggaaatgcaacagcacctctcagctagttgtcatgatattgctaacgtagcttctggtgtgtccgagtctggatctgcttgtcaatcacaatcttctttgctttctgggtcatcgttctatcaacagaacctctttgatggaaacaatggcccagatctgcatctgcacaacagtttccacaacttttcaagccaagagtcctccaaccttcttaatctcccaagaagtggccaattaatggcatcagagggatggccttcaaagaggttggctgtggaatctcttgctggtcatgagcttcaacctgtgcagctcaagcttgagaaagtgaatcaccagagtaatgtatctcacgtttctggcaccttgccgccattgtcagcaagagatggttctagtgcccaggcttgtggtacaaatgttcagagtaacctgctttcatcatcatttgctatccatgatggcttgtcaaccgtcaggagtggtggtgttggcagtggaactgatgcgataaccatagcttcgttgagatatggtgatatgaatttgctacctgaaaactccatagcaacgtccagttgtttgggtgaatcaggaaccttcaattctcttgacgatgtttgtggtgtaaacccatcacaaggtggaacctttgtgaaggtttacaaatcagggtccctcgggagatcgctcgatatcaccagattcagcagctactacgagttacgtagcgagctcgagcggttatttggtcttgaaggccaattggaggaccctgtaagatcaggctggcagcttgtattcgtcgaccgggaaaatgatattcttctcgtcggcgacgacccgtggcaggagtttgtgaatagcgtatggtgcataaagatcctctcgccacaagatgtgcagcagatggtccgcggcggaggcgaccttctgtctgcacctggagcgaggatgctgcagagcagtgtctgcgatgactattctgcaggccacgacatgcagaacctcaccggcatcattgcacctgtggtgcctctggactactga

SEQ ID NO: 7206 - protein, 888 aa, Sorghum bicolor
  misc_feature: Ceres ANNOT ID no. 6074934
  misc_feature (248)..(331): Pfam Id: Auxin_resp Pfam Desc: Auxin response factor
  misc_feature (121)..(226): Pfam Id: B3 Pfam Desc: B3 DNA binding domain
  misc_feature (10)..(888): NCBI GI: 19352043 NCBI Desc: auxin response factor 6b [oryza sativa]
  misc_feature (6)..(877): NCBI GI: 102139794 NCBI Desc: transcriptional factor b3 family protein [musa acuminata]
  misc_feature (6)..(888): NCBI GI: 144923737 NCBI Desc: transcriptional factor b3; auxin response factor; aux/iaa_arf_dimerisation [medicago truncatula]
  misc_feature (5)..(685): NCBI GI: 47496696 NCBI Desc: auxin response factor 3 [cucumis sativus]
  misc_feature (79)..(888): NCBI GI: 47496698 NCBI Desc: auxin response factor 4 [cucumis sativus]
  misc_feature: The sequence is a functional homolog of SEQ ID NO 1003 in the 10/666,642US patent application
  misc_feature: The sequence is a functional homolog of SEQ ID NO 1424 in the 10/666,642US patent application
  misc_feature: The sequence is a functional homolog of SEQ ID NO 16 in the 10/412,699US patent application
  misc_feature: The sequence is a functional homolog of SEQ ID NO 1623 in the 10/374,780US patent application
  misc_feature: The sequence is a functional homolog of SEQ ID NO 1656 in the 10/412,699US patent application
  misc_feature: The sequence is a functional homolog of SEQ ID NO 18 in the 10/412,699US patent application
  misc_feature: The sequence is a functional homolog of SEQ ID NO 1826 in the 10/412,699US patent application
  misc_feature: The sequence is a functional homolog of SEQ ID NO 2070 in the 10/374,780US patent application
  misc_feature: Useful for making plants with modulated growth and phenotype characteristics
  misc_feature: The sequence is a functional homolog of SEQ ID NO 16 in the 20040045049 US patent application
  misc_feature: The sequence is a functional homolog of SEQ ID NO 1656 in the 20040045049 US patent application
  misc_feature: The sequence is a functional homolog of SEQ ID NO 18 in the 20040045049 US patent application
  misc_feature: The sequence is a functional homolog of SEQ ID NO 1826 in the 20040045049 US patent application
  misc_feature: The sequence is a functional homolog of SEQ ID NO 1424 in the 10/666,642 US patent application
  misc_feature: The sequence is a functional homolog of SEQ ID NO 1826 in the 10/412,699 US patent application
  misc_feature: The sequence is a functional homolog of SEQ ID NO 2070 in the 10/374,780 US patent application
  misc_feature: The sequence is a functional homolog of SEQ ID NO 1004 in the 10/666,642 US patent application
  misc_feature: The sequence is a functional homolog of SEQ ID NO 1624 in the 10/374,780 US patent application
  misc_feature: The sequence is a functional homolog of SEQ ID NO 1657 in the 10/412,699 US patent application
  misc_feature: The sequence is a functional homolog of SEQ ID NO 1001 in the 10/666,642 US patent application
  misc_feature: The sequence is a functional homolog of SEQ ID NO 1621 in the 10/374,780 US patent application
  misc_feature: The sequence is a functional homolog of SEQ ID NO 1654 in the 10/412,699 US patent application
  misc_feature: The sequence is a functional homolog of SEQ ID NO 1003 in the 10/666,642 US patent application
  misc_feature: The sequence is a functional homolog of SEQ ID NO 1623 in the 10/374,780 US patent application
  misc_feature: The sequence is a functional homolog of SEQ ID NO 1656 in the 10/412,699 US patent application
  misc_feature: The sequence is a functional homolog of SEQ ID NO 224 in the 10/666,642 US patent application
  misc_feature: The sequence is a functional homolog of SEQ ID NO 278 in the 10/374,780 US patent application
  misc_feature: The sequence is a functional homolog of SEQ ID NO 830 in the 10/225,066 US patent application
  misc_feature: The sequence is a functional homolog of SEQ ID NO 894 in the 10/412,699 US patent application
  misc_feature: Useful for making plants with modulated light quality sensitivity
  misc_feature: Functional homolog of the protein sequence given in SEQ ID NO 13657
  misc_feature: The sequence is a functional homolog of SEQ ID NO 298 in the 10/412,699 US patent application
  misc_feature: Useful for biocontainment applications
  misc_feature: Useful for making plants with modulated flowering time
  misc_feature: Functional homolog of the protein sequence given in SEQ ID NO 13656
  misc_feature: Down-regulated in shoot tissues in response to aminocyclopropane carboxylic treatment
MSEPSPESDGEQRCLNSELWHACAGPLVSLPVVGSRVVYFPQGHSEQVAASTNKEVDAQIPNYPNLPPQLICQLHNVTMHADAETEEVYAQMTLQPLSPEEQKEPFLPIELGAGSKQPTNYFCKTLTASDTSTHGGFSVPRRAAEKVFPPLDFSQQPPVQELVARDLHDNEWKFRHIFRGQPKRHLLTTGWSVFVSAKRLVAGDSIIFIWNDNNQLLLGIRRANRPQTVMPSSVLSSDSMHIGLLAAAAHAAATNSRFTIFYNPRASPSEFVIPLAKYVKAVYHTRVSVGMRFRMLFETEESSVRRYMGTITGISDLDSERWPNSHWRSVKVGWDESTAGDKQPRVSLWEIEPLTTFPMYPTAFPLRLKRPWASGLPMFNGGRSDEFARYSSLMWLRDGNRGAQSLNFQGLGASPWLQPRIDYPLMGLKPDTYQQMAAAALEEIRAGDHLKQTSSLLPVQQTQNLNGGLDPLYGNPVLQQMQFQSQQSPLQAVQQGYGQNASESGFLQNQLQQLQLQKQQEPPQQQQQQTQVLQQQSHQEMQQHLSASCHDIANVASGVSESGSACQSQSSLLSGSSFYQQNLFDGNNGPDLHLHNSFHNFSSQESSNLLNLPRSGQLMASEGWPSKRLAVESLAGHELQPVQLKLEKVNHQSNVSHVSGTLPPLSARDGSSAQACGTNVQSNLLSSSFAIHDGLSTVRSGGVGSGTDAITIASLRYGDMNLLPENSIATSSCLGESGTFNSLDDVCGVNPSQGGTFVKVYKSGSLGRSLDITRFSSYYELRSELERLFGLEGQLEDPVRSGWQLVFVDRENDILLVGDDPWQEFVNSVWCIKILSPQDVQQMVRGGGDLLSAPGARMLQSSVCDDYSAGHDMQNLTGIIAPVVPLDY

SEQ ID NO: 7207 - DNA, 1995 bp, Sorghum bicolor
  misc_feature: Ceres ANNOT ID no. 6074936
  misc_feature: Encodes the peptide sequence at SEQ ID NO 7208
atgaagcgcgcacgcacctccgagggattcctcggcgtatgccggctgcgcgcgcgccggggcctggcgccgctcctcgccgcggcagcgttcgcctacctactgctcatgtccgtcaggctcgctggcctcagtggcgcggttgggaccacgcctgccgtcgtcggccgtcgcctcgccaccgccggcgcgggtaagccgccgctgcggcggcgggtcgacgagccgcctgcgcgcgcgaggggcggtacgagcggcggcggcgtctcccggtacggccgtatcgccgtccagatgctccggcggcaggaggccgtcgggaagcggcggaagctgtggggccggcttgggaacttcacggagctggagcgcgtggcggccaaggcgtgggcgcttggggccgacgcgtgggaggaggcctccgcgttcgccggtgacgtcgacgactccatcgcctcccgctcccgtgacgtcgccggggacggggaggtcaagtgccccggctcggtcgagctcgacgcaggcgagaccgtggcgttcctgccgtgcgggctgactgccgggtcggcggtgacggtggtcgggacggcgcgagaggcgcggcccgagcacgtccaggcgctggtgcggagcggcgggggcaacgggatggtgccggtggcgcagttcgcggtggagctgcgcggcctgcgcgccgtcgacggcgaggagccgcctagcatactccacctcaacccgcggctgcgcggcgactggagcgaccgccccgtgctggagatgaacacctgcttccgaatgcagtggggcagggcgcagcgctgccgcggctacccctccagagacgatgatctggtcgatggattcagaaaatgtgagagatgggagtggcaggacatagttgaatcgaaacaaacaaagacaagctcatggttcaacagattcatcgggcgggaaaagaaaccaaaaatgacatggccattcccgttttcagaggggaagatgtttgttctcactatccaagctggcgttgaaggatatcatattaatgtgggaggccgccatgttgcctcatttcctcataggatgggattcactctcgaagatgcaacaggtttagccataacagggggcatagatgttcactctgtgcatgcaacagcgcttccaaaggctcatcctaattcttctctccaacaagccctggaaatgtctgaaaggtggaaggctcaccctgtgccagaggaaccaattcatcttttcatcggcatcctctctgctacaaaccattttactgagcgcatggctattaggaaaacttggatgcagtttccggctatccaatcggggaatgcagttgctcggttctttgtcgcgctgagccacagaaaggagataaacgcagcactaaagaaggaagcagaattttttggagacatagtcattctgccatttatcgaccggtatgagctggtggttctgaaaacagttgcgatatgtcaacatggggtgcaaaatgtcactgcagattacatcatgaagtgcgatgacgacacctttgtgaggctggatgtagtattgcaacagatcgctacctacaacagaaccttacctctgtatctgggcaacctaaatctctaccatacgcctcaaagacggggcaaatgggccgtcacctacgaggaatggcctgaaccggcgtatcccccatatgccaatggacctggctacgttatctcgtctgacattgcgagagacatagcatcccggcatacaaatcactccctacggctgttcaagatggaggatgtgagcatgggcatgtgggtggaggactacagcgcgagcaccaccgtgcagtacatccacagcttgagtttctgccagtttggctgcgtggatgactacttcacggcgcactaccagtcccccagtcagatgctgtgcctctgggagaaactgtcagcagggcacgcgggctgctgtaactacagataa

SEQ ID NO: 7208 - protein, 664 aa, Sorghum bicolor
  misc_feature: Ceres ANNOT ID no. 6074936
  misc_feature (176)..(385): Pfam Id: Gal-bind_lectin Pfam Desc: Galactoside-binding lectin
  misc_feature (431)..(620): Pfam Id: Galactosyl_T Pfam Desc: Galactosyltransferase
  misc_feature (122)..(664): NCBI GI: 92896714 NCBI Desc: glycosyl transferase, family 31; arginase/agmatinase/formiminoglutamase; concanavalin a-like lectin/glucanase [medicago truncatula]
  misc_feature (118)..(664): NCBI GI: 115474657 NCBI Desc: os08g0130900 [oryza sativa (japonica cultivar-group)]
  misc_feature (91)..(664): NCBI GI: 30685292 NCBI Desc: galactosyltransferase family protein [arabidopsis thaliana]
  misc_feature (121)..(664): NCBI GI: 15241899 NCBI Desc: galactosyltransferase family protein [arabidopsis thaliana]
  misc_feature (121)..(664): NCBI GI: 5882743 NCBI Desc: ests gbh36134 and gbh36132 come from this gene. [arabidopsis thaliana]
  misc_feature: Useful for making plants with altered carbohydrate content
  misc_feature: Functional homolog of the protein sequence given in SEQ ID NO 13850
MKRARTSEGFLGVCRLRARRGLAPLLAAAAFAYLLLMSVRLAGLSGAVGTTPAVVGRRLATAGAGKPPLRRRVDEPPARARGGTSGGGVSRYGRIAVQMLRRQEAVGKRRKLWGRLGNFTELERVAAKAWALGADAWEEASAFAGDVDDSIASRSRDVAGDGEVKCPGSVELDAGETVAFLPCGLTAGSAVTVVGTAREARPEHVQALVRSGGGNGMVPVAQFAVELRGLRAVDGEEPPSILHLNPRLRGDWSDRPVLEMNTCFRMQWGRAQRCRGYPSRDDDLVDGFRKCERWEWQDIVESKQTKTSSWFNRFIGREKKPKMTWPFPFSEGKMFVLTIQAGVEGYHINVGGRHVASFPHRMGFTLEDATGLAITGGIDVHSVHATALPKAHPNSSLQQALEMSERWKAHPVPEEPIHLFIGILSATNHFTERMAIRKTWMQFPAIQSGNAVARFFVALSHRKEINAALKKEAEFFGDIVILPFIDRYELVVLKTVAICQHGVQNVTADYIMKCDDDTFVRLDVVLQQIATYNRTLPLYLGNLNLYHTPQRRGKWAVTYEEWPEPAYPPYANGPGYVISSDIARDIASRHTNHSLRLFKMEDVSMGMWVEDYSASTTVQYIHSLSFCQFGCVDDYFTAHYQSPSQMLCLWEKLSAGHAGCCNYR

SEQ ID NO: 7209 - DNA, 1953 bp, Sorghum bicolor
  misc_feature: Ceres ANNOT ID no. 6074938
  misc_feature: Encodes the peptide sequence at SEQ ID NO 7210
atgaagcgcgcgcgcagctccgagggattcctcggcgtgtgccggctgcgctcgcgccgcggcctggcgccgctcctcgccgcggcggcgttcgcctacctactgttcgtgtccgtcaagctcgctggactcagcggcgcggtggggaccgcgcctgccgtcggccgtcgcctcgccaccgccggcgcgggtaagctgccgccgctgcggcggcgggtcgacaagccgcccgcgcgcgcgatgggtggtacgagcggcgggggcgtgtccgggtacggccgcatcatcaacgagatgctccggcggcaggaggccgtctgggagcggcggaagcggtggggccggctggggaacttcacggagctggagcgcttggcggccaaggcgtgggcgctcggggccgtcgcgtgggaggaggcctccgcgttcgccggcgacgtcgacgacatcgccggggacggggagggcgctgcggccaagtgccccggctcgctcacgctcaacgctggggagaccgaggcgttcctgccgtgcgggctggccgccgggtcggcggtgacggtggtcgggatggcgcgagaggcgcggcccgagtacgtcgaggcgctggagcggagcggcgcgggcaacgggacggtgctggtggcgcagttcgcggtggagctgcgtggcctgcgcgccgtcgacggcgaggagccgcctaggatactccacctcaacccgcggctgcgcggcgactggagcggccgttccgtgctggagatgaacacctgcttccgaatgcagtggggcagggcgcagcgctgcgacgttgatggattcagaaaatgtgagggatgggagcgacaggacatagttgaatcgaaagaaacaaagacaagttcatggttcaacagattcatcgggcgggaaaagaaaccagaaatgacatggccattcccattttcagaggggaagatgtttgttctcactatccaagctggcgttgaaggatatcatattaatgtgggaggccgccatgttgcctcatttcctcataggatgggattcactctcgaagacgcaacaggtttagccgtaacagggggcatagatgttcactctgtgtatgcaacagcacttccaacggctcatcctagtttttctctccaacaagtcttggaaatgtctgaaaggtggaaggctcaccctctgcctaaggaaccaattcatcttttcatcggtatcctctctgctacaaaccattttgctgagcgcatggctattaggaaaacttggatgcagtttccggctatccaatcggggaatgcagttgctcggttttttgtcgcgctgagccacagaaaggagataaacgcagcactaaagaaggaagcagaatattttggagacatagtcattctgccatttatggaccggtatgagctggtggttctgaagacagttgcgctatgtcaatacggggtgcaaaatgtcactgcagattacatcatgaagtgtgatgacgacacctttgtgaggctggatgtagtattgcaacagatcgctgcctacaacagaaccttacctctgtatctgggcaacctgaatctctaccacagtcctcaaagaagcgggaaatgggctgtcacctttgaggaatggcctgaagcggcgtatcccccgtacgccaatggacctggctacgttatctcggccgacatcgcgagagacatagcatcccggcatacaaatcactccctacggctgttcaagatggaggatgtgagcatgggcatgtgggtggaggacttcaacgcgagcgcccccgtgcagtacgtccacagctggaggttctgccagttcggctgcgtggattactacttgacggcgcactaccagtccccctggcacatgctgtgcctctgggagaaactgtcagcagggcgccgggattgctgtaactacatataa

SEQ ID NO: 7210 - protein, 650 aa, Sorghum bicolor
  misc_feature: Ceres ANNOT ID no. 6074938
  misc_feature (171)..(371): Pfam Id: Gal-bind_lectin Pfam Desc: Galactoside-binding lectin
  misc_feature (417)..(607): Pfam Id: Galactosyl_T Pfam Desc: Galactosyltransferase
  misc_feature (25)..(649): NCBI GI: 115474657 NCBI Desc: os08g0130900 [oryza sativa (japonica cultivar-group)]
  misc_feature (156)..(649): NCBI GI: 92896714 NCBI Desc: glycosyl transferase, family 31; arginase/agmatinase/formiminoglutamase; concanavalin a-like lectin/glucanase [medicago truncatula]
  misc_feature (92)..(649): NCBI GI: 30685292 NCBI Desc: galactosyltransferase family protein [arabidopsis thaliana]
  misc_feature (17)..(648): NCBI GI: 34393273 NCBI Desc: galactosyltransferase family-like protein [oryza sativa (japonica cultivar-group)]
  misc_feature (163)..(648): NCBI GI: 15241899 NCBI Desc: galactosyltransferase family protein [arabidopsis thaliana]
  misc_feature: Useful for making plants with altered carbohydrate content
  misc_feature: Functional homolog of the protein sequence given in SEQ ID NO 13850
MKRARSSEGFLGVCRLRSRRGLAPLLAAAAFAYLLFVSVKLAGLSGAVGTAPAVGRRLATAGAGKLPPLRRRVDKPPARAMGGTSGGGVSGYGRIINEMLRRQEAVWERRKRWGRLGNFTELERLAAKAWALGAVAWEEASAFAGDVDDIAGDGEGAAAKCPGSLTLNAGETEAFLPCGLAAGSAVTVVGMAREARPEYVEALERSGAGNGTVLVAQFAVELRGLRAVDGEEPPRILHLNPRLRGDWSGRSVLEMNTCFRMQWGRAQRCDVDGFRKCEGWERQDIVESKETKTSSWFNRFIGREKKPEMTWPFPFSEGKMFVLTIQAGVEGYHINVGGRHVASFPHRMGFTLEDATGLAVTGGIDVHSVYATALPTAHPSFSLQQVLEMSERWKAHPLPKEPIHLFIGILSATNHFAERMAIRKTWMQFPAIQSGNAVARFFVALSHRKEINAALKKEAEYFGDIVILPFMDRYELVVLKTVALCQYGVQNVTADYIMKCDDDTFVRLDVVLQQIAAYNRTLPLYLGNLNLYHSPQRSGKWAVTFEEWPEAAYPPYANGPGYVISADIARDIASRHTNHSLRLFKMEDVSMGMWVEDFNASAPVQYVHSWRFCQFGCVDYYLTAHYQSPWHMLCLWEKLSAGRRDCCNYI

SEQ ID NO: 7211 - DNA, 1077 bp, Sorghum bicolor
  misc_feature: Ceres ANNOT ID no. 6074959
  misc_feature: Encodes the peptide sequence at SEQ ID NO 7212
atgaggtcgtacttcttcttgccgtgcttgatgatcttgttattcttgctgctcgtcgtcgtcggaggtgcggtggtggccggggagaagaagaagaagacgaaggtgccggcgatcatcgtgttcggcgactcttccgtggacacgggcaacaacaacttcatcccgaccatcgcccggagcaacttctggccctacggccgcgactacgccgatggcctccccacgggccggttttccaatggacgcctcgctaccgacttcatctccgaggccttcggccttcccccctccatccccgcctacctcgacaagacctgcaccatcgaccagctctccactggagtctccttcgcctccgctgccactggcctcgacaacgccaccgccggcgtcttgtccgtgatcacactggatgagcagctggcctacttcaaggagtacacggaccggctgaagatcgccaagggcgaggcggcggcgaaggagatcatcggcgaagcgctctacatctggagcatcggcaccaacgacttcatcgagaactactacaacctgccggagcggtggatgcagtacagcgtgggagagtacgaggcctacctgctggggctcgccgaggcagccatccgccgcgtgcacgagctcggcggccggaagatggacttcacggggctcacgcccatgggctgcctccccgccgagcggatcatcggcgaccccggcgagtgcaacgagcagtacaacgctgttgccaggaccttcaacgccaagctgcaggagctcgtcgtcaagctcaaccaggagctcccgggactgcagctcgtcttcgccgacacgtaccagctccttgccaacgtcgtcaacaagccggccgactatggatttgacaatgctgtgcaaggttgttgcggtacggggctttttgaggcaggttacttttgcagcttcagcacctcaacgctatgtgaaaatgccaacaagtatgtgttctttgacgcaatccatcccacagagaagatgtacaaattgctcgctgatacagtcatcaacaccacgttgcatgtattcatgtga

SEQ ID NO: 7212 - protein, 358 aa, Sorghum bicolor
  misc_feature: Ceres ANNOT ID no. 6074959
  misc_feature (39)..(349): Pfam Id: Lipase_GDSL Pfam Desc: GDSL-like Lipase/Acylhydrolase
  misc_feature (11)..(358): NCBI GI: 50726533 NCBI Desc: gdsl-motif lipase/hydrolase-like [oryza sativa (japonica cultivar-group)]
  misc_feature (34)..(358): NCBI GI: 115478062 NCBI Desc: os09g0132200 [oryza sativa (japonica cultivar-group)]
  misc_feature (36)..(357): NCBI GI: 48716709 NCBI Desc: lipase sil1-like protein [oryza sativa (japonica cultivar-group)]
  misc_feature (35)..(354): NCBI GI: 51535564 NCBI Desc: anter-specific proline-rich protein apg precursor-like [oryza sativa (japonica cultivar-group)]
  misc_feature (16)..(350): NCBI GI: 92890372 NCBI Desc: lipolytic enzyme, g-d-s-l [medicago truncatula]
MRSYFFLPCLMILLFLLLVVVGGAVVAGEKKKKTKVPAIIVFGDSSVDTGNNNFIPTIARSNFWPYGRDYADGLPTGRFSNGRLATDFISEAFGLPPSIPAYLDKTCTIDQLSTGVSFASAATGLDNATAGVLSVITLDEQLAYFKEYTDRLKIAKGEAAAKEIIGEALYIWSIGTNDFIENYYNLPERWMQYSVGEYEAYLLGLAEAAIRRVHELGGRKMDFTGLTPMGCLPAERIIGDPGECNEQYNAVARTFNAKLQELVVKLNQELPGLQLVFADTYQLLANVVNKPADYGFDNAVQGCCGTGLFEAGYFCSFSTSTLCENANKYVFFDAIHPTEKMYKLLADTVINTTLHVFM

SEQ ID NO: 7213 - DNA, 981 bp, Sorghum bicolor
  misc_feature: Ceres ANNOT ID no. 6074962
  misc_feature: Encodes the peptide sequence at SEQ ID NO 7214
atggccgctgccatccccaacggccacaccgccggcggcgacgacgcgccccctcccgcttcgtcgtcgctggtgttcctgggcacggggtgctcgagcgcggtcccgaacgcgcggtgcctgatccagccccccgacccgccctgctccgtctgctcccagtccctctccgtcccgcccgagctaaaccctaactacagatgcaatacttctcttttgattgactattgccaagatgaaggtgcacataagtatattataattgatgtggggaagacattcagagaacaagttctgcgatggtttgttcgccacaaaatcccttgcgttgattctattcttctgacccatgaacatgcagatgcaatcttgggccttgatgatgttcgggtcgtacagccatttagtcccacaaatgatattgatccaaccccaatttatctctctcaatttgctatggacagcatctcccaaaagttcccttatttggtcaaaaagaagttaaaggaaggggaggaaatcaggcgagttgcccaacttgactggaaaataattgagagtgatattcagaaaccatttataacttcagggctagagtttgttcccttgccggtgatccatggtgaagactacatttgtttgggtttcctttttggaagaaaatcaaaagttgcttacatatcagatgtttcgcggtttcccccaagcacagaatatgcaatttcgaagtgtggagggggccaactggatttgctcatattggattgcctgtacaggacaggttctcacaatgtgcacctatgttgggaccagacactagatgctgttaggaggatttgccccaaaagagcattgctcattgggatgacccatgagatggatcatcacaaggacaaccaaacattggaagaatggtccaggagggaagggatagatgtgcagctagctcgtgatggcctgcgtgtctacattgatctgtaa

SEQ ID NO: 7214 - protein, 326 aa, Sorghum bicolor
  misc_feature: Ceres ANNOT ID no. 6074962
  misc_feature (67)..(326): NCBI GI: 115489576 NCBI Desc: os12g0615500 [oryza sativa (japonica cultivar-group)]
  misc_feature (12)..(308): NCBI GI: 144923738 NCBI Desc: phnp protein , related [medicago truncatula]
  misc_feature (86)..(326): NCBI GI: 42564134 NCBI Desc: metallo-beta-lactamase family protein [arabidopsis thaliana]
  misc_feature (86)..(326): NCBI GI: 9294602 NCBI Desc: hydrolase-like protein [arabidopsis thaliana]
  misc_feature (86)..(326): NCBI GI: 145332379 NCBI Desc: metallo-beta-lactamase family protein [arabidopsis thaliana]
MAAAIPNGHTAGGDDAPPPASSSLVFLGTGCSSAVPNARCLIQPPDPPCSVCSQSLSVPPELNPNYRCNTSLLIDYCQDEGAHKYIIIDVGKTFREQVLRWFVRHKIPCVDSILLTHEHADAILGLDDVRVVQPFSPTNDIDPTPIYLSQFAMDSISQKFPYLVKKKLKEGEEIRRVAQLDWKIIESDIQKPFITSGLEFVPLPVIHGEDYICLGFLFGRKSKVAYISDVSRFPPSTEYAISKCGGGQLDLLILDCLYRTGSHNVHLCWDQTLDAVRRICPKRALLIGMTHEMDHHKDNQTLEEWSRREGIDVQLARDGLRVYIDL

SEQ ID NO: 7215 - DNA, 1494 bp, Sorghum bicolor
  misc_feature: Ceres ANNOT ID no. 6074964
  misc_feature: Encodes the peptide sequence at SEQ ID NO 7216
atgggggagggcagcatcaatgtgattgcacctttgctggacatcgacgaatcatctggtgcgtcggaggtgctgctgcagcaggagcctgtaccatggggcgtgctggcgcggctggcagcatgggaggccggcaacctgtggcgcatctcgtgggcatccatcctcaccacgctcttcagcttcacgctcagcctcgtcacccaaatgtttgtcggacacctcggtgagctcgagcttgccggcgcctccatcaccaacattggcatccagggcctagcttatggcgtcatgattggcatggcaagcgcggtgcagactgtctgtggtcaggcatacggtgccaggaggtatgcagccatgggcattgtgtgccagagggcgctagtgctccagctcgccacggctatcccaattgccttcctctactggtacgccggtccgttcctgcgcctgatcgggcaggaggcggacgtggctgcggcggggcagctgtacgcgcgtggcctgatgccgcagctgctcgctttcaccctcttctccccgatgcagaggttcctgcaggcccagaacatcgtcaatcctgtggcgtacatcacgttggcagtgctcatcttccacacccttgcctcatggctaggcgtgtttgtgcttggctttggcctccttggagcagcactgatactgagcttctcttggtgggtgcttgtggtgttgacgtggggttacatcgtctggagcccagcttgtaaagaaacgtggactggactgtccttgctcgcctttagaggcctctggggatatgccaagcttgcttttgcctcggccgtcatgctagcattggagatctggtacgtacaaggatttgtgcttcttactggtttcctccccaactcggagattgcacttgattctctctcaatctgcatcaattattggaactgggatttcaatatcatgcttggcttgagctatgcagccagtatccgtgtcggcaatgagcttggtgctagccatccaaaggtagcaaggttctcggtcatcgtagttgtcgttgtgagcatcgccttcagtttccttgcgacgcttacagtcttaattctgaggtatccactgagtacactctacacgagtagcgcaacagtaatagaggctgttatcagtctgatgcccctgatggcaatcagcatcttcttgaatggaattcagccaattctctcaggggttgccattgggagtggatggcaagcaacagttgcctatgtcaatgttggggcctactacctgattgggcttccaattggatgtgttctaggatacaaaacaagccttggagcagctggaatatggtggggtttaattataggggtcgctgtgcaaacgatagccctggtcattctcactgcaaggactaactgggacaaggaggtggagaaggcgatgcagcgattacaacagacagctgtggttcctgtaaacgacgtcatcgcatga

SEQ ID NO: 7216 - protein, 497 aa, Sorghum bicolor
  misc_feature: Ceres ANNOT ID no. 6074964
  misc_feature (53)..(213): Pfam Id: MatE Pfam Desc: MatE
  misc_feature (274)..(437): Pfam Id: MatE Pfam Desc: MatE
  misc_feature (19)..(486): NCBI GI: 115453843 NCBI Desc: os03g0571900 [oryza sativa (japonica cultivar-group)]
  misc_feature (7)..(486): NCBI GI: 15081773 NCBI Desc: at1g61890/f8k4_9 [arabidopsis thaliana]
  misc_feature (1)..(486): NCBI GI: 126363776 NCBI Desc: multi antimicrobial extrusion family protein [nicotiana tabacum]
  misc_feature (1)..(486): NCBI GI: 126363774 NCBI Desc: multi antimicrobial extrusion family protein [nicotiana tabacum]
  misc_feature (7)..(486): NCBI GI: 4835789 NCBI Desc: strong similarity to gi3367522 f8k4.9 from arabidopsis thaliana bac gbac004392. est gbw43487 comes from this gene
MGEGSINVIAPLLDIDESSGASEVLLQQEPVPWGVLARLAAWEAGNLWRISWASILTTLFSFTLSLVTQMFVGHLGELELAGASITNIGIQGLAYGVMIGMASAVQTVCGQAYGARRYAAMGIVCQRALVLQLATAIPIAFLYWYAGPFLRLIGQEADVAAAGQLYARGLMPQLLAFTLFSPMQRFLQAQNIVNPVAYITLAVLIFHTLASWLGVFVLGFGLLGAALILSFSWWVLVVLTWGYIVWSPACKETWTGLSLLAFRGLWGYAKLAFASAVMLALEIWYVQGFVLLTGFLPNSEIALDSLSICINYWNWDFNIMLGLSYAASIRVGNELGASHPKVARFSVIVVVVVSIAFSFLATLTVLILRYPLSTLYTSSATVIEAVISLMPLMAISIFLNGIQPILSGVAIGSGWQATVAYVNVGAYYLIGLPIGCVLGYKTSLGAAGIWWGLIIGVAVQTIALVILTARTNWDKEVEKAMQRLQQTAVVPVNDVIA

SEQ ID NO: 7217 - DNA, 2151 bp, Sorghum bicolor
  misc_feature: Ceres ANNOT ID no. 6074965
  misc_feature: Encodes the peptide sequence at SEQ ID NO 7218
atgtcagcgccgccctgtgacaccttgcccaccgctgccaacaacatccagccatttctcgtccttcacaaggctgctgcctcctcggtaccatcttcccgggctaagcaccagattcatacctcacagccatcctcacccaaccccaaatcagcaaacagatgtcgtcagccagcgggtgaggagtgtgaggacgaaggggatttggagctatacgagcagctgcgtgttgaggccttccaccggacctggtccaagatccaatccaccattgacgaggtcctcagggccatcaacctcaagctgtttgaccaggttctgcagtgggcaaaggagtccttcacctcagtccgtgccatcacggaaccgcaccgcactgaagtccagcagccgtaccctctcctgactgatgtgatctgcagaaggattcccacagcattcgtcctcaccaagaatgcggagtttgttgatgatatcacaacgtttcatgatcttgcagggcatatgaagtccaatggatgtcatgtagtcaagctgtcagcagctgaattatcagcaaaacatggagttggtggttgctttaggagcctgttgaggcagctactatccgatgttccagttgttgctgatgtatctgcgcttgcatcatggtattgtgaagctgggaactttgatcagcctatcattgtcataattgatgatttggagcaatgttctggtgatgtgctgggagagcttgtgatgatgctgagtgaatgggtgtttaaaattccagtcttctttgtaatggggatagcaactacccttgatgctccaaagaagcttctctcatcagaggcccttcaacgattagagccctgcaaacttaccttggggtctccctcagatagattgaatgcacttgttgaggccgtccttgttaaaccatgcactggattttgcatcagtcatgaagtcgcagtgttcctcagaaattacttttttaggcatgatgggacaataacttcttttattactgctctcaggcttgcatgctgtaagcacttctccatggaacctctaagctttttgtgcattggaatgctggaggaagattctgaggaattttggcgtgataagtttgaatcgctccctcaaacaatacggaaatatgcttttgatctaccctcatccaaaaatgcaaataattcaaacaattcttgcaacatggtagaaggattgtctaggctgatgaaattgcaaaaggattggagttctgttctcttgtgcctgtatgaagctggaagacaggacaaaatgcagcttttggatatcttctgtgaggcagccaacccagatttgcaaactgaaaattcaccagataattacttatgtgcctctaaagtgacttgtgaaaacttattaggagtaaagtcagggtctgctaaaggatttatagcccaagtaatgaatacaataaggtacttgcctacggaaattttgttacatgtccttgaagtttggagcatccatttaaaaggaatgagtgagatcaacgacagagtgaaggagcttcagtcaaccacaattggtgctgatagtgttaggaccaaaagaagatcaaccgccaatactggaaatggaacagttctactaaatgataaagtggctgcactattacaggatgtcattaggaaatatttggtacctgttgagtgcttgccttttcatgaaatcatctgcttcaagaatgttgacatcctccaatctgcgctgattggaaatccaagaagaatgattcaacttgatcttctgaagtcacagagccatctgaaatgttcttgttgcagcaggagtggtgctgctgtgtcaggatcgttgcatgacacatcaatcatgtgtaacctagcccaagaatatggtgatgtgattaaccttcatgattggtacacggcctttgaaggcattatcaagagcacaaattcaaaaggcaaacggaaatcttacagttctccctcgaagaagaaatcaaaacccacacctctggagggtgaaggtatgatccaagcaaggttttgcagagctgttactgagatgcaaatcactggccttcttcggatgccaagcaagagaaggcccgatcttgtgcagagaatcacgttcggtccttga

SEQ ID NO: 7218 - protein, 716 aa, Sorghum bicolor
  misc_feature: Ceres ANNOT ID no. 6074965
  misc_feature (36)..(357): Pfam Id: ORC3_N Pfam Desc: Origin recognition complex (ORC) subunit 3 N-terminus
  misc_feature (1)..(716): NCBI GI: 15866779 NCBI Desc: origin recognition complex subunit 3 [zea mays]
  misc_feature (1)..(715): NCBI GI: 28144537 NCBI Desc: origin recognition complex3 [oryza sativa (japonica cultivar-group)]
  misc_feature (1)..(715): NCBI GI: 115481914 NCBI Desc: os10g0402200 [oryza sativa (japonica cultivar-group)]
  misc_feature (545)..(714): NCBI GI: 108880045 NCBI Desc: origin recognition complex subunit [aedes aegypti]
  misc_feature (544)..(715): NCBI GI: 27735471 NCBI Desc: mgc53625 protein [xenopus laevis]
MSAPPCDTLPTAANNIQPFLVLHKAAASSVPSSRAKHQIHTSQPSSPNPKSANRCRQPAGEECEDEGDLELYEQLRVEAFHRTWSKIQSTIDEVLRAINLKLFDQVLQWAKESFTSVRAITEPHRTEVQQPYPLLTDVICRRIPTAFVLTKNAEFVDDITTFHDLAGHMKSNGCHVVKLSAAELSAKHGVGGCFRSLLRQLLSDVPVVADVSALASWYCEAGNFDQPIIVIIDDLEQCSGDVLGELVMMLSEWVFKIPVFFVMGIATTLDAPKKLLSSEALQRLEPCKLTLGSPSDRLNALVEAVLVKPCTGFCISHEVAVFLRNYFFRHDGTITSFITALRLACCKHFSMEPLSFLCIGMLEEDSEEFWRDKFESLPQTIRKYAFDLPSSKNANNSNNSCNMVEGLSRLMKLQKDWSSVLLCLYEAGRQDKMQLLDIFCEAANPDLQTENSPDNYLCASKVTCENLLGVKSGSAKGFIAQVMNTIRYLPTEILLHVLEVWSIHLKGMSEINDRVKELQSTTIGADSVRTKRRSTANTGNGTVLLNDKVAALLQDVIRKYLVPVECLPFHEIICFKNVDILQSALIGNPRRMIQLDLLKSQSHLKCSCCSRSGAAVSGSLHDTSIMCNLAQEYGDVINLHDWYTAFEGIIKSTNSKGKRKSYSSPSKKKSKPTPLEGEGMIQARFCRAVTEMQITGLLRMPSKRRPDLVQRITFGP

SEQ ID NO: 7219 - DNA, 1017 bp, Sorghum bicolor
  misc_feature: Ceres ANNOT ID no. 6074972
  misc_feature: Encodes the peptide sequence at SEQ ID NO 7220
atgccccaggtcgagtcggccgttgcctcggaggggccggcgccgccgcaggacgcatgggtcgtcgagttccgccgtctcctcccgcggtgggagtcactgcgcgattcctccaaggtcattatcccgatttcaatatctagggtcaaccagtttgatgctgcaaggctagatgttgagatgtctgccatgttgaaagagcagctactcaaggtgttctccttggtgaagccaggactcttgttccaatatgagcctgaactcgatgctttcctcgagttcctcatctggaggttctcaatttgggttgacaagccaaccccaggcaatgcactgatgaacctgaggtatagagatgaatgggcagcacccatcactggaaaagaagttagaacaggattggaaggacctgggctttctgtttctcaaaagatcttttattgtattagttttgttggtggccaatatatatggtcacgattacagtctttttctgctttccgtcgatggggcgattctgaacagagaccactagcacaccgtgcttggggcttagtgcagaatgctgaagtattgtacagggctgcttcgttatttaacctattattgtttcttcatggtggaaggtacaaaactattgtagagaggattctgaaagcaagacttgtctacgggagccccaacatgaacagagctgttagctttgagtacatgaatcggcagctggtctggaatgagttttcggaaatgttgcttttgcttctccccttgctaaactcatcctcagtaaagaagttccttctccccttctccaaagataagtcggcaggttcatctggcgatgaagcagattgtcctatatgtcggtccagtcctagcattccttttattgctcttccatgccaacacaggtattgctattactgcctacgcacacgttgttccgctacaagctcctatagatgcccacgctgtaacgaggtggtggttgcaattcaaagacaagggtctagttag

SEQ ID NO: 7220 - protein, 338 aa, Sorghum bicolor
  misc_feature: Ceres ANNOT ID no. 6074972
  misc_feature (54)..(273): Pfam Id: Pex2_Pex12 Pfam Desc: Pex2 / Pex12 amino terminal region
  misc_feature (285)..(325): Pfam Id: zf-C3HC4 Pfam Desc: Zinc finger, C3HC4 type (RING finger)
  misc_feature (15)..(336): NCBI GI: 92879457 NCBI Desc: zinc finger, ring-type; pex2 / pex12, n-terminal [medicago truncatula]
  misc_feature (15)..(252): NCBI GI: 7715595 NCBI Desc: f20b17.23 [arabidopsis thaliana]
  misc_feature (61)..(338): NCBI GI: 42572185 NCBI Desc: pex2/pex12 n-terminal domain-containing protein / zinc finger (c3hc4-type ring finger) family protein [arabidopsis thaliana]
  misc_feature (32)..(287): NCBI GI: 42761564 NCBI Desc: similar to rattus norvegicus (rat). peroxisome assembly factor-1 (paf-1) (peroxin-2) (peroxisomal membrane protein 3) [dictyostelium discoideum]
  misc_feature (46)..(333): NCBI GI: 62857417 NCBI Desc: loc549595 [xenopus tropicalis]
  misc_feature: Useful for making plants with modulated low light sensitivity
  misc_feature: GREAT-hit functional homolog of the protein sequence given in SEQ ID NO 13382
  misc_feature: Useful for making plants with modulated flowering time
  misc_feature: Useful for making plants with modulated low light sensitivity
  misc_feature: Functional homolog of the protein sequence given in SEQ ID NO 13382
MPQVESAVASEGPAPPQDAWVVEFRRLLPRWESLRDSSKVIIPISISRVNQFDAARLDVEMSAMLKEQLLKVFSLVKPGLLFQYEPELDAFLEFLIWRFSIWVDKPTPGNALMNLRYRDEWAAPITGKEVRTGLEGPGLSVSQKIFYCISFVGGQYIWSRLQSFSAFRRWGDSEQRPLAHRAWGLVQNAEVLYRAASLFNLLLFLHGGRYKTIVERILKARLVYGSPNMNRAVSFEYMNRQLVWNEFSEMLLLLLPLLNSSSVKKFLLPFSKDKSAGSSGDEADCPICRSSPSIPFIALPCQHRYCYYCLRTRCSATSSYRCPRCNEVVVAIQRQGSS

SEQ ID NO: 7221 - DNA, 2439 bp, Sorghum bicolor
  misc_feature: Ceres ANNOT ID no. 6074977
  misc_feature: Encodes the peptide sequence at SEQ ID NO 7222
atggcggcgaacggaacgtgcccggggccgatgaaggcgacgtcgcagggggcgttccagggggagaacccgctggactacgcgctgccgctggccatcgtccagatctgcctcgtcgtcgtcgtcacccgcggcctcgcctacctgctccgcccgctccgccagccccgcgtcatcgccgagatcatcggaggaattcttctaggcccatcggcgctggggcggagccacaagttcttgaacgccgtgttcccagctcagagcatgacggtgctggacacgctggccaacatcggcctgctcttcttcctgttcctcgtcggcctcgagctcgacatctccgcgatccgccgcaccggcaagaaggccctcgccattgcgctcgccggcatcagcgccccgttcgcgctcggcatcggcacgtcgttcgcgttccgtgccaccatcgtcaaaggcacgccgcagggcccgttcctcgtcttcatgggcgtggcgctctccatcaccgctttcccggtgctggcccgcatcctcgccgagctgaagcttctgaccacggacctcggtcgcatggccatgtccgccgcggcggtcaacgacgtcgccgcctggatcctgttggcgctggccatcgccctctccggtgacggctcgccgatcatctcgctgtgggtgctgctcaccgctgccggcttcgtcatcgccatctccctgttccttcgcccggtgcttgcctggatggcgcgccgctcccccgagggcgagcccgtcaaggaggtctacatctgcgccaccctcgccatcgtcctcggagctggtttcgtcaccgacactatcggcatccatgccctgttcggtgccttcatggtggggatcgtcgtccccaaggacgggccgttcgccggcgtcctcatcgagaaggtggaggatctcatctcggggctgttcctcccgctctacttcgtctccagcggcctcaagaccgacgtggcgaccatcaagggtgccaagtcctggggcctgctcgtgctcgtcatcgccaacgcttgcctcggcaagatcggcggcacggtgatcacgtccctgttcgttaagatccccgtccgtgaagccgtcactctcgggttcctcatgaacaccaaggggctcgtggagctgatcgtcctcaacatcggccgcgaccgcaaggtgctgaacgacgaggcgttcgccatcctggtgctcatggcgctgttcaccaccttcatcacgacgcccatcgtgatggccatctacaagccggcgcggcggacggtgccgtacaagcgccgcacggtggagtgcgtcgcccccggcgacgcggacagcgagctgcgcgtgctggcgtgcttccacaccagccgccacatccccacgctgctgaacctggtggaggcctcccggggcacggcgcgccgccgcctcgccctgtacgccatgcacctggtggagctctcggagcggtcgtcggccatcagccttgtgcagcgcgcgcgccgcgacgggatgcccttcttcaacggcaaggagcagcggacggagcaggtggtggtggcgttcgaggcgttccagcagctgagctccgtgcgggtgcgcgccatgacggccatctcggacctggacaccatccaccgggacgtgatcgacagcgccgccgacaagcgcgcggccatcgtggtgatgccgtaccacaaggcgctccaccacgacggcagcttcgtgtcgctggggtcggcgtaccacgccatcaacaagcgcgtcctccgcgaggcgccctgctcggtggccatcctcgtcgaccgcggcctcggagggcacgcacaggtgtcggccaagaacgtgtccttctccgtggcggcgctcttcttcggcgggcccgacgactgcgaggcgctcgcgtacgcgacgcgcatggccgagcacccgggcgtcgccgtgacgctggcgaggttccggccgacacggccgccgcagctggtggacgaggccgagagcgcggccgacgaggcggcggtggaggcgttcaaggccaaggtgggggccgtgaaggacgggtcggtgcggttcgaggagcccgaggcgtacaccagggagcaggtgctggagacgatcgagtcgctgtcgggattcaacgtgttcgtggtggggcggatgccgccggcggcgccgctggtggagaagcccgacgagctgggccccgtggggagctacctggtgtcgccggacttcaggacgtcggcgtccgtgctggtgatcaagaggtacgacccggcgaccaaccccaagagcaagaggttcgaccccaaggcgaggccgccggtggccacggaggaggatacgctggacgaggagatggggatgggcagctccaccgtggtgcccgtcatgcagtcgccgatgagcagcgacgacatcgtgtga

SEQ ID NO: 7222 - protein, 812 aa, Sorghum bicolor
  misc_feature: Ceres ANNOT ID no. 6074977
  misc_feature (36)..(423): Pfam Id: Na_H_Exchanger Pfam Desc: Sodium/hydrogen exchanger family
  misc_feature (64)..(809): NCBI GI: 115489590 NCBI Desc: os12g0616500 [oryza sativa (japonica cultivar-group)]
  misc_feature (5)..(768): NCBI GI: 9294151 NCBI Desc: na+/h+ exchangeing protein-like [arabidopsis thaliana]
  misc_feature (1)..(725): NCBI GI: 61658325 NCBI Desc: cation/h+ exchanger [arabidopsis thaliana]
  misc_feature (3)..(761): NCBI GI: 92870446 NCBI Desc: na+/h+ antiporter-like protein [medicago truncatula]
  misc_feature (3)..(761): NCBI GI: 92870445 NCBI Desc: na+/h+ antiporter-like protein [medicago truncatula]
  misc_feature: Useful for making plants with modulated heat sensitivity
  misc_feature: Functional homolog of the protein sequence given in SEQ ID NO 13975
  misc_feature: The sequence is a functional homolog of SEQ ID NO. 516 in the 11/188,298 US application
MAANGTCPGPMKATSQGAFQGENPLDYALPLAIVQICLVVVVTRGLAYLLRPLRQPRVIAEIIGGILLGPSALGRSHKFLNAVFPAQSMTVLDTLANIGLLFFLFLVGLELDISAIRRTGKKALAIALAGISAPFALGIGTSFAFRATIVKGTPQGPFLVFMGVALSITAFPVLARILAELKLLTTDLGRMAMSAAAVNDVAAWILLALAIALSGDGSPIISLWVLLTAAGFVIAISLFLRPVLAWMARRSPEGEPVKEVYICATLAIVLGAGFVTDTIGIHALFGAFMVGIVVPKDGPFAGVLIEKVEDLISGLFLPLYFVSSGLKTDVATIKGAKSWGLLVLVIANACLGKIGGTVITSLFVKIPVREAVTLGFLMNTKGLVELIVLNIGRDRKVLNDEAFAILVLMALFTTFITTPIVMAIYKPARRTVPYKRRTVECVAPGDADSELRVLACFHTSRHIPTLLNLVEASRGTARRRLALYAMHLVELSERSSAISLVQRARRDGMPFFNGKEQRTEQVVVAFEAFQQLSSVRVRAMTAISDLDTIHRDVIDSAADKRAAIVVMPYHKALHHDGSFVSLGSAYHAINKRVLREAPCSVAILVDRGLGGHAQVSAKNVSFSVAALFFGGPDDCEALAYATRMAEHPGVAVTLARFRPTRPPQLVDEAESAADEAAVEAFKAKVGAVKDGSVRFEEPEAYTREQVLETIESLSGFNVFVVGRMPPAAPLVEKPDELGPVGSYLVSPDFRTSASVLVIKRYDPATNPKSKRFDPKARPPVATEEDTLDEEMGMGSSTVVPVMQSPMSSDDIV

SEQ ID NO: 7223 - DNA, 927 bp, Sorghum bicolor
  misc_feature: Ceres ANNOT ID no. 6074978
  misc_feature: Encodes the peptide sequence at SEQ ID NO 7224
atggcgctccggccgctgcttcgcctcctcctcccatcgcctccccaccggaaccctccgccgcctccctcttccccacccgtcgcgtccaccagccgccgcgccgctgccgcagccgtcctcctgctctccgcggccgcttccgccccgccctcgcgctccgcccgcgccgagcccgagggcgaggacgtcgacgaggcccgcgtcgttcgcttgttccaggaggcgtcgccgtcggttgtgttcatcaaggacctcgtcgtcgcggggccgcagggccggggaggtggcggggaggaggacgatgacgagggggagggcggtggcgctaaggtggaggggacaggctcgggatttgtatgggactccgcgggccacattgtgacaaattaccacgtcgttgcaaaattagctggagatggatctgcctctcatcgctgcaaggtgtttttggaggattctagtggcaaaagttactcgaaggaagggagactaatagggtgtgatccagcgtatgatcttgcagttctgaagatagatgttgacagtgaccagctgaggcctgctctgattggcacatcacggagtttgcaagttgggcaaagctgctttgccattgggaacccttatggatatgaacacactctaactactggggttattagtggattggggagggagataccatctcccaatggcagagcgatccgtggggctatacagacagatgctgctataaatgctggtaactccggaggtccacttattgactcttatggccatgtgattggtgttaatacagctacattcacacgtaaaggatctgggatctcatccggggtgaactttgccatccccatcgacactgtggtacagtcggtccccaacctaatagtatacgggacctctgtgagcaacaggttttaa

SEQ ID NO: 7224 - protein, 308 aa, Sorghum bicolor
  misc_feature: Ceres ANNOT ID no. 6074978
  misc_feature (96)..(294): Pfam Id: Trypsin Pfam Desc: Trypsin
  misc_feature (149)..(308): NCBI GI: 115489592 NCBI Desc: os12g0616600 [oryza sativa (japonica cultivar-group)]
  misc_feature (113)..(301): NCBI GI: 92877899 NCBI Desc: peptidase s1 and s6, chymotrypsin/hap [medicago truncatula]
  misc_feature (113)..(301): NCBI GI: 2565436 NCBI Desc: degp protease precursor [arabidopsis thaliana]
  misc_feature (114)..(301): NCBI GI: 93451322 NCBI Desc: peptidase s1 and s6, chymotrypsin/hap:pdz/dhr/glgf [delta proteobacterium mlms-1]
  misc_feature (114)..(301): NCBI GI: 93454347 NCBI Desc: peptidase s1 and s6, chymotrypsin/hap:pdz/dhr/glgf [delta proteobacterium mlms-1]
MALRPLLRLLLPSPPHRNPPPPPSSPPVASTSRRAAAAAVLLLSAAASAPPSRSARAEPEGEDVDEARVVRLFQEASPSVVFIKDLVVAGPQGRGGGGEEDDDEGEGGGAKVEGTGSGFVWDSAGHIVTNYHVVAKLAGDGSASHRCKVFLEDSSGKSYSKEGRLIGCDPAYDLAVLKIDVDSDQLRPALIGTSRSLQVGQSCFAIGNPYGYEHTLTTGVISGLGREIPSPNGRAIRGAIQTDAAINAGNSGGPLIDSYGHVIGVNTATFTRKGSGISSGVNFAIPIDTVVQSVPNLIVYGTSVSNRF

SEQ ID NO: 7225 - DNA, 1200 bp, Sorghum bicolor
  misc_feature: Ceres ANNOT ID no. 6074984
  misc_feature: Encodes the peptide sequence at SEQ ID NO 7226
atggcggccgctgcgtcctccgcgctgcacgccgtcggcgccgtcgcctccgccaagcccagatccgccgccccagcggtggcgaggaggaggagcgtgcgcgtggcggcgggggcggcggccaagggaggaccgggctcttcgggaagaggcaggctggtggctcgcaacgccgttgcagccaaggcggatgaggcggccgcggcggcgggatccaagtcgggcggccatgagttgctgttgtttgaggcccttcgcgaagccttgatagaagagatgaatttggatccaacagtgtgtgtcatgggtgaagatgttggtcactatggaggttcatacaaggtgaccaaagggttggctgagatgtttggagatcttcgggttcttgatacccctattgctgagaactccttcactggcatgggagttggagcagcaatgaaagggctcaggcctgttgtggaaggcatgaacatgggtttccttctccttgcctacaaccagatctcaaacaactgtggcatgcttcactacacctcaggtggtcagttcaagatcccgattgtgatccgaggtcccggtggtgttggtcgtcaacttggtgctgagcactcacagcggctggagtcatacttccagtcaatccctggccttcaaatggttgcttgctccactccttacaacgccaagggcctgatgaaggcagccataaggagcgagaacccagtggtgctgtttgagcacgtcctcctatacaacctgaaggagaaaatccccgatgaggaatacatctgttgccttgaggaggcagagatggtgcgcccaggtgagcacgtgaccatcctcacgtactcccgcatgaggtaccatgtgatgcaggccgccaagacgctggtgaacaaagggtacgaccccgaggtcatcgacatcaggtcgctcaagccgttcgacctgcacaccatcgggaactcgatcaagaagacccaccgtgtgctgattgtggaggagtgcatgcggacgggtggcattggcgccagcctcaggtcggccatcatcgacaacttctgggactacctggatgcccccatcatgtgcctgtcgtcgcaggacgtgccgaccccgtacgccgcaacgctggaggacgcgactgtcgtgcagcctgcgcagatcgtggccgctgttgagcagatctgccaataa

SEQ ID NO: 7226 - protein, 399 aa, Sorghum bicolor
  misc_feature: Ceres ANNOT ID no. 6074984
  misc_feature (77)..(255): Pfam Id: Transket_pyr Pfam Desc: Transketolase, pyrimidine binding domain
  misc_feature (268)..(390): Pfam Id: Transketolase_C Pfam Desc: Transketolase, C-terminal domain
  misc_feature (2)..(399): NCBI GI: 77557068 NCBI Desc: pyruvate dehydrogenase e1 beta subunit [oryza sativa (japonica cultivar-group)]
  misc_feature (113)..(399): NCBI GI: 2982328 NCBI Desc: pyruvate dehydrogenase e1 beta subunit [picea mariana]
  misc_feature (78)..(398): NCBI GI: 61393567 NCBI Desc: beta subunit of pyruvate dehydrogenase e1 component [staurastrum punctulatum]
  misc_feature (78)..(399): NCBI GI: 61393681 NCBI Desc: beta subunit of pyruvate dehydrogenase e1 component [zygnema circumcarinatum]
  misc_feature (78)..(399): NCBI GI: 146331046 NCBI Desc: pyruvate dehydrogenase e1 component subunit beta
  misc_feature (78)..(398): SWISSPROT Homolog: EC 1.2.4.1 Pyruvate dehydrogenase E1 component subunit beta
MAAAASSALHAVGAVASAKPRSAAPAVARRRSVRVAAGAAAKGGPGSSGRGRLVARNAVAAKADEAAAAAGSKSGGHELLLFEALREALIEEMNLDPTVCVMGEDVGHYGGSYKVTKGLAEMFGDLRVLDTPIAENSFTGMGVGAAMKGLRPVVEGMNMGFLLLAYNQISNNCGMLHYTSGGQFKIPIVIRGPGGVGRQLGAEHSQRLESYFQSIPGLQMVACSTPYNAKGLMKAAIRSENPVVLFEHVLLYNLKEKIPDEEYICCLEEAEMVRPGEHVTILTYSRMRYHVMQAAKTLVNKGYDPEVIDIRSLKPFDLHTIGNSIKKTHRVLIVEECMRTGGIGASLRSAIIDNFWDYLDAPIMCLSSQDVPTPYAATLEDATVVQPAQIVAAVEQICQ

SEQ ID NO: 7227 - DNA, 1299 bp, Sorghum bicolor
  misc_feature: Ceres ANNOT ID no. 6074986
  misc_feature: Encodes the peptide sequence at SEQ ID NO 7228
atgactgttggatcacgtgtggtggtgatagacaatgggggtggtcttctcaaggctggatttggtggagacaatgatccaattgctgttgtccccaactgtatggccaaaccccctggtggcaatgccaattccaaaaaatggctggttgctgatcagctgcaggcagaagatgtcgacgtgactggcatgacactgaagcgtcctattgatcgtggctatctcatcaataccgaggtgcagaaggaggtgtgggaacgggttttacgcaatcttctccaggttgatcctaccaactcatccctattactggtggagccattgtttaaccctccagcgctacaacatgcaactgatgagctggtgttcgaggagtttggcttcaactctctttgtgttgcagatagtccttcccttgtccacctttatgaggctagccgtcaaccaatgctcttccgtgctcagtgcagccttgttgttgactgtggcttctctttcactcatgcatcccctgtgcttcagaactttactctgaattatggcgttcgacgtatggaccttggtggcaaggcccttacaaattatctcaaggagcttgtctcatatcgttcccttaatgtcatggatgaaactctcctcattgatgatgcaaaggaaaagctatgctttgtgtcgcttgatgtccctggtgatcttcaccttgccaggttatcatttaaggacaacccttttaggtgttcttacattctccccgatggtataacatacaagaaagggtttgtcaaggacatgaatgaagcacatagatatcgctctctgcctcttgatgaagaagcaaagagaaaagaacatagcatggatataaataagtccgaggaccggaaaaagccagaattaagtcaaaatgaatttgtattgacaaatgaaaggttccttgtcccagagatgctttttcatccaatcgatcttggcataaatcaagctggacttgctgagtgtatagttcgtgctgtacaagcttgccatccatatcttcaacctgtgcttttcgagagcatcatcttgacaggtggaagcacactgttccccagattcgctgatagactggagagggaacttcggcctcttgtccctgacaactacaaggttaaaataactcatcaagaagacccaattcttggtgtctggagaggcggatctattctggcatcaactcctgatttcgaatcaatgtgcactacaaagtctgagtacgaggagatgggatcagcaaggtgccgacgaaggtttttccactga

SEQ ID NO: 7228 - protein, 432 aa, Sorghum bicolor
  misc_feature: Ceres ANNOT ID no. 6074986
  misc_feature (2)..(431): Pfam Id: Actin Pfam Desc: Actin
  misc_feature (5)..(432): NCBI GI: 75214753 NCBI Desc: actin-related protein 6 [capsella rubella]
  misc_feature (3)..(432): NCBI GI: 21427467 NCBI Desc: actin-related protein 6 [arabidopsis thaliana]
  misc_feature (5)..(432): NCBI GI: 75223625 NCBI Desc: actin-related protein 6 [arabidopsis arenosa]
  misc_feature (5)..(432): NCBI GI: 75214617 NCBI Desc: actin-related protein 6 [olimarabidopsis pumila]
  misc_feature (8)..(272): NCBI GI: 62897479 NCBI Desc: arp6 actin-related protein 6 homolog [homo sapiens]
  misc_feature: Useful for making plants with modulated flowering time
  misc_feature: GREAT-hit functional homolog of the protein sequence given in SEQ ID NO 13389
  misc_feature: Useful for making plants with modulated flowering time
  misc_feature: Functional homolog of the protein sequence given in SEQ ID NO 13389
MTVGSRVVVIDNGGGLLKAGFGGDNDPIAVVPNCMAKPPGGNANSKKWLVADQLQAEDVDVTGMTLKRPIDRGYLINTEVQKEVWERVLRNLLQVDPTNSSLLLVEPLFNPPALQHATDELVFEEFGFNSLCVADSPSLVHLYEASRQPMLFRAQCSLVVDCGFSFTHASPVLQNFTLNYGVRRMDLGGKALTNYLKELVSYRSLNVMDETLLIDDAKEKLCFVSLDVPGDLHLARLSFKDNPFRCSYILPDGITYKKGFVKDMNEAHRYRSLPLDEEAKRKEHSMDINKSEDRKKPELSQNEFVLTNERFLVPEMLFHPIDLGINQAGLAECIVRAVQACHPYLQPVLFESIILTGGSTLFPRFADRLERELRPLVPDNYKVKITHQEDPILGVWRGGSILASTPDFESMCTTKSEYEEMGSARCRRRFFH

SEQ ID NO: 7229 - DNA, 642 bp, Sorghum bicolor
  misc_feature: Ceres ANNOT ID no. 6074990
  misc_feature: Encodes the peptide sequence at SEQ ID NO 7230
atggagaagcctcctcctcctccttgtcgtcctcatcctccagccactgccaccaatgtcgacgacgacgacgacgactatgtcgtccacctgtcactgaagctaggccccagctcgccgccacgccgctcctctcctcgtcctgccgtcgtcgtttcagacggtgccgccgctggtaatgccggcagcggcagcggcgccggcgcgaggctcttcccgtgcctcttctgcagcaagaagttcgtcacgtcgcaggcgctcaggggccatcagaacgcgcatcggaaggagaggaggagcgtggggcggaacgatggtggtgcccagcggcggcatcatctctactacgacgacatccaggaggccacgccggcgacgacctccattaccacgggcatgctacggctgccgccgccggcggcctgggtggccaccccggtctcgcactcatgcacgccgccaccgcacggcggacaccctcgtcgaggccaccacatggacggcgacggcgacgacctggcagtagtagcatttggagcggcgcctcatcatcgttgcacagccgtcgatgacgaccacaaagacagccatggcgatgagaagcaaatagcgcaggttgttgatctcgatttgaagctctag

SEQ ID NO: 7230 - protein, 213 aa, Sorghum bicolor
  misc_feature: Ceres ANNOT ID no. 6074990
  misc_feature (54)..(182): NCBI GI: 51536147 NCBI Desc: zinc finger protein-like [oryza sativa (japonica cultivar-group)]
  misc_feature (54)..(182): NCBI GI: 115479419 NCBI Desc: os09g0445500 [oryza sativa (japonica cultivar-group)]
  misc_feature (55)..(104): NCBI GI: 115455775 NCBI Desc: os03g0786400 [oryza sativa (japonica cultivar-group)]
  misc_feature (52)..(150): NCBI GI: 9755451 NCBI Desc: zinc finger protein zep6 [arabidopsis thaliana]
  misc_feature (70)..(139): NCBI GI: 124360460 NCBI Desc: histone h4; zinc finger, c2h2-type [medicago truncatula]
  misc_feature: The plant flowers significantly late compared to wild-type.
  misc_feature: The sequence is a functional homolog of SEQ ID NO 10 in the 10/412,699US patent application
  misc_feature: The sequence is a functional homolog of SEQ ID NO 1090 in the 10/412,699US patent application
  misc_feature: The sequence is a functional homolog of SEQ ID NO 1091 in the 10/412,699US patent application
  misc_feature: The sequence is a functional homolog of SEQ ID NO 1094 in the 10/412,699US patent application
  misc_feature: The sequence is a functional homolog of SEQ ID NO 124 in the 11/479,226US patent application
  misc_feature: The sequence is a functional homolog of SEQ ID NO 1279 in the 10/666,642US patent application
  misc_feature: The sequence is a functional homolog of SEQ ID NO 635 in the 10/374,780US patent application
  misc_feature: The sequence is a functional homolog of SEQ ID NO 636 in the 10/374,780US patent application
  misc_feature: The sequence is a functional homolog of SEQ ID NO 639 in the 10/374,780US patent application
  misc_feature: The sequence is a functional homolog of SEQ ID NO 760 in the 10/666,642US patent application
  misc_feature: The sequence is a functional homolog of SEQ ID NO 763 in the 10/666,642US patent application
  misc_feature: Useful for making plants with modulated flowering time
  misc_feature: Useful for making plants with modulated growth and phenotype characteristics
  misc_feature: The sequence is a functional homolog of SEQ ID NO 10 in the 20040045049 US patent application
  misc_feature: The sequence is a functional homolog of SEQ ID NO 1090 in the 20040045049 US patent application
  misc_feature: The sequence is a functional homolog of SEQ ID NO 1091 in the 20040045049 US patent application
  misc_feature: The sequence is a functional homolog of SEQ ID NO 1094 in the 20040045049 US patent application
  misc_feature: Functional homolog of the protein sequence given in SEQ ID NO 13533
MEKPPPPPCRPHPPATATNVDDDDDDYVVHLSLKLGPSSPPRRSSPRPAVVVSDGAAAGNAGSGSGAGARLFPCLFCSKKFVTSQALRGHQNAHRKERRSVGRNDGGAQRRHHLYYDDIQEATPATTSITTGMLRLPPPAAWVATPVSHSCTPPPHGGHPRRGHHMDGDGDDLAVVAFGAAPHHRCTAVDDDHKDSHGDEKQIAQVVDLDLKL

SEQ ID NO: 7231 - DNA, 3006 bp, Sorghum bicolor
  misc_feature: Ceres ANNOT ID no. 6075006
  misc_feature: Encodes the peptide sequence at SEQ ID NO 7232
atggacgtggactcgcgcatggcgaccgagtccgactccgactccgacgcgcgcggcggcggcggaggcggcggcggcgggtcagggtccgggagcgagacccccacggcgtccccgtccccgtcccagtccccatccgcgtccccgtcgccgtccgcgcccgggacacccacggccgcggctccggccgcgtctccggggccggtggcggggcccaggccggcgccgggttacacggtggtggacgccgcgatggacaagaaggaggacgggccggggtgccggtgcggccacacgctcacggcagtgccggcagtcggggaggaaggctcgcccgggtatgtgggcccccgcctgatactctttggtggtgccaccgctcttgagggcaactctgccacgccgccctcgtcggctgggagcgccgggatccatgtccattgttatgatgtgttgtcaaataagtggaccaggcttactccacttggtgaacctccttcaccaagagctgcacatgtagccactgctgttgggaccatggtggtcattcagggtggaattggccctgctggcttatctgctgaggaccttcatgttttggatcttacacaacaacgaccgcgatggcatagagtggtggttcaaggtcctggtcctggtccacggtatggacatgtgatggctttggttgggcagcgattcttattgacaattggtggcaatgatggaaaacggcccctggcagatgtatgggcccttgatactgcggctaagccatatgagtggagaaaacttgagccagaaggtgaagggccaccaccatgcatgtatgcaactgctagtgcccgttctgatggcctccttttgctttgtggtggaagggatgccaatagtgtgcccctatcaagtgcatatgggctcgctaagcatagagatgggcgttgggagtgggcaattgcacctggtgtgtctccatcacccagataccaacatgcagctgtttttgtcaatgcacggcttcatgtctcaggaggtgctctcgggggtggtcgcatggtagaagactcctcaagcgttgcagtattggacactgctgctggagtttggtgtgataccaaatcagtagttacaactccaaggacaggaagatatagtgcagacgcagcaggcggtgatgcttctgtagagcttacacggcggtgcaggcatgcagctgccgctgttggtgatttgatatttgtttatggaggtttacggggaggtgtgctgctagatgacctcctagttgctgaagatcttgctgctgctgaaacaaccagtgcagctaatcatgcagcagcagctgctgcatccgcaaatgtacaaagagaacctggtagatatgcctacaatgatgatcaatcaggacaaacagttactgtttcaagtcctgatggagctgttgttcttgggactccagttgctcctccggtcaatggagacatgtatactgatattagtcctgagaatgccattatacagggacagagaagattgagcaaaggtgttgattatttggttgaagcatcagctgcagaggctgaggcaatcagtgctactctagctgctgtaaaggctaggcaagttaacggagagatggagcattcgcctgacagggaacagtctccagatgctgcaccaagtaccaagcaaaattcaagcctcataaaaccagatgctgctcttgtgaacaattcaacaccacctcctggggttcggttgcaccatagagcagttgtggttgcagcagaaactggaggtgccttaggtggcatggttaggcagctgtcgattgaccagtttgagaatgaaggtagaagggtcatttatggcacccctgagaatgcaactgcggcaaggaaattactagatcggcaaatgtctattaatagtgtgcccaaaaaggtaattgcttctcttctgaaacctcgtggttggaagccccctgtgcgaaggcagttctttcttgattgcaatgagattgcagatctatgtgatagtgctgaaagaatattttcaagtgaacctagcgtcttacagcttaaagctcccattaagatatttggtgatctgcatggtcaatttggtgatctcatgcgcttatttgatgaatacggtgctccttcaacagctggagacattgcttacattgattatcttttcttgggagattatgtcgatcgtggtcagcatagtctggagacaatcagtcttctccttgcactgaaggttgaatatcctcataatgtacatttaattcgagggaatcatgaagcagcggatatcaatgctctttttgggttccgaatagagtgcatagagagaatgggtgagcgggatggtatctggacctggcatcgtgtgaacaggttatttaattggcttcctttggctgccctaatagaaaagaagataatttgtatgcatggtggtattggtcggtccatcaaccatatagagcaaattgaaaatcttcaaagaccaattaccatggaagctggctcagttgttctgatggatcttctatggtctgatccaactgagaatgacagcgtagagggactcaggccaaatgcacggggccctggtcttgttacctttgggcctgatagagttatggagttctgcaacaacaatgacctgcagttgattgtgcgagcacatgagtgtgtgatggatggctttgagcgtttcgctcaaggtcacttgatcactcttttctcggctacaaattactgtggaacggcaaacaacgcaggtgcaatcttagttctcggaagggatctggtggttgttccaaaactcatccatcctttgccgcctgccattacatcacctgagacatctccggagcatcatattgaggacacatggatgcaggagttgaatgccaacagaccgccaacaccaaccaggggccgccctcaagcacccaacaatgaccgaggctcccttgcctggatatag

SEQ ID NO: 7232 - protein, 1001 aa, Sorghum bicolor
  misc_feature: Ceres ANNOT ID no. 6075006
  misc_feature (696)..(905): Pfam Id: Metallophos Pfam Desc: Calcineurin-like phosphoesterase
  misc_feature (327)..(376): Pfam Id: Kelch_2 Pfam Desc: Kelch motif
  misc_feature (1)..(1001): NCBI GI: 110832776 NCBI Desc: serine/threonine protein phosphatase bsl2 homolog (bsu1-like protein 2 homolog)
  misc_feature (1)..(1001): NCBI GI: 42569377 NCBI Desc: kelch repeat-containing serine/threonine phosphoesterase family protein [arabidopsis thaliana]
  misc_feature (1)..(1001): NCBI GI: 92876063 NCBI Desc: dna topoisomerase ii; serine/threonine-specific protein phosphatase and bis(5-nucleosyl)-tetraphosphatase [medicago truncatula]
  misc_feature (38)..(1001): NCBI GI: 15223207 NCBI Desc: kelch repeat-containing protein / serine/threonine phosphoesterase family protein [arabidopsis thaliana]
  misc_feature (10)..(1001): NCBI GI: 140040351 NCBI Desc: dna topoisomerase ii; serine/threonine-specific protein phosphatase and bis(5-nucleosyl)-tetraphosphatase [medicago truncatula]
  misc_feature (1)..(1001): SWISSPROT Homolog: EC 3.1.3.16 Serine/threonine-protein phosphatase BSL2 homolog
  misc_feature: The sequence is a functional homolog of SEQ ID NO. 354 in the 11/188,298 US application
MDVDSRMATESDSDSDARGGGGGGGGGSGSGSETPTASPSPSQSPSASPSPSAPGTPTAAAPAASPGPVAGPRPAPGYTVVDAAMDKKEDGPGCRCGHTLTAVPAVGEEGSPGYVGPRLILFGGATALEGNSATPPSSAGSAGIHVHCYDVLSNKWTRLTPLGEPPSPRAAHVATAVGTMVVIQGGIGPAGLSAEDLHVLDLTQQRPRWHRVVVQGPGPGPRYGHVMALVGQRFLLTIGGNDGKRPLADVWALDTAAKPYEWRKLEPEGEGPPPCMYATASARSDGLLLLCGGRDANSVPLSSAYGLAKHRDGRWEWAIAPGVSPSPRYQHAAVFVNARLHVSGGALGGGRMVEDSSSVAVLDTAAGVWCDTKSVVTTPRTGRYSADAAGGDASVELTRRCRHAAAAVGDLIFVYGGLRGGVLLDDLLVAEDLAAAETTSAANHAAAAAASANVQREPGRYAYNDDQSGQTVTVSSPDGAVVLGTPVAPPVNGDMYTDISPENAIIQGQRRLSKGVDYLVEASAAEAEAISATLAAVKARQVNGEMEHSPDREQSPDAAPSTKQNSSLIKPDAALVNNSTPPPGVRLHHRAVVVAAETGGALGGMVRQLSIDQFENEGRRVIYGTPENATAARKLLDRQMSINSVPKKVIASLLKPRGWKPPVRRQFFLDCNEIADLCDSAERIFSSEPSVLQLKAPIKIFGDLHGQFGDLMRLFDEYGAPSTAGDIAYIDYLFLGDYVDRGQHSLETISLLLALKVEYPHNVHLIRGNHEAADINALFGFRIECIERMGERDGIWTWHRVNRLFNWLPLAALIEKKIICMHGGIGRSINHIEQIENLQRPITMEAGSVVLMDLLWSDPTENDSVEGLRPNARGPGLVTFGPDRVMEFCNNNDLQLIVRAHECVMDGFERFAQGHLITLFSATNYCGTANNAGAILVLGRDLVVVPKLIHPLPPAITSPETSPEHHIEDTWMQELNANRPPTPTRGRPQAPNNDRGSLAWI

SEQ ID NO: 7233 - DNA, 561 bp, Sorghum bicolor
  misc_feature: Ceres ANNOT ID no. 6075039
  misc_feature: Encodes the peptide sequence at SEQ ID NO 7234
atgggaaacaagagaacaaaagtgatcggcatgcaggtgagtgtcccggggaatagcatgctcaacatcgtgacagttcggtgtggacactgcacaaatctactgtcagtaaacctgagagcactgatgcactcactcccagaacaagatcagctccaggagaatatcaaggtccatggcgtcaatggcaccttgcatgatcagtgcggccatttggagctcggttcttcttcgtcctcaaagttccgacttccaatgatgtactcgccgcaaaacgagcacctgctgcaggaacaaacactgaataatgctcgtcctccagagaagaggcaacgggttccatcggcgtataacaggttcatcaaggaagagatacgcaggatcaaggcgaacaaccccgacattagccacagggaagccttcagcacagcagccaagaattgggcacattatccaaatatccatttcggtttaaactccggacgagagggtggcaagaagctcgtggatgaggctgttgcagcagcaccggctccgaaaaagatccaaggtttctactga

SEQ ID NO: 7234 - protein, 186 aa, Sorghum bicolor
  misc_feature: Ceres ANNOT ID no. 6075039
  misc_feature (11)..(158): Pfam Id: YABBY Pfam Desc: YABBY protein
  misc_feature (11)..(186): NCBI GI: 77557107 NCBI Desc: yabby protein [oryza sativa (japonica cultivar-group)]
  misc_feature (13)..(186): NCBI GI: 144905064 NCBI Desc: yabby2 like protein [ruscus aculeatus]
  misc_feature (11)..(186): NCBI GI: 140040331 NCBI Desc: yabby protein [medicago truncatula]
  misc_feature (11)..(186): NCBI GI: 41745658 NCBI Desc: yabby2-like transcription factor yab2 [antirrhinum majus]
  misc_feature (11)..(173): NCBI GI: 55771072 NCBI Desc: yabby2 like protein [amborella trichopoda]
  misc_feature: The sequence is a functional homolog of SEQ ID NO 1151 in the 10/666,642US patent application
  misc_feature: The sequence is a functional homolog of SEQ ID NO 1506 in the 10/666,642US patent application
  misc_feature: The sequence is a functional homolog of SEQ ID NO 420 in the 10/666,642US patent application
  misc_feature: Useful for making plants with modulated growth and phenotype characteristics
  misc_feature: The sequence is a functional homolog of SEQ ID NO 1151 in the 20070033671 US patent application
  misc_feature: The sequence is a functional homolog of SEQ ID NO 1506 in the 20070033671 US patent application
MGNKRTKVIGMQVSVPGNSMLNIVTVRCGHCTNLLSVNLRALMHSLPEQDQLQENIKVHGVNGTLHDQCGHLELGSSSSSKFRLPMMYSPQNEHLLQEQTLNNARPPEKRQRVPSAYNRFIKEEIRRIKANNPDISHREAFSTAAKNWAHYPNIHFGLNSGREGGKKLVDEAVAAAPAPKKIQGFY

SEQ ID NO: 7235 - DNA, 1875 bp, Sorghum bicolor
  misc_feature: Ceres ANNOT ID no. 6075052
  misc_feature: Encodes the peptide sequence at SEQ ID NO 7236
atgggcagcggggtccgggcgctgatgcgccggaagcaggtggactcggagcggacgcgcgccgccggcagcgcccaccagctccgcaaggagctctccgtcacccagctcgtcgccatcggtgttgggtcaacgattggagccggggtgtatgtccttgttgggacagttgcccgggagcattctgggccggcattgacactttcatttctgatagccggaatagcagctgcactttcagcattctgctatgcagagcttgctagccgttgcccttcagcaggaagcgcctaccattattcatacatctgcgttggcgaaggagttgcatggttgattggttgggctttgatacttgaatatacgattggtggatcagctgttgcccgtggcatatctcccaatctagccatcttttttggaggacaggatagtctgccatggattttggcacggcatcagatcccatggcttgatgttgttgttgatccttgtgctgctttcctggttttcgttgtcacaggtctgctatgcgtggggataaaagagagttcatttgtgcaaggagttgtgacagtcctaaattgctttgtgatgctatttgttatcatagccggtagttacatcggcttccaaacaggatgggttggctacaaggttgctggcggatttttcccttatggagcaaatggaatgcttgccgggtcagcaactgtcttctttgcctacataggctttgattcagttgccagcactgctgaggaggtgaagaatccacaacgagatctgccattgggaatcggaacagcattgtcgatttgctgtaccttgtacatgttggtttcagttgttattgttggtctggtaccatactttgctatggacccagacaccccaatttcatctgcctttgccaaacatgggatgcactgggcaatgtatcttgtaacaactggtgctgttcttgctctctgttcaaccttgatgggatctatattgccacagccaagaatattgatggccatggcacgagatggcctgttaccatcgttcttctctgatgtccacaagacgacacaagttccagtcaaaagcacaatagtgactggcatctgcgcagctgctcttgctttctttatggatgtctctcaactggctggaatggttagtgtaggcacactactcgcgttcactatagttgctgtgtccatcttgattcttaggtatgttcctccaaatgaggtacccctcccatcttccctgcaagtatcattccgcttgagccaagaaaatgacgaggaaaagctgaggggtacccttggagacaatgatcatgaacaagggtcagctgaaataagtgatgttgtagtagaatcaattaatgaccccctcattgagaagcagctgtacgcaagcaatttgaatgagacaaaacggcgtaagactgctgcatgcagcattgcatctatctgcataggggttctgatcctcacaacttcagcttcagcgacattcttgcccttcctggtgacatgcttcgtttgtgcttttggtggcctgctcctcctagctggtctgggcatgctctgctggattgaccaagatgatgggaggcactcctttggccattccggaggattcatctgtccattcgttcccttgctgccggtaatgtgtatcctcataaatacatacttgttaatcaatcttggtggcggcacatggatgcgagtgggggtgtggctggtgatgggggtgttcgtctacattttctatggccgcacccacagctcattgacagatgtcgtgtatgtccctgtggctgaggcgaatgagatatatgggtcaccctcttcatcagggtttgtggcgtaa

SEQ ID NO: 7236 - protein, 624 aa, Sorghum bicolor
  misc_feature: Ceres ANNOT ID no. 6075052
  misc_feature (36)..(487): Pfam Id: AA_permease Pfam Desc: Amino acid permease
  misc_feature (2)..(624): NCBI GI: 77556625 NCBI Desc: amino acid permease [oryza sativa (japonica cultivar-group)]
  misc_feature (2)..(546): NCBI GI: 77556626 NCBI Desc: amino acid permease [oryza sativa (japonica cultivar-group)]
  misc_feature (2)..(507): NCBI GI: 77556627 NCBI Desc: amino acid permease [oryza sativa (japonica cultivar-group)]
  misc_feature (5)..(614): NCBI GI: 13605811 NCBI Desc: at5g36940/mlf18_60 [arabidopsis thaliana]
  misc_feature (1)..(613): NCBI GI: 10178213 NCBI Desc: cationic amino acid transporter-like protein [arabidopsis thaliana]
  misc_feature: The sequence is a functional homolog of SEQ ID NO. 472 in the 11/188,298 US application
  misc_feature: The sequence is a functional homolog of SEQ ID NO. 510 in the 11/188,298 US application
  misc_feature: The sequence is a functional homolog of SEQ ID NO. 297 in the 11/188,298 US application
MGSGVRALMRRKQVDSERTRAAGSAHQLRKELSVTQLVAIGVGSTIGAGVYVLVGTVAREHSGPALTLSFLIAGIAAALSAFCYAELASRCPSAGSAYHYSYICVGEGVAWLIGWALILEYTIGGSAVARGISPNLAIFFGGQDSLPWILARHQIPWLDVVVDPCAAFLVFVVTGLLCVGIKESSFVQGVVTVLNCFVMLFVIIAGSYIGFQTGWVGYKVAGGFFPYGANGMLAGSATVFFAYIGFDSVASTAEEVKNPQRDLPLGIGTALSICCTLYMLVSVVIVGLVPYFAMDPDTPISSAFAKHGMHWAMYLVTTGAVLALCSTLMGSILPQPRILMAMARDGLLPSFFSDVHKTTQVPVKSTIVTGICAAALAFFMDVSQLAGMVSVGTLLAFTIVAVSILILRYVPPNEVPLPSSLQVSFRLSQENDEEKLRGTLGDNDHEQGSAEISDVVVESINDPLIEKQLYASNLNETKRRKTAACSIASICIGVLILTTSASATFLPFLVTCFVCAFGGLLLLAGLGMLCWIDQDDGRHSFGHSGGFICPFVPLLPVMCILINTYLLINLGGGTWMRVGVWLVMGVFVYIFYGRTHSSLTDVVYVPVAEANEIYGSPSSSGFVA

SEQ ID NO: 7237 - DNA, 1032 bp, Sorghum bicolor
  misc_feature: Ceres ANNOT ID no. 6075055
  misc_feature: Encodes the peptide sequence at SEQ ID NO 7238
atgtcgcgactcctcttctacctcctcatctgcctgttctgcgccggccgtcggcagatcgttggtacggcagcggccgggaccatccacgtccggagacgagccttcgacttcatccctctacccttcggcgtcaccggcgccgagagtctggccttcgaccgcagtggccaaggtccttacaccggtgtctcggacggccgtgtcctgagatgggatggcagcggccgcggctggacgaccttcgcctatagcaagaattatgcccacaacccattttgcagagcctccacggcgcgtccgggcgacgccgaggtcgtctgcggccgtccactggggctccaattcgacatcaggacgggcgacctgtacatcgccgatgcctaccacgggctgctgagggtcggtccggccggcggtgaggccgaggtggtggcggctcaggccgatggcaaggcgttcaacttcctcaacggcgtcgacgtcgaccaatccaccggagatgtgtacttcacagatagcagcacatcatacacgcgtctgcatggcgcgctgatctttctaacccatgagtcctctggccggctgatgaagtacgacgcgcgggccaagcgcgtgatagtgctcaaggatggtctacccttccccaatggcgttgcacttagcgccgaccggacgcaccttgtggtggcgcacacatggccatgccagctgttcaggtactggctggaagggactaaggctggcacctatgagctcttcgccgacttgcctggttacccagacaacatcaggcgcgataacagagtaggctattgggtggcgctcaaccaaaagaagcttgatggcgagaccatggagcatatcgtcggtgtacacctagacgtaaagggcaagcagcttgaggagatgaccgcggaggacaagagggtcactctttcagacattgtggaagaggacgttaaactgtggttgggatcggtggaactagactacatcatcgttgttgatcagacactagattgttattaa

SEQ ID NO: 7238 - protein, 343 aa, Sorghum bicolor
  misc_feature: Ceres ANNOT ID no. 6075055
  misc_feature (158)..(246): Pfam Id: Str_synth Pfam Desc: Strictosidine synthase
  misc_feature (49)..(307): Pfam Id: SGL Pfam Desc: SMP-30/Gluconolaconase/LRE-like region
  misc_feature (39)..(333): NCBI GI: 115478879 NCBI Desc: os09g0374900 [oryza sativa (japonica cultivar-group)]
  misc_feature (44)..(280): NCBI GI: 30694556 NCBI Desc: strictosidine synthase family protein [arabidopsis thaliana]
  misc_feature (45)..(280): NCBI GI: 115455371 NCBI Desc: os03g0750700 [oryza sativa (japonica cultivar-group)]
  misc_feature (45)..(280): NCBI GI: 140040327 NCBI Desc: strictosidine synthase [medicago truncatula]
  misc_feature (31)..(277): NCBI GI: 14028757 NCBI Desc: male fertility protein [zea mays]
MSRLLFYLLICLFCAGRRQIVGTAAAGTIHVRRRAFDFIPLPFGVTGAESLAFDRSGQGPYTGVSDGRVLRWDGSGRGWTTFAYSKNYAHNPFCRASTARPGDAEVVCGRPLGLQFDIRTGDLYIADAYHGLLRVGPAGGEAEVVAAQADGKAFNFLNGVDVDQSTGDVYFTDSSTSYTRLHGALIFLTHESSGRLMKYDARAKRVIVLKDGLPFPNGVALSADRTHLVVAHTWPCQLFRYWLEGTKAGTYELFADLPGYPDNIRRDNRVGYWVALNQKKLDGETMEHIVGVHLDVKGKQLEEMTAEDKRVTLSDIVEEDVKLWLGSVELDYIIVVDQTLDCY

SEQ ID NO: 7239 - DNA, 1038 bp, Sorghum bicolor
  misc_feature: Ceres ANNOT ID no. 6075060
  misc_feature: Encodes the peptide sequence at SEQ ID NO 7240
atgtcgtcacgcattctcttcctcctctgcttgcttcagatcgtttttacggcggccaggaacatccacgtcccaaagtatggctccagcaccgccgccgccgccttcgatttcatctctctaccgggtggtgtcaccggcgccgagagcctggccttcgaccgcagaggccagggtccctacgccggcgtctcggacggccgcgtgctcaggtggggcggcagcggccgtggctggacgaccttcgcctacagcactagctacgcccacaacccgtcttgcaaggcctctccggcgcgtccgggcgacaccgaggacgtctgtggccgcccccttgggctccagttcaacatcaggaccggcgatctgtacatcgccgacgcctaccacgggcttctcaaggttggcccggcaggcggtgaggccaaggtggtggcagccaaggccgacggtggcgcgttcaccttcgtcaacggcgtcgacatcgaccagtccaccggcgatgtgtacttcacggacagcagcacgtcgtacacgcggcggcacaacacggatatcatgacaaaccgtgacgcctccggccggctgatgaagtacgacgcacggggcaagcgtgttattgttctcaaggatgctctaccctaccctaatggtgtcgcagttagcaccgacagaacacacgtcgtggtggctcatacagggccgtgccaattgttcaggttctttattaaagggcctaaagcgggaacctatgagctctttgctgacttgcctggctacccagacaatatcaggcgtgacgcaaaaggaggctactgggttgcgcttaacagggagaagatcgatggagaggcgatagcggctggcaaacacatcgtcggtgtacgcctagattcaaagggcgtgcaacgcgatgagatgacggcagaggacaagagcgtcacactgtctgatgtctcagataaagatgacaagctttggttgggttccgtcgaactcgactacgtcgtagctgtagacccgaagttattaaattag

SEQ ID NO: 7240 - protein, 345 aa, Sorghum bicolor
  misc_feature: Ceres ANNOT ID no. 6075060
  misc_feature (158)..(246): Pfam Id: Str_synth Pfam Desc: Strictosidine synthase
  misc_feature (49)..(310): Pfam Id: SGL Pfam Desc: SMP-30/Gluconolaconase/LRE-like region
  misc_feature (6)..(336): NCBI GI: 115478879 NCBI Desc: os09g0374900 [oryza sativa (japonica cultivar-group)]
  misc_feature (44)..(280): NCBI GI: 30694556 NCBI Desc: strictosidine synthase family protein [arabidopsis thaliana]
  misc_feature (39)..(277): NCBI GI: 115455371 NCBI Desc: os03g0750700 [oryza sativa (japonica cultivar-group)]
  misc_feature (45)..(277): NCBI GI: 140040327 NCBI Desc: strictosidine synthase [medicago truncatula]
  misc_feature (43)..(277): NCBI GI: 14028757 NCBI Desc: male fertility protein [zea mays]
MSSRILFLLCLLQIVFTAARNIHVPKYGSSTAAAAFDFISLPGGVTGAESLAFDRRGQGPYAGVSDGRVLRWGGSGRGWTTFAYSTSYAHNPSCKASPARPGDTEDVCGRPLGLQFNIRTGDLYIADAYHGLLKVGPAGGEAKVVAAKADGGAFTFVNGVDIDQSTGDVYFTDSSTSYTRRHNTDIMTNRDASGRLMKYDARGKRVIVLKDALPYPNGVAVSTDRTHVVVAHTGPCQLFRFFIKGPKAGTYELFADLPGYPDNIRRDAKGGYWVALNREKIDGEAIAAGKHIVGVRLDSKGVQRDEMTAEDKSVTLSDVSDKDDKLWLGSVELDYVVAVDPKLLN

SEQ ID NO: 7241 - DNA, 2301 bp, Sorghum bicolor
  misc_feature: Ceres ANNOT ID no. 6075078
  misc_feature: Encodes the peptide sequence at SEQ ID NO 7242
  misc_feature: Down-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
atggcgtcccacattgttggataccctcgcatgggccccaagagggagctcaagtttgcccttgagtctttctgggatgggaagagcaccgctgaggatcttgagaaggttgctaccgacctcagggccagtatctggaagcagatggctgatgctgggatcaagtacatccccagcaacaccttctcctactacgaccaggtccttgacaccaccgccatgctcggcgctgtcccagaacgttactcatggactggaggagagatcgggttcgatacctacttctccatggctaggggcaatgccactgtccctgctatggagatgaccaagtggtttgacaccaactaccactttattgtccctgaattgggccctaacaccaagttctcctacgcttctcacaaggctgttaacgaatacaaggaggctaaggcgcttggggttgataccgtgccagtacttattggaccagtctcataccttttgctctcaaagcctgccaagggtgtggagaagggattccctcttctttcccttcttagcagcatcctccctgtttacaaggaggtcattgctgagttgaaggcagctggggcttcatggattcagtttgatgagcccactcttgtcctcgaccttgattctaacaaattggctgcgttctctgctgcatacgcagaactggaatctgcactttctggattgaatgtgcttgttgagacttactttgctgatgttcccgctgaatcatacaagaccctaacatctctgagcggtgtgactgcttatggttttgatcttgtccgtggaacccaaactcttggacttgtcacgagtgctggtttccctgctggaaagtacctctttgctggtgttgtggatggacgcaacatctgggctgatgatcttgctacatctctcagcactctccagtctcttgaggctgttgttgggaaggacaagcttgttgtatcaacttcctgctcactcatgcacaccgctgtggatcttgtgaacgagactaagcttgacagtgagattaagtcgtggcttgcatttgctgcccaaaaggtggttgaggttgatgctcttgcgaaggcattggctggtcaaaaggatgaggcttactttgcagcaaatgctgctgctcaggcatcaaggaaatcctctccccgtgtgaccaatgaagaagtccagaaggctgctgctgctctcaagggctctgaccaccgccgtgcaaccaccgttagtgctagattggatgcccagcagaaggagctcaacctccctgtccttcccacgaccacaattggttcgttcccacagactgtggagctcaggagggtccgccgtgagtacaaggcgaaaaagatctctgaggaggagtacatcagtgccatcaaggaggaaatcagcaaggttgttaagctccaagaagagcttgacatcgatgtgcttgtgcatggcgagcctgagagaaacgatatggttgagtactttggtgagcagctctctggttttgcattcactgccaatggctgggtgcaatcttacggatcaaggtgtgtcaagccaccgatcatctacggtgatgtgagccgccccaaccccatgaccgttttctggtcaaagacggcccagagcatgacatctcgcccaatgaagggaatgttgactggtccagtaacaatccttaactggtcctttgtgcggaatgaccagccaagatttgagacttgctaccagattgctcttgcgatcaagaaggaggttgaggatcttgaggctgctggtattaaggttatccaaatcgatgaggctgcattgagagaaggtctgccactccgcaaggctgagcacgctttctacttggactgggccgtccactccttcagaatcaccaactgtgaaatccaggacaccacccagatccacacccacatgtgctactccaacttcaacgacatcatccactccatcattgacatggacgccgatgtgatcaccatcgagaactcccggtctgacgagaagctcctctccgtcttccgtgagggtgtgaagtacggtgctggcattggccctggtgtctacgacatccactcccccaggatcccgtccaccgaggagattgccgaccgcgtcaacaagatgcttgcggtgctcgacaccaacatcctctgggtgaaccctgactgtggtctcaagacccgtaagtacgcggaggtcaagcccgccctaaccaacatggtctctgctgccaagctcatccgcacccagctcgccagtgccaagtga

SEQ ID NO: 7242 - protein, 766 aa, Sorghum bicolor
  misc_feature: Ceres ANNOT ID no. 6075078
  misc_feature (433)..(757): Pfam Id: Meth_synt_2 Pfam Desc: Cobalamin-independent synthase, Catalytic domain
  misc_feature (2)..(319): Pfam Id: Meth_synt_1 Pfam Desc: Cobalamin-independent synthase, N-terminal domain
  misc_feature (1)..(766): NCBI GI: 17017263 NCBI Desc: methionine synthase [zea mays]
  misc_feature (1)..(766): NCBI GI: 77556633 NCBI Desc: 5-methyltetrahydropteroyltriglutamate--homocysteine s-methyltransferase [oryza sativa (japonica cultivar-group)]
  misc_feature (1)..(766): NCBI GI: 68655500 NCBI Desc: methionine synthase 2 enzyme [hordeum vulgare subsp. vulgare]
  misc_feature (1)..(766): NCBI GI: 18483235 NCBI Desc: methionine synthase protein [sorghum bicolor]
  misc_feature (1)..(766): NCBI GI: 68655495 NCBI Desc: methionine synthase 1 enzyme [hordeum vulgare subsp. vulgare]
  misc_feature (1)..(766): SWISSPROT Homolog: EC 2.1.1.14 5-methyltetrahydropteroyltriglutamate--homocysteine methyltransferase
  misc_feature: Useful for making plants with altered cell wall content and/or composition
  misc_feature: GREAT-hit functional homolog of the protein sequence encoded by LOCUS at5g17920
  misc_feature: Useful for making plants with altered cell wall content and/or composition
  misc_feature: Functional homolog of the protein sequence given in SEQ ID NO 13984
  misc_feature: Down-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
MASHIVGYPRMGPKRELKFALESFWDGKSTAEDLEKVATDLRASIWKQMADAGIKYIPSNTFSYYDQVLDTTAMLGAVPERYSWTGGEIGFDTYFSMARGNATVPAMEMTKWFDTNYHFIVPELGPNTKFSYASHKAVNEYKEAKALGVDTVPVLIGPVSYLLLSKPAKGVEKGFPLLSLLSSILPVYKEVIAELKAAGASWIQFDEPTLVLDLDSNKLAAFSAAYAELESALSGLNVLVETYFADVPAESYKTLTSLSGVTAYGFDLVRGTQTLGLVTSAGFPAGKYLFAGVVDGRNIWADDLATSLSTLQSLEAVVGKDKLVVSTSCSLMHTAVDLVNETKLDSEIKSWLAFAAQKVVEVDALAKALAGQKDEAYFAANAAAQASRKSSPRVTNEEVQKAAAALKGSDHRRATTVSARLDAQQKELNLPVLPTTTIGSFPQTVELRRVRREYKAKKISEEEYISAIKEEISKVVKLQEELDIDVLVHGEPERNDMVEYFGEQLSGFAFTANGWVQSYGSRCVKPPIIYGDVSRPNPMTVFWSKTAQSMTSRPMKGMLTGPVTILNWSFVRNDQPRFETCYQIALAIKKEVEDLEAAGIKVIQIDEAALREGLPLRKAEHAFYLDWAVHSFRITNCEIQDTTQIHTHMCYSNFNDIIHSIIDMDADVITIENSRSDEKLLSVFREGVKYGAGIGPGVYDIHSPRIPSTEEIADRVNKMLAVLDTNILWVNPDCGLKTRKYAEVKPALTNMVSAAKLIRTQLASAK

SEQ ID NO: 7243 - DNA, 909 bp, Sorghum bicolor
  misc_feature: Ceres ANNOT ID no. 6075088
  misc_feature: Encodes the peptide sequence at SEQ ID NO 7244
atggacgtgcacccggcgaatgcggcggccgactccctcggagacctgttcccgcaccagcccgccggtttggagagtgatgagagcaacatacaatggctctctggctacgtagaggactgcttttcaagctccacatcctacacaaatcctgtttttgcaagatcggcaagccagggtgctgagaaaccaaagttaccgccaccttcatcttccaatggcaggagaaagaaaaggagcctggcctctgttatgaccaacgacgatgatcaacaatacatcatcccattgtatgttgagccaccgctaatcctaattgatcagaaacattggatggcagagagtgagctgatcctccccaagaaagacaaagaccaagaggtttgccagcaacaagggcaggaagagaagtgtgagaagggtgtgcggcggctggtgaagaggtgtagcaattgtttgtcatgccaaacaccacgatggagggatgggccatcggggccccagatgctgtgcaatgcatgtggcctgaggcttaagccagagaataggtttgccaccatttctgaggagcattgtggccaagaaaccaagaaagaacaagaaccaggagcacagcgagataagaagaagaagacgatgaagaagacatatgtgaatgacgccctgaccctgtcgtcagatcaggcagagaagcgctgcacccattgcttgtcctccaagaccccacagtggagagccggacctttgggaccgaagactctttgcaatgcctgtggcgtgaggtacaagtccggcaggctgctgcccgagtataggcctgccaacagcccgacttttatgagctgcatacactccaactctcacaagaaggtaatgcagatgaggcaggctgttgcccagcagcagtga

SEQ ID NO: 7244 - protein, 302 aa, Sorghum bicolor
  misc_feature: Ceres ANNOT ID no. 6075088
  misc_feature (149)..(184): Pfam Id: GATA Pfam Desc: GATA zinc finger
  misc_feature (233)..(268): Pfam Id: GATA Pfam Desc: GATA zinc finger
  misc_feature (205)..(301): NCBI GI: 8778844 NCBI Desc: t6d22.9 [arabidopsis thaliana]
  misc_feature (231)..(298): NCBI GI: 124365580 NCBI Desc: zinc finger, gata-type [medicago truncatula]
  misc_feature (230)..(300): NCBI GI: 115487540 NCBI Desc: os12g0168800 [oryza sativa (japonica cultivar-group)]
  misc_feature (210)..(302): NCBI GI: 2959736 NCBI Desc: homologous to gata-binding transcription factors [arabidopsis thaliana]
  misc_feature (188)..(298): NCBI GI: 37572443 NCBI Desc: ag-motif binding protein-1 [nicotiana tabacum]
  misc_feature: The plant flowers significantly late compared to wild-type.
  misc_feature: The plant is abnormally large.
  misc_feature: The sequence is a functional homolog of SEQ ID NO 10 in the 10/225,066US patent application
  misc_feature: The sequence is a functional homolog of SEQ ID NO 1032 in the 10/666,642US patent application
  misc_feature: The sequence is a functional homolog of SEQ ID NO 1078 in the 10/225,066US patent application
  misc_feature: The sequence is a functional homolog of SEQ ID NO 136 in the 11/375,241US patent application
  misc_feature: The sequence is a functional homolog of SEQ ID NO 1655 in the 10/374,780US patent application
  misc_feature: The sequence is a functional homolog of SEQ ID NO 1656 in the 10/374,780US patent application
  misc_feature: The sequence is a functional homolog of SEQ ID NO 1657 in the 10/374,780US patent application
  misc_feature: The sequence is a functional homolog of SEQ ID NO 1873 in the 11/479,226US patent application
  misc_feature: The sequence is a functional homolog of SEQ ID NO 2868 in the 10/374,780US patent application
  misc_feature: The sequence is a functional homolog of SEQ ID NO 304 in the 10/374,780US patent application
  misc_feature: The sequence is a functional homolog of SEQ ID NO 607 in the 10/374,780US patent application
  misc_feature: The sequence is a functional homolog of SEQ ID NO 608 in the 10/374,780US patent application
  misc_feature: The sequence is a functional homolog of SEQ ID NO 609 in the 10/374,780US patent application
  misc_feature: The sequence is a functional homolog of SEQ ID NO 838 in the 10/225,066US patent application
  misc_feature: Useful for making plants with altered alkaloid content
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 12975
  misc_feature: GREAT-hit functional homolog of the protein sequence given in SEQ ID NO 13019
  misc_feature: The sequence is a functional homolog of SEQ ID NO 10 in the 20050160493 US patent application
  misc_feature: The sequence is a functional homolog of SEQ ID NO 1078 in the 20050160493 US patent application
  misc_feature: The sequence is a functional homolog of SEQ ID NO 1655 in the 20060162006 US patent application
  misc_feature: The sequence is a functional homolog of SEQ ID NO 1656 in the 20060162006 US patent application
  misc_feature: The sequence is a functional homolog of SEQ ID NO 1657 in the 20060162006 US patent application
  misc_feature: The sequence is a functional homolog of SEQ ID NO 607 in the 20060162006 US patent application
  misc_feature: The sequence is a functional homolog of SEQ ID NO 608 in the 20060162006 US patent application
  misc_feature: The sequence is a functional homolog of SEQ ID NO 609 in the 20060162006 US patent application
  misc_feature: The sequence is a functional homolog of SEQ ID NO 1032 in the 20070033671 US patent application
  misc_feature: Useful for making plants with modulated flowering time
  misc_feature: Functional homolog of the protein sequence given in SEQ ID NO 13019
  misc_feature: The sequence is a functional homolog of SEQ ID NO 609 in the 10/374,780 US patent application
MDVHPANAAADSLGDLFPHQPAGLESDESNIQWLSGYVEDCFSSSTSYTNPVFARSASQGAEKPKLPPPSSSNGRRKKRSLASVMTNDDDQQYIIPLYVEPPLILIDQKHWMAESELILPKKDKDQEVCQQQGQEEKCEKGVRRLVKRCSNCLSCQTPRWRDGPSGPQMLCNACGLRLKPENRFATISEEHCGQETKKEQEPGAQRDKKKKTMKKTYVNDALTLSSDQAEKRCTHCLSSKTPQWRAGPLGPKTLCNACGVRYKSGRLLPEYRPANSPTFMSCIHSNSHKKVMQMRQAVAQQQ

SEQ ID NO: 7245 - DNA, 714 bp, Sorghum bicolor
  misc_feature: Ceres ANNOT ID no. 6075123
  misc_feature: Encodes the peptide sequence at SEQ ID NO 7246
atggtcgcagcagcctttactgtggatctggacaagcctctagtattccaggttggccatctagaggagcagtatcaggagtgggttcaccagccaattgttagcaaggaagggccacgattttttgaaaatgatatattggagttcttaacccgcacgaaatggtgggcagttccacttatctggttgcctgttgtctgttggtgcctgagtacttctatccagatgggcaatacaattacagatgtagctatgatgactgtgtttggaatatttctgtggacactgatcgaatatgtggtacaccgattcttgttccacataaaaaccaaaagttactggggaaacacagcgcattatctccttcatggatgccatcacaaacatccgatggatggacttcgacttgtttttccaccagctgctgcagctattttgtgctttccgttctggaacatgatcaagctattttcgaccccatctacaactcctggtctatttggaggtggcctgttgggttacgtgatctatgattgcacacactactacctgcatcatggccggccatcatcagatcctgcaaaatatctcaagaagtaccatctcaaccatcacttcagaattcaaaccaagggctttggaataacttcgaccctgtgggatcatgtatttggcacactgccttctaccaaaactgtcgacaagaccgtttga

SEQ ID NO: 7246 - protein, 237 aa, Sorghum bicolor
  misc_feature: Ceres ANNOT ID no. 6075123
  misc_feature (87)..(206): Pfam Id: FA_hydroxylase Pfam Desc: Fatty acid hydroxylase
  misc_feature (1)..(235): NCBI GI: 115489684 NCBI Desc: os12g0628400 [oryza sativa (japonica cultivar-group)]
  misc_feature (1)..(235): NCBI GI: 23308163 NCBI Desc: at2g34770/t29f13.2 [arabidopsis thaliana]
  misc_feature (88)..(234): NCBI GI: 54038699 NCBI Desc: loc398669 protein [xenopus laevis]
  misc_feature (88)..(234): NCBI GI: 32766618 NCBI Desc: loc398669 protein [xenopus laevis]
  misc_feature (8)..(235): NCBI GI: 44979987 NCBI Desc: aal183wp [eremothecium gossypii]
MVAAAFTVDLDKPLVFQVGHLEEQYQEWVHQPIVSKEGPRFFENDILEFLTRTKWWAVPLIWLPVVCWCLSTSIQMGNTITDVAMMTVFGIFLWTLIEYVVHRFLFHIKTKSYWGNTAHYLLHGCHHKHPMDGLRLVFPPAAAAILCFPFWNMIKLFSTPSTTPGLFGGGLLGYVIYDCTHYYLHHGRPSSDPAKYLKKYHLNHHFRIQTKGFGITSTLWDHVFGTLPSTKTVDKTV

SEQ ID NO: 7247 - DNA, 2475 bp, Sorghum bicolor
  misc_feature: Ceres ANNOT ID no. 6075154
  misc_feature: Encodes the peptide sequence at SEQ ID NO 7248
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
atggtctgcagctgctttgttcatcgagttatgaccaagtctgatgttgactggcttggctatgtggatactcattctacctcagggtatgttgtaattttgggtgaaaaattgatctcctggtcgtcaaagcgttggctggcgcttgtggaagggatcgaggaaagcgtgggtgtgggcaagggcagcaccaagatatatgccaccattgatctggagaagacccgcgtcgggcgtacacgtatcatctccaacgagcccgtcaatcctcgctggtacgagtccttccacatctactgcgcacacagggcggccaacgtaatcttcactgtcaagatcgacaaccccattggggcctcactcatcgggagggcttacatgcctgtggcagacatcctggtaggagaggagattgacaagtggcttgaaatctgtgatgacaagcgtgagcctattggacacagcaagatccatgtgaagattcagtactttgatgtttccaaggactgcaattgggcgaggggtgttcagagcaagaagtaccctggtgttccttacaccttcttctcgcagaggcaagggtgtaaggttactctataccaggacgctcatgtccccgacaactttgttcctaggatccctcttgctgatggcaagaactacgagccacaaaggtgctgggaggatatctttgatgccataagcaaggcccagcatttgatttacatcactggttggtctgtgtacacagagatcaccttggttagggacaccaacaggccaaaaccaggaggtgatgttactcttggggagttgctcaaaaggaaggccagtgaaggtgtccgggtccttatgttagtgtgggatgataggacttcagtcggcctgcttaagaaggatggtcatatggctacccatgatgaggagactgcaaattacttccatggcacggacgtcaactgtgttctgtgcggtcgcaaccctgatgattctggaagcttggttcaggatctgcagatatcaactatgttcacgcaccatcagaagatagtagtagttgaccatgagctgccaaaccatggctcccagcggaggaggatagtcagcttcattggtggcattgacctttgtgatggaaggtatgatacccagtatcactccttgtttaggacacttgacactgtccatcatgatgacttcaaccagccaaactttgggggtggatcaatcaagaaaggtggtccaagagagccatggcatgatattcattcaaggcttgaagggccaattgcttgggatgttctttacaactttgagcagagatggaggaagcagggtggcaaggacctccttgtacgtctcagggatctttctgacattattattcccccatctcctgtgatgttcccggaggacagagaaacatggaatgttcagctcttcagatccattgatggtggtgctgcttttggtttccctgagactcctgaggatgctgcaagagctggtcttgtgagtggaaaggatcaaatcatcgaccggagtatccaggatgcatacataaatgctatccggagggcgaagaacttcatctacattgagaatcagtacttccttggaagttcatatggctggaagccccaaggcatcaagccggaagaaattggtgctcttcacttgattccgaaggagctctcattgaagattgtcagcaagattgaagctggggaacgttttactgtttatgttgtggtgccaatgtggcctgagggtgttccagaaagtttttctgttcagccaattcttgactggcaaaggagaacaatggagatgatgtacactgacatcacacaagctctccatgccaagggaatcgaagcaaaccccaaggactatctcactttcttctgcttaggtaaccgtgaggtgaagcaggagggagaatatgaacccgaggaacacccagaacctgatactgattacatccgtgctcaagagtctaggaggtttatgatctatgttcatagcaaaatgatgatagtggatgacgagtacatcatcgttgggtccgccaacatcaaccagaggtccatggacggtgccagggactctgaaatcgccatgggcgcgtaccagccgtaccacctggcaaccaagcagcctgcccggggccagatccacggcttccggatgtctctgtggtacgagcacctgggaatgctggatgatgtcttccagcaccctgagagcatggagtgtgtgcagaaggtgaacaggatcgctgacaagtattgggatctgtacacaagcgatgacctcgagcaggatctcccaggccacctcctcagctaccccatcggtgtcactgccgatggcactgttactgcactgccggggatggacaacttccccgacacccgtgcccgtgtccttggcaacaagacgatttacatcccgaccattctcaccacatag

SEQ ID NO: 7248 - protein, 824 aa, Sorghum bicolor
  misc_feature: Ceres ANNOT ID no. 6075154
  misc_feature (342)..(380): Pfam Id: PLDc Pfam Desc: Phospholipase D Active site motif
  misc_feature (670)..(697): Pfam Id: PLDc Pfam Desc: Phospholipase D Active site motif
  misc_feature (49)..(126): Pfam Id: C2 Pfam Desc: C2 domain
  misc_feature (49)..(824): NCBI GI: 1020409 NCBI Desc: phospholipase d [zea mays]
  misc_feature (40)..(824): NCBI GI: 108935871 NCBI Desc: phospholipase d alpha 1 precursor (pld alpha 1) (choline phosphatase 1) (phosphatidylcholine-hydrolyzing phospholipase d 1)
  misc_feature (40)..(824): NCBI GI: 115434790 NCBI Desc: os01g0172400 [oryza sativa (japonica cultivar-group)]
  misc_feature (40)..(824): NCBI GI: 1902903 NCBI Desc: phospholipase d [oryza sativa (japonica cultivar-group)]
  misc_feature (49)..(824): NCBI GI: 46906221 NCBI Desc: phospholipase d2 [papaver somniferum]
  misc_feature (49)..(824): SWISSPROT Homolog: EC 3.1.4.4 Phospholipase D alpha 1
  misc_feature: Down-regulated in root tissues in response to methyl jasmonate treatment
  misc_feature: Down-regulated in shoot tissues in response to methyl jasmonate treatment
  misc_feature: Down-regulated in shoot tissues in response to salicylic acid treatment
MVCSCFVHRVMTKSDVDWLGYVDTHSTSGYVVILGEKLISWSSKRWLALVEGIEESVGVGKGSTKIYATIDLEKTRVGRTRIISNEPVNPRWYESFHIYCAHRAANVIFTVKIDNPIGASLIGRAYMPVADILVGEEIDKWLEICDDKREPIGHSKIHVKIQYFDVSKDCNWARGVQSKKYPGVPYTFFSQRQGCKVTLYQDAHVPDNFVPRIPLADGKNYEPQRCWEDIFDAISKAQHLIYITGWSVYTEITLVRDTNRPKPGGDVTLGELLKRKASEGVRVLMLVWDDRTSVGLLKKDGHMATHDEETANYFHGTDVNCVLCGRNPDDSGSLVQDLQISTMFTHHQKIVVVDHELPNHGSQRRRIVSFIGGIDLCDGRYDTQYHSLFRTLDTVHHDDFNQPNFGGGSIKKGGPREPWHDIHSRLEGPIAWDVLYNFEQRWRKQGGKDLLVRLRDLSDIIIPPSPVMFPEDRETWNVQLFRSIDGGAAFGFPETPEDAARAGLVSGKDQIIDRSIQDAYINAIRRAKNFIYIENQYFLGSSYGWKPQGIKPEEIGALHLIPKELSLKIVSKIEAGERFTVYVVVPMWPEGVPESFSVQPILDWQRRTMEMMYTDITQALHAKGIEANPKDYLTFFCLGNREVKQEGEYEPEEHPEPDTDYIRAQESRRFMIYVHSKMMIVDDEYIIVGSANINQRSMDGARDSEIAMGAYQPYHLATKQPARGQIHGFRMSLWYEHLGMLDDVFQHPESMECVQKVNRIADKYWDLYTSDDLEQDLPGHLLSYPIGVTADGTVTALPGMDNFPDTRARVLGNKTIYIPTILTT

SEQ ID NO: 7249 - DNA, 1485 bp, Sorghum bicolor
  misc_feature: Ceres ANNOT ID no. 6075177
  misc_feature: Encodes the peptide sequence at SEQ ID NO 7250
atggcgtcgtcgtgtatcgctggacttctcttgctgctcgccgcctgcgccgacgacaccgccgtcgtcgggctcgccacgcctgtcgagtacgagtaccacagttatgtggtaactcctctgtctccgcacccatatagcgcgccggcggctgccgacgacaacttctctgtgtcatcgtcgtcggctctgcacattcacctgctccaccgcgactcgttcgcagtgaacgccaccgcagctgagctcctcgcacgccgcctgcagcgagacgagctgagggcagcgtggatcatctcgaaagctgctgccaacggtacgccgccgccggtcgttgggctctccaccggacgcgggctcgtggcgccggtggtgtccagggcgccgacgagcggggagtacatggccaagatcgcggtgggcacgccggccgtccaggcgctgctggcgctggacacggccagcgacctcacgtggctgcagtgccagccatgccggcggtgctacccgcagtccgggcccgtgttcgacccgcggcactcgacgtcgtacggcgagatgaattacgacgcgccggactgtcaagcgctgggacggtccggcggcggcgacgcgaagcgcgggacgtgcatctacaccgtgcaatacggggacgggcacggctccacgtccacgtcggtgggtgacctcgtcgaggagacgctgaccttcgccggcggcgtccggcaggcctacctgtccatcggctgcggccatgacaacaagggcctgttcggtgcgccggcggcggggatcctagggctcggccgcggccagatatcgatcccgcaccagatcgcctttctcggctacaacgcgagcttctcctactgcctcgtcgacttcatctccggcccgggctccccctcctccactctcaccttcggtgccggcgccgtggacacctctccgccggcgtccttcacccccacggtcctcaaccagaacatgcccacgttctactacgtgcggctcatcggcgtcagcgtaggcggcgtgcgcgtgccgggcgtcactgagcgcgacctccagctagacccatacacgggtcgcggcggcgtcatcctggactccggcaccaccgtgacgcggctcgcccgcccagcgtacgtcgcgttccgtgacgccttccgtgccgcggcaaccagtctcggccaggtctccaccggcggcccctccggcttatttgatacgtgctacaccgtgggtggcagagcgggcgtgaaggtgcccgctgtgtcaatgcacttcgccggcggcgtggaggtgagtctccagcccaagaactacctcatccccgtcgactccaggggcaccgtctgcttcgcgttcgccggcaccggcgaccgtagcgtttcagtcatcggcaacatcttgcagcaggggttccgcgtcgtgtacgacctcgctggccagcgcgttgggttcgcgcccaataactgctga

SEQ ID NO: 7250 - protein, 494 aa, Sorghum bicolor
  misc_feature: Ceres ANNOT ID no. 6075177
  misc_feature (133)..(492): Pfam Id: Asp Pfam Desc: Eukaryotic aspartyl protease
  misc_feature (9)..(494): NCBI GI: 15290061 NCBI Desc: nucleoid dna-binding protein cnd41-like [oryza sativa (japonica cultivar-group)]
  misc_feature (35)..(494): NCBI GI: 47777372 NCBI Desc: unknow protein [oryza sativa (japonica cultivar-group)]
  misc_feature (115)..(494): NCBI GI: 18461217 NCBI Desc: p0690b02.2 [oryza sativa (japonica cultivar-group)]
  misc_feature (9)..(308): NCBI GI: 38344196 NCBI Desc: osjnba0064g10.12 [oryza sativa (japonica cultivar-group)]
  misc_feature (123)..(494): NCBI GI: 24430421 NCBI Desc: 41 kd chloroplast nucleoid dna binding protein (cnd41) [nicotiana sylvestris]
MASSCIAGLLLLLAACADDTAVVGLATPVEYEYHSYVVTPLSPHPYSAPAAADDNFSVSSSSALHIHLLHRDSFAVNATAAELLARRLQRDELRAAWIISKAAANGTPPPVVGLSTGRGLVAPVVSRAPTSGEYMAKIAVGTPAVQALLALDTASDLTWLQCQPCRRCYPQSGPVFDPRHSTSYGEMNYDAPDCQALGRSGGGDAKRGTCIYTVQYGDGHGSTSTSVGDLVEETLTFAGGVRQAYLSIGCGHDNKGLFGAPAAGILGLGRGQISIPHQIAFLGYNASFSYCLVDFISGPGSPSSTLTFGAGAVDTSPPASFTPTVLNQNMPTFYYVRLIGVSVGGVRVPGVTERDLQLDPYTGRGGVILDSGTTVTRLARPAYVAFRDAFRAAATSLGQVSTGGPSGLFDTCYTVGGRAGVKVPAVSMHFAGGVEVSLQPKNYLIPVDSRGTVCFAFAGTGDRSVSVIGNILQQGFRVVYDLAGQRVGFAPNNC

SEQ ID NO: 7251 - DNA, 1482 bp, Sorghum bicolor
  misc_feature: Ceres ANNOT ID no. 6075178
  misc_feature: Encodes the peptide sequence at SEQ ID NO 7252
atggcgtcgtcgtgtattctcctgctgctcgccgccgccgccgggctcgccacgcctgtggagtaccagtaccacagttatgcggtaactcctctgtctccacacacatatagcgtccctgctgccgacgacgacggcgctcgcgcgcggcaggaggacgtcgctgtgtcgccgtcagctctccacgttcgcctgctccaccgcgactcgttcgccgtgaacgccaccccagcccagctcctcgcgcgccgcctgcagcgggacgagctgagggcagcgtggatcatcaaggcggcggcgcccgcggcggcggcaaatgatacgccggtcgtcggactctccagcggaggcgcgttcgtggcgccggtggtgtccagggcgccgacgacgagcggggagtacatggccaagatcgcggtgggcacgccggccgtcgaggcgctgctggcgatggacacgggcagcgacatcacgtggctgcagtgccagccatgccggcggtgctacccgcagtccggtcccgtgttcgacccgcggcactcgacgtcgtaccgcgagatggggtacgacgcgccagattgccaagcgctgggacgatccggcggcggcgacgcgaagcgcatgacgtgcgtctacgccgtgggctacggggacgacggatctacgacggtgggcgacttcatcgaggagacgctgaccttcgccggcggcgtccaggttccgcacatgtcgatcggctgcggccatgacaacaagggcctgttcgcggcgccggcggccgggatcctgggcctcggccgcggccaaatatcgtgcccgagccagatcgctgctctcggctacaacgtcacgagcttctcctactgtctcgctgacttcttcttgtctagccccggccgctccgtctcctccaccctaaccatcggcgatggtgccgccgccggctccccaccaccgtcgttcaccccgacggtccaaaacctgaacatggccacgttctactacgtgcggctcgtcggcgtcagcgtcggcggcgtgcgcgtgccgggagtcaccgaggatgacctcaagctagacccgtacaccggccgcggcggcgtcattctggactccggcaccgccgtgacgaggcttgcccgccgcgcgtacatcgcgttccgtgatgccttccgtgccgcggcagtggacctcggccaggtctccatcggcggcccctccggcttcttcgatacgtgctacaccatgggtggcagggccatgaaggtgcccaccgtgtccatgcacttcgccggcggcgtggaattgacgctccctcccaagaactacctcatccccgtcgactccatgggcactgtctgcttcgcgtttgccggcaccggcgaccgtagcgtttccatcatcggcaacatccagcagcagggcttccgcgtcgtgtacaacatcggtggcggccgcgttgggttcgcgcccaatagctgctga

SEQ ID NO: 7252 - protein, 493 aa, Sorghum bicolor
  misc_feature: Ceres ANNOT ID no. 6075178
  misc_feature (133)..(491): Pfam Id: Asp Pfam Desc: Eukaryotic aspartyl protease
  misc_feature (1)..(493): NCBI GI: 15290061 NCBI Desc: nucleoid dna-binding protein cnd41-like [oryza sativa (japonica cultivar-group)]
  misc_feature (7)..(493): NCBI GI: 47777372 NCBI Desc: unknow protein [oryza sativa (japonica cultivar-group)]
  misc_feature (58)..(493): NCBI GI: 18461217 NCBI Desc: p0690b02.2 [oryza sativa (japonica cultivar-group)]
  misc_feature (7)..(315): NCBI GI: 38344196 NCBI Desc: osjnba0064g10.12 [oryza sativa (japonica cultivar-group)]
  misc_feature (61)..(493): NCBI GI: 38344829 NCBI Desc: osjnba0064h22.10 [oryza sativa (japonica cultivar-group)]
  misc_feature: The plant is abnormally small.
  misc_feature: Useful for making plants with modulated biomass
  misc_feature: Functional homolog of the protein sequence given in SEQ ID NO 13548
MASSCILLLLAAAAGLATPVEYQYHSYAVTPLSPHTYSVPAADDDGARARQEDVAVSPSALHVRLLHRDSFAVNATPAQLLARRLQRDELRAAWIIKAAAPAAAANDTPVVGLSSGGAFVAPVVSRAPTTSGEYMAKIAVGTPAVEALLAMDTGSDITWLQCQPCRRCYPQSGPVFDPRHSTSYREMGYDAPDCQALGRSGGGDAKRMTCVYAVGYGDDGSTTVGDFIEETLTFAGGVQVPHMSIGCGHDNKGLFAAPAAGILGLGRGQISCPSQIAALGYNVTSFSYCLADFFLSSPGRSVSSTLTIGDGAAAGSPPPSFTPTVQNLNMATFYYVRLVGVSVGGVRVPGVTEDDLKLDPYTGRGGVILDSGTAVTRLARRAYIAFRDAFRAAAVDLGQVSIGGPSGFFDTCYTMGGRAMKVPTVSMHFAGGVELTLPPKNYLIPVDSMGTVCFAFAGTGDRSVSIIGNIQQQGFRVVYNIGGGRVGFAPNSC

SEQ ID NO: 7253 - DNA, 1533 bp, Sorghum bicolor
  misc_feature: Ceres ANNOT ID no. 6075204
  misc_feature: Encodes the peptide sequence at SEQ ID NO 7254
  misc_feature: Down-regulated in shoot tissues in response to aminocyclopropane carboxylic treatment
  misc_feature: Up-regulated in root tissues in response to methyl jasmonate treatment
  misc_feature: Up-regulated in shoot tissues in response to methyl jasmonate treatment
atggaggagaaggtattgtccgaggcagcctcgaggggtgaggatgacttcaggagctgctgtggggatgaggaagagtgggaggacaccgaggaatcgttcacggccggcatcggaaagggggagcttgatgaggcctcggtgcgcctcttcttcaagggcgtgtcgagccccgaggcagaggggaagaagctctctgggatcggcgtcgtgatggagaggtcccctggggtgcctgttcttaaggtgcagaagaagctggatttctatgtcgaggagctggtggctgagcacctcgcgctcatggatgggctgctagtcgccctgcagaatggcatccggaagatcttcgccttcactaattcggaaaagctctactttcagatagcagaagctgaaattcttgaagatcagcttttggtagctttaggacacaggattcttgaactggtggataagttggaagactttgatttgatattgcttccaagctttgaactcgagaggcccttgcagttggccaaagaagctataggcatcagatatctgtctccttatgaggttggtacctgcccgatttgccgtgaggagaaactaggttctcagatgatcaaggcaggttgttcgcacacatattgctataattgcctgactgggtatattgaagacaagctgctgacctcaaagctgcctataaggtgtccacaattaaggtgtaaatatattatttctgctagcgagtgtaaatcattccttccagttagcagccatgattccctggagagagcatttgcagaagctggcacctctgaaatggaaagattttattgtccctttccaaattgttcagtgctgttagaccttagtcagcacttctctagggcaagttcatcaagccagtcagatctcagttgtatcgagtgcccagaatgccatagagatatatgtatcaactgtggagtgccatggcacatcatgatgggctgtgacgagtaccagagcttgcctgctgaggaaagagatgctggggacctgtctttgcatcgccttgcacagaacaataggtggaggcgctgtcaaaattgtcgacgtatgattgaactaacacagggctgcttccatatgacttgctggtgtgggcacgagttctgctactcctgtggtgctgactatgctagtggtgtacaaacatgccaatgcgtgttctgggacgatgaagccgtggaggcctcctccgctgagcgatccacccaagcagcatctgagatctgggcatgggacacgtttgactgcatgccgaccgccgtggaggggtactcggagcaggaaagggcacagctggcgctcatccagaggttcctcgcgggaggttttagcctgggagacaaccacaaccccaacccctgccagtcaccgccacgctgcgccgactcgtacatcgtcgacaccatgaaggacctccaccagctcccgtggcttgagcggttcgtgtcggtgatcagcgacacctacaatgatgactacatccagtga

SEQ ID NO: 7254 - protein, 510 aa, Sorghum bicolor
  misc_feature: Ceres ANNOT ID no. 6075204
  misc_feature (258)..(329): Pfam Id: IBR Pfam Desc: IBR domain
  misc_feature (23)..(408): NCBI GI: 92880897 NCBI Desc: zinc finger, ring-type; zinc finger, c6hc-type [medicago truncatula]
  misc_feature (43)..(391): NCBI GI: 42569316 NCBI Desc: zinc finger protein-related [arabidopsis thaliana]
  misc_feature (43)..(388): NCBI GI: 9757966 NCBI Desc: mutator-like transposase [arabidopsis thaliana]
  misc_feature (43)..(388): NCBI GI: 91806936 NCBI Desc: zinc finger protein-like protein [arabidopsis thaliana]
  misc_feature (43)..(388): NCBI GI: 145358583 NCBI Desc: zinc ion binding [arabidopsis thaliana]
  misc_feature: The sequence is a functional homolog of SEQ ID NO 1727 in the 10/374,780US patent application
  misc_feature: Useful for making plants with modulated growth and phenotype characteristics
  misc_feature: The sequence is a functional homolog of SEQ ID NO 1727 in the 20060162006 US patent application
  misc_feature: Down-regulated in shoot tissues in response to aminocyclopropane carboxylic treatment
  misc_feature: Up-regulated in root tissues in response to methyl jasmonate treatment
  misc_feature: Up-regulated in shoot tissues in response to methyl jasmonate treatment
  misc_feature: The sequence is a functional homolog of SEQ ID NO. 493 in the 11/188,298 US application
MEEKVLSEAASRGEDDFRSCCGDEEEWEDTEESFTAGIGKGELDEASVRLFFKGVSSPEAEGKKLSGIGVVMERSPGVPVLKVQKKLDFYVEELVAEHLALMDGLLVALQNGIRKIFAFTNSEKLYFQIAEAEILEDQLLVALGHRILELVDKLEDFDLILLPSFELERPLQLAKEAIGIRYLSPYEVGTCPICREEKLGSQMIKAGCSHTYCYNCLTGYIEDKLLTSKLPIRCPQLRCKYIISASECKSFLPVSSHDSLERAFAEAGTSEMERFYCPFPNCSVLLDLSQHFSRASSSSQSDLSCIECPECHRDICINCGVPWHIMMGCDEYQSLPAEERDAGDLSLHRLAQNNRWRRCQNCRRMIELTQGCFHMTCWCGHEFCYSCGADYASGVQTCQCVFWDDEAVEASSAERSTQAASEIWAWDTFDCMPTAVEGYSEQERAQLALIQRFLAGGFSLGDNHNPNPCQSPPRCADSYIVDTMKDLHQLPWLERFVSVISDTYNDDYIQ

SEQ ID NO: 7255 - DNA, 1428 bp, Sorghum bicolor
  misc_feature: Ceres ANNOT ID no. 6075257
  misc_feature: Encodes the peptide sequence at SEQ ID NO 7256
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
atgaagctccgcttgcgatccatggaggcgcgcggcggtgccgccgccgagacccaccgcgtggacctgccgcccacggccacgctggctgacgtgaggacgctcctcgcgtctaagctctccgcggcgcagcccgtccccgccgagtccgtccgcctctccctcaaccgcagcgaggagctcgtctcgccggaccccgccgccacgctcccgtccctcggcctcgcgtccggtgatctcgtcttcttcaccctatcccctctcacggccctagcgccgccggttcaggccctgccccggaaccctagcccgggctctggcactgcagcgtcgatcgctgaggctgtcgatcgcgggaaaggctcgaagcagcctgttactggaggttcctcttcgtcgtcacaggtgcaggctgtggtggcgaaccctagctttccggttgcttccagtggtcggccggatgtggtgatggaggaggccttcgatgcgacgaagggctggtcgagttttgtgcttagggatctcaagagggagatgggcaacgtcggcggcgcggaggggaccgcggcaggtcgcctggttgcggccttacatgcagctctgcttgatgtcggctttctcaccaccactctgatgggttctcatctctcactgcctcagggctggccgtcgggtgctttgaagccactgaccatcaggtataccgtaccagagctttcatcaatgttatctgtgactgaggaggggaaggtggtggtgctgaactactctttgatgggcaattttgttatggtatacgggtatgttcatggggcacagtcagaggtgtgccggttgtgcttggagttgccagggcttgagtctttactttatctggatagcgatcagctgagcggagtgcatgagaagggagttcatgatctgtggagagtgctgaaggatgagatttgcctgccattaatgatatcattgtgccaactgaatggtctacgcttgcctccatgcttcatggctttgcctgctgatctgaagactaaggtactggagtttctacctggggttgatcttgcaaaggttgagtgcacgtgcaaggaaatgaggaatcttgcatcagatgatagtatttggaagaagtttgtaagttatggtgagagctctaggggggctggcaagagtgcgaaggccatatttggagaggtttggcaggctaataagagaaggcagaagaggcctaatccaaccttttggaactatggctggggaaacagttcttatagccgcccacttaggctgccattgattggtggggactcggacagatttccttttattgggaatcctggttctgtggggcgtcactttggaaatcaacgaaggaacatgtcgccgaactgcatacttgatggtcaccgccataacttcctttga

SEQ ID NO: 7256 - protein, 475 aa, Sorghum bicolor
  misc_feature: Ceres ANNOT ID no. 6075257
  misc_feature (334)..(381): Pfam Id: F-box Pfam Desc: F-box domain
  misc_feature (8)..(475): NCBI GI: 115451729 NCBI Desc: os03g0232000 [oryza sativa (japonica cultivar-group)]
  misc_feature (1)..(461): NCBI GI: 23506143 NCBI Desc: at1g23780/f5o8_31 [arabidopsis thaliana]
  misc_feature (8)..(447): NCBI GI: 50417450 NCBI Desc: fbxo7-prov protein [xenopus laevis]
  misc_feature (191)..(377): NCBI GI: 115481004 NCBI Desc: os10g0130200 [oryza sativa (japonica cultivar-group)]
  misc_feature (1)..(442): NCBI GI: 109451894 NCBI Desc: fbxo7 [synthetic construct]
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
MKLRLRSMEARGGAAAETHRVDLPPTATLADVRTLLASKLSAAQPVPAESVRLSLNRSEELVSPDPAATLPSLGLASGDLVFFTLSPLTALAPPVQALPRNPSPGSGTAASIAEAVDRGKGSKQPVTGGSSSSSQVQAVVANPSFPVASSGRPDVVMEEAFDATKGWSSFVLRDLKREMGNVGGAEGTAAGRLVAALHAALLDVGFLTTTLMGSHLSLPQGWPSGALKPLTIRYTVPELSSMLSVTEEGKVVVLNYSLMGNFVMVYGYVHGAQSEVCRLCLELPGLESLLYLDSDQLSGVHEKGVHDLWRVLKDEICLPLMISLCQLNGLRLPPCFMALPADLKTKVLEFLPGVDLAKVECTCKEMRNLASDDSIWKKFVSYGESSRGAGKSAKAIFGEVWQANKRRQKRPNPTFWNYGWGNSSYSRPLRLPLIGGDSDRFPFIGNPGSVGRHFGNQRRNMSPNCILDGHRHNFL

SEQ ID NO: 7257 - DNA, 1089 bp, Sorghum bicolor
  misc_feature: Ceres ANNOT ID no. 6075263
  misc_feature: Encodes the peptide sequence at SEQ ID NO 7258
atggtggcgatgctcgcgcgcgccggcgtcacagccaccgccgggaaaggcctctcgcgccccacgggccgccgccagcgcaatggcatcgtcgtcgcggcggtcactagaacggggactggtgtgccacaggagggggcgctggagcggccggcgtggtccggggagacccctctgtcgcggctggtcggcgctctcatcgcgttcaagccgctctactcgctattgaagctcgcctcccgcgaggtcatcatcaggacggcggagaagtcgaacatcccgtggagggagatgacgaaggaggtgctggagtcggacgtgtacgaggtgttcgagagaatccaagacccaaacctcgtgtaccctgactattatctcaacccgtttcatgcctacgacgaagggaatctatcatggctggctgcagcagaggctgaaccggcaacaatgtcaatcgcaaagagggccatacctgatgctacatcgatcgaagaggcgaaccaaatcgtccgcgggaactggctgaatgtaattgaggagcatcatgtcaagtactcggggaactgtcaagtaaatgacatcttggacattggctgctctgttggagtaagcaccagatacctcgccgagaagttcccttcagctcaagctgttgggctcgacctatcaccatactttcttgctgtggcagcacaaaaggaagaaaaattgttacggccaaaccctattcgttgggttcatgcgaatggtgaagcgactgggctgccctctgattcatttgaccttgtctcccttgcttatgtgtgccatgagtgcccagcacgagcaataaccggattggtgaaggaagcattcagggtccttcgcccaggaggaacaatcgccttaacagacaattcgccaaaatccaaagtacttcaggaactatccccagttttgttcactctgatgaagagtaccgagcctttccttgacgagtactacatgttggatttggaggagacaatgagaaaagtcggctttgttaacgtttgctccatcctgacagaccccaggcacagaacagtcactgcaaccgtgccttactaa

SEQ ID NO: 7258 - protein, 362 aa, Sorghum bicolor
  misc_feature: Ceres ANNOT ID no. 6075263
  misc_feature (195)..(296): Pfam Id: Methyltransf_11 Pfam Desc: Methyltransferase domain
  misc_feature (195)..(294): Pfam Id: Methyltransf_12 Pfam Desc: Methyltransferase domain
  misc_feature (160)..(357): Pfam Id: Ubie_methyltran Pfam Desc: ubiE/COQ5 methyltransferase family
  misc_feature (4)..(362): NCBI GI: 115481318 NCBI Desc: os10g0181600 [oryza sativa (japonica cultivar-group)]
  misc_feature (44)..(362): NCBI GI: 39598908 NCBI Desc: cmv 1a interacting protein 1 [nicotiana tabacum]
  misc_feature (3)..(361): NCBI GI: 92874660 NCBI Desc: sam (and some other nucleotide) binding motif [medicago truncatula]
  misc_feature (50)..(362): NCBI GI: 67923987 NCBI Desc: similar to methylase involved in ubiquinone/menaquinone biosynthesis [crocosphaera watsonii wh 8501]
  misc_feature (60)..(360): NCBI GI: 113476529 NCBI Desc: methyltransferase type 11 [trichodesmium erythraeum ims101]
MVAMLARAGVTATAGKGLSRPTGRRQRNGIVVAAVTRTGTGVPQEGALERPAWSGETPLSRLVGALIAFKPLYSLLKLASREVIIRTAEKSNIPWREMTKEVLESDVYEVFERIQDPNLVYPDYYLNPFHAYDEGNLSWLAAAEAEPATMSIAKRAIPDATSIEEANQIVRGNWLNVIEEHHVKYSGNCQVNDILDIGCSVGVSTRYLAEKFPSAQAVGLDLSPYFLAVAAQKEEKLLRPNPIRWVHANGEATGLPSDSFDLVSLAYVCHECPARAITGLVKEAFRVLRPGGTIALTDNSPKSKVLQELSPVLFTLMKSTEPFLDEYYMLDLEETMRKVGFVNVCSILTDPRHRTVTATVPY

SEQ ID NO: 7259 - DNA, 933 bp, Sorghum bicolor
  misc_feature: Ceres ANNOT ID no. 6075268
  misc_feature: Encodes the peptide sequence at SEQ ID NO 7260
atgctcctccgcccgcgcccctccctcttccgagccgtcgcgccgccgccgctcaccagcgcccgtgtcccctcccgtcgcacgttctcagcttctgcagaggcgggaacagcctcccccaaggatgcagcgccagcgccagcgccggttccggcggtcacgcgcaagaacgccaggaaggccgtgccgccgcctatggggatcgtgaagacggcgctgtttcttccgcccggggtggagcgggacgcgacggtggccgcggacatggtcataccggggtcgaacattgtggtcgggccctacgctggggacgcgagggtgaaggaggctgagttcgtcaagagcagtgcgcgtgcgcgggactgccccaaggacgaccgacccgagttcgccgtcctcggccgttccaacgttggcaaatcctcgctcatcaacgccctcacccgccgcaaggaagccgcgctcacctccaaaaagcctgggaagacacagacaatcaatcactttttggttaataagagttggtaccttgtggatttgcctggttatgggtttgcagctgcatcccaatcagctcgaatggactggtcttcatttaccaagggttacttcttgaacagagataccttggttggcgtacttctccttattgatgccagtatcccacctcagaaaattgatctagactgtgctaactggctcggccgtaacaatattggattgacatttgtgttcaccaagtgcgacaaagtaaagaagggtaaaggagggcggcctgatgagaacatcaagcagttccaggaaactatcagtgggctttatccagatccaccaccatggatcatgacaagcagtgttaccggattaggccgcgacgggctactcctccatatgtcacagctgaggaactactgggataatgaagcagtctag

SEQ ID NO: 7260 - protein, 310 aa, Sorghum bicolor
  misc_feature: Ceres ANNOT ID no. 6075268
  misc_feature (128)..(249): Pfam Id: MMR_HSR1 Pfam Desc: GTPase of unknown function
  misc_feature (89)..(306): NCBI GI: 25306612 NCBI Desc: probable nucleotide-binding protein [imported] - arabidopsis thaliana
  misc_feature (107)..(295): NCBI GI: 124005837 NCBI Desc: gtp-binding protein [microscilla marina atcc 23134]
  misc_feature (107)..(310): NCBI GI: 126646524 NCBI Desc: gtp-binding protein [algoriphagus sp. pr1]
  misc_feature (106)..(301): NCBI GI: 126663224 NCBI Desc: gtpase engb [flavobacteria bacterium bal38]
  misc_feature (106)..(303): NCBI GI: 117579263 NCBI Desc: protein containing gtp binding domain [gramella forsetii kt0803]
  misc_feature: Useful for making plants with modulated heat sensitivity
  misc_feature: GREAT-hit functional homolog of the protein sequence given in SEQ ID NO 13099
  misc_feature: Useful for making plants with modulated heat sensitivity
  misc_feature: Functional homolog of the protein sequence given in SEQ ID NO 13099
MLLRPRPSLFRAVAPPPLTSARVPSRRTFSASAEAGTASPKDAAPAPAPVPAVTRKNARKAVPPPMGIVKTALFLPPGVERDATVAADMVIPGSNIVVGPYAGDARVKEAEFVKSSARARDCPKDDRPEFAVLGRSNVGKSSLINALTRRKEAALTSKKPGKTQTINHFLVNKSWYLVDLPGYGFAAASQSARMDWSSFTKGYFLNRDTLVGVLLLIDASIPPQKIDLDCANWLGRNNIGLTFVFTKCDKVKKGKGGRPDENIKQFQETISGLYPDPPPWIMTSSVTGLGRDGLLLHMSQLRNYWDNEAV

SEQ ID NO: 7261 - DNA, 1209 bp, Sorghum bicolor
  misc_feature: Ceres ANNOT ID no. 6075273
  misc_feature: Encodes the peptide sequence at SEQ ID NO 7262
atggccgcgacggcggcggagaggatggtgggggcggagtgggaggaggaggaggaggggaagcaggggatgaggaggaggaagcggtacgggctggtggagtaccgggcgctgccggcctacctgcgggacaacgagtacatccaccgccattaccgctgcgagtggccgctcccgcaggtgctgctctccgccttctccatccacaacgagacccttaacgtctggacgcatcttattggatttttcatctttctcgctctgaccatatacacagcaacacaagttccaaatgtagtagatattcagagcttgcaacatttgccggatgtgctgagaaaggctgatattcataagattcaggcggagcttgtgtcatgtcttccgtcgttacctcatctttcggatctacaaaagctgaaggatgagctgaagagctcttggaattctatggaggttcttccatctctgtcccgttggcatctcttggagttactcgcaagttgtttgccacacagatttacccatccaaatgaaacaagtttgtctgttcttcaaagcatgaaggaggatctagcaaacctgattgcgccgcaactgatcagaccaattgcgcggtggccattctatgccttcttgggaggagccatgttctgccttctcgccagcagtacttgccaccttctctcgtgccattctcgccgcctagcgtacattatgcttcggcttgattacgcaggcattgcagctctaatcgccacatccttctaccctccagtatactattctttcatgtgctaccccttcttttgcaacatgtacctcagtttcataaccatcctaggagtggcaactatcgcgttctctctacttccggtcttccagagccctgagttcagaaccatcagagcatgcctcttttttggcatgggcgcatccggtgtgatacccgttcttcataagctggtcctcttctggcatcaaccggaggcattgcacacgaccggatatgaagttctgatggggctcttctacgggctgggagcactggtatatgcgacccgggtacctgagcgctggatgcctgggaagtttgacatcgccgggcacagccaccagctgttccacgtcttggttgttgccggagcctacacacactaccacgcagggctggtgtacctcaagtggagagacgtgcaaggctgctga

SEQ ID NO: 7262 - protein, 402 aa, Sorghum bicolor
  misc_feature: Ceres ANNOT ID no. 6075273
  misc_feature (66)..(387): Pfam Id: HlyIII Pfam Desc: Haemolysin-III related
  misc_feature (204)..(402): NCBI GI: 92895989 NCBI Desc: hly-iii related proteins [medicago truncatula]
  misc_feature (209)..(388): NCBI GI: 125773203 NCBI Desc: ga18798-pa [drosophila pseudoobscura]
  misc_feature (209)..(388): NCBI GI: 24649049 NCBI Desc: cg5315-pc, isoform c [drosophila melanogaster]
  misc_feature (209)..(388): NCBI GI: 45551946 NCBI Desc: cg5315-pb, isoform b [drosophila melanogaster]
  misc_feature (209)..(388): NCBI GI: 117935909 NCBI Desc: adiponectin receptor [bombyx mori]
  misc_feature: Useful for making plants with altered cell wall content and/or composition
  misc_feature: GREAT-hit functional homolog of the protein sequence encoded by LOCUS at4g38310
  misc_feature: Useful for making plants with altered cell wall content and/or composition
  misc_feature: Functional homolog of the protein sequence given in SEQ ID NO 13986
  misc_feature: Useful for making plants with altered carbohydrate content
  misc_feature: Functional homolog of the protein sequence given in SEQ ID NO 13987
  misc_feature: The sequence is a functional homolog of SEQ ID NO. 326 in the 11/188,298 US application
MAATAAERMVGAEWEEEEEGKQGMRRRKRYGLVEYRALPAYLRDNEYIHRHYRCEWPLPQVLLSAFSIHNETLNVWTHLIGFFIFLALTIYTATQVPNVVDIQSLQHLPDVLRKADIHKIQAELVSCLPSLPHLSDLQKLKDELKSSWNSMEVLPSLSRWHLLELLASCLPHRFTHPNETSLSVLQSMKEDLANLIAPQLIRPIARWPFYAFLGGAMFCLLASSTCHLLSCHSRRLAYIMLRLDYAGIAALIATSFYPPVYYSFMCYPFFCNMYLSFITILGVATIAFSLLPVFQSPEFRTIRACLFFGMGASGVIPVLHKLVLFWHQPEALHTTGYEVLMGLFYGLGALVYATRVPERWMPGKFDIAGHSHQLFHVLVVAGAYTHYHAGLVYLKWRDVQGC

SEQ ID NO: 7263 - DNA, 1815 bp, Sorghum bicolor
  misc_feature: Ceres ANNOT ID no. 6075278
  misc_feature: Encodes the peptide sequence at SEQ ID NO 7264
atgggtcgcgacgccgaggagacctcgccgccggtgtcctcgtcggaattggagcaggaagaagacgacgacgactgctacctgagcgatcaggaggacgatgccctagaagagtccgtcctccaggtcctcgaggacgagcaccacgaggactgccattggtccgcctcatgcgtcatcaccaaggaatccctcctggcggcgcagagggaggatcttaggaaggtgatggagctgctagggttgagggagcaccatgcccggacgctcctcatccactaccgctgggatgtggagaggattttcgagcttctcgatcagaagggcagggataggctcttctcggaggctggtattcctctccagtacaccaataatgccgggacaacctcctcggcggaggtgacctgcaatgtttgttatgatgatgtgccaccctcgactgcctccgagatggactgcggccacagttactgcaatgattgttggactgaatatttcattgtgaaaataaatgagggtcagagccggcgtgtcagatgcatggctccaaagtgcaatgctatttgtgatgaagcaataattcgaaaactagtcattgcgagacacccagatatcgcagaacgctttgaaagatttttactggaatcatatattgaggataatgatacagtcaagtggtgcccaagcacaccacattgtggaaatgctatacgcgtcaaaggcgatatttattgtgaggtggaatgcacatgtggatgccagttttgttttaattgctccttacaagcacactcaccatgttcctgcatgatgtgggagctctggatcaagaaatgccgtgatgaatcagaaacagtgaattggataacagtaaatactaagccctgtcccaagtgtcacaaacctgtggagaagaatggtggctgcaacctggttgcatgtatatgtggacaagcattctgttggttatgtgggggggctacaggtagagatcacacatggtcaagtattagtggccacagttgtggccggttcactgatgatcagactaagaagacggaacaagcaaggcgagacctgtacagatatatgcactaccacaacagatacaaggctcacactgactctcttaagcaggaagcaaagctaaagaatgagatccaggggaagatatccatttcagaaaataaggagtcaaagataaaagattattcttgggtcatgaatgggttaaacaggctattcagatcaaggcgtgttctttcctattcatatccgtttgcattttatatgtttggtgatgagattttcaaggatgagatgactcctcacgaaagagaagtgaagcagaatttatttgaggatcagcaacaacaactagaatttaatgttgaaagactttctggtttccttgagaaagattttcaactttttactgatgacgaggtcatggatacgatgaagcatgtcatcaatctttccaatgtggttgataagctctgcaaacaaatgtatcagtgcatcgagaatgatttgttatatcctctacgcacacctcacaacattgctccatacaaatctaagggccttgacagggcctcggagcttaatattagttgggattctgctgaacaaagttcacagtcaacaaaacgaagtcagaatgaagcatcgactgttctggggaaacgaggctcgagttctgataatagggggcaccaatctaacaagcgagagagggtagatgctaatggtggtggtagtgcactttttgatctcaatgtgccagctgaagtggtggataagatctga

SEQ ID NO: 7264 - protein, 604 aa, Sorghum bicolor
  misc_feature: Ceres ANNOT ID no. 6075278
  misc_feature (208)..(270): Pfam Id: IBR Pfam Desc: IBR domain
  misc_feature (21)..(603): NCBI GI: 29125020 NCBI Desc: ariadne-like protein ari2 [arabidopsis thaliana]
  misc_feature (21)..(603): NCBI GI: 20855959 NCBI Desc: at2g16090/f7h1.11 [arabidopsis thaliana]
  misc_feature (205)..(540): NCBI GI: 15232252 NCBI Desc: zinc finger protein-related [arabidopsis thaliana]
  misc_feature (185)..(540): NCBI GI: 9294477 NCBI Desc: ring finger protein-like [arabidopsis thaliana]
  misc_feature (47)..(491): NCBI GI: 30354164 NCBI Desc: ariadne homolog, ubiquitin-conjugating enzyme e2 binding protein, 1 [homo sapiens]
  misc_feature: The sequence is a functional homolog of SEQ ID NO 1727 in the 10/374,780US patent application
  misc_feature: The sequence is a functional homolog of SEQ ID NO 274 in the 10/666,642US patent application
  misc_feature: The sequence is a functional homolog of SEQ ID NO 330 in the 10/374,780US patent application
  misc_feature: The sequence is a functional homolog of SEQ ID NO 56 in the 11/375,241US patent application
  misc_feature: The sequence is a functional homolog of SEQ ID NO 854 in the 10/225,066US patent application
  misc_feature: Useful for making plants with modulated growth and phenotype characteristics
  misc_feature: The sequence is a functional homolog of SEQ ID NO 854 in the 20050160493 US patent application
  misc_feature: The sequence is a functional homolog of SEQ ID NO 1727 in the 20060162006 US patent application
  misc_feature: The sequence is a functional homolog of SEQ ID NO 274 in the 20070033671 US patent application
  misc_feature: The sequence is a functional homolog of SEQ ID NO 1727 in the 10/374,780 US patent application
  misc_feature: The sequence is a functional homolog of SEQ ID NO 330 in the 10/374,780 US patent application
  misc_feature: The sequence is a functional homolog of SEQ ID NO 56 in the 11/375,241 US patent application
  misc_feature: The sequence is a functional homolog of SEQ ID NO 854 in the 10/225,066 US patent application
  misc_feature: The sequence is a functional homolog of SEQ ID NO 274 in the 10/666,642 US patent application
  misc_feature: The sequence is a functional homolog of SEQ ID NO. 493 in the 11/188,298 US application
MGRDAEETSPPVSSSELEQEEDDDDCYLSDQEDDALEESVLQVLEDEHHEDCHWSASCVITKESLLAAQREDLRKVMELLGLREHHARTLLIHYRWDVERIFELLDQKGRDRLFSEAGIPLQYTNNAGTTSSAEVTCNVCYDDVPPSTASEMDCGHSYCNDCWTEYFIVKINEGQSRRVRCMAPKCNAICDEAIIRKLVIARHPDIAERFERFLLESYIEDNDTVKWCPSTPHCGNAIRVKGDIYCEVECTCGCQFCFNCSLQAHSPCSCMMWELWIKKCRDESETVNWITVNTKPCPKCHKPVEKNGGCNLVACICGQAFCWLCGGATGRDHTWSSISGHSCGRFTDDQTKKTEQARRDLYRYMHYHNRYKAHTDSLKQEAKLKNEIQGKISISENKESKIKDYSWVMNGLNRLFRSRRVLSYSYPFAFYMFGDEIFKDEMTPHEREVKQNLFEDQQQQLEFNVERLSGFLEKDFQLFTDDEVMDTMKHVINLSNVVDKLCKQMYQCIENDLLYPLRTPHNIAPYKSKGLDRASELNISWDSAEQSSQSTKRSQNEASTVLGKRGSSSDNRGHQSNKRERVDANGGGSALFDLNVPAEVVDKI

SEQ ID NO: 7265 - DNA, 498 bp, Sorghum bicolor
  misc_feature: Ceres ANNOT ID no. 6075282
  misc_feature: Encodes the peptide sequence at SEQ ID NO 7266
atggcgctcgcggaggggaacaacggcgcggtcgtcttcagcgaggagcaggaggcgctggtgctcaagtcgtgggccgtcatgaagaaggactccgccaacctgggcctccgcttcttcctcaaggtcttcgagatcgcgccgtcggcgaagcagatgttctcgttcctgcgcgactccgacgtgccgctagagaagaaccctaagctcaagacgcatgccatgtccgtctttgtcatgacttgcgaggcggcggcgcagcttcgcaaggccgggaaggtcacagtgagggagaccacgctcaagaggctgggcgccacgcacttgaagtacggcgtcgcagatggccactttgaggtgacggggttcgcgctgcttgagacgatcaaggaggcgctccccgctgacatgtggagcctcgagatgaagaaagcctggagcgaggcttacaaccagctggtggcggccatcaagcaagagatgaaacctgatgcctag

SEQ ID NO: 7266 - protein, 165 aa, Sorghum bicolor
  misc_feature: Ceres ANNOT ID no. 6075282
  misc_feature (17)..(126): Pfam Id: Globin Pfam Desc: Globin
  misc_feature (1)..(165): NCBI GI: 9858882 NCBI Desc: hemoglobin [zea mays subsp. parviglumis]
  misc_feature (1)..(165): NCBI GI: 7271869 NCBI Desc: hemoglobin [zea mays]
  misc_feature (1)..(165): NCBI GI: 22001638 NCBI Desc: non-symbiotic hemoglobin (hbm) (zeama glb1)
  misc_feature (1)..(165): NCBI GI: 9931924 NCBI Desc: hemoglobin [zea mays]
  misc_feature (1)..(163): NCBI GI: 2058496 NCBI Desc: hemoglobin 2 [oryza sativa]
  misc_feature: Useful for making plants with modulated cold sensitivity
  misc_feature: Useful for making plants with modulated endosperm cell number
  misc_feature: Useful for making plants with modulated endosperm cell size
  misc_feature: Useful for making plants with modulated salt sensitivity
  misc_feature: GREAT-hit functional homolog of the protein sequence given in SEQ ID NO 13519
  misc_feature: GREAT-hit functional homolog of the protein sequence given in SEQ ID NO 13520
  misc_feature: Useful for making plants with modulated cold sensitivity
  misc_feature: Useful for making plants with modulated salt sensitivity
  misc_feature: Functional homolog of the protein sequence given in SEQ ID NO 13520
MALAEGNNGAVVFSEEQEALVLKSWAVMKKDSANLGLRFFLKVFEIAPSAKQMFSFLRDSDVPLEKNPKLKTHAMSVFVMTCEAAAQLRKAGKVTVRETTLKRLGATHLKYGVADGHFEVTGFALLETIKEALPADMWSLEMKKAWSEAYNQLVAAIKQEMKPDA

SEQ ID NO: 7267 - DNA, 1452 bp, Sorghum bicolor
  misc_feature: Ceres ANNOT ID no. 6075284
  misc_feature: Encodes the peptide sequence at SEQ ID NO 7268
atggcgagctccgacgatggtggttccagcgcccccagggacgtgccgggcagctacgggctgccgctggtgggcgccgtgcgcgaccgcctcgacttctactacttccaggggcaggacaagtacttcgagtcccgcgtggagcgctacggctccaccgtggtgcgcatcaacgtgccgccggggcccttcatggcgcgcgacccgcgggtggtggcggtcctggacgccaagagcttcccggtcctcttcgacatggacaaggtggagaagaaggacctgttcacgggcacctacatgccctccacctccctcaccggcggctaccgcgtctgctcctacctcgaaccctccgagcccacccacaccaaggtgaagcagatgctcttctccctcctcctctcccgcaaagacgacgtcatccccaccttccgctccaacttctccgcgctcctcgccaccgtcgagtcgcagctcgccaagagcggcggcaaggccgacttcaacaagctcaacgacgtcacctccttcgacttcatcggcgaggcctacttcggcgtgcgcccctccgcgacggacctcggcagcggcgggccgaccaaggcggccaagtggctcatctggcagctccacccgctcgtcacgctcggcctccccatggtgctcgaggagccgctgctgcacaccttccacctcccgccgttcctcgtcaagggcgactacagggcgctgtacaagtacttctccacggcggcgaagcaggcgctggacaccgccgagggcctgggcctgtcgcgcgaggaggcctgccacaacctcctcttcgccaccaccttcaacagctacggcgggctcaaggtgctgttcccgggcctcctggccaacgtcgccaacgccggcgagaagctccacgagaagctggtggccgagatccgcggcgccgtggccgaggccggcggcaaggtcacgctcgccgcggtggagaagatggagctggccaagtccgtggtgtgggagtcgctgcgcctggacccgcccgtcaagttccagtacggccacgccaagaaggacctgctgatcgagagccacgacgccgtgttccaggtgaagaagggcgagatgctgttcggctaccagccgtgcgccaccaaggacccgcgcgtgttcggcgacacggccaaggagttcgtgcccgaccggttcgtcggcgaggaaggcagcaagctgctgcagtacgtgtactggtccaacggacgcgagaccgagaaccccagcgtcgacaacaagcagtgccccggcaagaactttgtggtgctcgtcggcaggctcttcctcgtcgagctcttcctccgttacgacaccttcaccgccgaggtcgccacggagctgctcggcgccagtgtcgtcttcaccgccgtcaccaaagctacctcaggtgcgggcagcgagtag

SEQ ID NO: 7268 - protein, 483 aa, Sorghum bicolor
  misc_feature: Ceres ANNOT ID no. 6075284
  misc_feature (15)..(484): Pfam Id: p450 Pfam Desc: Cytochrome P450
  misc_feature (1)..(483): NCBI GI: 39980758 NCBI Desc: allene oxide synthase [zea mays]
  misc_feature (1)..(479): NCBI GI: 7452979 NCBI Desc: allene oxide synthase [hordeum vulgare subsp. vulgare]
  misc_feature (8)..(482): NCBI GI: 7452981 NCBI Desc: allene oxide synthase [hordeum vulgare subsp. vulgare]
  misc_feature (13)..(480): NCBI GI: 73619653 NCBI Desc: cytochrome p450 74a2 (allene oxide synthase 2) (hydroperoxide dehydrase 2)
  misc_feature (13)..(480): NCBI GI: 32351269 NCBI Desc: allene oxide synthase [oryza sativa (japonica cultivar-group)]
  misc_feature (13)..(480): SWISSPROT Homolog: EC 4.2.1.92 Cytochrome P450 74A2
  misc_feature: Described in US Patent 7,132,590
  misc_feature: Useful for biocontainment applications
  misc_feature: Useful for making plants with modulated nitrogen use efficiency
  misc_feature: Functional homolog of the protein sequence encoded by LOCUS at5g42650
  misc_feature: Useful for biocontainment applications
  misc_feature: Useful for making plants with modulated nitrogen use efficiency
  misc_feature: Functional homolog of the protein sequence given in SEQ ID NO 13988
  misc_feature: The sequence is a functional homolog of SEQ ID NO. 294 in the 11/188,298 US application
MASSDDGGSSAPRDVPGSYGLPLVGAVRDRLDFYYFQGQDKYFESRVERYGSTVVRINVPPGPFMARDPRVVAVLDAKSFPVLFDMDKVEKKDLFTGTYMPSTSLTGGYRVCSYLEPSEPTHTKVKQMLFSLLLSRKDDVIPTFRSNFSALLATVESQLAKSGGKADFNKLNDVTSFDFIGEAYFGVRPSATDLGSGGPTKAAKWLIWQLHPLVTLGLPMVLEEPLLHTFHLPPFLVKGDYRALYKYFSTAAKQALDTAEGLGLSREEACHNLLFATTFNSYGGLKVLFPGLLANVANAGEKLHEKLVAEIRGAVAEAGGKVTLAAVEKMELAKSVVWESLRLDPPVKFQYGHAKKDLLIESHDAVFQVKKGEMLFGYQPCATKDPRVFGDTAKEFVPDRFVGEEGSKLLQYVYWSNGRETENPSVDNKQCPGKNFVVLVGRLFLVELFLRYDTFTAEVATELLGASVVFTAVTKATSGAGSE

SEQ ID NO: 7269 - DNA, 3882 bp, Sorghum bicolor
  misc_feature: Ceres ANNOT ID no. 6075287
  misc_feature: Encodes the peptide sequence at SEQ ID NO 7270
atgttctctccggcaatcaggaggccacacctcctcaaccgcagggacagggaggagggatccccttcgccgcctcctgctgctcccgcccattccccgtcgcctcacgggttcgccgtgcccgaccgccccgccaccggcaccccggtcccatggaactcctcctccctcctcgctaggatttcgacgtctaagcgaactgacaggactggtgattcggaccagatccaaccagtgcgcgtagcggagtttccccaagttgttcggaatgcccaagccagcctgctacagaagaatttctctggcaagaacatgcttgctggtggcattgataaagaaacatcccttgcgtggatgatatgcggaaatgagctttttatatggagttacttggcttctgttgcaaaagactgtattgcacttgacattccatcttctcttatcggatacaatgacgtgaaacccctcctcggtattcagtggacagtttgtataatgagatggcatagtggtggtgcatcaacaaggaatagtggagagatgttgcatagaaaaagttcaactggtgtgatcctctgcaacaaaagaacacaagctgttgcttattggcccgatatctatgctgaatttaataggagcctagttcttagttcgtcaggtgatggtgaggtgtctgcatgtgatgctgcatctgattgtttgaggtttaattcgcttattgcggctgcagttccaggatgtattcatgagtgcattgcaatagcttctgatcctgcaggtgctttgtggctgttccagtgttcaccggaaggaattcatcaaagaaaagttcatgcagatacattaggagatggtggtgccgatcattcccagaaaagtaatggtggaaggtccttgatttggttaccaaataatgtctcatctgagggttctgaccggaagttctttttattgacaaacaatgaggtgcaatgttggagtatctcattcttgaatgacatcaatgtcaaaaaattagggtctcacggaattgttggtactgacggagatgtgggcattaagaaagatatagctgggcagaaaaatatatggcttttggacatgcagatagatgagcgtgggaaggaatttagcattcttgttgctacattatgcaaagatagggttagcgggtcaaactacactcaatattctcttttgacaatgctgtacaagcctaaccagaagctttcgtctgaagataatgtagctaaagttgaaaggtttttggagaaaaaagctccttctcaggtgataattcctaaggctagggtagaggatgatgaattcttgttctccatgaggctaaaaactggtggtaagccttctggttctgttatcatcctgtcaggtgatggaacagcaacagtggccatgtattggagaggttccacccgactttatcagtttgatctgccttgggatgctggaaaggtcctagatgcttccgttatcccatcagctgaggacagagatgaaggtgcttgggtggttctaacagaaaaggcaggggtctgggcaattcctgaaaaagctgtattagttggtggggtggaacctccagaacgcagcttgtcacgaaagggtagttgtaatgaaacaattgctgaggagaaaagaagaagtcagggcttcagtgctagtgttgttcccaggagagttagctctgaggcttggagtgctggagagaggcaaaggcctgcattaactggcatagctcagcagtctgtggttgatgaagagtctgaaatgctactgaaccgattatttcatgattttataatctccagtgcagttagcgaggcacttcaaaagcttagagcagcaggagcatttgagaaagagggtgagatgaacatatttgttcggacgagcaaatccattgtaaacacattagctaaacattggacaacaaccagagaagctgaatttcttgcctcaacaattgtttcgtcccttgttgagaagcagcaaaaacatgagaaattccttcagtttcttgtcttgtcaaagtgccacgaagaactcgcttcaaagcaaagagcagcaatgctaactgtcatggagcatggtgaaaagctctctggaatggcacaccttagggaattacaaaatgcccttatccagcaacgctcaagcactcatttatcacctcagtcgaaaacccaaggtactggcgctctttggaaccttattcagttggttggtgagaaagctcgaagaaacacagttctcttaatggatcgtgataatgctgaagtgttctacagtagggtttctgatatagatgatctattttattgtttatctcatgagcttcaatacatcattagtagagaagaacacccatctgttcagatgcaacgtgcacttgagttagcaaatgcttgtatcgccttagttcaggcagcatcacactacaggaaggatcacaaggaatggtatccatctcctgaaggactgataacatggaacatccaacctgttgtacggtctggaatctggagtttagcatccttgattatggagcttttgggagattcaggagctgcagacatgtcaatgaaatctagtctatggtctcagctggaaggactcacagatattctactggaggcatatataggccttttaactgcccaatttgaacgtgggcaggaacatggtgtgctagtccaagaatattgtgaacgaagagatgaacttctcagatccctctacaaccttgctaaacaaatagtggaggtcaaataccaggagtcaaaagatggtacggacaatctggatctgaaagaatctatatttagaaaggttatttctcctattttagcaacagccaaacgacatgaagggtaccagacactgtggcagatttgctatgatctagatgattcagatctcctccgcagcctaatgcatgatagtgttgggcctcatggcggattcagtttctttgtctttaaagagttagtcaacagaggagactactctaagctgttaaggctaggtgaagaattccaggaagagcttgcaagctttctgaaagagcggagtgatctgctgtggcttcatgagatatgcttaaaccagttctcatctgcttctgagacccttcatacctatgctctgcgtggtagtcctgatggagatgctagcttcacaaccagcagaaagccactatcctttgttgaaagaagccgtcttctttatctctctaaaattgctgcaacagcaggtaaggatattggttatgaggtgaaggttgcacggatagaagcagacatgcggattctaaaactgcaggaagaaatagttcagcatgatccagaatacgcacaagtaaaatatacaaacgcattgcttggtccatcagaactgattgagatgtgcttgaggagagaccgagagctctcctttaaagcttttgaagtatttgctttgacaagctcatcattccgaagctccaacagaggtcttctagaggcatgctggatgaatgcaactgaccaggatgattgggtaaagctttcagaggcatccacgttagaaggttggagtgacgaactcatcgaagaatctcttcaagcaactgtcctcttcaaagcttccaggttgtgttacagcccggatgctgtggtgtatgatggcacctttgaggatgtgctgcctgtgaagaaagaggatgtccatctgagaggtttggagagcaaatgcttgtcagttgaagaagtgctgatgcagcacaaagattttccagatgctggtaaattgatgatgactgcagtgattttgggcaaggaactaacttttacagccacagaacctgtggagatggactcataa

SEQ ID NO: 7270 - protein, 1293 aa, Sorghum bicolor
  misc_feature: Ceres ANNOT ID no. 6075287
  misc_feature (88)..(531): Pfam Id: Nup133_N Pfam Desc: Nup133 N terminal like
  misc_feature (611)..(1167): Pfam Id: Nup133 Pfam Desc: Nup133 nucleoporin
  misc_feature (13)..(1280): NCBI GI: 83423284 NCBI Desc: nucleoporin [lotus corniculatus var. japonicus]
  misc_feature (662)..(924): NCBI GI: 47087231 NCBI Desc: zgc:55311 [danio rerio]
  misc_feature (765)..(924): NCBI GI: 20071177 NCBI Desc: nucleoporin 133 [mus musculus]
  misc_feature (765)..(924): NCBI GI: 26986607 NCBI Desc: nucleoporin 133 [mus musculus]
  misc_feature (765)..(926): NCBI GI: 119590305 NCBI Desc: nucleoporin 133kda, isoform cra_a [homo sapiens]
MFSPAIRRPHLLNRRDREEGSPSPPPAAPAHSPSPHGFAVPDRPATGTPVPWNSSSLLARISTSKRTDRTGDSDQIQPVRVAEFPQVVRNAQASLLQKNFSGKNMLAGGIDKETSLAWMICGNELFIWSYLASVAKDCIALDIPSSLIGYNDVKPLLGIQWTVCIMRWHSGGASTRNSGEMLHRKSSTGVILCNKRTQAVAYWPDIYAEFNRSLVLSSSGDGEVSACDAASDCLRFNSLIAAAVPGCIHECIAIASDPAGALWLFQCSPEGIHQRKVHADTLGDGGADHSQKSNGGRSLIWLPNNVSSEGSDRKFFLLTNNEVQCWSISFLNDINVKKLGSHGIVGTDGDVGIKKDIAGQKNIWLLDMQIDERGKEFSILVATLCKDRVSGSNYTQYSLLTMLYKPNQKLSSEDNVAKVERFLEKKAPSQVIIPKARVEDDEFLFSMRLKTGGKPSGSVIILSGDGTATVAMYWRGSTRLYQFDLPWDAGKVLDASVIPSAEDRDEGAWVVLTEKAGVWAIPEKAVLVGGVEPPERSLSRKGSCNETIAEEKRRSQGFSASVVPRRVSSEAWSAGERQRPALTGIAQQSVVDEESEMLLNRLFHDFIISSAVSEALQKLRAAGAFEKEGEMNIFVRTSKSIVNTLAKHWTTTREAEFLASTIVSSLVEKQQKHEKFLQFLVLSKCHEELASKQRAAMLTVMEHGEKLSGMAHLRELQNALIQQRSSTHLSPQSKTQGTGALWNLIQLVGEKARRNTVLLMDRDNAEVFYSRVSDIDDLFYCLSHELQYIISREEHPSVQMQRALELANACIALVQAASHYRKDHKEWYPSPEGLITWNIQPVVRSGIWSLASLIMELLGDSGAADMSMKSSLWSQLEGLTDILLEAYIGLLTAQFERGQEHGVLVQEYCERRDELLRSLYNLAKQIVEVKYQESKDGTDNLDLKESIFRKVISPILATAKRHEGYQTLWQICYDLDDSDLLRSLMHDSVGPHGGFSFFVFKELVNRGDYSKLLRLGEEFQEELASFLKERSDLLWLHEICLNQFSSASETLHTYALRGSPDGDASFTTSRKPLSFVERSRLLYLSKIAATAGKDIGYEVKVARIEADMRILKLQEEIVQHDPEYAQVKYTNALLGPSELIEMCLRRDRELSFKAFEVFALTSSSFRSSNRGLLEACWMNATDQDDWVKLSEASTLEGWSDELIEESLQATVLFKASRLCYSPDAVVYDGTFEDVLPVKKEDVHLRGLESKCLSVEEVLMQHKDFPDAGKLMMTAVILGKELTFTATEPVEMDS

SEQ ID NO: 7271 - DNA, 1377 bp, Sorghum bicolor
  misc_feature: Ceres ANNOT ID no. 6075294
  misc_feature: Encodes the peptide sequence at SEQ ID NO 7272
atgcctcccaccatgctcgcgccggtgcccaccaggccgcgctccaaccccttccgccggcgtagaggggctgctccgctgctccacgatcagactgcggcggctgcggcgaagcggcccgctgagtcgtccacctcggcctcctcctgcttctacagcgaggtgatctccaactcctccacatccctcgccgcgtatcagcacccggagaagaggcagcggcgccaggacgcggacgcggacgcgggcgaggcgcggccggctggctccgagtgctcggaggtgatcggcggcgcgagggtgcgcctcgccgaggtcgaggcctccgagtcgtcgtgccttggcgccgtgctcgagtccgacctcgcctgcccggagcagctcgccgacgacgctgagaggaccgactactcctccgcgtgcgatgagctgaccccgtcggagcccgatgaggaggaggtgcttagcggtcccagccgctccgctctgtactccctcagccccctgaccagctccccattgaccgaggatgacaacgacggcgcgccctccgcgaccttctccctcttcctcgacttcgccgagcagttcgtcccctgcgttcaccccaaagcgcgcgccgtcaccagtaccgctctcgatctcctgacggggaggcgatttgaggacttggacgacgaggagagctacgagcggttccggcggcgcgagcggcgcgaggctgttgcgcgcgactacactgaggtgtacagctccatacccggcagctacggccgtctcgtcgtggagcaacgtgtcgtcatggtgaactggatcattgagcattcacgtctgatgaaactccagccagttacaatgtttatggggattggattgatggaccgcttcttgacacaagggtatatgaagggtttgagcaaacttcagttgctgggcattgcctgcatcaccctggctacccgcattgaagagaaccagccatacaattgcgtccttcaaaagacttttaaagttgggatcaatacctacagccagagtgaggttgttgccatggagtggctggttcaggaggtcctcaacttcaagtgctttgtcacaacaactcaacatttcctatggttctatctgaaggctgcaaatgctgatgacagggtagcagacctggcaaactacctggccttcgtctcacttcgggaccataagaagctctccttctggccctcgactgtggcagccgcagtggtaacccttgcttgccttgccacaggcaaggggtcctcgtgtcatttggtgatggagactcacatgaggacgcaggacgatgacctgccagaatgcctaatgtgcctcgagtggctgctcaactacgtcccgtga

SEQ ID NO: 7272 - protein, 458 aa, Sorghum bicolor
  misc_feature: Ceres ANNOT ID no. 6075294
  misc_feature (228)..(364): Pfam Id: Cyclin_N Pfam Desc: Cyclin, N-terminal domain
  misc_feature (108)..(454): NCBI GI: 91805783 NCBI Desc: cyclin [arabidopsis thaliana]
  misc_feature (279)..(447): NCBI GI: 8778235 NCBI Desc: f10b6.15 [arabidopsis thaliana]
  misc_feature (227)..(447): NCBI GI: 1752809 NCBI Desc: cyclin a [asterina pectinifera]
  misc_feature (263)..(418): NCBI GI: 600859 NCBI Desc: cyclin 2
  misc_feature (265)..(429): NCBI GI: 12275256 NCBI Desc: cyclin b2 [silurana tropicalis]
  misc_feature: The sequence is a functional homolog of SEQ ID NO. 336 in the 11/188,298 US application
  misc_feature: The sequence is a functional homolog of SEQ ID NO. 511 in the 11/188,298 US application
MPPTMLAPVPTRPRSNPFRRRRGAAPLLHDQTAAAAAKRPAESSTSASSCFYSEVISNSSTSLAAYQHPEKRQRRQDADADAGEARPAGSECSEVIGGARVRLAEVEASESSCLGAVLESDLACPEQLADDAERTDYSSACDELTPSEPDEEEVLSGPSRSALYSLSPLTSSPLTEDDNDGAPSATFSLFLDFAEQFVPCVHPKARAVTSTALDLLTGRRFEDLDDEESYERFRRRERREAVARDYTEVYSSIPGSYGRLVVEQRVVMVNWIIEHSRLMKLQPVTMFMGIGLMDRFLTQGYMKGLSKLQLLGIACITLATRIEENQPYNCVLQKTFKVGINTYSQSEVVAMEWLVQEVLNFKCFVTTTQHFLWFYLKAANADDRVADLANYLAFVSLRDHKKLSFWPSTVAAAVVTLACLATGKGSSCHLVMETHMRTQDDDLPECLMCLEWLLNYVP

SEQ ID NO: 7273 - DNA, 1059 bp, Sorghum bicolor
  misc_feature: Ceres ANNOT ID no. 6075297
  misc_feature: Encodes the peptide sequence at SEQ ID NO 7274
atgggaagcgcaggtgcgctgcttttgcacccgccgccgcagctgcaacccggtggcgtcctcttccgcaagagccggcccctcctgcgccagcgcaacctgcctctattatcgctagctgccgcggcgctcgagcccgagcgccgccggcggcagagcctccgctgcgctgccgtcgacggggacggcgggccatgggaggctgggccactgccacagaaagagtctccgaccagccgcatcggcgccgcactcgaggacccacctcctgtggaaaatggttccttaggcccctcagaggaagaacagagtgctctgtataattttctttatccaagcaaagacttacttccagatgataaggagatgagtatatttgatcatctagaggagcttcgtgagaggattttcatctcagttttggctgttggggctgcgatactaggctgttttgctttttcaaaagatttggtgctttttctagaggccccagtgactgttcagggtgttcggtttttgcagctctcacctggggaatttttctttacaacattaaaggtttcaggttattgtggccttttacttggaagtcctatcattttgtatgagatcattgcatttgttatcccaggtttaacaagggacgagcggaaatttctcgggcctattgtgttgggttcttctgttctattctacctaggcattttcttctcctacacggttctcagccctgctgcgttgaacttctttgtgaattatgcagatggggcagtggaatcgttgtggtcaatagaccagtactttgaattcatacttgtgctgatgtttagcacaggtttgtcgtttcaggtccctgttatccagcttttgctgggacaacttggattggtttctagtgaccaaatgctttcaatctggagatatgttgttgttggtgctgttgttgctgctgccgtgcttacaccttcgacggatccgttgacacaaatgctcttggctggtcctttgcttggtttatacttgggtggtgcatggatggtcaagctaattgggcgataa

SEQ ID NO: 7274 - protein, 352 aa, Sorghum bicolor
  misc_feature: Ceres ANNOT ID no. 6075297
  misc_feature (134)..(335): Pfam Id: TatC Pfam Desc: Sec-independent protein translocase protein (TatC)
  misc_feature (41)..(352): NCBI GI: 25312108 NCBI Desc: tatc-like protein [imported] - arabidopsis thaliana
  misc_feature (73)..(352): NCBI GI: 15277529 NCBI Desc: tatc [pisum sativum]
  misc_feature (98)..(347): NCBI GI: 145351797 NCBI Desc: tat family transporter: protein export tatc [ostreococcus lucimarinus cce9901]
  misc_feature (117)..(352): NCBI GI: 119510447 NCBI Desc: sec-independent periplasmic protein translocase [nodularia spumigena ccy9414]
  misc_feature (117)..(352): NCBI GI: 67922171 NCBI Desc: sec-independent periplasmic protein translocase [crocosphaera watsonii wh 8501]
MGSAGALLLHPPPQLQPGGVLFRKSRPLLRQRNLPLLSLAAAALEPERRRRQSLRCAAVDGDGGPWEAGPLPQKESPTSRIGAALEDPPPVENGSLGPSEEEQSALYNFLYPSKDLLPDDKEMSIFDHLEELRERIFISVLAVGAAILGCFAFSKDLVLFLEAPVTVQGVRFLQLSPGEFFFTTLKVSGYCGLLLGSPIILYEIIAFVIPGLTRDERKFLGPIVLGSSVLFYLGIFFSYTVLSPAALNFFVNYADGAVESLWSIDQYFEFILVLMFSTGLSFQVPVIQLLLGQLGLVSSDQMLSIWRYVVVGAVVAAAVLTPSTDPLTQMLLAGPLLGLYLGGAWMVKLIGR

SEQ ID NO: 7275 - DNA, 2061 bp, Sorghum bicolor
  misc_feature: Ceres ANNOT ID no. 6075301
  misc_feature: Encodes the peptide sequence at SEQ ID NO 7276
atggcggcggcagaggcgcggggaggggagttccccgtggggatgaaggtgctggtcgtggacgacgacccgacgtgcctcctcgtgctcaagaggatgctccttgactgcagatacgacgtgacaacatgtcctcaggctacaagagcactaactatgctgcgagagaataggcgtggttttgatgttataataagtgatgtccacatgcctgatatggatggattcaggctacttgaacttgtaggccttgagatggaccttccagttatcatgatgtctgctgattcaagaacggatattgtaatgaagggaattaaacatggagcgtgtgactatttaataaaacctgtcagaatggaggagttgaaaaacatctggcaacatgttgttaggaaaaaatttaatgaaaacaaggatcatgagcattctggtagcctagatgataccgatcgtaacagaccaaccaataatgataatgaatatgcttcctctgcgaatgatggaggtgatggcagctggaaatctcagaaaaagaaaagagagaaagaagatgatgaaactgacctggaaaatggcgatccttcttctacatcaaagaaaccaagagttgtttggtcagttgagcttcatcaacaatttgtgaatgcagtcaatcacctcgggatagacaaagctgttccaaagaaaattttggaattgatgaatgtccctggcttaaccagggaaaatgttgccagccatttgcagaaattcagactatacctgaagagaattgctcagcatcatgcaggaatacctcatccatttgttgcgcctgcttctagtgctaaagttgctcctttaggaggactggaattccaagctttggctgcttctggtcagatccctcctcaagctctggctgctttgcaggatgaactccttggtcgacctacaagcagtttggcgttgcctggaagggaccagtcatctttgcgactggctgcaatcaaaggaaacaagtcccatggagagagagaaatagcatttggtcaacccatatacaagtgtcagaataacgcatatggcgcattccctcaaagcagcccatcagttggaggattgccatcttttgcagcttggcccaataacaaacttggtatgactgattcaccaagcacattgggaaatgtgggcagttctcaaaataataatatgctattgcatgaattgcagcaacagccagacacattgctgtcaggaacccttcacaatattgatgtcaaaccttctggtgtagttatgccatctcagtcgttaaatgcattcccggctagtgagggtatctcacctaatcaaaatcccttgattctaccatctcaatcctcaagttttctggcatcaattcctccatccatgaaacatgaacctcttcttggatcaccttcaccgtcaactagtctgttgggtgggcttgatatggttaatcaagcttcaacaagtcagcctctgattagtagccatggagcaaatcttcctggtctcataaaccgcagcacaaatgcaatgccttcaccaggaattaataattttcaaagtgggaacataccttatctggttaatcagaatgctatgggagttagctcaagaccaccaggtgttctaaagactgagagcactgactcgctgagtcgtagttatggctatattggtggtagtaccagtgtggactctgtcttgctgtcttctcagtccaaaaatgcacagtatggtttactgcagagtcaaaatgatgttagcggcagctggtcgccttcacaagattttgatagttttggaaattctcttgggcaaggccaccctggttccacttcatctaacttccagagttctgcccttggcaagctacctgaccaaggacgagggaggaatcatgggtttgtcgggaaaggcacttgcattccaagccgctttgcagtggatgaggttgaatctccaactaacaacttgagccacagcattggaaacagtggagacatagtgaaccccgacatattcggatttagtggacagatgtga

SEQ ID NO: 7276 - protein, 686 aa, Sorghum bicolor
  misc_feature: Ceres ANNOT ID no. 6075301
  misc_feature (15)..(128): Pfam Id: Response_reg Pfam Desc: Response regulator receiver domain
  misc_feature (203)..(253): Pfam Id: Myb_DNA-binding Pfam Desc: Myb-like DNA-binding domain
  misc_feature (1)..(686): NCBI GI: 13661174 NCBI Desc: response regulator 8 [zea mays]
  misc_feature (1)..(686): NCBI GI: 15667625 NCBI Desc: response regulator 10 [zea mays]
  misc_feature (10)..(508): NCBI GI: 33330870 NCBI Desc: type-b response regulator [catharanthus roseus]
  misc_feature (10)..(505): NCBI GI: 109631196 NCBI Desc: srr384 [striga asiatica]
  misc_feature (11)..(530): NCBI GI: 4210449 NCBI Desc: arr1 protein [arabidopsis thaliana]
  misc_feature: The sequence is a functional homolog of SEQ ID NO 1104 in the 11/479,226US patent application
  misc_feature: The sequence is a functional homolog of SEQ ID NO 1232 in the 10/666,642US patent application
  misc_feature: The sequence is a functional homolog of SEQ ID NO 1233 in the 10/666,642US patent application
  misc_feature: The sequence is a functional homolog of SEQ ID NO 1990 in the 11/479,226US patent application
  misc_feature: The sequence is a functional homolog of SEQ ID NO 1992 in the 11/479,226US patent application
  misc_feature: The sequence is a functional homolog of SEQ ID NO 1999 in the 11/479,226US patent application
  misc_feature: The sequence is a functional homolog of SEQ ID NO 2000 in the 11/479,226US patent application
  misc_feature: The sequence is a functional homolog of SEQ ID NO 238 in the 10/666,642US patent application
  misc_feature: The sequence is a functional homolog of SEQ ID NO 2404 in the 10/374,780US patent application
  misc_feature: The sequence is a functional homolog of SEQ ID NO 550 in the 10/225,066US patent application
  misc_feature: The sequence is a functional homolog of SEQ ID NO 912 in the 10/412,699US patent application
  misc_feature: The sequence is a functional homolog of SEQ ID NO 932 in the 10/666,642US patent application
  misc_feature: The sequence is a functional homolog of SEQ ID NO 933 in the 10/666,642US patent application
  misc_feature: The sequence is a functional homolog of SEQ ID NO 934 in the 10/666,642US patent application
  misc_feature: The sequence is a functional homolog of SEQ ID NO 935 in the 10/666,642US patent application
  misc_feature: The sequence is a functional homolog of SEQ ID NO 936 in the 10/666,642US patent application
  misc_feature: The sequence is a functional homolog of SEQ ID NO 937 in the 10/666,642US patent application
  misc_feature: Useful for making plants with altered Lignin content
  misc_feature: Useful for making plants with modulated growth and phenotype characteristics
  misc_feature: Functional homolog of the protein sequence given in SEQ ID NO 13182
  misc_feature: The sequence is a functional homolog of SEQ ID NO 912 in the 20040045049 US patent application
  misc_feature: The sequence is a functional homolog of SEQ ID NO 550 in the 20050160493 US patent application
  misc_feature: The sequence is a functional homolog of SEQ ID NO 1990 in the 20070022495 US patent application
  misc_feature: The sequence is a functional homolog of SEQ ID NO 1992 in the 20070022495 US patent application
  misc_feature: The sequence is a functional homolog of SEQ ID NO 1999 in the 20070022495 US patent application
  misc_feature: The sequence is a functional homolog of SEQ ID NO 2000 in the 20070022495 US patent application
  misc_feature: The sequence is a functional homolog of SEQ ID NO 1232 in the 20070033671 US patent application
  misc_feature: The sequence is a functional homolog of SEQ ID NO 1233 in the 20070033671 US patent application
  misc_feature: The sequence is a functional homolog of SEQ ID NO 932 in the 20070033671 US patent application
  misc_feature: The sequence is a functional homolog of SEQ ID NO 933 in the 20070033671 US patent application
  misc_feature: The sequence is a functional homolog of SEQ ID NO 934 in the 20070033671 US patent application
  misc_feature: The sequence is a functional homolog of SEQ ID NO 935 in the 20070033671 US patent application
  misc_feature: The sequence is a functional homolog of SEQ ID NO 936 in the 20070033671 US patent application
  misc_feature: The sequence is a functional homolog of SEQ ID NO 937 in the 20070033671 US patent application
  misc_feature: Useful for making plants with altered lignin content
  misc_feature: Functional homolog of the protein sequence given in SEQ ID NO 13182
  misc_feature: The sequence is a functional homolog of SEQ ID NO 172 in the 10/666,642 US patent application
  misc_feature: The sequence is a functional homolog of SEQ ID NO 2510 in the 10/374,780 US patent application
  misc_feature: The sequence is a functional homolog of SEQ ID NO 686 in the 10/412,699 US patent application
  misc_feature: The sequence is a functional homolog of SEQ ID NO 976 in the 10/225,066 US patent application
  misc_feature: The sequence is a functional homolog of SEQ ID NO 1452 in the 11/479,226 US patent application
  misc_feature: The sequence is a functional homolog of SEQ ID NO 148 in the 10/225,066 US patent application
  misc_feature: The sequence is a functional homolog of SEQ ID NO 2512 in the 10/374,780 US patent application
  misc_feature: The sequence is a functional homolog of SEQ ID NO 688 in the 10/412,699 US patent application
  misc_feature: The sequence is a functional homolog of SEQ ID NO 936 in the 10/666,642 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 2000 in the 11/479,226 US patent application
  misc_feature: The sequence is a functional homolog of SEQ ID NO 1999 in the 11/479,226 US patent application
  misc_feature: The sequence is a functional homolog of SEQ ID NO. 378 in the 11/188,298 US application
MAAAEARGGEFPVGMKVLVVDDDPTCLLVLKRMLLDCRYDVTTCPQATRALTMLRENRRGFDVIISDVHMPDMDGFRLLELVGLEMDLPVIMMSADSRTDIVMKGIKHGACDYLIKPVRMEELKNIWQHVVRKKFNENKDHEHSGSLDDTDRNRPTNNDNEYASSANDGGDGSWKSQKKKREKEDDETDLENGDPSSTSKKPRVVWSVELHQQFVNAVNHLGIDKAVPKKILELMNVPGLTRENVASHLQKFRLYLKRIAQHHAGIPHPFVAPASSAKVAPLGGLEFQALAASGQIPPQALAALQDELLGRPTSSLALPGRDQSSLRLAAIKGNKSHGEREIAFGQPIYKCQNNAYGAFPQSSPSVGGLPSFAAWPNNKLGMTDSPSTLGNVGSSQNNNMLLHELQQQPDTLLSGTLHNIDVKPSGVVMPSQSLNAFPASEGISPNQNPLILPSQSSSFLASIPPSMKHEPLLGSPSPSTSLLGGLDMVNQASTSQPLISSHGANLPGLINRSTNAMPSPGINNFQSGNIPYLVNQNAMGVSSRPPGVLKTESTDSLSRSYGYIGGSTSVDSVLLSSQSKNAQYGLLQSQNDVSGSWSPSQDFDSFGNSLGQGHPGSTSSNFQSSALGKLPDQGRGRNHGFVGKGTCIPSRFAVDEVESPTNNLSHSIGNSGDIVNPDIFGFSGQM

SEQ ID NO: 7277 - DNA, 1014 bp, Sorghum bicolor
  misc_feature: Ceres ANNOT ID no. 6075303
  misc_feature: Encodes the peptide sequence at SEQ ID NO 7278
atgtcctccgccgccgcccgagccctcacgtcggtctcccgcgcagccttctcctggaagccgacggggcgcccgcagcaaacgctggcggcggcagtgagcaggtcgggcgtggggctccactcgggagcgcgcgtcaccgccacgctgttcccgacgcaagctggcgagggtaggtatttcctcgtggagggtgaggaggaggcgaaggtggcggcagaggtggggaacgccgagccacggtcgcagctctgcacgacgcttcggcgaggcgaaggcgcccacacgcgggtccggacggtggagcaccttctctcggcgatggaggcgcttggcgtcgacaattgccgtatcgaggttagcggcggtgacgagattcctttgcttgatggatcagcgcaagagtgggtagaagcaatacaaagcgttggcttgtgtgcggcagaggatgccaatgggctaaagttggataaactggcgcctgaaattcatgagcctgtttacctagggaaagatgattgctttatagctgcattccctagctcgcaaatccacatcacctatggcattgatttcccaaaggtgccaacgattgggtgtcaatgggtttctacattcctggatgagaatatatactcaagcaagattgcacctgcaagaactttctgtatatttgaagaggttgaaaaaatgcgtgctgctggactcatcaaaggagggtcactagaaaatgctatggtttgcagcatatctggtggttggctgaatccaccactgcggtttgaggatgaaccttgccgccacaagattttagatcttattggtgacttctcgctgtttgcacagaatggtaaccagggttttccaattgctcatataattgcctataaggctggtcacgcgctgcacactgattttctcagccatctgtctggaaagaacactgtggaccaagaacaacttgctgggcaatgttcaaatatatgcggctcctattcatcgtatgttcggtag

SEQ ID NO: 7278 - protein, 337 aa, Sorghum bicolor
  misc_feature: Ceres ANNOT ID no. 6075303
  misc_feature (22)..(315): Pfam Id: LpxC Pfam Desc: UDP-3-O-acyl N-acetylglycosamine deacetylase
  misc_feature (7)..(297): NCBI GI: 9945091 NCBI Desc: f5a9.8 [arabidopsis thaliana]
  misc_feature (26)..(303): NCBI GI: 17229762 NCBI Desc: udp-3-o-acyl n-acetylglucosamine deacetylase [nostoc sp. pcc 7120]
  misc_feature (26)..(303): NCBI GI: 75906320 NCBI Desc: udp-3-0-acyl n-acetylglucosamine deacetylase [anabaena variabilis atcc 29413]
  misc_feature (28)..(315): NCBI GI: 67924367 NCBI Desc: udp-3-0-acyl n-acetylglucosamine deacetylase [crocosphaera watsonii wh 8501]
  misc_feature (26)..(303): NCBI GI: 23125700 NCBI Desc: cog0774: udp-3-o-acyl-n-acetylglucosamine deacetylase [nostoc punctiforme pcc 73102]
  misc_feature: Useful for making plants with altered cell wall content and/or composition
  misc_feature: GREAT-hit functional homolog of the protein sequence encoded by LOCUS at1g24793
  misc_feature: GREAT-hit functional homolog of the protein sequence encoded by LOCUS at1g24880
  misc_feature: GREAT-hit functional homolog of the protein sequence encoded by LOCUS at1g25054
  misc_feature: Useful for making plants with altered cell wall content and/or composition
  misc_feature: Functional homolog of the protein sequence given in SEQ ID NO 13989
MSSAAARALTSVSRAAFSWKPTGRPQQTLAAAVSRSGVGLHSGARVTATLFPTQAGEGRYFLVEGEEEAKVAAEVGNAEPRSQLCTTLRRGEGAHTRVRTVEHLLSAMEALGVDNCRIEVSGGDEIPLLDGSAQEWVEAIQSVGLCAAEDANGLKLDKLAPEIHEPVYLGKDDCFIAAFPSSQIHITYGIDFPKVPTIGCQWVSTFLDENIYSSKIAPARTFCIFEEVEKMRAAGLIKGGSLENAMVCSISGGWLNPPLRFEDEPCRHKILDLIGDFSLFAQNGNQGFPIAHIIAYKAGHALHTDFLSHLSGKNTVDQEQLAGQCSNICGSYSSYVR

SEQ ID NO: 7279 - DNA, 558 bp, Sorghum bicolor
  misc_feature: Ceres ANNOT ID no. 6075334
  misc_feature: Encodes the peptide sequence at SEQ ID NO 7280
atggcagggaaagccggcggactcaaaggggttgccctcatcggcggcggcgccaacagcacggtcgccggggccctccacttcttcgaggacccctccaccagtaggtacaccgaggtgaggggcaaggtcacgggcttgactccgggaaggcatggatttcacatccacgtctttggcgacactaccaatggctgcaactcaaccgggccccattttaaccctcacaataagccccatggagctccatttgataaggaacgacatgcgggtgacctgggaaacatagtagcaaacgaagatggagttgcagaagtgttcataagggacttacagatttcactgagtgggcctcattccatactaggaagggcagttgttgtccatgctgatcctgatgacctggggaggggtggccatgaactcagtaagtcaacaggaaatgcaggagctagaattggatgtgctctaaatccaggacttcctagagctttaggcaaccgtgtctatagatttcctagagttagaggcttagagctgtgccaaacagggccttaa

SEQ ID NO: 7280 - protein, 185 aa, Sorghum bicolor
  misc_feature: Ceres ANNOT ID no. 6075334
  misc_feature (8)..(159): Pfam Id: Sod_Cu Pfam Desc: Copper/zinc superoxide dismutase (SODC)
  misc_feature (3)..(157): NCBI GI: 115451597 NCBI Desc: os03g0219200 [oryza sativa (japonica cultivar-group)]
  misc_feature (6)..(165): NCBI GI: 113367100 NCBI Desc: copper/zinc superoxide dismutase [musa basjoo var. formosana]
  misc_feature (1)..(157): NCBI GI: 92881794 NCBI Desc: superoxide dismutase, copper/zinc binding [medicago truncatula]
  misc_feature (6)..(157): NCBI GI: 2660798 NCBI Desc: cytosolic copper/zinc superoxide dismutase [mesembryanthemum crystallinum]
  misc_feature (6)..(157): NCBI GI: 3273755 NCBI Desc: copper/zinc superoxide dismutase [arabidopsis thaliana]
  misc_feature (6)..(157): SWISSPROT Homolog: EC 1.15.1.1 Superoxide dismutase [Cu-Zn] 2
MAGKAGGLKGVALIGGGANSTVAGALHFFEDPSTSRYTEVRGKVTGLTPGRHGFHIHVFGDTTNGCNSTGPHFNPHNKPHGAPFDKERHAGDLGNIVANEDGVAEVFIRDLQISLSGPHSILGRAVVVHADPDDLGRGGHELSKSTGNAGARIGCALNPGLPRALGNRVYRFPRVRGLELCQTGP

SEQ ID NO: 7281 - DNA, 1335 bp, Sorghum bicolor
  misc_feature: Ceres ANNOT ID no. 6075335
  misc_feature: Encodes the peptide sequence at SEQ ID NO 7282
atggccatcgacaaggtggatgccaaggagagggagaagatcgaggccgtccgcaagctgctgcgcaagcaggcgccgctctccgcaaagcaggcacagtactgcaacgacgcgtgcgtggagcggttcctgcggtcgcggggggagaacgtcaagaaggcggcgaagcacctgaggaccgtcctctcatggagggagaccgtcggagctgatcacatcatggccgacgagttctccgccgagctcgccgacggcgtggccttcgtctcgggccacgacgacgacggccgcccagttgtggtgtttcgaatcaagcaggactaccccaagttccactcgcagaaatcgttcgtgcggctgatggtgttcacactggaggtggcggtggcgtgcatgtcccggttcgtggaccagttcgtcctcctcttcgatgcaagctttttccgctcggcgtcggctttcctcaacctgctcatgggcacgctcaagatcgtcgccgactactaccccggccgcctccaccgcgccttcgtcatcgacccgccctccctcttctccgtcctctggaagggagtgcggccgttcgtggagctggcgccggcgacggcggtggtgtgctccctggacttcgaggactcgctggaggacgcctccttcacggcgtacccgcggaccgcgtcgctgcggtacgagccggcggtggcggcggcggccgccgtcgtggggaaggccggtgtcgggtcggcctcgtcgcggttctccgtcacccccaccgacaaccctatcaagccgtggtacctctccaccatccccacctcggtgggctcccgttccgtggtgcccacctccagcagcccgtcgctggtcggcgcgtccccgctctccgcgcgctccttctccttcgcctcgcccgccacgctgcgctccacggccgccacgccgccgccgttcccacgcggcggcgttggtgcgccgcccctgacgccgtcctccgccgccaagggcccccacaagaccccgccgccagcgcagcatttcccgcggacgcctcggccgtcgttcctgcagtcgccgtcgatgctgttcgcgttccggaaggaggggcagggcgccagccgcgtggagcgcgagcgcgagtccttcctcccgtacctgcgcttctaccgccggccctacgacgagatttcctaccgcgccaagatgcgcccgccgctcggcggcctcatatcaatcgtcggcgagaagttcaagcagaagccggtgcagcagccgctgcgtcggcacgccgggctccaccaccacaaccaccattaccaacagcagcagaggatctga

SEQ ID NO: 7282 - protein, 444 aa, Sorghum bicolor
  misc_feature: Ceres ANNOT ID no. 6075335
  misc_feature (12)..(386): NCBI GI: 2388560 NCBI Desc: yup8h12.1 [arabidopsis thaliana]
  misc_feature (12)..(305): NCBI GI: 8778733 NCBI Desc: t25n20.2 [arabidopsis thaliana]
  misc_feature (13)..(203): NCBI GI: 30687745 NCBI Desc: sec14 cytosolic factor family protein / phosphoglyceride transfer family protein [arabidopsis thaliana]
  misc_feature (4)..(197): NCBI GI: 92871092 NCBI Desc: cellular retinaldehyde binding/alpha-tocopherol transport; cellular retinaldehyde-binding/triple function, n-terminal [medicago truncatula]
  misc_feature (8)..(205): NCBI GI: 17226662 NCBI Desc: polyphosphoinositide binding protein [gossypium hirsutum]
MAIDKVDAKEREKIEAVRKLLRKQAPLSAKQAQYCNDACVERFLRSRGENVKKAAKHLRTVLSWRETVGADHIMADEFSAELADGVAFVSGHDDDGRPVVVFRIKQDYPKFHSQKSFVRLMVFTLEVAVACMSRFVDQFVLLFDASFFRSASAFLNLLMGTLKIVADYYPGRLHRAFVIDPPSLFSVLWKGVRPFVELAPATAVVCSLDFEDSLEDASFTAYPRTASLRYEPAVAAAAAVVGKAGVGSASSRFSVTPTDNPIKPWYLSTIPTSVGSRSVVPTSSSPSLVGASPLSARSFSFASPATLRSTAATPPPFPRGGVGAPPLTPSSAAKGPHKTPPPAQHFPRTPRPSFLQSPSMLFAFRKEGQGASRVERERESFLPYLRFYRRPYDEISYRAKMRPPLGGLISIVGEKFKQKPVQQPLRRHAGLHHHNHHYQQQQRI

SEQ ID NO: 7283 - DNA, 1647 bp, Sorghum bicolor
  misc_feature: Ceres ANNOT ID no. 6075336
  misc_feature: Encodes the peptide sequence at SEQ ID NO 7284
atggctgaacaattatacaccgtggcatcagatagtgaaaccactggggaagacaaatcacagccttcattccctgatgttgctattggcattgacattgggacttccaaatgcagtgttgctgtttggaatggtcaccaagttgagctcttaaagaatacccgtaatcagaaagggatgaggtcatatgtcatgttcaaagatgatactctttcagcaggagttactggaggggcagccaaggaaaatgcacatgaggaaagagacatcttatcaggaagtgccatattcaacatgaaacgcctgataggaagaatggacactgatgaagtggttcaagctagtaagaccctcccatttctcgtgcagacattgggtatcggtgtgagaccgtttattgcggcactcgtgaacaacatgtggcgatctacaactccggaggaggtccttgccatctttcttcttgaattgaaggccttggtggagatgcatcttaaacatcctgtgaggaatgctgtgcttaccataccagttgcattcagtcgatttcagcaaaccaggattgagagagcctgtgctatggctgggctgcatgtgttgaggttgatgccggaaccaactgctgtggcacttctgtatgctcagcagcagcagcagcttgtgaatgacaatatgggaagcggcattgagaaaattggccgtgctggtggggaggatatacttcagaacataatgcgccatgttgttcccaattttgacaatttatatgctggccagacaatggatagaatccagtcgatgagtttactgcgaatggcaactcaagatgcaattcacaaactggttaaccaggaaactgtggagatcaatatagatttggggaatggccacaaagtgtccaaagtcctagaccattcagagtttgaacaagtcaaccgggcaatttttgataagtgtgaaaagatcatcaaccagtgcttggttgatgcgaagttagtaccagaggacatcaatgatgtcatattggttggtggttgttcgaagatccccagaatcagaagccttgtcctgggtctatgcaagaaggagatctcttacaagaacatagatgctctagaagccgctgtttctggtgctgcgctggaaggagccatcgcttcaggagtgaatgatccttcagggagcttggatcttctcacaatccaggcaactcctatgaacctgggaatccgtgccaatggcgatagctttgctgcaatcattcccaggaacacgacagtgccagccagaagggacatgctgttcacaacgacacatgacaaccagactgaagccctaattgctgtgtatgaaggagaaggggaacgtgctgaagataaccatctgttaggatacttcaagattactggaatcccagcagcccctaagggaacagttgagatcagtgtatgcatggacatcgacgctaccaatgtcctcagggtgtttgcaggggtcgtcaagcctcaaggcccagccactccaccattcatcgaggtgaggatgccaacgctggacgatggccatggctggtgtgggcaagctctagcaaagatgtatgggaagactctcgaccttgctgttcttccaaagaagctgcagccatga

SEQ ID NO: 7284 - protein, 548 aa, Sorghum bicolor
  misc_feature: Ceres ANNOT ID no. 6075336
  misc_feature (28)..(548): Pfam Id: HSP70 Pfam Desc: Hsp70 protein
  misc_feature (236)..(546): NCBI GI: 24111419 NCBI Desc: at2g32120/f22d22.13 [arabidopsis thaliana]
  misc_feature (236)..(546): NCBI GI: 21618151 NCBI Desc: 70kd heat shock protein [arabidopsis thaliana]
  misc_feature (3)..(544): NCBI GI: 140056992 NCBI Desc: heat shock protein hsp70 [medicago truncatula]
  misc_feature (235)..(544): NCBI GI: 92868308 NCBI Desc: short-chain dehydrogenase/reductase sdr [medicago truncatula]
  misc_feature (209)..(542): NCBI GI: 92877330 NCBI Desc: heat shock protein hsp70 [medicago truncatula]
MAEQLYTVASDSETTGEDKSQPSFPDVAIGIDIGTSKCSVAVWNGHQVELLKNTRNQKGMRSYVMFKDDTLSAGVTGGAAKENAHEERDILSGSAIFNMKRLIGRMDTDEVVQASKTLPFLVQTLGIGVRPFIAALVNNMWRSTTPEEVLAIFLLELKALVEMHLKHPVRNAVLTIPVAFSRFQQTRIERACAMAGLHVLRLMPEPTAVALLYAQQQQQLVNDNMGSGIEKIGRAGGEDILQNIMRHVVPNFDNLYAGQTMDRIQSMSLLRMATQDAIHKLVNQETVEINIDLGNGHKVSKVLDHSEFEQVNRAIFDKCEKIINQCLVDAKLVPEDINDVILVGGCSKIPRIRSLVLGLCKKEISYKNIDALEAAVSGAALEGAIASGVNDPSGSLDLLTIQATPMNLGIRANGDSFAAIIPRNTTVPARRDMLFTTTHDNQTEALIAVYEGEGERAEDNHLLGYFKITGIPAAPKGTVEISVCMDIDATNVLRVFAGVVKPQGPATPPFIEVRMPTLDDGHGWCGQALAKMYGKTLDLAVLPKKLQP

SEQ ID NO: 7285 - DNA, 1272 bp, Sorghum bicolor
  misc_feature: Ceres ANNOT ID no. 6075347
  misc_feature: Encodes the peptide sequence at SEQ ID NO 7286
atgggtcccgcgaggcttcccctagcctgcatcgtcaccacgttgatctttgtctacatgctagtacaccacggcgccagttcgcaggaagttttcccggaggctgacggcccggcagcagagaattcagacgagctgtggctcaggtccggaccgccgccgagggtcgtcgacgtcgatgactacggagccggagatgccggcggcgaccacgtcaccgaggcgtttctcgaggcgtggagcgaggcctgcaactcctccgatgaccggtccgtgttcctcgtgcccgagggcaaggcctacctcctgatgcccgtcatcttccgtggcccctgcagagctgtctcgatcactgcgatgataaagggaacgctggaggcgccgtccaaccgatcggtctggctggatcaggatctgcaggagtggatcacgttcgagggcatcgatcgcctccgtgtcctcggcggcggcaccctcgatggcaacgggcttcagtggtggatcaactcgtgcaagctcaacaaatcaatggcactgtacttcaggaggtgcacccacctggtggtggaggagctggaggtgagagacagcatgcagatgcacgtcgcgatcgcctactcgtggaacgtggtcgtgtcgaagctgctcatcactgcaccggggtggagccccaacaccgacggcatccatgtgtccaacagcagggaagtgtccataagcaagtgcaccatcagcacaggggatgactgtatatccattgtgactggatcaatgtttgtacgggtaaccagcatattttgcggaccgggccatggaataagcattggtagtctaggagcaaacaactcttgggcccatgtctctgatgtcctcgttgagaaagccacgctgctgggcactaccaacggtgtgaggatcaaaacttggcagggaggacatggctatgctgaaagaattagcttccaagatatatcaatgcacaacgttactaacccaataattatcgatcagaactactgtgactccaagagaccttgtcatgaacagggatcagcggttgccgtacgcaatatacgctacagaaacatacatggaactagtgcttcaaaagtcgccgtcaattttatttgcagtggcgctctgcactgtgatggtatactaatgcaagatatttatttggttggagaaggaagatatgctacatgttcttatacgaacgctacagttgtacaatttgggtataacttccctttttgcagtgcagagatgtag

SEQ ID NO: 7286 - protein, 423 aa, Sorghum bicolor
  misc_feature: Ceres ANNOT ID no. 6075347
  misc_feature (84)..(420): Pfam Id: Glyco_hydro_28 Pfam Desc: Glycosyl hydrolases family 28
  misc_feature (55)..(420): NCBI GI: 15081600 NCBI Desc: polygalacturonase pg1 [vitis vinifera]
  misc_feature (55)..(422): NCBI GI: 548488 NCBI Desc: polygalacturonase precursor (pg) (pectinase)
  misc_feature (55)..(422): NCBI GI: 166325 NCBI Desc: polygalacturonase [actinidia deliciosa]
  misc_feature (53)..(411): NCBI GI: 166951 NCBI Desc: polygalacturonase
  misc_feature (55)..(419): NCBI GI: 7959983 NCBI Desc: polygalacturonase a [actinidia chinensis]
  misc_feature (55)..(422): SWISSPROT Homolog: EC 3.2.1.15 Polygalacturonase precursor
  misc_feature: Useful for making plants with altered cell wall content and/or composition
  misc_feature: Functional homolog of the protein sequence encoded by LOCUS at2g41850
  misc_feature: Functional homolog of the protein sequence encoded by LOCUS at4g35670
  misc_feature: Functional homolog of the protein sequence encoded by LOCUS at5g17200
  misc_feature: Useful for making plants with altered carbohydrate content
  misc_feature: Functional homolog of the protein sequence given in SEQ ID NO 13985
MGPARLPLACIVTTLIFVYMLVHHGASSQEVFPEADGPAAENSDELWLRSGPPPRVVDVDDYGAGDAGGDHVTEAFLEAWSEACNSSDDRSVFLVPEGKAYLLMPVIFRGPCRAVSITAMIKGTLEAPSNRSVWLDQDLQEWITFEGIDRLRVLGGGTLDGNGLQWWINSCKLNKSMALYFRRCTHLVVEELEVRDSMQMHVAIAYSWNVVVSKLLITAPGWSPNTDGIHVSNSREVSISKCTISTGDDCISIVTGSMFVRVTSIFCGPGHGISIGSLGANNSWAHVSDVLVEKATLLGTTNGVRIKTWQGGHGYAERISFQDISMHNVTNPIIIDQNYCDSKRPCHEQGSAVAVRNIRYRNIHGTSASKVAVNFICSGALHCDGILMQDIYLVGEGRYATCSYTNATVVQFGYNFPFCSAEM

SEQ ID NO: 7287 - DNA, 2754 bp, Sorghum bicolor
  misc_feature: Ceres ANNOT ID no. 6075350
  misc_feature: Encodes the peptide sequence at SEQ ID NO 7288
atggatccgccgccgcggcggctagccgccccgctgctcctcctcctcctgctcctcgccgcggccttcgccgccgcgcgcgcgtggaagaaggacgagttccgcaactgcaaccagacgcccttctgcaagcgcgctcggacccgcgccccgcactcgctcgaagcgccgctctccctcgccgccggctccctcaccgtcgcccccgacggctctatctccgccgagctctcccacccttcccgcccgcggcccctcgtgctccgcctctccgcgctgcccccgcacgcgctgcggctccagatcgatgaggactactccaccgccactccgccgcaccgccggttccacgtccccgatgtcctcgtcccggacctcgaggcccgcacgctccacctccccgagcccaagaccgccgccggcgtatccaccgtcgcgctctcctccgaccttgacgtcgtcgttaagcacgatccgttcgagcttaccgtccgccgcgctgggtcgggcgatcccgtgctctccttcaactcccacggcctcttcgacttcgagccgatgcgggagtccaagccggaggacgagacgtgggaggagcacttccggagccacaccgacaagcgcccccgcggtccgcagtccatcaccttcgacgtgtccttctatggcgcggacttcgtctacggtctcccggagcacgggtccacttcgctcgccctcctccccacccgcggcccgggggtcgaggagtccgagccctaccgcctcttcaaccttgatgtcttcgagtacctccatgaatcgcccttcggtttgtatggctcgatccccttcatgattgggcacggtgatcgggcgtcgtctggcttcttctggctcaacgcagcggagatgcagatcgacgtgcttgcgccaggttgggatggggccactgcccaggagaatgggcagatcgacacactgtggatggctgaggctggcgtggtcgatgcattcttctttgttggttctgagccgaaagatgtgatcaagcagtacataagtgtgacaggcacaccttcaatgccacagcagtttgctacagcgtatcaccaatgccggtggaactaccgggatgaggcagatgttgatggagtagatgctggttttgatgagcatgatattccatatgatgtcctctggcttgacattgagcatacggatggcaagcggtactttacatgggatcgttctgccttccccaatccagaggagatgcagcgaaagatagctgataaggggaggaagatggtcaccatcgtggatccccatatcaagcgggacagttcattccacctccatcaggaggcaacagacaaggggtactatgtgaaagatgccaatgggaatgactttgatgggtggtgctggcctggatcatcatcctatcctgacatgttgaatcctgagatacgtgagtggtgggctgacaagttctcctatgaaaactacaagggatcaactccaacactgtacatttggaatgatatgaatgagccatcagtcttcaatggccctgaggtcaccatgcccagggatgcaatgcattatggagatgctgaacaccgagaattgcacaatgcatatgggtactacttccatatggctactgcagatggacttctcaagcgaggcgaggggaaagatagaccctttgttttgtcaagggccttctttgctggaagtcaacggtatggtgcagtttggacaggcgacaactccgcagactgggatcacctgaaatcttctatcccaatggtcttaactcttggtcttactggcttgcctttctctggcgcggatgttggtggattctttggaaacccagaaccagacctattggtgcgttggtaccaagtaggagccttttatcctttctttaggggtcacgcccatcatgacacaaagagacgtgagccatggttatttggagagcgaagaactgccatcataagggaggcgatacatatgcggtattcattgttgccctacttctacacgctgttcagagaggctagtgtaaatggcattcctgtcatgcgtcctttatggctagaatttcctgatgataaagaaacatataacaatggggaggcgtttatggtggggccaagccttttagctcaaggaatatacgaagagggccagaaatcagtgtctgtctaccttcctgggaaggagtcatggtatgacttgagaaatggatctccatacaagggaagtgtgacacataagctacaggttttagaagatagcattcccagcttccaaagggctggtacaattgtgccaagaaaggacagattcagacgcagttctactcagatggtgaatgatccatacactctggtgatagctctcaacagttcaggtgctgcagaaggcgaactttatgtggatgacgggaaaagttatgattaccagcaaggggcattcatccatcgccgatttgtctttgcagacaataagctaacttcgttcaatattgcacctgacaatttgggcaagaaatttgcaagtgattgcgtgattgaaagaattatagtcctcggtttacgatctggagcaaagaaggctattattgagcctggaaaccaagaagtagaaattgaatcaggaccgattagtttaaggagtggttccagcccggttgcaccaacaatccggaggcccaatgttcgcattgcggacagttggacaataaggatagcataa

SEQ ID NO: 7288 - protein, 917 aa, Sorghum bicolor
  misc_feature: Ceres ANNOT ID no. 6075350
  misc_feature (332)..(776): Pfam Id: Glyco_hydro_31 Pfam Desc: Glycosyl hydrolases family 31
  misc_feature (58)..(917): NCBI GI: 115451569 NCBI Desc: os03g0216600 [oryza sativa (japonica cultivar-group)]
  misc_feature (14)..(916): NCBI GI: 92869664 NCBI Desc: glycoside hydrolase, family 31 [medicago truncatula]
  misc_feature (8)..(916): NCBI GI: 2648032 NCBI Desc: alpha-glucosidase [solanum tuberosum]
  misc_feature (8)..(916): NCBI GI: 38322939 NCBI Desc: alpha glucosidase ii [lycopersicon esculentum]
  misc_feature (188)..(916): NCBI GI: 7672977 NCBI Desc: glucosidase ii alpha subunit [homo sapiens]
  misc_feature (188)..(916): SWISSPROT Homolog: EC 3.2.1.84 Neutral alpha-glucosidase AB precursor
MDPPPRRLAAPLLLLLLLLAAAFAAARAWKKDEFRNCNQTPFCKRARTRAPHSLEAPLSLAAGSLTVAPDGSISAELSHPSRPRPLVLRLSALPPHALRLQIDEDYSTATPPHRRFHVPDVLVPDLEARTLHLPEPKTAAGVSTVALSSDLDVVVKHDPFELTVRRAGSGDPVLSFNSHGLFDFEPMRESKPEDETWEEHFRSHTDKRPRGPQSITFDVSFYGADFVYGLPEHGSTSLALLPTRGPGVEESEPYRLFNLDVFEYLHESPFGLYGSIPFMIGHGDRASSGFFWLNAAEMQIDVLAPGWDGATAQENGQIDTLWMAEAGVVDAFFFVGSEPKDVIKQYISVTGTPSMPQQFATAYHQCRWNYRDEADVDGVDAGFDEHDIPYDVLWLDIEHTDGKRYFTWDRSAFPNPEEMQRKIADKGRKMVTIVDPHIKRDSSFHLHQEATDKGYYVKDANGNDFDGWCWPGSSSYPDMLNPEIREWWADKFSYENYKGSTPTLYIWNDMNEPSVFNGPEVTMPRDAMHYGDAEHRELHNAYGYYFHMATADGLLKRGEGKDRPFVLSRAFFAGSQRYGAVWTGDNSADWDHLKSSIPMVLTLGLTGLPFSGADVGGFFGNPEPDLLVRWYQVGAFYPFFRGHAHHDTKRREPWLFGERRTAIIREAIHMRYSLLPYFYTLFREASVNGIPVMRPLWLEFPDDKETYNNGEAFMVGPSLLAQGIYEEGQKSVSVYLPGKESWYDLRNGSPYKGSVTHKLQVLEDSIPSFQRAGTIVPRKDRFRRSSTQMVNDPYTLVIALNSSGAAEGELYVDDGKSYDYQQGAFIHRRFVFADNKLTSFNIAPDNLGKKFASDCVIERIIVLGLRSGAKKAIIEPGNQEVEIESGPISLRSGSSPVAPTIRRPNVRIADSWTIRIA

SEQ ID NO: 7289 - DNA, 894 bp, Sorghum bicolor
  misc_feature: Ceres ANNOT ID no. 6075354
  misc_feature: Encodes the peptide sequence at SEQ ID NO 7290
atgggcagcggcggcgaaggcagcgacggcggcgccgcgagctttcgggaggctcatgacttcagcaacgtcgcgtccttctctgagctgccgttcctgcgctccgccccggcccgtgaaagctccaacaactccggcatccgcatcttcggtatcgacgtcccacattcaccgccggagagaaaggctaaagaggccaccgccaccacgcccgctactaccgccgccgcttccgccacgcaaagcagcagtggcggtaccagcaccaccgtcgtcacagctgccaccgacagcagccgcaagttcgagtgccactactgctgcagaaacttcccgacgtcgcaggcgctcggaggccaccagaacgcgcataagcgcgagcggcagcacgcgaagcgggtgcagatgcagtccgcaatggccgctgcggcggcggctgccggcggcgcgcaccaccaccacctcctcggctacccgcagcatcgcttcggcgtggcaggtcccacggtggcgacattgtacccctcgtggacaacaatgagggctcctgcagcaggcgccgctgcggccggtgccgtcgccatcggcccgccgcagttctacagcgggatcgggtcgatcacccagccgatcaacgggaaccccctgacgactgggctctggagggggccgcctgctgggcacgggaacacgagcgtaccgccgggtggagaccggcggccagttgcgctctcgtcgtccgtgctccgcggtgacgatccgagggcctcaacttctcttttggcgtcgccctcctcttcttcctctttgctgctatctccacaaggtcagtttgtatgtgagcagccagcgaccactgcagccgagggtgtgagcttagatttgcatctataa

SEQ ID NO: 7290 - protein, 297 aa, Sorghum bicolor
  misc_feature: Ceres ANNOT ID no. 6075354
  misc_feature (100)..(226): NCBI GI: 115479419 NCBI Desc: os09g0445500 [oryza sativa (japonica cultivar-group)]
  misc_feature (17)..(133): NCBI GI: 32362299 NCBI Desc: at3g58070 [arabidopsis thaliana]
  misc_feature (45)..(226): NCBI GI: 51536147 NCBI Desc: zinc finger protein-like [oryza sativa (japonica cultivar-group)]
  misc_feature (17)..(133): NCBI GI: 6729550 NCBI Desc: zinc finger-like protein [arabidopsis thaliana]
  misc_feature (16)..(224): NCBI GI: 790687 NCBI Desc: zinc finger protein
  misc_feature: Abnormal phyllotaxy, leaf number higher than wild-type
  misc_feature: The plant flowers significantly late compared to wild-type.
  misc_feature: The plant is abnormally large.
  misc_feature: The plant is abnormally small.
  misc_feature: The plant produces a reduced number of seeds.
  misc_feature: The sequence is a functional homolog of SEQ ID NO 10 in the 10/412,699US patent application
  misc_feature: The sequence is a functional homolog of SEQ ID NO 1090 in the 10/412,699US patent application
  misc_feature: The sequence is a functional homolog of SEQ ID NO 1092 in the 10/412,699US patent application
  misc_feature: The sequence is a functional homolog of SEQ ID NO 1093 in the 10/412,699US patent application
  misc_feature: The sequence is a functional homolog of SEQ ID NO 1094 in the 10/412,699US patent application
  misc_feature: The sequence is a functional homolog of SEQ ID NO 1108 in the 10/225,066US patent application
  misc_feature: The sequence is a functional homolog of SEQ ID NO 12 in the 10/412,699US patent application
  misc_feature: The sequence is a functional homolog of SEQ ID NO 1212 in the 10/412,699US patent application
  misc_feature: The sequence is a functional homolog of SEQ ID NO 124 in the 11/479,226US patent application
  misc_feature: The sequence is a functional homolog of SEQ ID NO 1289 in the 10/666,642US patent application
  misc_feature: The sequence is a functional homolog of SEQ ID NO 1290 in the 10/666,642US patent application
  misc_feature: The sequence is a functional homolog of SEQ ID NO 1292 in the 10/666,642US patent application
  misc_feature: The sequence is a functional homolog of SEQ ID NO 1536 in the 10/666,642US patent application
  misc_feature: The sequence is a functional homolog of SEQ ID NO 1936 in the 10/412,699US patent application
  misc_feature: The sequence is a functional homolog of SEQ ID NO 2 in the 10/374,780US patent application
  misc_feature: The sequence is a functional homolog of SEQ ID NO 2198 in the 10/374,780US patent application
  misc_feature: The sequence is a functional homolog of SEQ ID NO 248 in the 11/375,241US patent application
  misc_feature: The sequence is a functional homolog of SEQ ID NO 464 in the 11/435,388US patent application
  misc_feature: The sequence is a functional homolog of SEQ ID NO 556 in the 10/666,642US patent application
  misc_feature: The sequence is a functional homolog of SEQ ID NO 623 in the 10/374,780US patent application
  misc_feature: The sequence is a functional homolog of SEQ ID NO 624 in the 10/374,780US patent application
  misc_feature: The sequence is a functional homolog of SEQ ID NO 626 in the 10/374,780US patent application
  misc_feature: The sequence is a functional homolog of SEQ ID NO 635 in the 10/374,780US patent application
  misc_feature: The sequence is a functional homolog of SEQ ID NO 637 in the 10/374,780US patent application
  misc_feature: The sequence is a functional homolog of SEQ ID NO 638 in the 10/374,780US patent application
  misc_feature: The sequence is a functional homolog of SEQ ID NO 639 in the 10/374,780US patent application
  misc_feature: The sequence is a functional homolog of SEQ ID NO 760 in the 10/666,642US patent application
  misc_feature: The sequence is a functional homolog of SEQ ID NO 761 in the 10/666,642US patent application
  misc_feature: The sequence is a functional homolog of SEQ ID NO 762 in the 10/666,642US patent application
  misc_feature: The sequence is a functional homolog of SEQ ID NO 763 in the 10/666,642US patent application
  misc_feature: The sequence is a functional homolog of SEQ ID NO 903 in the 10/374,780US patent application
  misc_feature: The sequence is a functional homolog of SEQ ID NO 980 in the 11/435,388US patent application
  misc_feature: Useful for biocontainment applications
  misc_feature: Useful for making plants with altered alkaloid content
  misc_feature: Useful for making plants with altered terpenoid content
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated drought sensitivity
  misc_feature: GREAT-hit functional homolog of the protein sequence given in SEQ ID NO 13265
  misc_feature: GREAT-hit functional homolog of the protein sequence given in SEQ ID NO 13272
  misc_feature: Functional homolog of the protein sequence given in SEQ ID NO 13309
  misc_feature: The sequence is a functional homolog of SEQ ID NO 10 in the 20040045049 US patent application
  misc_feature: The sequence is a functional homolog of SEQ ID NO 1090 in the 20040045049 US patent application
  misc_feature: The sequence is a functional homolog of SEQ ID NO 1092 in the 20040045049 US patent application
  misc_feature: The sequence is a functional homolog of SEQ ID NO 1093 in the 20040045049 US patent application
  misc_feature: The sequence is a functional homolog of SEQ ID NO 1094 in the 20040045049 US patent application
  misc_feature: The sequence is a functional homolog of SEQ ID NO 12 in the 20040045049 US patent application
  misc_feature: The sequence is a functional homolog of SEQ ID NO 1212 in the 20040045049 US patent application
  misc_feature: The sequence is a functional homolog of SEQ ID NO 1936 in the 20040045049 US patent application
  misc_feature: The sequence is a functional homolog of SEQ ID NO 623 in the 20060162006 US patent application
  misc_feature: The sequence is a functional homolog of SEQ ID NO 624 in the 20060162006 US patent application
  misc_feature: The sequence is a functional homolog of SEQ ID NO 626 in the 20060162006 US patent application
  misc_feature: Functional homolog of the protein sequence given in SEQ ID NO 13581
MGSGGEGSDGGAASFREAHDFSNVASFSELPFLRSAPARESSNNSGIRIFGIDVPHSPPERKAKEATATTPATTAAASATQSSSGGTSTTVVTAATDSSRKFECHYCCRNFPTSQALGGHQNAHKRERQHAKRVQMQSAMAAAAAAAGGAHHHHLLGYPQHRFGVAGPTVATLYPSWTTMRAPAAGAAAAGAVAIGPPQFYSGIGSITQPINGNPLTTGLWRGPPAGHGNTSVPPGGDRRPVALSSSVLRGDDPRASTSLLASPSSSSSLLLSPQGQFVCEQPATTAAEGVSLDLHL

SEQ ID NO: 7291 - DNA, 1365 bp, Sorghum bicolor
  misc_feature: Ceres ANNOT ID no. 6075357
  misc_feature: Encodes the peptide sequence at SEQ ID NO 7292
atggcggctgcgacggcggcaggggcagccgccgcggccgccgccgtatccctgatcgcctgctacctcctcctccacaagggtagacccaacctcccgtgggtcccaacagttgggttttcccgcgcgagcggccggcgggcgcgacggaggggtctcgtggaggccatcggcaacacacctctcattcgcatcaacagcctctccgacgccacaggatgcgagattctggggaaggctgagttcctgaacccgggtggcagcgtgaaggaccgcgtggcggttaagatcatcgaggaggctctagaatctggagatctcgtatatggtggtactgtaacagaggggagtgctggaagcacagctattagcttggctactgttgctcctgcctatggttgtaggtgtcatgttgtaatccccgatgatgctgccattgaaaagtctcaaataattgaggcgcttggagctactgttgaacgagtgcgccctgtttcaataactcacagagaccattttgtcaacattgccagaagaagggctttagaagcaaacaaattagcagcagcacagagtgaatcaaatgagaaacaaactaatggtttagcacatgttggttctgagatgatggatgacaagttaacagctatgcagagagagtcaaacaagatgcaaaataatgatccagcacttttcagtactgaaactctacactctggaaaatgtgatgtgaattctgattcaaagggaggtttttttgctgaccagtttgagaatatggcaaattatcgagcacattatgaatggactggtcctgagatatggaaacagactaaagggaacctgcatgcctttgttgcagcagctggtactggcggtacaattgccggagtctcacgatatcttaaggaaaagaacaggagcatcaaatgctttttaatggaccctcctggatctggtctgttcaataaggttaccagaggggtgatgtacacaaaagaggaggctgagggaaagcggcttaagaacccttttgatactattactgaaggaataggaatcaatagggtcactaaaaatttcatgatggcggaactggatggagcttatcgcggatcagatagggaagctgttgagatgtcaaggttcttgctgaaaaatgatggactatttgttgggagttcttcagccatgaattgcgttggcgctgtaagagttgctcaagatttgggtccagggcatacaattgtgacgattctttgtgacagtgggatgaggcatctaagcaagttcttcaatgagcagtatttggctgatcatggattgacaccagcagctactgctctggaatttcttgataaatga

SEQ ID NO: 7292 - protein, 454 aa, Sorghum bicolor
  misc_feature: Ceres ANNOT ID no. 6075357
  misc_feature (53)..(422): Pfam Id: PALP Pfam Desc: Pyridoxal-phosphate dependent enzyme
  misc_feature (246)..(452): NCBI GI: 140039542 NCBI Desc: cystathionine beta-synthase [medicago truncatula]
  misc_feature (1)..(452): NCBI GI: 8778327 NCBI Desc: f14j16.13 [arabidopsis thaliana]
  misc_feature (1)..(201): NCBI GI: 42571895 NCBI Desc: pyridoxal-5'-phosphate-dependent enzyme, beta family protein [arabidopsis thaliana]
  misc_feature (235)..(453): NCBI GI: 89298375 NCBI Desc: pyridoxal-phosphate dependent enzyme family protein [tetrahymena thermophila sb210]
  misc_feature (252)..(440): NCBI GI: 60462769 NCBI Desc: cysteine synthase [dictyostelium discoideum]
  misc_feature (228)..(453): SWISSPROT Homolog: EC 2.5.1.47 Cysteine synthase 2
MAAATAAGAAAAAAAVSLIACYLLLHKGRPNLPWVPTVGFSRASGRRARRRGLVEAIGNTPLIRINSLSDATGCEILGKAEFLNPGGSVKDRVAVKIIEEALESGDLVYGGTVTEGSAGSTAISLATVAPAYGCRCHVVIPDDAAIEKSQIIEALGATVERVRPVSITHRDHFVNIARRRALEANKLAAAQSESNEKQTNGLAHVGSEMMDDKLTAMQRESNKMQNNDPALFSTETLHSGKCDVNSDSKGGFFADQFENMANYRAHYEWTGPEIWKQTKGNLHAFVAAAGTGGTIAGVSRYLKEKNRSIKCFLMDPPGSGLFNKVTRGVMYTKEEAEGKRLKNPFDTITEGIGINRVTKNFMMAELDGAYRGSDREAVEMSRFLLKNDGLFVGSSSAMNCVGAVRVAQDLGPGHTIVTILCDSGMRHLSKFFNEQYLADHGLTPAATALEFLDK

SEQ ID NO: 7293 - DNA, 1536 bp, Sorghum bicolor
  misc_feature: Ceres ANNOT ID no. 6075358
  misc_feature: Encodes the peptide sequence at SEQ ID NO 7294
atgggcagcttgggagaggtggatcatggcaaggagatgttccatggccatggccattctgatcctgtcgtcgacgagctcaaccgtctgcagaatctcctcagagaaaaggaaagggagttaggacatgcatacagtgaaatcaaaggcctgaaggtgacggaagctcttaaggacaaggctattgctgagctgagcaaggaactgaagaaacaagacgagaagatgagaagtttggagaaacaacttgagcaaaagaatttagaagtcaaaagactaaacaatgagcgcaaagaagcattgtccgcacaattcgctgcagaggcaacacttagaaggatccactcttctcaaaaagatgaggaatcggttccattcgatgccatcatagcacccttggagtcagacataagaaaatacagacatgagattgcagtgctccaagatgacaagaaggcactagaacgacatctaaagttgaaggaggtggcgcttgttgaagcaggcaacattttgcgtagcgcgcttgagagagcactaatagtagaggacgttcagaatcagaacattgaactgaagaaacagatggagatataccatgaagagaataaattattagagaaggctaacagacagaaggtgctagaggtcgagaagctcacacataccatcaatgaacttgaagaatccattcttgcaactggcgaggttgccaatgcagtgcacttctatcagaatcaagctaccatgttgaatgaggaaaagaggacccttgagagggagctagctcgagccaaggtttatgtcaatcgtgtcgcgtcaacaacagcaaatgaatggaaaaacgactctgagaagctgatgccagtcaagcgatggctagaagaacggaggcacctacagggagagatacaacgactgcgtgacaagataacaatagcggagaagtcttcaaagatcgaagcccaacttaatgacaaactcaaaaggaggcttaagtcacttgaagatgacatgagaaatgaaacatccaactcatctacaaaggaaatcaacaaacaagccactcctagaagatcaacgtctcaaccaaagcaacacaaaacaatgagagtgttgcctcaaccatattcacatgaagccattgataggagaagacctatatctcaaccaagggcatcagtggcagggaaagtattgaagcaacctaattcagaaaccaaaccaatagagaaaattagagttgtgaagcgatttgatagccctagagcgagaacggtttctagtaaaggtgagtgtctcgtgaaaaatcaactatgggcatcaaaaggcaaaatggatgttgttgctgggaaagagaacaaagtacaaaacccaaattctaagacatgtttgattgtttcacatcctcaagggcatatagagacaaaagtgtttgacggaaatgatgaatatggaattcaaagcagcgaacatcatgaagacgtggagaatgagagaaatggggatagctccagtgatgaaagtagcccttag

SEQ ID NO: 7294 - protein, 511 aa, Sorghum bicolor
  misc_feature: Ceres ANNOT ID no. 6075358
  misc_feature (181)..(491): Pfam Id: Myosin_HC-like Pfam Desc: Myosin II heavy chain-like
  misc_feature (17)..(462): NCBI GI: 23463063 NCBI Desc: at1g68060/t23k23_9 [arabidopsis thaliana]
  misc_feature (6)..(411): NCBI GI: 92891211 NCBI Desc: myosin ii heavy chain-like [medicago truncatula]
  misc_feature (17)..(462): NCBI GI: 9945080 NCBI Desc: f5a9.19 [arabidopsis thaliana]
  misc_feature (17)..(463): NCBI GI: 52076974 NCBI Desc: myosin ii heavy chain-like [oryza sativa (japonica cultivar-group)]
  misc_feature (21)..(413): NCBI GI: 2245081 NCBI Desc: myosin ii heavy chain like protein [arabidopsis thaliana]
MGSLGEVDHGKEMFHGHGHSDPVVDELNRLQNLLREKERELGHAYSEIKGLKVTEALKDKAIAELSKELKKQDEKMRSLEKQLEQKNLEVKRLNNERKEALSAQFAAEATLRRIHSSQKDEESVPFDAIIAPLESDIRKYRHEIAVLQDDKKALERHLKLKEVALVEAGNILRSALERALIVEDVQNQNIELKKQMEIYHEENKLLEKANRQKVLEVEKLTHTINELEESILATGEVANAVHFYQNQATMLNEEKRTLERELARAKVYVNRVASTTANEWKNDSEKLMPVKRWLEERRHLQGEIQRLRDKITIAEKSSKIEAQLNDKLKRRLKSLEDDMRNETSNSSTKEINKQATPRRSTSQPKQHKTMRVLPQPYSHEAIDRRRPISQPRASVAGKVLKQPNSETKPIEKIRVVKRFDSPRARTVSSKGECLVKNQLWASKGKMDVVAGKENKVQNPNSKTCLIVSHPQGHIETKVFDGNDEYGIQSSEHHEDVENERNGDSSSDESSP

SEQ ID NO: 7295 - DNA, 2400 bp, Sorghum bicolor
  misc_feature: Ceres ANNOT ID no. 6075359
  misc_feature: Encodes the peptide sequence at SEQ ID NO 7296
atggcgccgccaccgccgccgaagctgccgattcccggccgccgcaacatacttatcaccagcgcacttccgtatgtcaataacgtcccccacctcgggaacatcatcggctgtgtgctcagcgccgacgtgttcgctcgatactgccggctccggggttacaacgctatttacatatgcgggactgacgagtatggcaccgccaccgagactaaggccatggaggagaagtgcacgcccaaggagatctgcgacaagtaccatgctatccacaatgaagtttacaagtggtttaacataaaatttgacaagtttgggcggacatcttctcctgagcagacagaagtctgccatgcaattttccataaattgatggaaaataattggctcacagaaaataccatgcagcagctttactgcgatacgtgccaaaaatttttagccgatagacttgttgaaggaacatgcccgaacaaagcctgcaacgcatcagcacgaggagatcagtgtgaaacatgcagcaccttgttgaatccaactgaacttattgacccaaagtgcaaggtttgtaagaatactccacgtattcgtgacacggatcacttatttttagagcttcctctattgagagacaagctggtaaactacatcaatgaaacttcagttgctggttcgtggagtcaaaatgctattcaagcaacaaatgcatggctgaaggaagggctaaagccacgctgcatcaccagagatcttaaatggggtgttcctgttcctcacgagaagtataaagacaaggtgttctatgtttggtttgatgcacctatcggctatgtgtctattacggcatcctatacacctgagtgggagaagtggtggaagaatcctgataatgtagaattgtttcagtttatgggcaaagataatgtgccatttcacacgatcatgttcccttcaacgctacttggaactggggaaaagtggacaatgatgaagacgataagtgttactgaatatttaaattatgaagcaggaaaattttccaagagtaagggtattggagtctttggtaatgatgcaaaggatacaaatatccctcctgaagtatggcgatactacttgcttatgaatcgccctgaggcatcagatacactctttacttgggctgatttgcaagcgaaattgaacagcgagttgctgaataacttgggaaacttcattaatcgtgtgctaagttttgttgcaaaaccagctggagctggatatgattctgttgtacccgatgctcctaatgcgagcacacacccattgacaaagacgcttgcagaaaaaaccagtaaatgggttgagcaatatctcgacgcaatggaaaaggttaaactgaaacaaggactgaagagtgcaatgggcatttctagtgatggaaatgcgtatctgcaagagagccagttttggaaactttacaaggaagatcctgcatcatgtgcgatcgtgatgaaaacttcagttggtcttgtctacctgcttgcctgtcttctggagcctttcatgccctccttttctgatgaagtgctgcgtcaattaaatttatgtccagaagaaaatctgtcatttagtgaagaaaagggagaaattgcaaaggcaaaaactccttgggattttgtaccagctgggcacaaaatagggaagcccgcacctctgttcaaggaattgaaagatgaagatgtagttctccatagagaaaactatgcagggagtcaagctgagagaagctcaaaagcagcagctgatgctgaagccaacaaagttgctaacaagctcaagggcacaaaattatctgatggaggaacaaaaaaggaaccaaagaaacaatctggtggctcaaaatcgaagacagctgaggctgacattacagttgcaaaattggatattagagtggggcttatcagaaaagcagagaagcatccagatgctgattcgctttatgtggaggagattgatgttggagagggcgcaccaagaacagtggtcagcggccttgtcaaattcatacctcttgaagaaatgcagaaccggaaggtttgcgtactctgcaatctgaaaccggtggcaatgcgtggtataaaatcgcatgcgatggttttggctgcatccaatgaggaccacacgaaggttgagttggtggagccacccgaatctgctgccgttggggagcgtgttacctttgctgggtactcgggggagcccgaggcttccctcagtggcaagagcaagacgtgggagaagctggccgccgagctgcacagcaacggtgagctcgtggcgtgctacaaagatgtgcccttcactacctcggctggagtctgcaaggtcaagacaatagcaaacggagagattcgctag

SEQ ID NO: 7296 - protein, 799 aa, Sorghum bicolor
  misc_feature: Ceres ANNOT ID no. 6075359
  misc_feature (17)..(410): Pfam Id: tRNA-synt_1g Pfam Desc: tRNA synthetases class I (M)
  misc_feature (643)..(738): Pfam Id: tRNA_bind Pfam Desc: Putative tRNA binding domain
  misc_feature (3)..(799): NCBI GI: 4091008 NCBI Desc: methionyl-trna synthetase [oryza sativa]
  misc_feature (2)..(799): NCBI GI: 109940177 NCBI Desc: probable methionyl-trna synthetase (methionine--trna ligase) (metrs)
  misc_feature (2)..(799): NCBI GI: 54290977 NCBI Desc: methionyl-trna synthetase [oryza sativa (japonica cultivar-group)]
  misc_feature (3)..(799): NCBI GI: 115468260 NCBI Desc: os06g0508700 [oryza sativa (japonica cultivar-group)]
  misc_feature (7)..(799): NCBI GI: 92893761 NCBI Desc: aminoacyl-trna synthetase, class ia; nucleic acid-binding, ob-fold, subgroup [medicago truncatula]
  misc_feature (7)..(655): SWISSPROT Homolog: EC 6.1.1.10 Methionyl-tRNA synthetase, cytoplasmic
MAPPPPPKLPIPGRRNILITSALPYVNNVPHLGNIIGCVLSADVFARYCRLRGYNAIYICGTDEYGTATETKAMEEKCTPKEICDKYHAIHNEVYKWFNIKFDKFGRTSSPEQTEVCHAIFHKLMENNWLTENTMQQLYCDTCQKFLADRLVEGTCPNKACNASARGDQCETCSTLLNPTELIDPKCKVCKNTPRIRDTDHLFLELPLLRDKLVNYINETSVAGSWSQNAIQATNAWLKEGLKPRCITRDLKWGVPVPHEKYKDKVFYVWFDAPIGYVSITASYTPEWEKWWKNPDNVELFQFMGKDNVPFHTIMFPSTLLGTGEKWTMMKTISVTEYLNYEAGKFSKSKGIGVFGNDAKDTNIPPEVWRYYLLMNRPEASDTLFTWADLQAKLNSELLNNLGNFINRVLSFVAKPAGAGYDSVVPDAPNASTHPLTKTLAEKTSKWVEQYLDAMEKVKLKQGLKSAMGISSDGNAYLQESQFWKLYKEDPASCAIVMKTSVGLVYLLACLLEPFMPSFSDEVLRQLNLCPEENLSFSEEKGEIAKAKTPWDFVPAGHKIGKPAPLFKELKDEDVVLHRENYAGSQAERSSKAAADAEANKVANKLKGTKLSDGGTKKEPKKQSGGSKSKTAEADITVAKLDIRVGLIRKAEKHPDADSLYVEEIDVGEGAPRTVVSGLVKFIPLEEMQNRKVCVLCNLKPVAMRGIKSHAMVLAASNEDHTKVELVEPPESAAVGERVTFAGYSGEPEASLSGKSKTWEKLAAELHSNGELVACYKDVPFTTSAGVCKVKTIANGEIR

SEQ ID NO: 7297 - DNA, 1428 bp, Sorghum bicolor
  misc_feature: Ceres ANNOT ID no. 6075369
  misc_feature: Encodes the peptide sequence at SEQ ID NO 7298
atgtcgacgaggaggcattttgcgatattcaccaccgcaagcctcccatggatgacgggaacagccatcaaccctttgttccgggccgcttacttggcaaaggatggtgataaggatgttacgctagtgatcccctggctttgtctaagggaccaagagttggtttaccctaacaatattgtatttgactcgcctttggagcatgagagctatgttcatcactggatcgaggagaggattgacttcaggccatccttcagcatcaaattctacccaggaaagttttctaaagaaatgagaagcattcttcctgttggagatattacagaatgcattccagatgaagttgctgacattgctgtattggaagagcccgagcatctgaattggtaccaccatgggcgaagatggaaaaataagttccggcgagttataggaattgttcatacaaattatctagcatatgtaaggagagaaaagaatggtcaagttatcgcttgtttcctcaagtatgctaacacttgggtaactcgaatctattgccacaagattatcagattgtcaggtgccacccaagatctgcccaggtctgttatatgcaatgtccatggtgttaatccaaaatttcttgaggtaggcaagctaaagttgaggcagctgcagaatggggagaaagccttcacaaaaggggcatactacatcgggaagatggtatggagcaagggatacagggagcttcttgatctgctatccaaatatcagagcaagttggttggtcttgaagtggatttatatggtagcggagaagattctgatgaggtctgtgaatctgccaaacgtttaagtttgtctatcaatgttcatcctggtcgtgatcatgcagatcccttgttccatgagtacaaagtattcatcaatcccagcaccacagatgtggtctgtacgaccaccgctgaagcgctggcaatggggaagatagttatatgtgccaatcactcgtcaaatgagttcttcaagcagttccccaactgccgtatctatgacaatgaagacgaatttgtacaactaacactgaatgctctatcagagcagcctgctccattgacagacgcgcagaggtacgagttgtcatgggaggctgcgactcagagattcattgaggctgctgatataaatcctcatgtgccggagtccaggacccatcaaagctcgagggctttgttgcctgcttttctaagaactcgtaaactgaaacagaacttagaggacgcatcagtttacctgcaccaagccctctcaggtctggaagtcactcgctgtgcgtttggtgctgttcctaagacgctgcagcctgacgaggacctctgtaaagaccttggtttggctcctcctgtaaataggaaaaggctgaaatttaagatgacgtaa

SEQ ID NO: 7298 - protein, 475 aa, Sorghum bicolor
  misc_feature: Ceres ANNOT ID no. 6075369
  misc_feature (218)..(378): Pfam Id: Glycos_transf_1 Pfam Desc: Glycosyl transferases group 1
  misc_feature (1)..(462): NCBI GI: 49617335 NCBI Desc: digalactosyldiacylglycerol synthase 2 [lotus corniculatus var. japonicus]
  misc_feature (1)..(461): NCBI GI: 49617331 NCBI Desc: digalactosyldiacylglycerol synthase 2 [glycine max]
  misc_feature (5)..(462): NCBI GI: 33589694 NCBI Desc: at4g00550 [arabidopsis thaliana]
  misc_feature (4)..(464): NCBI GI: 116310807 NCBI Desc: osigba0092m08.9 [oryza sativa (indica cultivar-group)]
  misc_feature (3)..(464): NCBI GI: 76800640 NCBI Desc: digalactosyldiacylglycerol synthase 1 [vigna unguiculata]
  misc_feature (1)..(462): SWISSPROT Homolog: EC 2.4.1.241 Digalactosyldiacylglycerol synthase 2, chloroplast
MSTRRHFAIFTTASLPWMTGTAINPLFRAAYLAKDGDKDVTLVIPWLCLRDQELVYPNNIVFDSPLEHESYVHHWIEERIDFRPSFSIKFYPGKFSKEMRSILPVGDITECIPDEVADIAVLEEPEHLNWYHHGRRWKNKFRRVIGIVHTNYLAYVRREKNGQVIACFLKYANTWVTRIYCHKIIRLSGATQDLPRSVICNVHGVNPKFLEVGKLKLRQLQNGEKAFTKGAYYIGKMVWSKGYRELLDLLSKYQSKLVGLEVDLYGSGEDSDEVCESAKRLSLSINVHPGRDHADPLFHEYKVFINPSTTDVVCTTTAEALAMGKIVICANHSSNEFFKQFPNCRIYDNEDEFVQLTLNALSEQPAPLTDAQRYELSWEAATQRFIEAADINPHVPESRTHQSSRALLPAFLRTRKLKQNLEDASVYLHQALSGLEVTRCAFGAVPKTLQPDEDLCKDLGLAPPVNRKRLKFKMT

SEQ ID NO: 7299 - DNA, 1845 bp, Sorghum bicolor
  misc_feature: Ceres ANNOT ID no. 6075377
  misc_feature: Encodes the peptide sequence at SEQ ID NO 7300
atgctgtcattgcccagaacggcggcggcggtgacggtgtatgcgctgctcgctcttatcgccagcgccggcgccgccgctgcgggaggtggcgtgcagccgctgtcgaggatcgccatccaccgcgccaccgctgcgccccagccgggtgccttcgtcgacgcgtcgccggcccttctcggcctggagggggaggacagagaatgggtgaccgtcacatatagtaaccccaggccttcgaaggatgactggattggagtcttctctcctgctaatttcaatgattccatttgtccacaagagaacgaatgggtggagtcccctcttttatgcacagctcctatcaagttccaatttgcaaactacacgaatcgtgattatggaaacactggaaagggatccttgaagcttcagctgataaatcagagagagggtttctcatttgcattgttctctggaggcctgtcgaatccaaagctcatcgcccactcaaagagtgttactttcatcaacccaaaggctccggtgttcccacgcttagcacaaggaaaatcttggaatgaaatgacagttacatggacaagtgggtatggtacaaatgaggctacaccatttgtcagatggggcatacaagggcaaatccaaatcctttctcctgcaggcacccttactttcagtcgcgagaccatgtgtggtcctcctgcaaggacagttggttggcgtgatcctggtttcatacacacaagttttctcaaggaattatggtacacataccaagttggtcatcacatttttaatggctctatagtttggggacatcagtatagcttcaaagcacctccttatcctggggaagactctttgcaacgtgttgtaatttttggggatatgggcaaggctgaggttgatggttcaaatgagttcaatggctttgagcctgcttcacttaacacaacgaaccagctaattaaagacttgaagaatattgatgtggttttccatattggagacatcgcatatgccaatggctatctgtcacaatgggatcaattcactgcacaggttgagcccattgcttctactgtgccttacatggttgcgagtggtaaccacgaaagggattggcctggatcaggatctttctacggaaatcttgactcaggtggtgaatgtggggtaccagctcagaatatgttctacgtgccagcagaaaaccgcgagcagttctggtactcaatggactacgggatgttccgtttctgcatatccaataccgagttggactggagggcaggcacggagcagtacaggttcatcgagcactgcctgtcgtctgttgatcggcagaaacagccatggctcatcttcctcgcgcaccgtgttctgggttactcgtctgccaccttctacgccgacgaaggaacaaccgaggagcccatgggacgcgagagccttcagtcactctggcagaagcacaaggtcgacatcgctatgtatggccacgtccacggctacgagcggacctgcccagtatacgagaacgcgtgtgtcgccaaggggtctaacctctacaccggcgctttcacggcgacgacgcacgtcgtggtgggcggcggcggcgccagcctcgccgactacacagccgtgcgggcgcggtggagccacgtgcgggaccgcgactttgggttcgcgaagctgacggcgttcaaccacacgacgctgctgtttgagtacaagaagagccgggacggcagcgtgcacgaccacttcaccgtctcccgcgactaccgcgacgtcctggcctgcggcgtcgacaactgcccgagcaccaccctggcgtcgtga

SEQ ID NO: 7300 - protein, 614 aa, Sorghum bicolor
  misc_feature: Ceres ANNOT ID no. 6075377
  misc_feature (289)..(505): Pfam Id: Metallophos Pfam Desc: Calcineurin-like phosphoesterase
  misc_feature (11)..(614): NCBI GI: 77556256 NCBI Desc: diphosphonucleotide phosphatase 1 [oryza sativa (japonica cultivar-group)]
  misc_feature (13)..(614): NCBI GI: 18075958 NCBI Desc: diphosphonucleotide phosphatase 1 [lupinus luteus]
  misc_feature (26)..(614): NCBI GI: 77556254 NCBI Desc: diphosphonucleotide phosphatase 1 [oryza sativa (japonica cultivar-group)]
  misc_feature (26)..(614): NCBI GI: 115489244 NCBI Desc: os12g0576600 [oryza sativa (japonica cultivar-group)]
  misc_feature (33)..(410): NCBI GI: 144924941 NCBI Desc: metallophosphoesterase; fibronectin, type iii-like fold [medicago truncatula]
MLSLPRTAAAVTVYALLALIASAGAAAAGGGVQPLSRIAIHRATAAPQPGAFVDASPALLGLEGEDREWVTVTYSNPRPSKDDWIGVFSPANFNDSICPQENEWVESPLLCTAPIKFQFANYTNRDYGNTGKGSLKLQLINQREGFSFALFSGGLSNPKLIAHSKSVTFINPKAPVFPRLAQGKSWNEMTVTWTSGYGTNEATPFVRWGIQGQIQILSPAGTLTFSRETMCGPPARTVGWRDPGFIHTSFLKELWYTYQVGHHIFNGSIVWGHQYSFKAPPYPGEDSLQRVVIFGDMGKAEVDGSNEFNGFEPASLNTTNQLIKDLKNIDVVFHIGDIAYANGYLSQWDQFTAQVEPIASTVPYMVASGNHERDWPGSGSFYGNLDSGGECGVPAQNMFYVPAENREQFWYSMDYGMFRFCISNTELDWRAGTEQYRFIEHCLSSVDRQKQPWLIFLAHRVLGYSSATFYADEGTTEEPMGRESLQSLWQKHKVDIAMYGHVHGYERTCPVYENACVAKGSNLYTGAFTATTHVVVGGGGASLADYTAVRARWSHVRDRDFGFAKLTAFNHTTLLFEYKKSRDGSVHDHFTVSRDYRDVLACGVDNCPSTTLAS

SEQ ID NO: 7301 - DNA, 993 bp, Sorghum bicolor
  misc_feature: Ceres ANNOT ID no. 6075380
  misc_feature: Encodes the peptide sequence at SEQ ID NO 7302
atggcgatggcggcgctgcgacgcgaggggaggcgcatcctcctctcccccaccgtccccaacccgtctccggcggccgcttccgctgcggtgacgcgatcctccgccatctcgcaaccggagatggctccacttggtgcacggtctatttcaactcaagttgtgaggaaccggatgaagagtgtcaagaacatccagaagatcacaaaggctatgaagatggttgcagcatcaaagcttcgtgctgttcagacgaggactgaaaattcacgtggcctgtgggagcctttcaccgcccttcttggggatgctcctagcgttgatgtcaagaagaatgtgattgtggccattacctctgataagggactctgtggtggtattaattcaacatcggtgaaagttagcagggcccttcacaagttgacatctggtccagaaaaagaaagcaagtttgttatattaggagaaaagggaaaagttcagctggttcgtgactcaaggaacagcattgaaatgactgtaactgaactacagaagaatcctatcaactatacacagattgctgtgctggccgatgacatattgaaaaatgtggaatatgatgctctgagggttattttcaacaagttccattctgttatatcatttaagcccacaatggtaacaatactgtcccctgaggttgcagaaaaagaatcagaagctggtgggaagatgggtgacctagattcttatgagattgaaggcggcgagacaaaatcagagatattgcagaatctagctgagttccagttttcttgtgttctgtacaatggtgccctagagaatgcatgcagtgagcttggagcccgtatgtctgccatggacagctccagcagaaatgctggcgatatgcttgatcgtctaactctcacttacaacaggacacgccaagcatccatcactacagagcttattgaaattatatctggtgcatcggcccttgaaggatag

SEQ ID NO: 7302 - protein, 330 aa, Sorghum bicolor
  misc_feature: Ceres ANNOT ID no. 6075380
  misc_feature (50)..(328): Pfam Id: ATP-synt Pfam Desc: ATP synthase
  misc_feature (1)..(330): NCBI GI: 303626 NCBI Desc: f1-atpase gammma subunit [ipomoea batatas]
  misc_feature (3)..(330): NCBI GI: 61675574 NCBI Desc: mitochondrial f1-atpase gamma subunit [ipomoea nil]
  misc_feature (1)..(329): NCBI GI: 21554962 NCBI Desc: mitochondrial f1-atpase, gamma subunit (atp3_arath) [arabidopsis thaliana]
  misc_feature (1)..(329): NCBI GI: 110740981 NCBI Desc: mitochondrial f1-atpase, gamma subunit [arabidopsis thaliana]
  misc_feature (1)..(329): NCBI GI: 23198402 NCBI Desc: mitochondrial f1-atpase, gamma subunit (atp3_arath) [arabidopsis thaliana]
  misc_feature (1)..(330): SWISSPROT Homolog: EC 3.6.3.14 ATP synthase gamma chain, mitochondrial precursor
MAMAALRREGRRILLSPTVPNPSPAAASAAVTRSSAISQPEMAPLGARSISTQVVRNRMKSVKNIQKITKAMKMVAASKLRAVQTRTENSRGLWEPFTALLGDAPSVDVKKNVIVAITSDKGLCGGINSTSVKVSRALHKLTSGPEKESKFVILGEKGKVQLVRDSRNSIEMTVTELQKNPINYTQIAVLADDILKNVEYDALRVIFNKFHSVISFKPTMVTILSPEVAEKESEAGGKMGDLDSYEIEGGETKSEILQNLAEFQFSCVLYNGALENACSELGARMSAMDSSSRNAGDMLDRLTLTYNRTRQASITTELIEIISGASALEG

SEQ ID NO: 7303 - DNA, 1107 bp, Sorghum bicolor
  misc_feature: Ceres ANNOT ID no. 6075382
  misc_feature: Encodes the peptide sequence at SEQ ID NO 7304
atggcggcgtctccgtcttctccccctgccgccgctggagttggtggccagagcgtgatccccttacccttagcgccgtctccccatctcaccaacttcttcgtgtggagggaatttgtctggggaggaattgcaggcgcatttggggaaggcatgatgcatccagttgacactctgaaaacaaggcttcagagtcaggctataatgacaggggctaaggctcagaagaatatattccagatggtcaggacagtttgggcttcagatggtctcagaggtttttacagaggaatcagcccaggtgttactggatctcttgcgactggcgctacatatttcggtgttattgaatcgactaagacatggttggagattgctaatcctaatctaagtggacactggtcacattttattgctggagcgattggtgatacacttggatcctttgtctatgtgccttgcgaagtcatgaaacaaagaatgcaagtccaaggcacccaaaaatcttgggcatcagctgcagctaaaggaagtatttctcaaactcatgggactcagatgtatgggtactacaatggaatcttccatgctggttgttctatctggagagatcatggcttgaaggggctttatgcaggatactggtctacgcttgccagagatgtcccttttgctggtctaatggtcactttctatgaagcaatgaaagagatggctgattatgggaaaacaaagtatttgccgcacagtgatttggatgtcagcaactcctttgaaggacttgttctaggaggattggcaggcggctgtagtgcatacttgacaacccccttggatgtgatcaagacaagactgcaagtacaaggaccaacgtctaggtacaatgggtggctggatgctataacaaagacgtgggcttccgaaggggtgcacggcttgttcaagggaagtgttccaagaataatatggtatattccggcatcagcattcacattcatggcagtggaattcctaagggaccatttcaacggcaaggttgatgcagatgcccatgaactaacctccctgtcaatcgacacaagatcagaagttgagaaatcagcttaa

SEQ ID NO: 7304 - protein, 368 aa, Sorghum bicolor
  misc_feature: Ceres ANNOT ID no. 6075382
  misc_feature (34)..(127): Pfam Id: Mito_carr Pfam Desc: Mitochondrial carrier protein
  misc_feature (132)..(242): Pfam Id: Mito_carr Pfam Desc: Mitochondrial carrier protein
  misc_feature (256)..(346): Pfam Id: Mito_carr Pfam Desc: Mitochondrial carrier protein
  misc_feature (32)..(368): NCBI GI: 92873621 NCBI Desc: mitochondrial carrier protein [medicago truncatula]
  misc_feature (42)..(286): NCBI GI: 4581529 NCBI Desc: spcc1450.19 [schizosaccharomyces pombe]
  misc_feature (42)..(323): NCBI GI: 44984212 NCBI Desc: afl196wp [eremothecium gossypii]
  misc_feature (42)..(323): NCBI GI: 45198325 NCBI Desc: afl196wp [eremothecium gossypii]
  misc_feature (206)..(330): NCBI GI: 119391879 NCBI Desc: s-adenosylmethionine transporter [nicotiana benthamiana]
  misc_feature: The sequence is a functional homolog of SEQ ID NO. 517 in the 11/188,298 US application
  misc_feature: The sequence is a functional homolog of SEQ ID NO. 385 in the 11/188,298 US application
  misc_feature: The sequence is a functional homolog of SEQ ID NO. 398 in the 11/188,298 US application
MAASPSSPPAAAGVGGQSVIPLPLAPSPHLTNFFVWREFVWGGIAGAFGEGMMHPVDTLKTRLQSQAIMTGAKAQKNIFQMVRTVWASDGLRGFYRGISPGVTGSLATGATYFGVIESTKTWLEIANPNLSGHWSHFIAGAIGDTLGSFVYVPCEVMKQRMQVQGTQKSWASAAAKGSISQTHGTQMYGYYNGIFHAGCSIWRDHGLKGLYAGYWSTLARDVPFAGLMVTFYEAMKEMADYGKTKYLPHSDLDVSNSFEGLVLGGLAGGCSAYLTTPLDVIKTRLQVQGPTSRYNGWLDAITKTWASEGVHGLFKGSVPRIIWYIPASAFTFMAVEFLRDHFNGKVDADAHELTSLSIDTRSEVEKSA

SEQ ID NO: 7305 - DNA, 1767 bp, Sorghum bicolor
  misc_feature: Ceres ANNOT ID no. 6075398
  misc_feature: Encodes the peptide sequence at SEQ ID NO 7306
atggcggacagggtcggtggcagcgacgacggagacaagtccgagtggaatagtgacggtgaggtggcgaggagcctcgatggcgctggctcgccaattgcgccctcgaggaacaagttaaaagatgctcctggcccgtccctgctggtcaatggagcagggccatctgcctctttggtggaggactttgtagggatgggtcttattaaggggaatggggatggtggtgcagagtcattactagagctccttctggcatacaaggcgataggcaatgacccttcattggataaatcctctgcttctgtttgtggcccccggaccatttgtgatgacaaagacattcttgcgaattgggatgcgcatgatgctagtacgagcagtgacagggatcatgcatctgatgattctggtgatgaggtattgattccatgcctctttcatcttgaacttcaatttttacctatgggcttgtcacagaaggatgaaaaaattgagtccttagtgagaatgggctttcctaaagatgaagcagaaatggccattgtcagatgtgggcaggatgcacctatgtctgttttgattgatttaatctatagttcagaagcttcagaagatggttactatggcaatttctctggccatgaggatgattcttttggaggaagaaaggaaaagagaaagagatctgaagatgcagaacaaggcagtagccatgatgagccgatgcctctcccaaacccaatggttgggtttaacctgccaaatgtgagcttaagatcagtggacagatctctaccatcaaaggctattgggccacctttcttctactatgagaatgtagccattgctccaaagggtgtctggacgacaatatcacagttcttatatgacatccaacctgagtttgtggattctaggttcttatgtgctgctgccaggaaaagaggttacgtacataacttgccaattgagaacaggtcacctctccttcccttacccccaaagacaatatttgaggccttcccccatactaaaaagtggtggccctcatgggaccctagaaaacagttcaactgcctcctgaccagtatggctaaacctaagttaacggaacagattcaccatgctcttgcaaaatgtaaagatccaccacctcgacgtgttcagaagtatgtcttggaaacctgcaggacggcgaacttggtatgggttggtctgaacaaggttgctcatctagagcctgatgagatggagttcctgcttggtttccccaaagaccacaccaggggaatcggcaggcctgagaggttcaagtctttgggcaattcattccatgtcgacaccgtcgcataccatctctcagcacttcgggacatgtttccacatggcatgaatgtcctttccttgttctctggcattggaggagcagaggtagctctccacaggctcgacattcgcatgaagacagtcgtttcggtggagatatctgagacgaacaggttcgtcttgaggacttggtggaatcagacccaaacaggcactttgatagagatcaccgatgttcagagcctgactaccgagaggctcgagtcatgcatcaggaggattggtggttttgacctggtgattgggggcagcccctgtaacaatcttgctgggcgcaatcgattccaccgtgatggcttggagggagagcagtcgtcgctcttctaccactattacaggatcttggacacggtgaagtccatcatgggcagaatgtag

SEQ ID NO: 7306 - protein, 588 aa, Sorghum bicolor
  misc_feature: Ceres ANNOT ID no. 6075398
  misc_feature (57)..(587): NCBI GI: 29467228 NCBI Desc: dna methyltransferase [nicotiana tabacum]
  misc_feature (154)..(587): NCBI GI: 140056280 NCBI Desc: uba-like [medicago truncatula]
  misc_feature (10)..(587): NCBI GI: 92874580 NCBI Desc: ubiquitin-associated [medicago truncatula]
  misc_feature (240)..(530): NCBI GI: 42766606 NCBI Desc: at5g15380 [arabidopsis thaliana]
  misc_feature (196)..(588): NCBI GI: 115461927 NCBI Desc: os05g0133900 [oryza sativa (japonica cultivar-group)]
MADRVGGSDDGDKSEWNSDGEVARSLDGAGSPIAPSRNKLKDAPGPSLLVNGAGPSASLVEDFVGMGLIKGNGDGGAESLLELLLAYKAIGNDPSLDKSSASVCGPRTICDDKDILANWDAHDASTSSDRDHASDDSGDEVLIPCLFHLELQFLPMGLSQKDEKIESLVRMGFPKDEAEMAIVRCGQDAPMSVLIDLIYSSEASEDGYYGNFSGHEDDSFGGRKEKRKRSEDAEQGSSHDEPMPLPNPMVGFNLPNVSLRSVDRSLPSKAIGPPFFYYENVAIAPKGVWTTISQFLYDIQPEFVDSRFLCAAARKRGYVHNLPIENRSPLLPLPPKTIFEAFPHTKKWWPSWDPRKQFNCLLTSMAKPKLTEQIHHALAKCKDPPPRRVQKYVLETCRTANLVWVGLNKVAHLEPDEMEFLLGFPKDHTRGIGRPERFKSLGNSFHVDTVAYHLSALRDMFPHGMNVLSLFSGIGGAEVALHRLDIRMKTVVSVEISETNRFVLRTWWNQTQTGTLIEITDVQSLTTERLESCIRRIGGFDLVIGGSPCNNLAGRNRFHRDGLEGEQSSLFYHYYRILDTVKSIMGRM

SEQ ID NO: 7307 - DNA, 1593 bp, Sorghum bicolor
  misc_feature: Ceres ANNOT ID no. 6075406
  misc_feature: Encodes the peptide sequence at SEQ ID NO 7308
  misc_feature: Down-regulated in shoot tissues in response to aminocyclopropane carboxylic treatment
  misc_feature: Down-regulated in root tissues in response to methyl jasmonate treatment
  misc_feature: Down-regulated in shoot tissues in response to methyl jasmonate treatment
  misc_feature: Up-regulated in root tissues in response to salicylic acid treatment
atggcgttccgccgcatcctatccaccgcggtgcgccgccgctcggccgtcgccgccgcggcggccgggaacgcgcgcgaggcctccacgggcgtcgccgcggcgcctggcgtgctcgcccccgactcgaccccggtgcgcgctcccgtgttgccgtacgaccgcatcgccgaggccgtcaacgccaggctccggcggctcgagcacccggacccgcgcttcctccgctacgccagccccgtgccgtcccacgccgaccacacggccatccttgcggcgccggagacccgggtcaccacgctgcctaatggcctgcgtgtcgccacggagtcgtccctcgccgcgcgcacggctacggtcggcgtgtggatcgatgcgggcagcaggtacgagaacgagaaggcagccggcgtcgcgcattttgtcgagcacatgctgttcaagggcacggggaagcgcagcgcggcgcagctggagcaggagatcgaggacatgggtggccacctcaatgcgtacacgtcgcgggagcagacgacctactacgccaaggtgctcgacaaggacgtgccccgtgcgatggaggtcctcgcggacatcctgcagaactctaatctcgaccaggctcgcattgaacgtgagcgcgaagtgatcctacgggagatgcaggaggttgagggacagtctgaggaagttatatttgatcatctccatgcaactgcattccaatatacatctcttggcagaccaatcctgggttctgcagataatgtcaaatcaatcaccaaagaggacctcgagaactacattgcaactcattatacagctcctaggatggttatcactgctgcaggtaatgttaaacatgaagacattgttgagcaggcaaagaagttgttcaataagctatcaactgaccctacaacgacaaacatgttggtcgctaaggaaccagcctcttttaccggttctgaggttcgaatcattgatgatgacatgcccctagctcaatttgctgttgctttcaatggagcatcatgggtagatcctgattctgttgcactgatggttatgcaatcaatgcttggttcatggaacaagagtgctggtggaggaaagcacatgggttcagagcttgtacagagggcagcaatcaatgacattgctgagagtgtaatggcattcaacacgaattacaaggatactggtctttttggtgtctatgctgttgctaaggctgattgcttggatgatttggcttttgcaattatgcatgagatgagcaaattgtcataccgggttatggaagaagatgttatccgtgcacgtaatcagctgaagtcctcaatccaactccatctcgatggttcaactgctgttgtcgaggacattggccgtcagctgctgacctatggccgaagaattcctactgctgagctttttgcaagaatagatgctgttgatgcaagcactgtgaagcgtgttgcaaatcgcttcatctttgatcaggatgttgctattgcggcaatgggaccaattcaaggacttccagactacaactggttcagacgccggacctacatgctccgttactag

SEQ ID NO: 7308 - protein, 530 aa, Sorghum bicolor
  misc_feature: Ceres ANNOT ID no. 6075406
  misc_feature (106)..(254): Pfam Id: Peptidase_M16 Pfam Desc: Insulinase (Peptidase family M16)
  misc_feature (259)..(445): Pfam Id: Peptidase_M16_C Pfam Desc: Peptidase M16 inactive domain
  misc_feature (1)..(530): NCBI GI: 12802327 NCBI Desc: mitochondrial processing peptidase beta subunit [cucumis melo]
  misc_feature (1)..(530): NCBI GI: 13959067 NCBI Desc: mitochondrial processing peptidase [avicennia marina]
  misc_feature (1)..(522): NCBI GI: 82621176 NCBI Desc: mitochondrial processing peptidase-like [solanum tuberosum]
  misc_feature (1)..(530): NCBI GI: 587566 NCBI Desc: mitochondrial processing peptidase [solanum tuberosum]
  misc_feature (1)..(530): NCBI GI: 410633 NCBI Desc: cytochrome c reductase-processing peptidase subunit i, mpp subunit i, p55 [potatoes, var. marfona, tuber, peptide mitochondrial, 534 aa]
  misc_feature (90)..(519): SWISSPROT Homolog: EC 3.4.24.64 Mitochondrial-processing peptidase subunit beta, mitochondrial precursor
  misc_feature: Down-regulated in shoot tissues in response to aminocyclopropane carboxylic treatment
  misc_feature: Down-regulated in root tissues in response to methyl jasmonate treatment
  misc_feature: Down-regulated in shoot tissues in response to methyl jasmonate treatment
  misc_feature: Up-regulated in root tissues in response to salicylic acid treatment
MAFRRILSTAVRRRSAVAAAAAGNAREASTGVAAAPGVLAPDSTPVRAPVLPYDRIAEAVNARLRRLEHPDPRFLRYASPVPSHADHTAILAAPETRVTTLPNGLRVATESSLAARTATVGVWIDAGSRYENEKAAGVAHFVEHMLFKGTGKRSAAQLEQEIEDMGGHLNAYTSREQTTYYAKVLDKDVPRAMEVLADILQNSNLDQARIEREREVILREMQEVEGQSEEVIFDHLHATAFQYTSLGRPILGSADNVKSITKEDLENYIATHYTAPRMVITAAGNVKHEDIVEQAKKLFNKLSTDPTTTNMLVAKEPASFTGSEVRIIDDDMPLAQFAVAFNGASWVDPDSVALMVMQSMLGSWNKSAGGGKHMGSELVQRAAINDIAESVMAFNTNYKDTGLFGVYAVAKADCLDDLAFAIMHEMSKLSYRVMEEDVIRARNQLKSSIQLHLDGSTAVVEDIGRQLLTYGRRIPTAELFARIDAVDASTVKRVANRFIFDQDVAIAAMGPIQGLPDYNWFRRRTYMLRY

SEQ ID NO: 7309 - DNA, 738 bp, Sorghum bicolor
  misc_feature: Ceres ANNOT ID no. 6075409
  misc_feature: Encodes the peptide sequence at SEQ ID NO 7310
atgtcggtgccaatgtataagaaacagaactcattgagcacccctgtccacaagacaaacccgtttgattcagattcagattctgaagggccatcaagggcacagtctgttccagtacgacacaccaatcaatctgttcaagagttggaagattatgctataaccaaagcacgagaaaccacacacaaagtaaatgattgtgtcagagctgctgaagccatcagggaagatgctacacagaccatgctaactttacaccatcaaggtgagcagatcatgcggtctcatcaagtagcagctgaaattgagcaggaccttacagtgagtgagaagctcttgggaagtctgggtgggctattttccaagtcatggaggccaaagagaagtcaacagataaaaggaccagtctcaggaaataacttttctgcgacgacagctaacgacacggaacagaggtggaagctaggaattgtcccagcacgtcaagaacgtcccagtcatgtacaaaccacacctgtatctgcaatggagaaaattcaggctgagacagcaaagcaggatgatgcactttccgacctctgtagcacattgggacaactcaaggaaatggcagtggatatgggcgcagaaattgacaggcaaaacaaagctctggttcctttcagcgacgacgttgatgaactgaatttcagactgaaaggcgcgaatcaacggggacgccggttgctggggaagtga

SEQ ID NO: 7310 - protein, 245 aa, Sorghum bicolor
  misc_feature: Ceres ANNOT ID no. 6075409
  misc_feature (185)..(245): Pfam Id: SNARE Pfam Desc: SNARE domain
  misc_feature (1)..(245): NCBI GI: 32308076 NCBI Desc: snap-28 [hordeum vulgare subsp. vulgare]
  misc_feature (43)..(245): NCBI GI: 21553460 NCBI Desc: snap25a [arabidopsis thaliana]
  misc_feature (43)..(245): NCBI GI: 22655332 NCBI Desc: at5g61210/maf19_210 [arabidopsis thaliana]
  misc_feature (44)..(245): NCBI GI: 58825794 NCBI Desc: snap1 [oryza sativa (japonica cultivar-group)]
  misc_feature (44)..(245): NCBI GI: 32308074 NCBI Desc: snap-34 [hordeum vulgare subsp. vulgare]
  misc_feature: The sequence is a functional homolog of SEQ ID NO. 342 in the 11/188,298 US application
MSVPMYKKQNSLSTPVHKTNPFDSDSDSEGPSRAQSVPVRHTNQSVQELEDYAITKARETTHKVNDCVRAAEAIREDATQTMLTLHHQGEQIMRSHQVAAEIEQDLTVSEKLLGSLGGLFSKSWRPKRSQQIKGPVSGNNFSATTANDTEQRWKLGIVPARQERPSHVQTTPVSAMEKIQAETAKQDDALSDLCSTLGQLKEMAVDMGAEIDRQNKALVPFSDDVDELNFRLKGANQRGRRLLGK

SEQ ID NO: 7311 - DNA, 909 bp, Sorghum bicolor
  misc_feature: Ceres ANNOT ID no. 6075412
  misc_feature: Encodes the peptide sequence at SEQ ID NO 7312
atgccggctggagttgcacggccaccagctgggactgggacgaaggaggagatggcaggtctgagcgacttcgagtttttcaagatcctgatcccagggatgtacgaggaagcactgaggctgcccacaaagttcggtgagatcctcggagctcgccgggatctgaagctgcggctcaccggcggagagatgatgccgctgtgggacgtggaagtcttcgtcgacgagaagaacggcgacatgtacctccacaaaggctggaaaaagttcgcccgcgcacacgacctccgcaaagggtacatgctcgtcttccgctacgacgacgacggccgtggcgacctcgtcgtcacggtctttgacctcaccacctgccgcaaggagtacctgcacgccggcgccggtgcgtggtctaaaaggacagtgacaaacataaaaccttctgctcgtcgtcgtcgtgtgcccacaggcggcggaaacaccaaccctggcgccggcggcggacgctcgctgcccatcgcggagccgtcgcatttcgccgtgaccctccggcagtgcaacctggaggcgaagcagaaccagtacctgaacgtgcccgtggagtttcaggacgcgcacgggtacgtccgccggcgccgggtggagctgcagatgggcgggcgctcatggatggtgaacctgaagcgcagcaagcggctgctcggcgaccgctcgtccttcaagtacgggtggcatcagttctgcgtcgacaacggtctcaaggtcggcgacgtctgcttcttccgggtgatccgcgagggcagccgttgcggcgacgacgacgaagatgaagagtgggagccggaggaggaggacgatgagcacgtgctcaaggtggaggtacgcaagaagaacggcacgttcgtctcctga

SEQ ID NO: 7312 - protein, 302 aa, Sorghum bicolor
  misc_feature: Ceres ANNOT ID no. 6075412
  misc_feature (25)..(124): Pfam Id: B3 Pfam Desc: B3 DNA binding domain
  misc_feature (177)..(299): Pfam Id: B3 Pfam Desc: B3 DNA binding domain
  misc_feature (168)..(263): NCBI GI: 124359884 NCBI Desc: transcriptional factor b3 [medicago truncatula]
  misc_feature (22)..(152): NCBI GI: 92893108 NCBI Desc: transcriptional factor b3 [medicago truncatula]
  misc_feature (4)..(127): NCBI GI: 92872624 NCBI Desc: transcriptional factor b3; cupredoxin [medicago truncatula]
  misc_feature (26)..(127): NCBI GI: 92872626 NCBI Desc: transcriptional factor b3; cupredoxin; tonb box, n-terminal [medicago truncatula]
  misc_feature (176)..(264): NCBI GI: 42569291 NCBI Desc: transcriptional factor b3 family protein [arabidopsis thaliana]
  misc_feature: The sequence is a functional homolog of SEQ ID NO. 467 in the 11/188,298 US application
MPAGVARPPAGTGTKEEMAGLSDFEFFKILIPGMYEEALRLPTKFGEILGARRDLKLRLTGGEMMPLWDVEVFVDEKNGDMYLHKGWKKFARAHDLRKGYMLVFRYDDDGRGDLVVTVFDLTTCRKEYLHAGAGAWSKRTVTNIKPSARRRRVPTGGGNTNPGAGGGRSLPIAEPSHFAVTLRQCNLEAKQNQYLNVPVEFQDAHGYVRRRRVELQMGGRSWMVNLKRSKRLLGDRSSFKYGWHQFCVDNGLKVGDVCFFRVIREGSRCGDDDEDEEWEPEEEDDEHVLKVEVRKKNGTFVS

SEQ ID NO: 7313 - DNA, 1659 bp, Sorghum bicolor
  misc_feature: Ceres ANNOT ID no. 6075427
  misc_feature: Encodes the peptide sequence at SEQ ID NO 7314
atgcagctgcggatctcgccgagcatgcgcagcatcaccatctccagcagcaatggcgtcgtcgactccatgaaggtgcgcgtcgcgccgcagccgcccccaccgccgccgccgccgcacggggccgcccggcgcggcggtggagggggagggggatggtactggcgcgccgtcgcgttccctgtcgtcgtggcgctcggctgcctcctgcccttcgccttcatcctcgccgccgtccccgcgctcgaggcaggcggaagcaagtgctcctccgtcgattgcttggggaggcgaatagggcctagtttccttggtaggcaggggggtgattctacaaggctggtgcaagatctgtacagaatttttgatcaagttaacaatgaggaatacccatctgatgaaaagttaccagaatcattcagggattttcttttggagatgaaggataaccattatgatgctagagcatttgctgttaggttgaaagctacgatggaaagcatggataaggaggtaaagaggtcaaggttggcagaacagctgtataaacattatgctgcaactgctattcccaaaggaatccactgcttgtctctgcgccttactgatgaatactcctcaaatgctcatgcacggaaacagttaccgccaccagaactgttacctttgctttctgataattccttccaacattatattctagccagtgataacattcttgctgcttcagttgttgtgagctcaactgtacgatcttcctcagtgcctgagaaagtagtcttccatgttattactgataagaaaacatatcctgggatgcattcatggtttgctcttaattccatatctcctgcaatatttgactggctgacaagagaaaatgtcccagtactagaggctattgaaaaccatcgtggagttagaaatcactatcatggagatcatgcaacagtttccagcgcaagtgacaatcctagggtgcttgcttcaaagttgcaggctcggagccccaaatacatatccctgctgaaccatctccgcatttatttgcctgagctctttcccaacctcaacaaggtggtcttcctcgatgatgacattgttgttcagcgtgatttgtctcccctttgggcgatcaatcttgaagggaaggtgaatggagctgtggaaacatgcagaggggaagacagctgggtgatgtctaagcgtttcaggacgtatttcaacttctcgcatcccgtgatagctcggagtcttgacccagatgaatgtgcttgggcatatggtatgaatatatttgatctggcagcttggaggaagacaaacattagggacacatatcatttctggttgaaggagaacctaaaatctggtcttacactctggaaatttggtactttaccacccgcccttatagcatttaggggtcatgtgcatggcatcgacccatcatggcacctgcttggcttaggataccaagacaagacagatattgagagcgtcaggagggctgcagtgatacattacaatggccagtgcaagccatggctagacattgcttttaagaacctacaaccattttggacaaagcatgtaaactactccaatgacttcgttagaaactgccatattttggagcctcagcatgtcaaggagtga

SEQ ID NO: 7314 - protein, 552 aa, Sorghum bicolor
  misc_feature: Ceres ANNOT ID no. 6075427
  misc_feature (196)..(520): Pfam Id: Glyco_transf_8 Pfam Desc: Glycosyl transferase family 8
  misc_feature (1)..(544): NCBI GI: 145408196 NCBI Desc: secondary wall-associated glycosyltransferase family 8d [populus tremula x populus alba]
  misc_feature (137)..(546): NCBI GI: 52077221 NCBI Desc: glycosyl transferase family 8 protein-like [oryza sativa (japonica cultivar-group)]
  misc_feature (32)..(546): NCBI GI: 57899736 NCBI Desc: glycosyl transferase family 8 protein-like [oryza sativa (japonica cultivar-group)]
  misc_feature (134)..(546): NCBI GI: 7271113 NCBI Desc: 68 kda protein [cicer arietinum]
  misc_feature (144)..(544): NCBI GI: 42408867 NCBI Desc: glycosyltransferase family-like [oryza sativa (japonica cultivar-group)]
  misc_feature: Useful for making plants with altered cell wall content and/or composition
  misc_feature: Functional homolog of the protein sequence encoded by LOCUS at3g01040
  misc_feature: Functional homolog of the protein sequence encoded by LOCUS at5g15470
  misc_feature: Useful for making plants with altered carbohydrate content
  misc_feature: Functional homolog of the protein sequence given in SEQ ID NO 13981
  misc_feature: Useful for making plants with altered cell wall content and/or composition
  misc_feature: Functional homolog of the protein sequence given in SEQ ID NO 13990
MQLRISPSMRSITISSSNGVVDSMKVRVAPQPPPPPPPPHGAARRGGGGGGGWYWRAVAFPVVVALGCLLPFAFILAAVPALEAGGSKCSSVDCLGRRIGPSFLGRQGGDSTRLVQDLYRIFDQVNNEEYPSDEKLPESFRDFLLEMKDNHYDARAFAVRLKATMESMDKEVKRSRLAEQLYKHYAATAIPKGIHCLSLRLTDEYSSNAHARKQLPPPELLPLLSDNSFQHYILASDNILAASVVVSSTVRSSSVPEKVVFHVITDKKTYPGMHSWFALNSISPAIFDWLTRENVPVLEAIENHRGVRNHYHGDHATVSSASDNPRVLASKLQARSPKYISLLNHLRIYLPELFPNLNKVVFLDDDIVVQRDLSPLWAINLEGKVNGAVETCRGEDSWVMSKRFRTYFNFSHPVIARSLDPDECAWAYGMNIFDLAAWRKTNIRDTYHFWLKENLKSGLTLWKFGTLPPALIAFRGHVHGIDPSWHLLGLGYQDKTDIESVRRAAVIHYNGQCKPWLDIAFKNLQPFWTKHVNYSNDFVRNCHILEPQHVKE

SEQ ID NO: 7315 - DNA, 1632 bp, Sorghum bicolor
  misc_feature: Ceres ANNOT ID no. 6075428
  misc_feature: Encodes the peptide sequence at SEQ ID NO 7316
  misc_feature: Up-regulated in root tissues in response to methyl jasmonate treatment
  misc_feature: Up-regulated in shoot tissues in response to methyl jasmonate treatment
atggagctgaggctgaggcggctgctgctgcttgcgctcatctgcctgcatgctccccgttgggcttcggctcagcagccggaggaggcgacggtcatagttaaaggctcgagtaggattgctgccacggatgacaactacgtctgtgctacaattgattggtggccgccggagaagtgcaactacaatcagtgtccatggggccaggcgtcaattcttaatctggatttggatcacccatttcttgctcaagccattcaagcatttgaccatttgaggattaggctgggaggctccttgcaagaccgagttgtttatgatgtgggaacagaaagtccatgctccccattcacaaatgcatccaatggcttgtttggtttctcagttggttgccttggtatggataggtgggacaaactgaatgatctattccagagaacaggagcacttgtcacatttggcgtgaatgcactctacgggaggtataatgttcggcgttccatctgggcaggcaaatggaactccactaatgcatatgattttgtaaaatacacaatctcaaagggatacccagttggctcatgggaatttggcaatgagctgagtgggcatggaatcggagcaaaagttgatgctaaactttatggaaaggatgtaattgaatttaaatccatccttcggcaattgtacaaggcaccactgtcccagccactccttttagccccaggagggttctttgatcaacagtggtattctcagctacttgagacttcaggtcatggtgttgttaatgccttatctcaccatgtatataatcttggtggagggaatgatgttcatcttataaggaagatattagacccaaagtacttagatcgtgctgaagatacttacagagacatgcaacttaccatccaaaggcatggaacatgggcttctgcttgggtcagtgaaagtggcggtgtattcaacaatggtggtcaactggtgtcaaatacattcatcaacagcatctggtatctagatcagcttggaatggcatctaagtacaacacaaaagtgttctgcaggcagactctcatcggtggcaactatggactgcttgacacagaaacttttctgccaaatcctgattactacagtgctctactatggcatcggcttatgggcaatggagttctttcagttgatataaatgcaccacgtcaaatacgtgcttatgctcattgtaggagacaacagcaaggcatcacgcttctgttgatcaacctaagcaacactactggatacaacgtcactctacagaatgacatcaacgtcagcctcggtaaaagacctgaccttgagaagcgcagttctttcacacacaggctcaagaaagcagtctcatggctgggaaggaaaccaacaagcgacaccaagaggagggaggagtaccatctgaccgccaaggacggtgatctccagagcaagacgatgctgctcaatggggtcccgctagaacttggagatgctggcagcattccagctatggatcctgtgctcgttgccgttgattcgccggtgcacctagcaccaacatccatcgccttcgtagttctacccaagtttgaggccaaggcttgttcttga

SEQ ID NO: 7316 - protein, 543 aa, Sorghum bicolor
  misc_feature: Ceres ANNOT ID no. 6075428
  misc_feature (27)..(345): Pfam Id: Glyco_hydro_79n Pfam Desc: Glycosyl hydrolase family 79, N-terminal domain
  misc_feature (29)..(446): NCBI GI: 92896668 NCBI Desc: glycoside hydrolase family 79, n-terminal [medicago truncatula]
  misc_feature (28)..(434): NCBI GI: 8918740 NCBI Desc: beta-glucuronidase precursor [scutellaria baicalensis]
  misc_feature (134)..(543): NCBI GI: 30692666 NCBI Desc: glycosyl hydrolase family 79 n-terminal domain-containing protein [arabidopsis thaliana]
  misc_feature (6)..(380): NCBI GI: 30692673 NCBI Desc: glycosyl hydrolase family 79 n-terminal domain-containing protein [arabidopsis thaliana]
  misc_feature (174)..(410): NCBI GI: 92884256 NCBI Desc: glycoside hydrolase family 79, n-terminal [medicago truncatula]
  misc_feature: Useful for making plants with altered carbohydrate content
  misc_feature: Functional homolog of the protein sequence given in SEQ ID NO 13979
  misc_feature: Up-regulated in root tissues in response to methyl jasmonate treatment
  misc_feature: Up-regulated in shoot tissues in response to methyl jasmonate treatment
MELRLRRLLLLALICLHAPRWASAQQPEEATVIVKGSSRIAATDDNYVCATIDWWPPEKCNYNQCPWGQASILNLDLDHPFLAQAIQAFDHLRIRLGGSLQDRVVYDVGTESPCSPFTNASNGLFGFSVGCLGMDRWDKLNDLFQRTGALVTFGVNALYGRYNVRRSIWAGKWNSTNAYDFVKYTISKGYPVGSWEFGNELSGHGIGAKVDAKLYGKDVIEFKSILRQLYKAPLSQPLLLAPGGFFDQQWYSQLLETSGHGVVNALSHHVYNLGGGNDVHLIRKILDPKYLDRAEDTYRDMQLTIQRHGTWASAWVSESGGVFNNGGQLVSNTFINSIWYLDQLGMASKYNTKVFCRQTLIGGNYGLLDTETFLPNPDYYSALLWHRLMGNGVLSVDINAPRQIRAYAHCRRQQQGITLLLINLSNTTGYNVTLQNDINVSLGKRPDLEKRSSFTHRLKKAVSWLGRKPTSDTKRREEYHLTAKDGDLQSKTMLLNGVPLELGDAGSIPAMDPVLVAVDSPVHLAPTSIAFVVLPKFEAKACS

SEQ ID NO: 7317 - DNA, 963 bp, Sorghum bicolor
  misc_feature: Ceres ANNOT ID no. 6075430
  misc_feature: Encodes the peptide sequence at SEQ ID NO 7318
atggacggggactcgaagaagctgagggttcggtttcctggagtagcaaagggaggtagaggtggacgccagggttcagcgataccaccgcaagaaagcacgcctattggaagagcagaaatgaacagcagtggagaatatgatgctgcattcgcggccacaattgcagcagcagcatttgcaattgctgcccgtgaagagaagcttgcaactcagaagaagactgtccccatcgaggaggtgcccccagccctgtcgccagccaagagaggtgaaagcaccaaaaaacctgctggagccaacaaaatcgcaagatggtttagtggcaaggagcctctagaacacgacgatgacggtccagttaacgtatcggtgaggaggccactgaaaccagcacctggaaagcctgaggatatgcctgcagatcacaaggtggcacccaagatgcttgaaacttctctgagtgtgaagaagggttcaggatcctccagcaagtcagcagacaggaaagggagcaagaagtttgagcaagaacaggctgttcagaaagcgccatcggccgtcaggccagccacctcatatcattctagacggaatggagaagacgcagcaggagtaactgctattggcggcacgggatctaaggctgatgaatgggagaaggcaaagcttgcaagagttagagaagagtatgaaaagatgatggagaccatagctgaatgggaaactgagaagaaggtgaaggcgagacgccaaaaagaacagaaagagactgagctggacagaaagagagcaaaagcactagaagaatacaaccaggagatgacaaggatcaacaaaattgctggaggagcaaggtcaatggcagaggaacgaaaatacaacgatgagaataagatcaaagagaaggcacgcaagatacgatccacaggaaagcctccccgcacatgtgcttgcttttga

SEQ ID NO: 7318 - protein, 320 aa, Sorghum bicolor
  misc_feature: Ceres ANNOT ID no. 6075430
  misc_feature (207)..(318): Pfam Id: Remorin_C Pfam Desc: Remorin, C-terminal region
  misc_feature (122)..(320): NCBI GI: 115451495 NCBI Desc: os03g0211500 [oryza sativa (japonica cultivar-group)]
  misc_feature (214)..(320): NCBI GI: 8778390 NCBI Desc: f16a14.13 [arabidopsis thaliana]
  misc_feature (217)..(317): NCBI GI: 30697834 NCBI Desc: remorin family protein [arabidopsis thaliana]
  misc_feature (176)..(315): NCBI GI: 42573455 NCBI Desc: remorin family protein [arabidopsis thaliana]
  misc_feature (176)..(315): NCBI GI: 21555669 NCBI Desc: remorin [arabidopsis thaliana]
  misc_feature: The sequence is a functional homolog of SEQ ID NO 104 in the 10/666,642US patent application
  misc_feature: The sequence is a functional homolog of SEQ ID NO 1040 in the 10/666,642US patent application
  misc_feature: The sequence is a functional homolog of SEQ ID NO 1041 in the 10/666,642US patent application
  misc_feature: Useful for making plants with modulated growth and phenotype characteristics
  misc_feature: The sequence is a functional homolog of SEQ ID NO 104 in the 20070033671 US patent application
  misc_feature: The sequence is a functional homolog of SEQ ID NO 1040 in the 20070033671 US patent application
  misc_feature: The sequence is a functional homolog of SEQ ID NO 1041 in the 20070033671 US patent application
MDGDSKKLRVRFPGVAKGGRGGRQGSAIPPQESTPIGRAEMNSSGEYDAAFAATIAAAAFAIAAREEKLATQKKTVPIEEVPPALSPAKRGESTKKPAGANKIARWFSGKEPLEHDDDGPVNVSVRRPLKPAPGKPEDMPADHKVAPKMLETSLSVKKGSGSSSKSADRKGSKKFEQEQAVQKAPSAVRPATSYHSRRNGEDAAGVTAIGGTGSKADEWEKAKLARVREEYEKMMETIAEWETEKKVKARRQKEQKETELDRKRAKALEEYNQEMTRINKIAGGARSMAEERKYNDENKIKEKARKIRSTGKPPRTCACF

SEQ ID NO: 7319 - DNA, 786 bp, Sorghum bicolor
  misc_feature: Ceres ANNOT ID no. 6075433
  misc_feature: Encodes the peptide sequence at SEQ ID NO 7320
atgtggagctttgcatcaaatgccatagctggaagccttaagaaaaagggacaaccctcaaaatgcagcatatccaatccagattgttctgatgatgaagtttcttcatgtaccagcagagaggaaggccttgattgtccaatatgttgggaatccttcaaccttgtggagaatgttccctatgtcttgtggtgtggccacacaatgtgcaaaaactgcatccttggtcttcactgggcagttgtcaagtttccgtcccttcctatccagctgcctttgttcatctcatgcccctggtgcaacctgttgtctttccgtctggtttacaagggcaacctcaggttcccacgcaagaactactttctgctctggatggttgagagcatgaatggtgagagagcgaaattccattcctctaatcatgaagagcaccattcctcatggcattcaagtgccggcacaaattccagtcatcaacaccgaagaaatgctactgtacgatcagagagctcttctgccagagaaacaagtgtcgtcggtaacattttccacactgacaacattagtgcttctctgcagaagcttatggtatgcttcatgcagctgacagccaagtttccactcgtgataatcttcctgctgatagtcctttatgctgtccctgcaagtgctgctgttctggtcctgtatgcccttgtcacgtttttgtttgcactgccctcatttttgatcctctactttgcttatcccagcttggattggcttgtcagagagatcttcgcttaa

SEQ ID NO: 7320 - protein, 261 aa, Sorghum bicolor
  misc_feature: Ceres ANNOT ID no. 6075433
  misc_feature (1)..(259): NCBI GI: 11994767 NCBI Desc: ring zinc finger protein-like [arabidopsis thaliana]
  misc_feature (42)..(74): NCBI GI: 83754838 NCBI Desc: chain a, solution structure of the ring domain of the tripartite motif protein 32
  misc_feature (42)..(74): NCBI GI: 123225989 NCBI Desc: tripartite motif protein 32 [mus musculus]
  misc_feature: The plant produces a reduced number of seeds.
  misc_feature: Useful for biocontainment applications
  misc_feature: Useful for making plants with altered alkaloid content
  misc_feature: GREAT-hit functional homolog of the protein sequence given in SEQ ID NO 12877
  misc_feature: Useful for making plants with altered protein content
  misc_feature: Functional homolog of the protein sequence given in SEQ ID NO 13460
  misc_feature: Useful for biocontainment applications
  misc_feature: Useful for making plants with altered alkaloid content
  misc_feature: Functional homolog of the protein sequence given in SEQ ID NO 12877
  misc_feature: The sequence is a functional homolog of SEQ ID NO. 497 in the 11/188,298 US application
MWSFASNAIAGSLKKKGQPSKCSISNPDCSDDEVSSCTSREEGLDCPICWESFNLVENVPYVLWCGHTMCKNCILGLHWAVVKFPSLPIQLPLFISCPWCNLLSFRLVYKGNLRFPRKNYFLLWMVESMNGERAKFHSSNHEEHHSSWHSSAGTNSSHQHRRNATVRSESSSARETSVVGNIFHTDNISASLQKLMVCFMQLTAKFPLVIIFLLIVLYAVPASAAVLVLYALVTFLFALPSFLILYFAYPSLDWLVREIFA

SEQ ID NO: 7321 - DNA, 3996 bp, Sorghum bicolor
  misc_feature: Ceres ANNOT ID no. 6075435
  misc_feature: Encodes the peptide sequence at SEQ ID NO 7322
atggtgcccaacgggctcctgcccagtgcgtccgccggggtgacgcggcggctcgaccccgagcgctgggcggtcgcggaggaccgcacggcggagttgatcgcgcgcatccagcccaacgcgtactccgaggggcggaggctggccgtgtaccactacgtgcagcggctcatcatgaactgcctctcctgccaggtttttacctttgggtcggtccctctcaagacttacttacccgatggtgacattgatgtcactgcttttagtaatagtgaagaattaaaggagatttgggcaaatcttgtccgggatgcattggagcgtgaagagaagaatgaaaatgctgaatttcatgtaaaagaagtccagtatattcaggcagaggtcaagattataaagtgtcttgttgaaaacattgtcgttgacatctcatttaatcaagtcggtggactatgcacactatgttttcttgaagagattgacaacttgatcagccgaaaccatttattcaagaggagtatcatattgataaaagcatggtgtttctatgagagtcgtattctcggagctcaccatggtcttatatctacttatgcattggagacacttgttctgtacatatttcatatattcaacaactctttcaccggacctcttgaggtgttgtaccgcttcttagaatttttcagcaactttgattgggagaaattttgtttgagcttgtggggccctgttccgattagttcacttccagatatgactgcggaacccccacggatggacagtggtgaattgttgctgaacaagtccttcctggatacttgtagttctgcatatggagttgtgcctcgcacccaggagaaccagggtcaaccatttgtttcaaaacattttaatgttattgatcctttacgtgcaaacaacaatcttggaagaagtgtcagtaaaggaaatttctttagaatacgcagtgcttttgcgtacggggcgaaaaggcttggaaagttacttgaatgtccaaaagaagacttaattgctgaattaaaccagttcttcacaaatacatggataagacatgggagtggcagtcgtcccgatgtgcctaccccaagtctagttgatgtgcggcctctgaaggttgttccttctgtagtgtcaagctcaagcagccagagaagtgtaacagcattcaagaaaaaggttgaaaatcctaagcttcatgctaatcaggataatcttcgtccgaatcaagataatctcactgaagttggtcacatgtatactgatccttctcaaccagttcacaaaagtgacatacattatcataatctgcctagagcggttaatccttcagttactcatgttcagcaccaaaaaaactatacaccacaaggcaatgctaaggtctctgaacagcttgaaagaaataactcagctggattgatgcaaagtgaaagggataagagagtgccaaatggtctctttgtcaatgacagaaatgggcagaacaggtctagatttgcaagaacccgatcaagtcctgaactcacagactcttctgctgaagggtttcgtggaaggcggaataatgcagttggtatggaaaaatctttgggtgttgatcacagcagcagaagaaacatcttggttccagaagtgtctagcaaccacagcactaagtcttcacaggatgaatcagtgtcttccttgaacagttcatctcaccctagtgcaatggcagcttctgactcgaatagtgtttcaagcagctatcgtgatgataatggttttgtgatgaatgaagaactcccttctgtttctgaatcatcggatatgcaccatgacgaacaagttctggttaatttaatggaatccgtgaagttgcatggattcaatggacagattcaattaccaatgcaaataccttctcatatgtccgtagcacatccccctttactggctccaacaactttttcacaaaagcatttggctggggttccaccagctaacttaattgggacaccatggttgcccaatatgcagttcctgcatggatttgttccacctcctatggcccattacatacacaatccaaattttgcaccaaacattgaggacggtactgagactgaaaagcctaatacatcagatgtgacccatgatgctggcaaaacatggcaagagtatggtgttgggttttctagacagtttgatcctgaagcaagagatcctcacatctatggtattgatggcaaagaacattcctctttgcctaatggcgtaccaggtgctcccttggaaaggcagatgaaatttacagttgagaataatggtgtagatgatgaaacttatactggcatgttcccaaaccatacaagtagagaagctgctgtagattactctaagaggagtggttatgtgaatgttctttcttcacatgccagttcatccaaaggcaaaactatggattcgagttcatgggatgaaatgactgtaaatacaacaaaaccaccaagagaaaaatggggaaaaagatctgcctttgcggcacctgccacgaccacacatggcaagactgggtggcagatgggaaatactgcagagcatctcccagctgaagttaatgatggccccagaaatgggacagtggtaccaatcatcactgaagcttctgagatagtaacagggtctgattctttttcagcacaatcaagaactagtcaagtaccaaatgattttgatccatcacaaattggcatgccaaatccagtgtttgcaccttttcttattggatcaccacagcataggcaaggtgatagctctggacttacttttgttcaaacaggtccaccagttccttttgttgtgctcccatttgttccagggaatagcgatggttctggtccccagtttgagagaaacgaaggaattgatcagcttcctgccaatactgtaggtcaattttttggttcacttaatgatgttcaccaacaagattctagtgctacctcaacagtatcatccagttctatgactgagccatctggtgaacacaagcctgacatcttgaatagtgattttgtcagccattggcataatttacagtatgggcgactctgccagaatcctcgtcccatgggtcctgttctataccctgttccggtgccgccaatgtatttacagggccatgcaccatgggatgggcctggaagaccagctgcaccaaatgttaactggccacaaatggtgggcggtcaacgagtatttcctgtgatgcctgtacaaccgactacagaaagaactggtgttattcagcactatggtgaagatgcacccagataccgtggaggcacgggaacctacttgccaaatcctaaggttccttttagggaccggcactcaaattcaagaaactacagaggaggttataatggtgacaggggtgattatagtgataaggagggaagctggataaactcaaaacaacggaatccaaaccgtggctatggacgtagccagtcagagaggtctggcatgaggtctgatagacatgtcactgatgagagccagtctgatagacaacggcgtacttatagaaatgactcgtaccggcatgaggcaagctctcagtatcttgtgcaggggcaaccttttggatccacaagctctatgcgcaaactaggaaacacagcgcatggggtttatacacaaccatctacgtcttcaaatggtgccggtgctttatctggccctccaggaccaccattttttatggtgtactcttatgaacaaggctcaaatcatggtgcttcctcatctgaaccaattgaatttggatctcttgggccacttcctgcagcagatggtgatgacataccaaggtcgacacgccaagtaatgcctaatgggttttatgggcaaagacgtggtccgtataggggtggttcctctcattcatctcctgatcaaccatcctcacctcagcatcgtcggtaa

SEQ ID NO: 7322 - protein, 1331 aa, Sorghum bicolor
  misc_feature: Ceres ANNOT ID no. 6075435
  misc_feature (1)..(963): NCBI GI: 115451487 NCBI Desc: os03g0210800 [oryza sativa (japonica cultivar-group)]
  misc_feature (20)..(367): NCBI GI: 79597803 NCBI Desc: nucleic acid binding [arabidopsis thaliana]
MVPNGLLPSASAGVTRRLDPERWAVAEDRTAELIARIQPNAYSEGRRLAVYHYVQRLIMNCLSCQVFTFGSVPLKTYLPDGDIDVTAFSNSEELKEIWANLVRDALEREEKNENAEFHVKEVQYIQAEVKIIKCLVENIVVDISFNQVGGLCTLCFLEEIDNLISRNHLFKRSIILIKAWCFYESRILGAHHGLISTYALETLVLYIFHIFNNSFTGPLEVLYRFLEFFSNFDWEKFCLSLWGPVPISSLPDMTAEPPRMDSGELLLNKSFLDTCSSAYGVVPRTQENQGQPFVSKHFNVIDPLRANNNLGRSVSKGNFFRIRSAFAYGAKRLGKLLECPKEDLIAELNQFFTNTWIRHGSGSRPDVPTPSLVDVRPLKVVPSVVSSSSSQRSVTAFKKKVENPKLHANQDNLRPNQDNLTEVGHMYTDPSQPVHKSDIHYHNLPRAVNPSVTHVQHQKNYTPQGNAKVSEQLERNNSAGLMQSERDKRVPNGLFVNDRNGQNRSRFARTRSSPELTDSSAEGFRGRRNNAVGMEKSLGVDHSSRRNILVPEVSSNHSTKSSQDESVSSLNSSSHPSAMAASDSNSVSSSYRDDNGFVMNEELPSVSESSDMHHDEQVLVNLMESVKLHGFNGQIQLPMQIPSHMSVAHPPLLAPTTFSQKHLAGVPPANLIGTPWLPNMQFLHGFVPPPMAHYIHNPNFAPNIEDGTETEKPNTSDVTHDAGKTWQEYGVGFSRQFDPEARDPHIYGIDGKEHSSLPNGVPGAPLERQMKFTVENNGVDDETYTGMFPNHTSREAAVDYSKRSGYVNVLSSHASSSKGKTMDSSSWDEMTVNTTKPPREKWGKRSAFAAPATTTHGKTGWQMGNTAEHLPAEVNDGPRNGTVVPIITEASEIVTGSDSFSAQSRTSQVPNDFDPSQIGMPNPVFAPFLIGSPQHRQGDSSGLTFVQTGPPVPFVVLPFVPGNSDGSGPQFERNEGIDQLPANTVGQFFGSLNDVHQQDSSATSTVSSSSMTEPSGEHKPDILNSDFVSHWHNLQYGRLCQNPRPMGPVLYPVPVPPMYLQGHAPWDGPGRPAAPNVNWPQMVGGQRVFPVMPVQPTTERTGVIQHYGEDAPRYRGGTGTYLPNPKVPFRDRHSNSRNYRGGYNGDRGDYSDKEGSWINSKQRNPNRGYGRSQSERSGMRSDRHVTDESQSDRQRRTYRNDSYRHEASSQYLVQGQPFGSTSSMRKLGNTAHGVYTQPSTSSNGAGALSGPPGPPFFMVYSYEQGSNHGASSSEPIEFGSLGPLPAADGDDIPRSTRQVMPNGFYGQRRGPYRGGSSHSSPDQPSSPQHRR

SEQ ID NO: 7323 - DNA, 348 bp, Sorghum bicolor
  misc_feature: Ceres ANNOT ID no. 6075444
  misc_feature: Encodes the peptide sequence at SEQ ID NO 7324
atggcaagcagggcaaggggtggacgcgcacctcccactccctcccccacacaggcagagataggacggctccaaggtggattctatcagccgatagtgaacatcaacgatccgcacgttcaggaggtcggcaggtgggcggtgtcggagcatgtcaagaaggcgaacgacgggctaaaattcagtagagtggtgagcggtcaatatcaagtggtcgagggcttcaactatcgtctcatcatcgatgcaactgatagccatggcaaggttgccaagtatgaggccgtggtgtgggagaaggaatgggagaactttcttcagctcacgtcctttaaaccggctaactga

SEQ ID NO: 7324 - protein, 115 aa, Sorghum bicolor
  misc_feature: Ceres ANNOT ID no. 6075444
  misc_feature (26)..(115): Pfam Id: Cystatin Pfam Desc: Cystatin domain
  misc_feature (22)..(114): NCBI GI: 122246932 NCBI Desc: cysteine proteinase inhibitor 8 precursor (oryzacystatin-8) (oryzacystatin viii) (oc-viii)
  misc_feature (22)..(114): NCBI GI: 109238651 NCBI Desc: cystatin hv-cpi8 [hordeum vulgare subsp. vulgare]
  misc_feature (16)..(115): NCBI GI: 21592712 NCBI Desc: cystatin-like protein [arabidopsis thaliana]
  misc_feature (22)..(114): NCBI GI: 109238647 NCBI Desc: cystatin hv-cpi6 [hordeum vulgare subsp. vulgare]
  misc_feature (16)..(114): NCBI GI: 89257481 NCBI Desc: cystatin domain containing protein [brassica oleracea]
  misc_feature: Useful for making plants with modulated salt sensitivity
  misc_feature: GREAT-hit functional homolog of the protein sequence given in SEQ ID NO 13217
  misc_feature: The sequence is a functional homolog of SEQ ID NO. 303 in the 11/188,298 US application
MASRARGGRAPPTPSPTQAEIGRLQGGFYQPIVNINDPHVQEVGRWAVSEHVKKANDGLKFSRVVSGQYQVVEGFNYRLIIDATDSHGKVAKYEAVVWEKEWENFLQLTSFKPAN

SEQ ID NO: 7325 - DNA, 1794 bp, Sorghum bicolor
  misc_feature: Ceres ANNOT ID no. 6075445
  misc_feature: Encodes the peptide sequence at SEQ ID NO 7326
atggccgccgggcgggccttcctcggcgcgccgtgctcctccctcgccgccggcgcccgccgccttgccttcgcttcccctttgccgcggaccctcacccccgcgctccgctgcggcgttcgcggtcgctgcatcgcttccgcctcctcgtcccccgacgcggcctcctcgcccgagccatacgtgctcaccacgccgctctactacgtcaacgctccgccgcatatgggaagcgcctacaccactatcgcggcggacgccatcgcccgcttccagaggttgcaagagaagaatgttatatttattactggaaccgatgaacatggtgagaaaatagctgcttccgcagaggccagtggtagaaacccaaaggagcattgtgatgcaatttcaagttcatataagacgctctgggctgatttagacatagaatacgacaagtttattcgcacaacggatagtaagcacgaggctgttgtgaacgaattctattccagagtattaaacagtggtgacatatatagagctgattatgaaggactttactgtgtgagctgtgaggagtacaaggatgaaaaagagctattggaaaacaattgttgccctgtgcatttgaagccttgtgtagaaagaaaagaagataactatttctttgccttgtcaaagtaccagcataagttggaagagctactgacaagaaatcctgattttgtaaggccatcatatcgcttgaacgaggtccaaggctggattaaaagtggattaagggacttttctatttcccgtgcatctgtagaatggggcattccagtgccaaacgataccaagcagacaatatacgtgtggtttgatgctctcttagggtatatctcagcattattagatgatggtgagcaagcaagtttgcagcaagctgttgatcatggttggccagcctccctgcacttgattggaaaggacatattacggtttcatgcagtttattggccagccatgttaatgtctgcaggtttaactgttcccgatacagtttttggtcatggattcttgacaaaggatggcatgaagatgggaaagtcattaggcaacacactggaaccaaaagatctggtagaaagatttggtgctgatgctgttaggtacttcttcttgcgggaagtagaattcggcaatgatggggactattcagaagaacgctttatcaatatagtcaatgctcatcttgctaatacaattggaaacctccttaatcgtacacttgggctactaaaaaagaattgtaaatccaaactagcttttgattcaatagctgccgcagatggaggtttgttcagagataacatagaaaacctggtggacaaggcaaagcaccattatgaaaatcttttgctgtcatcagcatgtgaaactgttttagagattggtaaccttggaaacttgtacatcgatgagcaagcaccatggtcctgtttcaagcaagggggtgagagtgctgaaaaggctgcaaaggatcttgtacttattttagagacaatgaggataattgcaatcgcactatctcctatcactccaagcctttctctgaggatttacacacagctcggtttcacagaagaccagtttagactgttgagatgggaggatacgaaatggggaggccttaaagcgggccaggtaatgtccgagccaaagccagtgtttgcaaggatagaaaccgaggcggaagaggatggccaagcaagttcaaaagcagcaaaggggggaagaagaaagcacgcagcaaaggacttgtag

SEQ ID NO: 7326 - protein, 597 aa, Sorghum bicolor
  misc_feature: Ceres ANNOT ID no. 6075445
  misc_feature (61)..(420): Pfam Id: tRNA-synt_1g Pfam Desc: tRNA synthetases class I (M)
  misc_feature (39)..(390): Pfam Id: tRNA-synt_1 Pfam Desc: tRNA synthetases class I (I, L, M and V)
  misc_feature (47)..(591): NCBI GI: 7076783 NCBI Desc: methionyl-trna synthetase (atcpmetrs) [arabidopsis thaliana]
  misc_feature (47)..(591): NCBI GI: 22137164 NCBI Desc: at3g55400/t22e16_60 [arabidopsis thaliana]
  misc_feature (47)..(591): NCBI GI: 2266985 NCBI Desc: metrs [arabidopsis thaliana]
  misc_feature (47)..(505): NCBI GI: 145332859 NCBI Desc: ova1 (ovule abortion 1) [arabidopsis thaliana]
  misc_feature (58)..(571): NCBI GI: 81299951 NCBI Desc: methionyl-trna synthetase [synechococcus elongatus pcc 7942]
  misc_feature (56)..(576): SWISSPROT Homolog: EC 6.1.1.10 Methionyl-tRNA synthetase
MAAGRAFLGAPCSSLAAGARRLAFASPLPRTLTPALRCGVRGRCIASASSSPDAASSPEPYVLTTPLYYVNAPPHMGSAYTTIAADAIARFQRLQEKNVIFITGTDEHGEKIAASAEASGRNPKEHCDAISSSYKTLWADLDIEYDKFIRTTDSKHEAVVNEFYSRVLNSGDIYRADYEGLYCVSCEEYKDEKELLENNCCPVHLKPCVERKEDNYFFALSKYQHKLEELLTRNPDFVRPSYRLNEVQGWIKSGLRDFSISRASVEWGIPVPNDTKQTIYVWFDALLGYISALLDDGEQASLQQAVDHGWPASLHLIGKDILRFHAVYWPAMLMSAGLTVPDTVFGHGFLTKDGMKMGKSLGNTLEPKDLVERFGADAVRYFFLREVEFGNDGDYSEERFINIVNAHLANTIGNLLNRTLGLLKKNCKSKLAFDSIAAADGGLFRDNIENLVDKAKHHYENLLLSSACETVLEIGNLGNLYIDEQAPWSCFKQGGESAEKAAKDLVLILETMRIIAIALSPITPSLSLRIYTQLGFTEDQFRLLRWEDTKWGGLKAGQVMSEPKPVFARIETEAEEDGQASSKAAKGGRRKHAAKDL

SEQ ID NO: 7327 - DNA, 1806 bp, Sorghum bicolor
  misc_feature: Ceres ANNOT ID no. 6075446
  misc_feature: Encodes the peptide sequence at SEQ ID NO 7328
atgaggaagcacgggtggcagctgccgtaccaccctctccaggtggttgcgatagccgtgttctcggcactgggcttcgccttctatgtcttcttcgtgccgttcgtggggacgaagccgttccagattgtggccatggctatctacactccgttgattacatgtgtcgttgtgttatacatatggtgtgcggcaacaaatcctggagacccgggcattttcgattcaactaagaatttgaagttagataagcatgaaaagcactcctatgtaaattcggaccagggaattaatcatggaggaaggccattaagtgagacttttggtactgctgataacagtgagaagctgagcagcatgcttgagaggaaggattcgccttcttggcccagattttctggaattctttccctggtttgtctcccattctcttgccattgcaaacaatgcctccattcagacagtcaaccttcagaacagaaaatgtgtgaagaaggcatgtttttctgcagcttatgcgaagcagaggttctgaagaacagtaagcattgtagagtatgtgacaagtgtgttgatggattcgaccatcactgcagatggcttaacaattgcatagggaaaaggaactacaaaggtttcttcgctctaatggcttctgcagttattctgtggttgtcgggggcacttgtgttgattctctgtattgtgaagcgaggagaattctctaggcaggttgtcacaaagttgggaagcagcttctcaactgtggcttttgtaattgttgtggcgacctgcaccattttagcaatggttgcaaccgtgccacttgtccagcttttatgttttcatatccttcttgtcaaaaagggaattagcacgtatgattacatcatagctttgagggagcaggaggatcaacaagaggttcctggacaccaaagtccacagatgtctattattagttctgttactggttttagcacagccagttcttttggacctcttcatcgtggttcatggtgcactccaccaagattgttcctggaagaccagttcgatgccattcctccagaggtcggcatttcacagaattcaggcagtaagaaaatcaaggaagaggaaggagcaaggagaaaaaatggagcagtgaaaatcagtccatggacattggcacggctaaatgcagaggaagtttcaaaggcagctgcggaggcaaggaagaaatccaaaatcctgaaaccaattgcaaaacatggcatctcagacaatggcagtaaaccagaccataagctcagctaccagagacgactagatagaagaggtttccctgctgagctttctcttgacccacttgcaactctatctgcaagcggcactgaaagcaactacagcgacacagcaacagaaatttgtggcagtttagccccattacagctcgaagcaagaagtgctttccagcctagtactgcagcatccacaagaaatgttgcttcatcgcctgaaagtagctttgactcgcctgatctccaccccttccgcacttcctcagccacaggcgatgagatgcagggagccatgacacattcagctcacaggggcatcgagtttaaaagatcatcgagcgatggttatgaagcatctggaggtgaagatagtgaccgcatcccttcaagaatcgtgcacagatcgtcgaactgggccaatgtctttctgaattctagtcagggaggccctcaagctgatctgctcacgacatcatctgaaggttttttagttaacgcaaatgtctcgaattctggttcctag

SEQ ID NO: 7328 - protein, 601 aa, Sorghum bicolor
  misc_feature: Ceres ANNOT ID no. 6075446
  misc_feature (159)..(223): Pfam Id: zf-DHHC Pfam Desc: DHHC zinc finger domain
  misc_feature (1)..(523): NCBI GI: 42563074 NCBI Desc: zinc finger (dhhc type) family protein [arabidopsis thaliana]
  misc_feature (227)..(523): NCBI GI: 115473141 NCBI Desc: os07g0596000 [oryza sativa (japonica cultivar-group)]
  misc_feature (1)..(537): NCBI GI: 15233295 NCBI Desc: zinc finger (dhhc type) family protein [arabidopsis thaliana]
  misc_feature (140)..(415): NCBI GI: 38344276 NCBI Desc: osjnba0013k16.7 [oryza sativa (japonica cultivar-group)]
  misc_feature (133)..(463): NCBI GI: 92875106 NCBI Desc: zinc finger, dhhc-type [medicago truncatula]
MRKHGWQLPYHPLQVVAIAVFSALGFAFYVFFVPFVGTKPFQIVAMAIYTPLITCVVVLYIWCAATNPGDPGIFDSTKNLKLDKHEKHSYVNSDQGINHGGRPLSETFGTADNSEKLSSMLERKDSPSWPRFSGILSLVCLPFSCHCKQCLHSDSQPSEQKMCEEGMFFCSLCEAEVLKNSKHCRVCDKCVDGFDHHCRWLNNCIGKRNYKGFFALMASAVILWLSGALVLILCIVKRGEFSRQVVTKLGSSFSTVAFVIVVATCTILAMVATVPLVQLLCFHILLVKKGISTYDYIIALREQEDQQEVPGHQSPQMSIISSVTGFSTASSFGPLHRGSWCTPPRLFLEDQFDAIPPEVGISQNSGSKKIKEEEGARRKNGAVKISPWTLARLNAEEVSKAAAEARKKSKILKPIAKHGISDNGSKPDHKLSYQRRLDRRGFPAELSLDPLATLSASGTESNYSDTATEICGSLAPLQLEARSAFQPSTAASTRNVASSPESSFDSPDLHPFRTSSATGDEMQGAMTHSAHRGIEFKRSSSDGYEASGGEDSDRIPSRIVHRSSNWANVFLNSSQGGPQADLLTTSSEGFLVNANVSNSGS

SEQ ID NO: 7329 - DNA, 1248 bp, Sorghum bicolor
  misc_feature: Ceres ANNOT ID no. 6075450
  misc_feature: Encodes the peptide sequence at SEQ ID NO 7330
atggccggctccgagcagcgcgtcgtcgccgtcatcatggtcggcggccccaccaaagggacgcggttccggccgctgtcgctgaacgtgcccaagccgctcttccctatcgccggccagcccatggtgcaccaccccatctccgcctgccgccggatccccaacctggcacagatatacctcatcgggttctacgaggagcgggaattcgcgctctatgtctcgtctatctccaacgagctcaggatccctgtcaggtacctacgagaggacaaacctcacgggtcagctggagggctctacagctttagagattatatcatggaagacagtccgtcacacatagttctgctgaactgcgacgtctgttctagcttcccccttccagacatgctggaggcccataaaaagtatggaggaatgggtaccttactagtcaacaaggtatctgcagagtcagcgaaccagttcggcgagttggtagctgatcctgaaacaaacgaactgctgcactatacggaaaagccagagacttttgtgagtgatctcataaattgtggagtatatatatttactcccaatatctttagcgccattgaggatgtcttaaaacagaaaaaggacagagcaaatttgcggcgtgtatctagctttgaagctcttcattcagcaaccaaggcgcttccaccagactttgttaggttagatcaagacattttatcccctcgagcgggaaagaaggagctgtacacataccagacgcttgatttttgggaacagatcaaaaccccagggatgtctttgagatgctctgggttatatctttctcagttccgccgtacctctcctcatcttttagcctcaggagacggcaaaagaactgccactattgttggcgatgtgtatatccatccatctgccaaggtgcatcctacttcaaagattggccccaatgtctctatatcagcaaatgcgcgagttggagctggtgccaggcttatcaattgcataattctggatgatgttgaaattatggaaaatgctgttgttatacattcaattgtggggtggaagtcatccattggaaaatggtcacgtgtacagggcgaaggcgatcacaatgccaaacttggcattactattcttggtgaagcagttgatgttgaagatgaagtagttgtagttaacagcatcgtgctcccaaataaaactctcaatgtcagtgtccaagaggagatcatcctataa

SEQ ID NO: 7330 - protein, 415 aa, Sorghum bicolor
  misc_feature: Ceres ANNOT ID no. 6075450
  misc_feature (9)..(231): Pfam Id: NTP_transferase Pfam Desc: Nucleotidyl transferase
  misc_feature (4)..(415): NCBI GI: 140053753 NCBI Desc: nucleotidyl transferase; trimeric lpxa-like [medicago truncatula]
  misc_feature (5)..(415): NCBI GI: 5882732 NCBI Desc: similar to gbaf135422 gdp-mannose pyrophosphorylase a (gmppa) from homo sapiens. ests gbaa712990, gbn65247, gbn38149, gbt04179, gbz38092, gbt76473, gbn96403, gbaa394551 and gbaa728527
  misc_feature (5)..(415): NCBI GI: 5882732 (continued) come from this gene. [arabidopsis thaliana]
  misc_feature (4)..(415): NCBI GI: 22325477 NCBI Desc: adp-glucose pyrophosphorylase family protein [arabidopsis thaliana]
  misc_feature (5)..(368): NCBI GI: 30699056 NCBI Desc: adp-glucose pyrophosphorylase family protein [arabidopsis thaliana]
  misc_feature (10)..(415): NCBI GI: 28830182 NCBI Desc: similar to homo sapiens (human). gdp-mannose pyrophosphorylase a [dictyostelium discoideum]
  misc_feature: The sequence is a functional homolog of SEQ ID NO. 521 in the 11/188,298 US application
MAGSEQRVVAVIMVGGPTKGTRFRPLSLNVPKPLFPIAGQPMVHHPISACRRIPNLAQIYLIGFYEEREFALYVSSISNELRIPVRYLREDKPHGSAGGLYSFRDYIMEDSPSHIVLLNCDVCSSFPLPDMLEAHKKYGGMGTLLVNKVSAESANQFGELVADPETNELLHYTEKPETFVSDLINCGVYIFTPNIFSAIEDVLKQKKDRANLRRVSSFEALHSATKALPPDFVRLDQDILSPRAGKKELYTYQTLDFWEQIKTPGMSLRCSGLYLSQFRRTSPHLLASGDGKRTATIVGDVYIHPSAKVHPTSKIGPNVSISANARVGAGARLINCIILDDVEIMENAVVIHSIVGWKSSIGKWSRVQGEGDHNAKLGITILGEAVDVEDEVVVVNSIVLPNKTLNVSVQEEIIL

SEQ ID NO: 7331 - DNA, 1551 bp, Sorghum bicolor
  misc_feature: Ceres ANNOT ID no. 6075453
  misc_feature: Encodes the peptide sequence at SEQ ID NO 7332
atggcgtcccgcgacctcgccgagagcctcctctccggcggcgggggcggagcctccgcctcacacgacgaatacgaggagcgcgcgtacgactccgacgacaaggtctccatcgccatctcggattccgacggcgaagacgacggcgcgccggcgtcgcgcccacccttctcgtggcggaagctctggcgcttcacgggcccgggtttcctcatgtgcatcgcgttcctggacccgggaaacctggagggggacctgcaggcgggcgccgccgcggggtaccagctgctatggctgctcatgtgggcgacggtcatgggcgcgctgatgcagctgctctccgcgcggctcggcgtggccacggggaagcacctcgccgagctctgccgcgaggagtacccgacctgggccacgcgcgcgctctgggccatgacggagctcgcgctcgtcggcgccgacatacaggaggtgattggcagcgcgattgccatcaagatcctctcggggggcaccgtgccgctctggggtggcgtcgtcatcaccgcgctcgattgcttcatctttctcttcctggagaattatggtgtgagaaaactggaggcatttttcgctgtattgattgcaactatggctgtttcatttgcggttatgtttggtgaaacaaagcctagtggcaaggaacttctgattggtttggtggttccaaaattgagttcaaagacaattaagcaagcggttggaattgtgggctgcatcatcatgcctcacaatgttttcttgcattcagcactagtgcagtccaggaagattgacacaaacaagaaatctcgtgttcaagaagcagtttactactacaacattgagtcaattcttgcactcattgtgtccttctttattaacatctgtgtcacaacagtttttgccaaaggattttatgggtctaaacaggctgacagtataggtcttgagaatgctgggcagtacttacaggaaaaatatggaactgcattctttcccatcctctatatctgggctattggtttgttagcatctgggcagagtagcacaattactggcacatatgcaggacaatttgttatgggaggcttccttaatcttcgattgaagaagtggctacgagcaatgattactcgaagttttgccattattccaactatgattgtggctttatttttcgatactgaagatcctactatggatattctgaatgaagcactcaatgttcttcaatccatacagattccatttgctctaattcctctcatcaccctcgtttcaaaggagcaaatcatgggatcgttcgtaattggtcccatcaccaaagtgattagctggattgttacagtatttctgatgcttatcaacgggtatcttatactgtctttctacattactgatgtccggggtgcattgcttcgctcaagcttgtgtattgtgttgattgtttaccttgcattcatcgtctatcttattgtgcgaaatacttcgctgtattctcgcctttgctcatctatgtcaaagagcccatga

SEQ ID NO: 7332 - protein, 516 aa, Sorghum bicolor
  misc_feature: Ceres ANNOT ID no. 6075453
  misc_feature (82)..(445): Pfam Id: Nramp Pfam Desc: Natural resistance-associated macrophage protein
  misc_feature (54)..(515): NCBI GI: 2231149 NCBI Desc: integral membrane protein [oryza sativa]
  misc_feature (23)..(498): NCBI GI: 31322147 NCBI Desc: ferrous ion membrane transport protein dmt1 [glycine max]
  misc_feature (21)..(516): NCBI GI: 5231117 NCBI Desc: nramp2 [arabidopsis thaliana]
  misc_feature (21)..(500): NCBI GI: 6468012 NCBI Desc: metal transporter nramp3 [arabidopsis thaliana]
  misc_feature (23)..(500): NCBI GI: 57231016 NCBI Desc: nramp metal transporter-like protein [thlaspi caerulescens]
MASRDLAESLLSGGGGGASASHDEYEERAYDSDDKVSIAISDSDGEDDGAPASRPPFSWRKLWRFTGPGFLMCIAFLDPGNLEGDLQAGAAAGYQLLWLLMWATVMGALMQLLSARLGVATGKHLAELCREEYPTWATRALWAMTELALVGADIQEVIGSAIAIKILSGGTVPLWGGVVITALDCFIFLFLENYGVRKLEAFFAVLIATMAVSFAVMFGETKPSGKELLIGLVVPKLSSKTIKQAVGIVGCIIMPHNVFLHSALVQSRKIDTNKKSRVQEAVYYYNIESILALIVSFFINICVTTVFAKGFYGSKQADSIGLENAGQYLQEKYGTAFFPILYIWAIGLLASGQSSTITGTYAGQFVMGGFLNLRLKKWLRAMITRSFAIIPTMIVALFFDTEDPTMDILNEALNVLQSIQIPFALIPLITLVSKEQIMGSFVIGPITKVISWIVTVFLMLINGYLILSFYITDVRGALLRSSLCIVLIVYLAFIVYLIVRNTSLYSRLCSSMSKSP

SEQ ID NO: 7333 - DNA, 825 bp, Sorghum bicolor
  misc_feature: Ceres ANNOT ID no. 6075461
  misc_feature: Encodes the peptide sequence at SEQ ID NO 7334
atgacgagcgcctccgagctcttcaccgcgcgacgcggcgcccgtgggggccgcctctccgatcccgacccggacccggacccggatccgcacgccgacgcgctccgggaccagcacggcatcggcgggcggcgccggcgacgcgggtgccgcccgcgacgccagctcgacgccgctggggacgtgcggcagcacctgcacaccggcgccccgccaccgcgtcgccgcgggtcgtacaccgatcagatcttatcgtacatagacaataacaacattggggattctgcagctcggaggaacagacttgataggctgatgttcaggacaaatgagcggcttcctggtgctgtactgcaagcacaagcacgtgtcctggagagactcaggggcgtttctcttggttcatctgcctccaggccatccatctcattagatgaattttctgctagcgatgtgtttagaatcatcgacttcagaaatagagaaacgaggcacgaggcaaatcggccccactcatcatcgttccacccgagcagtgaatcagatgaagaaagaccaactgtcagttccactaactccaaccggtcaactggacttagcaaggcggctttcctgcgtttgcagattgagatttttgaggctagcaaagatgataacagagaagcatcatcagaatgttctatttgccttgatggattttatgatggagatgagctgataaggttgcgctgtggccacaggttccactcaacatgcttggagccatgggtgcggaaatgtgcagactgcccatactgtcgaacaaatatacggtcacgatcctga

SEQ ID NO: 7334 - protein, 274 aa, Sorghum bicolor
  misc_feature: Ceres ANNOT ID no. 6075461
  misc_feature (226)..(266): Pfam Id: zf-C3HC4 Pfam Desc: Zinc finger, C3HC4 type (RING finger)
  misc_feature (160)..(270): NCBI GI: 12323602 NCBI Desc: ring-h2 finger protein rhy1a; 24780-23662 [arabidopsis thaliana]
  misc_feature (160)..(270): NCBI GI: 21592374 NCBI Desc: ring-h2 finger protein rhy1a [arabidopsis thaliana]
  misc_feature (160)..(270): NCBI GI: 28416631 NCBI Desc: at1g49850 [arabidopsis thaliana]
  misc_feature (55)..(267): NCBI GI: 22597166 NCBI Desc: ring-h2 finger protein [glycine max]
  misc_feature (193)..(270): NCBI GI: 3790593 NCBI Desc: ring-h2 finger protein rhy1a [arabidopsis thaliana]
  misc_feature: The sequence is a functional homolog of SEQ ID NO. 329 in the 11/188,298 US application
  misc_feature: The sequence is a functional homolog of SEQ ID NO. 271 in the 11/188,298 US application
MTSASELFTARRGARGGRLSDPDPDPDPDPHADALRDQHGIGGRRRRRGCRPRRQLDAAGDVRQHLHTGAPPPRRRGSYTDQILSYIDNNNIGDSAARRNRLDRLMFRTNERLPGAVLQAQARVLERLRGVSLGSSASRPSISLDEFSASDVFRIIDFRNRETRHEANRPHSSSFHPSSESDEERPTVSSTNSNRSTGLSKAAFLRLQIEIFEASKDDNREASSECSICLDGFYDGDELIRLRCGHRFHSTCLEPWVRKCADCPYCRTNIRSRS

SEQ ID NO: 7335 - DNA, 4434 bp, Sorghum bicolor
  misc_feature: Ceres ANNOT ID no. 6075475
  misc_feature: Encodes the peptide sequence at SEQ ID NO 7336
atgggagttcacgggctgtgggaactgctggctccggtcgggcgacgcgtctcggtggagacccttgcggggaagcgggtggcggtggacgcgagcatctggatggtgcagttcatgcgggcgatgcgggacgacagcggcgagatggtccgggacgcccacctcctcgggttcctccgccgcatctgcaagctcctcttcctccgcgtccgccccgtattcgtcttcgatggcgccacgccggcgctcaagcgccgcaccctcgccgcccgccgcaggcaccgtgacgccgcgcaggccaaggtccgcaagacagccgagaagctcctgctctcccatctcaaagcgaggaagcttgaagaattggcagaacaaatccggagtgacagggctaagcatgatgccaagggcaaacaagttgagagcagtaaagaaggagaaactgagaaaacaagtcaaaaccaaattggtgataccaacaacagtgagggaaatgctgcatcaatcaatcaggagaaagtggatgaaatgctggccgcatcacttgctgcagaggaagaggcagatttcactgacgaaggaaaacaccattttacaagtgttccgttgccagaaggagctgaaattgatgaggatgaagatgatgatgaagggatgatcttccctatgacaactggtgacattgatcctgcagtattggcttcccttcctccatcgatgcagttagatcttcttgttcagatgagggagagagtgatggctgaaaacaggcagaaataccagaaaataaaaaaggaacctgcaaaattttcagagcttcaaatacagtcctatctcaaaacagttgctttccgtcgagagatagaccaagttcagaagtctgctgcagggaagggtggtggaggtgtccagacatcaaaaatagcatcagaagctaacagagagtttattttctcatcatcattcactggtgataaacagatgctggcacaaagacgtgaaaaggaacataatgttgagaacactaaatcaaaaaaggaaattaattcttctgtcttcacatctaacccaacaaatagtttgggaacaatgaagcctcccaacagcagtaaaccttcgagggattttgggcctgatgttgagacctatcgtgatgagagaggacgaattagagtaagcagggtcagagcaatgggaattcgtatgactcgtgacattcaaaggaatttagattttattaaagagaatgagcaggttaaaagtaagggacaaacgcagaccagtgttcacaatggatcaacaggcaatgaagaacctccagtttttccagagcatctttttgaaagtaacaagctccagagttcttgtaatcctgatgaggatctttctgaaactgacagagagaaccatcagacctcatcacaagtagaagcagcagataacatttctgagagttcttgtcatggaaacaaggaagcaatagagatatctttctcggttgatcaaactgaattgaaggatggcgatgaagatatatttttgcaactagtgtctgggtcgacatccaacatgttttctggcaataattgtttggttaaaaacacggaagaatctgaagattctgagtgtatttgggaagatggtgttattgaagcaggaacatctcctatgaaagttggcaagaacgatcataagtcatctctgccagagaattgcagcgatgatgagatggagtgggaggaaggtgatagctttgcacctggagttgcttctagtagtgaacataatccatgtaacgcaccaaagggggatttagaagaagcagctcttgtacaggaagcaataaggaggagtttagaggattttgagaagaaggcatctgagaatgtgagcactggagatatacaagaatctgttgaagatagatctttgcagttctccaataatgttcctaagatatctgaagctcttggtgaaaatgattcacattctggagtacctgttgttgaagagataaacaatgaaacaagaacagaaatcaattgtgataaggatgatatggtacagggcactggactacttggaattgatagacaagaaaatgaaacccgacctcaactggtgaaaaatgatgggcatctggggtctgtgcctctatgtactacattcacaagtaatctggctgaaaaaccatctaacagcacagaagctaacggtgaagatgtaatgatatttacaaccaaacttcctggaacagctgtaggcgattgtgataaaacttccaacctaaacattatgaattctgatcaatcaaaatgcagcaatgatattgcttcaactggagaaaccttgtcacatcaaaaggatcttttgattgatgaactgctagctgacactgctgaacaaaaagaaaatgctacccaagtagatctgaagtttgccacatctgagatagattatacacaaatttgtgacaatgatgacaaccatacaatatcagcgagttatgttgatgcagagctatctcgtcttagacaagaacagatagatcttggacatgaaaggcgaaaacttgaaagtcatgcagagtctgtaagcagtgagatgtttgccgaatgccaggaattgctccaaatgtttggcttgccatatattattgcaccaacggaagctgaagctcaatgtgcatacatggaaataaataacctcgttgatggagttgtcactgatgattcagacgtctttctgtttggagcaaggaatgtttacaagaacatatttgatgataggaagtacgtagaaacatattttatgaagctcgatcctttttcaaatagtgttgtaatgtttcaggacattgagtctgagcttgggttaacacgagaacagttaatccgtatggctctgcttcttgggagtgactacactgaaggcgttagtggtatcggcattgtgaatgctattgaagttgtacatgcatttcctgaggaagatggactgcagaagtttaaagaatggattgaatcaccggatccatcaatatttggtaaactgcatgtggaagcaagtggtagatcaaagaaaagaaaacttggtggaaatgattcagatggaaagggtaaaggcctggaacctgaatgcattcaaggttctgatgataaacaatcttctaatgaggctgaacatgtaaaggaaatatttatgagtaaacataggaatgtgagcaagaactggcatatccctgcaacttttcccagtgaatcagttgtaaatgcatatatttctccacaagttgacaattcaatggagcctttttcctggggaagaccagatttaggcctactacgcaaaaagatgatgaatactcagttgcgcatggaggcattttattcattcaacgagagatttgcaaaaattcgtagcaaaaggattaagaaagccatcaagggcattacagggaaaagctttcttgacacagatgaacctgagccagataatcccagtactagcaagacgatcaagaagaaagaggcaaactcctcaagccatgccagaggtagaggaaaaaggaaaaacaattctggaatcaggaatatggaaagtcaagaagataatgtaggagataccaacagtttggcagatacagttgagattactagagaaaataacaataccactaagagaaaaagagggagcccctgtggtcgctccaaaggaagaggacgaagcaggacaaatgctggaaatgatgcaacaataagtcaggaggattatgaaatagagtattctacttcagcttcagatgaggattcatgtaaaaggcattccaacagttatggatcagaaggaagggcattgcgaaggtcaagtaggaagcggaaacaggtgacatacatggaagatggtcatgaagcatatgacaatgatgttccaatgcatcaaaacgatgaaaataacccaggccaagctgctgcagtcgcagacatggctggagaggacacagggtttaacctttaccatcaggatacaagtgaactgaacagcagtcggatgcatataggtgcaggcactaccgaagatatcaatgaagattcccaggactttgagttacgtgaggacaatcaggtggattcggcaccgaaagactatctgttcagtggtggtggtttttgtatggaggagggcgaaggcaacgaacaagaaccagcaggtcatcaatctggtgcagaaatagaacctgagccaagtggtccatgtgacgctatggatggagtttcagagagttgcaagagtgcgagcctgtcgaccgcgggagagtgtacagagaatgcaagcatggaggcccgtggtgcatcttcgtcgcagcagagacgcaaggcaagccgaggttttagtgccatgccgacgcttaccaagcgtaggagaaaatcgtga

SEQ ID NO: 7336 - protein, 1477 aa, Sorghum bicolor
  misc_feature: Ceres ANNOT ID no. 6075475
  misc_feature (1)..(98): Pfam Id: XPG_N Pfam Desc: XPG N-terminal domain
  misc_feature (878)..(978): Pfam Id: XPG_I Pfam Desc: XPG I-region
  misc_feature (407)..(1033): NCBI GI: 19112887 NCBI Desc: dna repair protein rad13 [schizosaccharomyces pombe]
  misc_feature (407)..(1033): NCBI GI: 3130034 NCBI Desc: rad13 [schizosaccharomyces pombe]
  misc_feature (407)..(1033): NCBI GI: 5020 NCBI Desc: excision repair protein [schizosaccharomyces pombe]
  misc_feature (846)..(1006): NCBI GI: 119396045 NCBI Desc: dna excision repair protein rad2 [aspergillus clavatus nrrl 1]
  misc_feature (828)..(1006): NCBI GI: 66848275 NCBI Desc: dna excision repair protein rad2 [aspergillus fumigatus af293]
MGVHGLWELLAPVGRRVSVETLAGKRVAVDASIWMVQFMRAMRDDSGEMVRDAHLLGFLRRICKLLFLRVRPVFVFDGATPALKRRTLAARRRHRDAAQAKVRKTAEKLLLSHLKARKLEELAEQIRSDRAKHDAKGKQVESSKEGETEKTSQNQIGDTNNSEGNAASINQEKVDEMLAASLAAEEEADFTDEGKHHFTSVPLPEGAEIDEDEDDDEGMIFPMTTGDIDPAVLASLPPSMQLDLLVQMRERVMAENRQKYQKIKKEPAKFSELQIQSYLKTVAFRREIDQVQKSAAGKGGGGVQTSKIASEANREFIFSSSFTGDKQMLAQRREKEHNVENTKSKKEINSSVFTSNPTNSLGTMKPPNSSKPSRDFGPDVETYRDERGRIRVSRVRAMGIRMTRDIQRNLDFIKENEQVKSKGQTQTSVHNGSTGNEEPPVFPEHLFESNKLQSSCNPDEDLSETDRENHQTSSQVEAADNISESSCHGNKEAIEISFSVDQTELKDGDEDIFLQLVSGSTSNMFSGNNCLVKNTEESEDSECIWEDGVIEAGTSPMKVGKNDHKSSLPENCSDDEMEWEEGDSFAPGVASSSEHNPCNAPKGDLEEAALVQEAIRRSLEDFEKKASENVSTGDIQESVEDRSLQFSNNVPKISEALGENDSHSGVPVVEEINNETRTEINCDKDDMVQGTGLLGIDRQENETRPQLVKNDGHLGSVPLCTTFTSNLAEKPSNSTEANGEDVMIFTTKLPGTAVGDCDKTSNLNIMNSDQSKCSNDIASTGETLSHQKDLLIDELLADTAEQKENATQVDLKFATSEIDYTQICDNDDNHTISASYVDAELSRLRQEQIDLGHERRKLESHAESVSSEMFAECQELLQMFGLPYIIAPTEAEAQCAYMEINNLVDGVVTDDSDVFLFGARNVYKNIFDDRKYVETYFMKLDPFSNSVVMFQDIESELGLTREQLIRMALLLGSDYTEGVSGIGIVNAIEVVHAFPEEDGLQKFKEWIESPDPSIFGKLHVEASGRSKKRKLGGNDSDGKGKGLEPECIQGSDDKQSSNEAEHVKEIFMSKHRNVSKNWHIPATFPSESVVNAYISPQVDNSMEPFSWGRPDLGLLRKKMMNTQLRMEAFYSFNERFAKIRSKRIKKAIKGITGKSFLDTDEPEPDNPSTSKTIKKKEANSSSHARGRGKRKNNSGIRNMESQEDNVGDTNSLADTVEITRENNNTTKRKRGSPCGRSKGRGRSRTNAGNDATISQEDYEIEYSTSASDEDSCKRHSNSYGSEGRALRRSSRKRKQVTYMEDGHEAYDNDVPMHQNDENNPGQAAAVADMAGEDTGFNLYHQDTSELNSSRMHIGAGTTEDINEDSQDFELREDNQVDSAPKDYLFSGGGFCMEEGEGNEQEPAGHQSGAEIEPEPSGPCDAMDGVSESCKSASLSTAGECTENASMEARGASSSQQRRKASRGFSAMPTLTKRRRKS

SEQ ID NO: 7337 - DNA, 1311 bp, Sorghum bicolor
  misc_feature: Ceres ANNOT ID no. 6075490
  misc_feature: Encodes the peptide sequence at SEQ ID NO 7338
atgaagagggccaagcccccctggaccctggcactaggcctccaaaggagttctacacatgccagaagctacagcagtcaactttctgctacttcccaatgctcaaatctgacaagaaaaagctgttacttacctaatccctatctataccaagtctggagtaggtcatttgcttcagacaacggagacaagtttgaggctgttgtgcccttcatgggtgaatctgtaactgatggaactcttgctaacttcctgaagaaacctggagacagagtcgaggccgatgaacccatagcacagattgaaactgataaggtcactatagatgttgcaagtcctgaggctggtgttattgaaaagctcattgctagtgaaggcgacacagttactcccggcactaaagttgcaatcatatccaagtctgctcaacctgctgaaacacatgttgctccatctgaggaagcaactccaaaagaatcatcaacgcctaaagttgaagagaaaccaaaggtagaggaaaaagccccaaaagttgaacctcccaagatgcaagcaccaaagccaactgcaccatcaaaaatgtccccttcagaaccacagctccctccaaaagaacgagagcgaagggtgccgatgccaaggctcagaaagcgtattgcaaaccggcttaaggattctcagaacacctttgcaatgctgactacatttaatgaagttgacatgaccaatttgatgaaacttcgttctgattataaagatgaatttgtcacaaagcatggtgtcaaattgggcctaatgtcttgctttgtcaaggctgctgtttcggcacttcaaaaccaaccgattgtcaatgctgtcattgatggtgacgatatcatatacagagactatgtggacgtcagtgttgctgttggcacatccaagggccttgtggttcctgttatccgggatgctgataccatgaactttgctgacattgagaaagggataaacaaccttgcaaagaaggcaactgagggggcactctcaattgatgacatggcaggaggaacatttaccatctccaatggtggtgtctatggaagcctcatcagcacacctatcatcaaccccccacagtcggcaattctggggatgcattccattgtgcaacgccctgtggttgtgaatggtgacatcctcgcgaggccaatgatgtacctcgcgctgacatacgaccacaggctgattgacggcagagaggctgtcttcttcctgcggcgcatcaaggatgtggtcgaggaccccaggaggttgctgcttgacatataa

SEQ ID NO: 7338 - protein, 436 aa, Sorghum bicolor
  misc_feature: Ceres ANNOT ID no. 6075490
  misc_feature (204)..(434): Pfam Id: 2-oxoacid_dh Pfam Desc: 2-oxoacid dehydrogenases acyltransferase (catalytic domain)
  misc_feature (65)..(138): Pfam Id: Biotin_lipoyl Pfam Desc: Biotin-requiring enzyme
  misc_feature (12)..(436): NCBI GI: 116309381 NCBI Desc: h0718e12.4 [oryza sativa (indica cultivar-group)]
  misc_feature (51)..(436): NCBI GI: 22136096 NCBI Desc: 2-oxoglutarate dehydrogenase e2 subunit [arabidopsis thaliana]
  misc_feature (51)..(436): NCBI GI: 4210332 NCBI Desc: 2-oxoglutarate dehydrogenase e2 subunit [arabidopsis thaliana]
  misc_feature (14)..(436): NCBI GI: 18416889 NCBI Desc: 2-oxoacid dehydrogenase family protein [arabidopsis thaliana]
  misc_feature (72)..(436): NCBI GI: 30687411 NCBI Desc: 2-oxoacid dehydrogenase family protein [arabidopsis thaliana]
  misc_feature (63)..(436): SWISSPROT Homolog: EC 2.3.1.61 Dihydrolipoyllysine-residue succinyltransferase component of 2-oxoglutaratedehydrogenase complex, mitochondrial precursor
MKRAKPPWTLALGLQRSSTHARSYSSQLSATSQCSNLTRKSCYLPNPYLYQVWSRSFASDNGDKFEAVVPFMGESVTDGTLANFLKKPGDRVEADEPIAQIETDKVTIDVASPEAGVIEKLIASEGDTVTPGTKVAIISKSAQPAETHVAPSEEATPKESSTPKVEEKPKVEEKAPKVEPPKMQAPKPTAPSKMSPSEPQLPPKERERRVPMPRLRKRIANRLKDSQNTFAMLTTFNEVDMTNLMKLRSDYKDEFVTKHGVKLGLMSCFVKAAVSALQNQPIVNAVIDGDDIIYRDYVDVSVAVGTSKGLVVPVIRDADTMNFADIEKGINNLAKKATEGALSIDDMAGGTFTISNGGVYGSLISTPIINPPQSAILGMHSIVQRPVVVNGDILARPMMYLALTYDHRLIDGREAVFFLRRIKDVVEDPRRLLLDI

SEQ ID NO: 7339 - DNA, 828 bp, Sorghum bicolor
  misc_feature: Ceres ANNOT ID no. 6075493
  misc_feature: Encodes the peptide sequence at SEQ ID NO 7340
atgaagggacccggcctcttctccgacatcggcaagaaggccaaggatctactcactaaggactacacgtacgaccagaagttgaccatctccaccgccagcgcctctggagtgggccttacttccacagctgtaaagaaaggaggtctttattctctggatgtcagttcagtttacaagtacaagaataccactgttgatgttaaagtggacacagaatcaaatatctctactacattgactgtgttggacgccttgccatccacaaagcttgtcacttctgtgaagctgcccgactacaattctggaaaggtggagctgcaatacttccatgagaatgcaacctttgctactgttgttggcacaaagccgactcctgtgattgatctttctgggacagtaggcgctcaaggagttgcatttggtgcagaagctgggtatgacactgctacaggaaaatttaccaagtacactgctgcaattggtgtaaccaagccagactaccatgctgcattcattctggcggacaaaggtgacaccattaaagtgtcaggtgtttatcactttgatgagaaacagaaggcctcagctgtggctgagctaacccggaggctctcaacaaatcagaatacactcacagtcggtggactgtacacagttgatcctcagacatccgtgaaggcaaggctcaacaacactggaacgcttgccgcgcttcttcagcatgagcttaaacccaagtcagtcttgacaatctctggtgaattcgacaccaaggccctggacagaccccccaagtttggcttggcgcttgcactgaagccctga

SEQ ID NO: 7340 - protein, 275 aa, Sorghum bicolor
  misc_feature: Ceres ANNOT ID no. 6075493
  misc_feature (3)..(268): Pfam Id: Porin_3 Pfam Desc: Eukaryotic porin
  misc_feature (1)..(275): NCBI GI: 31249532 NCBI Desc: pgpor29 [pennisetum glaucum]
  misc_feature (2)..(275): NCBI GI: 60279272 NCBI Desc: pom30 [solanum tuberosum]
  misc_feature (2)..(275): NCBI GI: 36957216 NCBI Desc: vdac2.1 [lotus corniculatus var. japonicus]
  misc_feature (1)..(275): NCBI GI: 77999247 NCBI Desc: pom30-like protein [solanum tuberosum]
  misc_feature (2)..(275): NCBI GI: 92866964 NCBI Desc: porin, eukaryotic type [medicago truncatula]
MKGPGLFSDIGKKAKDLLTKDYTYDQKLTISTASASGVGLTSTAVKKGGLYSLDVSSVYKYKNTTVDVKVDTESNISTTLTVLDALPSTKLVTSVKLPDYNSGKVELQYFHENATFATVVGTKPTPVIDLSGTVGAQGVAFGAEAGYDTATGKFTKYTAAIGVTKPDYHAAFILADKGDTIKVSGVYHFDEKQKASAVAELTRRLSTNQNTLTVGGLYTVDPQTSVKARLNNTGTLAALLQHELKPKSVLTISGEFDTKALDRPPKFGLALALKP

SEQ ID NO: 7341 - DNA, 1731 bp, Sorghum bicolor
  misc_feature: Ceres ANNOT ID no. 6075495
  misc_feature: Encodes the peptide sequence at SEQ ID NO 7342
atggggagagcccaagccttcttgttcctgtcgctgctgtgggtcgccatgctgagtgctgctcctcgcgtggtgcaatctcttccttacgactactcgtccagctctgagtgcttgccggagccgctggagcctcagtacggcggcggcatcctccggaacgccaacttcagcgctggcctccagggctggtcgtcgttcgggtacggcgccgtcgaggaaggcttgtcagagagcggcaacagctacggcgtggcgcggaaccggacccggccgtaccagagcgtcagccagaaggtgttcctgcagaacgacacgcactacactctgtcagcttggttgcaggtcagcaatggtagcgccgatatcagagccgtggtgaagaccaacggcgaattcatccacgccggcggcgtcgaagcgcggtccggctgctggtccattctcaaaggcggcctcaccgcccccgcctccggcgcggcagaactctacttcgagagcaacacgacgacggtggacatctgggtggacaacgtctcgctgcagcccttctcccgcgaggagtgggcggcgcaccaccacgcggccatcaagtcggcgcgcaagaagacggtgcggctccgcgccagggactcgtcggggaagcccgtgccgggcgcgcaggtgcgcatcgagcacgtccggagcggcttcccgctggggtctgccatgagcgcggagatcctgcagagcccggcgtaccagcggtggttcacgtcgcggttcacggtgaccacgttcgagaacgagatgaagtggtacagcacggagcgggtgcaggggcgggaggactactcggtccccgacgcgatgctgcggttcgccaagagccacggcgtcgcggtgcgcggccacaacgtgttctgggaccagccgagccagcagccgtcctgggtgcggtcgctgtcgtaccagcagctccagcaggcgacggcgcggcggatcaagtcggtgatgtcgcggtacgccgggcaggtgatcgcgtgggacgtggtgaacgagaacctccacttcaactacttcgagggcaagttcgggtgggacgcgtcggcggagttctaccgcaaggcgcaccagctggacgcgcaggcgctcatgtccatgaacgagtacaacacgctggagtggcccggcgacccgatggcagggccgagcaagtacctgggcaagctgttccagatcaagaagttcccgggcaacgccaacgacgccaggatggccatcggtctggagggccacttctccgtgcccagcatcccctacatccgcgcggcgctggacaccatgtccaaggccaacgcgcccatctggctgaccgagatcgacgtcgcgccggggcccaaccaggcgcactacctggagcagatactcagggaggtgtacgcgcacccggccgtgcacggcatcatcctctggacggcgcgccacccgcagggatgctacgtcatgtgcctcaccgacagcaacttcaggaacctacccacgggcgacgtcgtcgacaagctcatcgcggagtggaagacgcactcgcacgccggcgtggcggacgccgacggatactacgaggccgagctgttccacggggactacaaggtcaccgtcagccacccggtggccaactccaccgtggtgcagagcctgagcgtcgacagggagaccgacaccgatagcgagtacaccatacacgtctag

SEQ ID NO: 7342 - protein, 576 aa, Sorghum bicolor
  misc_feature: Ceres ANNOT ID no. 6075495
  misc_feature (222)..(516): Pfam Id: Glyco_hydro_10 Pfam Desc: Glycosyl hydrolase family 10
  misc_feature (49)..(184): Pfam Id: CBM_4_9 Pfam Desc: Carbohydrate binding domain
  misc_feature (12)..(568): NCBI GI: 42567365 NCBI Desc: glycosyl hydrolase family 10 protein [arabidopsis thaliana]
  misc_feature (7)..(573): NCBI GI: 23429644 NCBI Desc: endoxylanase [carica papaya]
  misc_feature (148)..(357): NCBI GI: 22329142 NCBI Desc: glycosyl hydrolase family 10 protein [arabidopsis thaliana]
  misc_feature (94)..(565): NCBI GI: 7270330 NCBI Desc: beta-xylan endohydrolase-like protein [arabidopsis thaliana]
  misc_feature (88)..(566): NCBI GI: 79555537 NCBI Desc: hydrolase, hydrolyzing o-glycosyl compounds [arabidopsis thaliana]
MGRAQAFLFLSLLWVAMLSAAPRVVQSLPYDYSSSSECLPEPLEPQYGGGILRNANFSAGLQGWSSFGYGAVEEGLSESGNSYGVARNRTRPYQSVSQKVFLQNDTHYTLSAWLQVSNGSADIRAVVKTNGEFIHAGGVEARSGCWSILKGGLTAPASGAAELYFESNTTTVDIWVDNVSLQPFSREEWAAHHHAAIKSARKKTVRLRARDSSGKPVPGAQVRIEHVRSGFPLGSAMSAEILQSPAYQRWFTSRFTVTTFENEMKWYSTERVQGREDYSVPDAMLRFAKSHGVAVRGHNVFWDQPSQQPSWVRSLSYQQLQQATARRIKSVMSRYAGQVIAWDVVNENLHFNYFEGKFGWDASAEFYRKAHQLDAQALMSMNEYNTLEWPGDPMAGPSKYLGKLFQIKKFPGNANDARMAIGLEGHFSVPSIPYIRAALDTMSKANAPIWLTEIDVAPGPNQAHYLEQILREVYAHPAVHGIILWTARHPQGCYVMCLTDSNFRNLPTGDVVDKLIAEWKTHSHAGVADADGYYEAELFHGDYKVTVSHPVANSTVVQSLSVDRETDTDSEYTIHV

SEQ ID NO: 7343 - DNA, 828 bp, Sorghum bicolor
  misc_feature: Ceres ANNOT ID no. 6075498
  misc_feature: Encodes the peptide sequence at SEQ ID NO 7344
atgaaggcgtgcgcgaaggcggcgggggagagactaccgctggtccgtgctccgtcaaccagtcagcctctggctcggagctttgttaaggtaagcagattaccctctcaacatgagacgaagtgtcaagtatcctgctcagttagggtgtcagaaaacacagctcgcagaatatatgccacagcagaaaacattttcccggcaatgaaagatcatgtcttgaaagcaactgatgcaatcaacagaggagaagtgattgcggtgcccactgataccatatacgggtttgcgtgtgatgcctgctctgcgggagcagttaatcgtatttatgagatcaaagggcgtatacaaacacggcctctggcaatttgtgttgctgatgtctcagacatatcacggtttgctttagtggaccacttgccacatggcttgcttgatagtctacttcctgggcctgtcactgttgttctaaaacgaggtgaaaacagcatattagagagatcacttaatcctggcttggatagcattggagttcgtgtgccggatctggatttcatacgatccattgctcgtggcgctggaagtgcacttgcacttaccagcgccaacttaagcggacagcctagtagtgtcagtgtcaaagattttgagggtttatggccacattgttcatgtgtctttgatggtggagtacttccttctgggcgtgctggttcaacaattgttgatctaataacaccaggagtctacaagatattgagagatggaagctcaaggaaggaaacagcagctgtgcttggcaagtttggctttgttgaagcttcgtga

SEQ ID NO: 7344 - protein, 275 aa, Sorghum bicolor
  misc_feature: Ceres ANNOT ID no. 6075498
  misc_feature (77)..(256): Pfam Id: Sua5_yciO_yrdC Pfam Desc: yrdC domain
  misc_feature (102)..(274): NCBI GI: 115451395 NCBI Desc: os03g0201600 [oryza sativa (japonica cultivar-group)]
  misc_feature (10)..(269): NCBI GI: 42573748 NCBI Desc: yrdc protein-related [arabidopsis thaliana]
  misc_feature (10)..(270): NCBI GI: 87248253 NCBI Desc: ischemia/reperfusion inducible protein [bombyx mori]
  misc_feature (74)..(272): NCBI GI: 30908964 NCBI Desc: ischemia/reperfusion inducible protein [mus musculus]
  misc_feature (74)..(272): NCBI GI: 23956354 NCBI Desc: cdna sequence bc023823 [mus musculus]
MKACAKAAGERLPLVRAPSTSQPLARSFVKVSRLPSQHETKCQVSCSVRVSENTARRIYATAENIFPAMKDHVLKATDAINRGEVIAVPTDTIYGFACDACSAGAVNRIYEIKGRIQTRPLAICVADVSDISRFALVDHLPHGLLDSLLPGPVTVVLKRGENSILERSLNPGLDSIGVRVPDLDFIRSIARGAGSALALTSANLSGQPSSVSVKDFEGLWPHCSCVFDGGVLPSGRAGSTIVDLITPGVYKILRDGSSRKETAAVLGKFGFVEAS

SEQ ID NO: 7345 - DNA, 1758 bp, Sorghum bicolor
  misc_feature: Ceres ANNOT ID no. 6075499
  misc_feature: Encodes the peptide sequence at SEQ ID NO 7346
atgaccaaagttaacggtctggtggataaactcgccttctggctcggatggattgctctcctgcaaggctgcatggtgaaatctctcccatacgattactctgcaagcatcgaggcaagtcccctgctccgctcctgttgcctgccggagccgctggagccgcagtacggcggcggcatcctccgcaacgccgacttcagcgcgggcctccggggctggtccacctttggctacggcagcatcgcggagagcaagtcggcggcgggcaacgggttcgccgtcgcgctcaaccggacgcgggcgtaccagagcgtcagccagaaggtgtacctgcagggcgacacgcactacaccctctccgcgtggttgcaggtcagcgacgcaagcgccgacgtgcgggccgtcgtcaagaccgtcggtgacttcgtccacgccggcggcgtcgtcgccaaggccggttgctggtccatgctcaagggcggcctcaccgccgcgtcttcgggtccggccgagctctacttcgagagcaacgctacggtggacctgtgggtggacagcgtgtcgctgaagcccttctccaaggacgagtggacggcgcaccgtgcccagtccgtggtggcggcgcgcaagaagacggtgaggcttcaggcgacggactccgcggggaatccgctggaaggcgcggcggtgtccctggacgcggtccggaccaacttcccgctgggcgcggccgtgagccggtacattctcaccaactcggcgtaccagacgtggttcgcgtcccgcttcgcggtggccaccttcgagaacgagatgaagtggtacagcacggagccggcgccggggcgcgaggactacacggtcccggacgccatgatggcgttcgccaagtccaacggcatcgccgtgcgcggccacaacgtgttctgggaccagccgagccagcagcccgggtgggtgcagtcgcttccctacccgcagctgctggcggcggcgtcgcggcggatccgctccgtcatgtcgcgctacgccggccaggtcatcggctgggacgtggtcaacgagaacctgcacttcaacttctacgagggacgcttcggctgggacgcgtccaccgccttctacgccgccgcgcgcctgctggacaccggctccgcgctcatgttcttgaacgagtacaacacgctggagcagccgggagacatggccgcgctgccggccaggtacctgcagcgcctgcagcagatcatcgccgcctacccggagaacggcgccggcatggccatcggcctcgagggccacttcaccaagcccaacatcccctacatgcgcgccgcgctcgacacactggcgcaggccggcatccccgtctggctcaccgaggtcgacgtcgccccaggcccgtcgcaggcgcagcacctggaggaggtgctgcgggaggcgtacgcgcacccggcggtgcaggggatcgtcatctggtcggcgtggcagccgcaggggtgctacgtcatgtgcctcaccgacaacaacttcaagaacctgccgcagggggacgtcgtggaccgcctcatcgccgagtggcgggcgagcccgcgggccggcgccacggacgcgcagggctacttcgaggccgacctcgtccacggcgagtacaaggtcaccgtcagccaccccgcgctcaacagctccatctcccggagcgtcaaggtggagctgggctcaggcagtgagcactacttcattgacatgcaggtctag

SEQ ID NO: 7346 - protein, 585 aa, Sorghum bicolor
  misc_feature: Ceres ANNOT ID no. 6075499
  misc_feature (231)..(523): Pfam Id: Glyco_hydro_10 Pfam Desc: Glycosyl hydrolase family 10
  misc_feature (58)..(192): Pfam Id: CBM_4_9 Pfam Desc: Carbohydrate binding domain
  misc_feature (15)..(565): NCBI GI: 23429644 NCBI Desc: endoxylanase [carica papaya]
  misc_feature (21)..(570): NCBI GI: 42567365 NCBI Desc: glycosyl hydrolase family 10 protein [arabidopsis thaliana]
  misc_feature (157)..(365): NCBI GI: 22329142 NCBI Desc: glycosyl hydrolase family 10 protein [arabidopsis thaliana]
  misc_feature (122)..(578): NCBI GI: 115463091 NCBI Desc: os05g0304900 [oryza sativa (japonica cultivar-group)]
  misc_feature (103)..(573): NCBI GI: 7270330 NCBI Desc: beta-xylan endohydrolase-like protein [arabidopsis thaliana]
MTKVNGLVDKLAFWLGWIALLQGCMVKSLPYDYSASIEASPLLRSCCLPEPLEPQYGGGILRNADFSAGLRGWSTFGYGSIAESKSAAGNGFAVALNRTRAYQSVSQKVYLQGDTHYTLSAWLQVSDASADVRAVVKTVGDFVHAGGVVAKAGCWSMLKGGLTAASSGPAELYFESNATVDLWVDSVSLKPFSKDEWTAHRAQSVVAARKKTVRLQATDSAGNPLEGAAVSLDAVRTNFPLGAAVSRYILTNSAYQTWFASRFAVATFENEMKWYSTEPAPGREDYTVPDAMMAFAKSNGIAVRGHNVFWDQPSQQPGWVQSLPYPQLLAAASRRIRSVMSRYAGQVIGWDVVNENLHFNFYEGRFGWDASTAFYAAARLLDTGSALMFLNEYNTLEQPGDMAALPARYLQRLQQIIAAYPENGAGMAIGLEGHFTKPNIPYMRAALDTLAQAGIPVWLTEVDVAPGPSQAQHLEEVLREAYAHPAVQGIVIWSAWQPQGCYVMCLTDNNFKNLPQGDVVDRLIAEWRASPRAGATDAQGYFEADLVHGEYKVTVSHPALNSSISRSVKVELGSGSEHYFIDMQV

SEQ ID NO: 7347 - DNA, 534 bp, Sorghum bicolor
  misc_feature: Ceres ANNOT ID no. 6075505
  misc_feature: Encodes the peptide sequence at SEQ ID NO 7348
atggggttctgggaggcttttctcaactggctccgcagcctcttcttcaagcaagagatggagctttccttgatagggctccaaaatgctgggaaaacatcacttgtgaacgtcattgctactggaggctttagtgaggatatgatccctactgtaggattcaatatgagaaaggttaccaaaggaaatgtgacgataaaattgtgggatcttggaggccaaccaagattccggagcatgtgggagagatactgccgtgcggtttctgcaattgtgtatgttgttgacgcggcagatcgagaaaacatggccattgcaaaaggggagctccatgacctcttgagcaagccatctttgactgggatcccattattagtcattggcaataaaattgacaagcctgaagctttccctaagggcctaaagacaatcactgaccgagaagtggcatgcttcatgatatcatgcaagaactcgaccaacattgattctgtcattgactggctggtgaagcactcgaaaaagaagaattga

SEQ ID NO: 7348 - protein, 177 aa, Sorghum bicolor
  misc_feature: Ceres ANNOT ID no. 6075505
  misc_feature (7)..(173): Pfam Id: Arf Pfam Desc: ADP-ribosylation factor family
  misc_feature (24)..(175): Pfam Id: Ras Pfam Desc: Ras family
  misc_feature (21)..(132): Pfam Id: Miro Pfam Desc: Miro-like protein
  misc_feature (20)..(132): Pfam Id: MMR_HSR1 Pfam Desc: GTPase of unknown function
  misc_feature (20)..(177): NCBI GI: 9757877 NCBI Desc: adp-ribosylation factor-like protein [arabidopsis thaliana]
  misc_feature (20)..(174): NCBI GI: 9757978 NCBI Desc: adp-ribosylation factor-like protein [arabidopsis thaliana]
  misc_feature (18)..(177): NCBI GI: 145339305 NCBI Desc: atarla1b (adp-ribosylation factor-like a1b); gtp binding [arabidopsis thaliana]
  misc_feature (8)..(176): NCBI GI: 119584324 NCBI Desc: adp-ribosylation factor-like 8b, isoform cra_b [homo sapiens]
  misc_feature (1)..(176): NCBI GI: 119611801 NCBI Desc: adp-ribosylation factor-like 8a, isoform cra_a [homo sapiens]
  misc_feature: Useful for making plants with altered terpenoid content
  misc_feature: Functional homolog of the protein sequence given in SEQ ID NO 13991
  misc_feature: The sequence is a functional homolog of SEQ ID NO. 400 in the 11/188,298 US application
MGFWEAFLNWLRSLFFKQEMELSLIGLQNAGKTSLVNVIATGGFSEDMIPTVGFNMRKVTKGNVTIKLWDLGGQPRFRSMWERYCRAVSAIVYVVDAADRENMAIAKGELHDLLSKPSLTGIPLLVIGNKIDKPEAFPKGLKTITDREVACFMISCKNSTNIDSVIDWLVKHSKKKN

SEQ ID NO: 7349 - DNA, 1035 bp, Sorghum bicolor
  misc_feature: Ceres ANNOT ID no. 6075506
  misc_feature: Encodes the peptide sequence at SEQ ID NO 7350
atggcggcatcgctctccaagcacctccgcctccgcctgcgcggcggcggcgagcactgcctcctcccctcccgcgcctccacttcccacacctcatcaccagcacctccccctccatcgcgtcctcccgctgcggccgcgccgccgcccccaggggcagccaaggaggccagcgcgtggtccaaacttttcctcttcgctcccggcgctatcaccttcggcctcggcacatggcagctcttccggaggcaggagaagatagagatgctggattacaggacacggaggctggagatggaacccgtggtgtggaacgaggccgcctcatccgctgcccttcgtgatccggcagcactggagttccgaaaaattgtgtgtgaaggtgacttcgatgaggagaagtcagtgtttgtcggacctcgctctcggagcatctcgggtgtgacggagaatgggtattatgtcatcactccattgattcctaggtcgactgagtctggcagcttgcagtcacctatccttgtgaatagaggatgggttcctcgtggatggcgtgataaaaatgttaaggatcttcagatcctcgatgaagcttcagagtccccagaagctgttgaaaagccagacgaaaaaggttcatggtggaagttttggtctaacaagcctaaattgtctcctgagattgaaaaacctaggataccacctataagagtaattggagtaatccgaggaagtgagaagccaagcatatttgttccagctaatgagcccagtagtggccagtggttctatgtggatgttcccatgattgctcgtgcttgtggacttcctgagaatactgtttatatagaggatataaatgaagatatatctccaacaaacccttatcctgttccaaaagatgtcaacaccttgattcgtcactcagtgatgccagatgaccatcttaaatacacgtttacatggtacactctttctgctgctgtgacttatatggcttccaagcggataaaagcaaagaaggtcaggatgtag

SEQ ID NO: 7350 - protein, 344 aa, Sorghum bicolor
  misc_feature: Ceres ANNOT ID no. 6075506
  misc_feature (1)..(342): Pfam Id: SURF1 Pfam Desc: SURF1 family
  misc_feature (22)..(343): NCBI GI: 6630873 NCBI Desc: surfeit 1 [arabidopsis thaliana]
  misc_feature (99)..(343): NCBI GI: 9294495 NCBI Desc: surfeit 1 homolog [arabidopsis thaliana]
  misc_feature (27)..(334): NCBI GI: 30694342 NCBI Desc: cytochrome c oxidase assembly protein surfeit-related [arabidopsis thaliana]
  misc_feature (168)..(319): NCBI GI: 8778690 NCBI Desc: t1n15.12 [arabidopsis thaliana]
  misc_feature (1)..(182): NCBI GI: 4507319 NCBI Desc: surfeit 1 [homo sapiens]
MAASLSKHLRLRLRGGGEHCLLPSRASTSHTSSPAPPPPSRPPAAAAPPPPGAAKEASAWSKLFLFAPGAITFGLGTWQLFRRQEKIEMLDYRTRRLEMEPVVWNEAASSAALRDPAALEFRKIVCEGDFDEEKSVFVGPRSRSISGVTENGYYVITPLIPRSTESGSLQSPILVNRGWVPRGWRDKNVKDLQILDEASESPEAVEKPDEKGSWWKFWSNKPKLSPEIEKPRIPPIRVIGVIRGSEKPSIFVPANEPSSGQWFYVDVPMIARACGLPENTVYIEDINEDISPTNPYPVPKDVNTLIRHSVMPDDHLKYTFTWYTLSAAVTYMASKRIKAKKVRM

SEQ ID NO: 7351 - DNA, 2130 bp, Sorghum bicolor
  misc_feature: Ceres ANNOT ID no. 6075507
  misc_feature: Encodes the peptide sequence at SEQ ID NO 7352
atgtccgcgatcatgctatgtacctgcagccgggaccagtccaagtttgaagatcttcctcgatcaccagaatctcttgcaacacgtgacttttcagcgaattgttcttcttcaaagatggcaagtcgagaaacaactcctgatgatagccaagaggcccgagcattgctaggtagactggaacatcagagagggaactttgatgcagcattgcaagttcttcaggggattgatataagaagcctgagaccgcgaatgaccagtgctattgctgaaagtatcaagcctagaacgcccccacgctcttcaagaaggaaatcttcacaagtgaatggaatgctcatgcatatgtcaatgcattctgtaagcttgcttctagaggccatactgcttaaagcaaaatctctggacacccttggtagagtagcagatgctgcagaagaatgcagaaccatcatagacattatcgagtctgcatggccatacggtgttccggatggtactgctgaagagtgtaagctaatagacatattccattcggctctagaatatcttcctaagctgtggatgaggagtggttgttttgatgaagccatcatcgcatatcgcagagctcttgcaaagccgtggaatctagattctcaaaggtccgccaaaatgcaaaaagatttggcagtgactctgctgtattgtggcgttgaagtgaagttccctcaagaatttgctcaggaaaggaatctggtaacccctgggaacaacttagaggaagcaattttgttgttactcatgctaacaagaaagctatctctccgagaaatacaatgggatcctgaccttgtgaatcatttgatgtatgcactctcattatctgggcactatgaagttttggccagccatcttgaaatgctgttgcctggaacctataccagatcagagaggtggtatatccttgcactttgctacggtgcagctggcatggatgatagtgcgttaaacatcataaggaatggtttttctgtgctggagagaaagggaaagcctcatgttccatctcttcttttaggagcaaaactatgttgtaagaacccaaagcatgcttctgaagggataaagtttgcaaataaagctatgaagtctttcggaagacgtgatctgcatttcatcagcactgcaaaacactttctcggtgtttgttatggacctttttctaggtcctccgcctcacacttggagaaatcgagattggaagataatgcactgaggctgctgcaggatgctgctacaacagcaaagtataatcctgaaataatgtatagccttgcttgggaaaatgcaatgcagcgcaaactcaatgcagctgttgaaagtgcaacagaatgtcttgagatggtgatgggaggttctgttagtgcctggaagttactaattcttgtactatctgcacaacagaatttgcaagaagctgaagcagtagcagattttgcaatggatgaagctgagaaaaatgatcagttggatattttgaggctgaaagcacaaattcaggcttcccgtggacagttcaagtctgcagtggaatcttttcgggttttgcttgccagtatccaagtaaagaaggacatctggaaatcgaccacttgtaatgaggttaaatgcctacagaagttggagatggactcatggttagatttggcatcaatctactcaaagcttgaggcatggcatgactcaaacatctgccttgacaaagctatatccattaatttcttttatcccaagtgttggcatgtcagaggtcttctgttggaggctcaattcttgcacaaggaagccctgatggcgttctctttcgccctctcaattgacccagattacgtccccagcatggtttgcatggcaggaattctccgagatattggagggaattcgctatcaattgcaagaacttacttgcgcaatgccctccgtttagagcctacaaaccaccgagcttggttgagtcttgggcttgtcctgaaagctgaaggatcgctgcaggaggctgcggactgcttccaggcagcatatgagctcagagaattgtcaccaattcaggacttctctgagcaactcccgatcatgctgcattag

SEQ ID NO: 7352 - protein, 709 aa, Sorghum bicolor
  misc_feature: Ceres ANNOT ID no. 6075507
  misc_feature (592)..(625): Pfam Id: TPR_1 Pfam Desc: Tetratricopeptide repeat
  misc_feature (5)..(700): NCBI GI: 33589668 NCBI Desc: at1g27460/f17l21_26 [arabidopsis thaliana]
  misc_feature (24)..(700): NCBI GI: 77556181 NCBI Desc: calmodulin-binding protein mpcbp [oryza sativa (japonica cultivar-group)]
  misc_feature (5)..(700): NCBI GI: 78708807 NCBI Desc: new cdna-based gene [oryza sativa (japonica cultivar-group)]
  misc_feature (34)..(701): NCBI GI: 27450574 NCBI Desc: pollen-specific calmodulin-binding protein [arabidopsis thaliana]
  misc_feature (11)..(700): NCBI GI: 56381953 NCBI Desc: at4g28600 [arabidopsis thaliana]
MSAIMLCTCSRDQSKFEDLPRSPESLATRDFSANCSSSKMASRETTPDDSQEARALLGRLEHQRGNFDAALQVLQGIDIRSLRPRMTSAIAESIKPRTPPRSSRRKSSQVNGMLMHMSMHSVSLLLEAILLKAKSLDTLGRVADAAEECRTIIDIIESAWPYGVPDGTAEECKLIDIFHSALEYLPKLWMRSGCFDEAIIAYRRALAKPWNLDSQRSAKMQKDLAVTLLYCGVEVKFPQEFAQERNLVTPGNNLEEAILLLLMLTRKLSLREIQWDPDLVNHLMYALSLSGHYEVLASHLEMLLPGTYTRSERWYILALCYGAAGMDDSALNIIRNGFSVLERKGKPHVPSLLLGAKLCCKNPKHASEGIKFANKAMKSFGRRDLHFISTAKHFLGVCYGPFSRSSASHLEKSRLEDNALRLLQDAATTAKYNPEIMYSLAWENAMQRKLNAAVESATECLEMVMGGSVSAWKLLILVLSAQQNLQEAEAVADFAMDEAEKNDQLDILRLKAQIQASRGQFKSAVESFRVLLASIQVKKDIWKSTTCNEVKCLQKLEMDSWLDLASIYSKLEAWHDSNICLDKAISINFFYPKCWHVRGLLLEAQFLHKEALMAFSFALSIDPDYVPSMVCMAGILRDIGGNSLSIARTYLRNALRLEPTNHRAWLSLGLVLKAEGSLQEAADCFQAAYELRELSPIQDFSEQLPIMLH

SEQ ID NO: 7353 - DNA, 1377 bp, Sorghum bicolor
  misc_feature: Ceres ANNOT ID no. 6075527
  misc_feature: Encodes the peptide sequence at SEQ ID NO 7354
atgctcgacatcaacttgttccgcgccgacaagggcggcaacccggacctcatccgcgagtcccagcgcagccggttcgcctccgttgagctcgtcgatgaggtcatcgccctcgacatggcatggcgcggaaagcagttcgacctggacaagatccggcaggagctcaacgctaccagcaagaagatcggcaagctcaaagccagcaagcaagaagaggaagcgaagaagctcatggagagcacagacgaaattaagaagaggttggctgccaaagaagttgaggtgcaggaggccaagagcacccttgacgccaaggtcacgacgattggcaacatcgtgcacgattccgtgccagtcagcgacgatgaggcaaacaataaaattgtacggacatttggagagaagagagtagaggaaaatttgaagaatcatgtagacctttgcaggatgcttgacattgtcgcattggagaagggtgctgatgtggccggtggtaggggtttctatttaaagggtgatggtgtcttccttaaccaggcattgataaacttcgggctagcttttctgagaaaacggggatttgagccaatgcagactccctttttcatgagaaaggagactatggcaaaatgtgctcagttggcgcagtttgatgaggagctttacaaggttacaggtgatggtgaggacaaatatctcatagctacatcagagcagccattatgtgcttatcacctaggtgatcgaatctaccctgctgaacttccaattaaatatgctgggtactctacatgcttccggaaggaagctggttctcatggaagggacacagctggcatcttcagagttcaccaatttgaaaaaattgaacaattctgcattacaagcccaaatggcaatgattcctgggagatgcatgaagagatgttaaaaaattcagaagacttctataaagagattggactaccataccaagttgtttccattgtctctggtgctcttaatgatgctgctgctaagaaatatgatttggaagcttggttccccgcatcaaagaccttccgagagttggtgtcctgttcaaactgcactgactttcagtcaaggagacttggaattgggtatggccagaaaaagaatgatgagcagtccaagcagtttgttcatatgctgaactccaccttgactgccactgagaggacactctgctgtattctggagaatttccaaaaggaggatggtgtcgaggtgccgaaggcactgcaaccttatatgggtggaatagagttccttcctttcaagcaacctttggatgtcaaacaagctgctgactccaaatcaaacaagtccaaatcaaagggaaaggcaccttga

SEQ ID NO: 7354 - protein, 458 aa, Sorghum bicolor
  misc_feature: Ceres ANNOT ID no. 6075527
  misc_feature (178)..(352): Pfam Id: tRNA-synt_2b Pfam Desc: tRNA synthetase class II core domain (G, H, P, S and T)
  misc_feature (1)..(114): Pfam Id: Seryl_tRNA_N Pfam Desc: Seryl-tRNA synthetase N-terminal domain
  misc_feature (1)..(457): NCBI GI: 3319776 NCBI Desc: seryl-trna synthetase [zea mays]
  misc_feature (1)..(434): NCBI GI: 3451411 NCBI Desc: seryl-trna synthetase [helianthus annuus]
  misc_feature (2)..(456): NCBI GI: 60473019 NCBI Desc: seryl-trna synthetase [dictyostelium discoideum]
  misc_feature (2)..(456): NCBI GI: 42733938 NCBI Desc: similar to seryl-trna synthetase, cytoplasmic (ec 6.1.1.11) [schizosaccharomyces pombe] [dictyostelium discoideum]
  misc_feature (1)..(454): NCBI GI: 119498645 NCBI Desc: seryl-trna synthetase [neosartorya fischeri nrrl 181]
  misc_feature (1)..(453): SWISSPROT Homolog: EC 6.1.1.11 Seryl-tRNA synthetase
MLDINLFRADKGGNPDLIRESQRSRFASVELVDEVIALDMAWRGKQFDLDKIRQELNATSKKIGKLKASKQEEEAKKLMESTDEIKKRLAAKEVEVQEAKSTLDAKVTTIGNIVHDSVPVSDDEANNKIVRTFGEKRVEENLKNHVDLCRMLDIVALEKGADVAGGRGFYLKGDGVFLNQALINFGLAFLRKRGFEPMQTPFFMRKETMAKCAQLAQFDEELYKVTGDGEDKYLIATSEQPLCAYHLGDRIYPAELPIKYAGYSTCFRKEAGSHGRDTAGIFRVHQFEKIEQFCITSPNGNDSWEMHEEMLKNSEDFYKEIGLPYQVVSIVSGALNDAAAKKYDLEAWFPASKTFRELVSCSNCTDFQSRRLGIGYGQKKNDEQSKQFVHMLNSTLTATERTLCCILENFQKEDGVEVPKALQPYMGGIEFLPFKQPLDVKQAADSKSNKSKSKGKAP

SEQ ID NO: 7355 - DNA, 1689 bp, Sorghum bicolor
  misc_feature: Ceres ANNOT ID no. 6075528
  misc_feature: Encodes the peptide sequence at SEQ ID NO 7356
atggcgggcgcgccgccgctgaggtcggacgtcgatttcgccgacgtattcggtggcccgccacgccgctcgtcggggaacgagcaccgctcgtcgtccgggtccgcgacgagggcacggagcgggggatcggacacgcccgtgttcggggaccgggggagctccgaccgaaggaggcatcccggggaggagttctacaaggacatattctcagggagcgaggcagcgtcgcccaggcggggcggcgccggggattggggggatgtgtttggcgggccgacttcgcctgtctccacggcccgcccgcgatcgagcttctccatgcgggtcaacagaggcacggacgtttcagtgcctagttctccctctcggcaaatatccaacagaaacgatgatggagcatcttatgcttacagcgttccaacttcgcccaatgcatccatgaataattaccttgcccaagggccagcccaacagcattcaaagaagaatcccttctcatggcatcgccatccattcctatctaggttccgttctcaaagtggagaaaagaaaagcacatctaattatgtcagctccatggacagtgaatatgaagggactcctgctaacttggaaagtatcatggccaataacaagttccatttttccttctataagtgggcaggcaaaggagccttgttagtgttgccagctacttcacaagaaaagtctgaagacattattggactgagaagcttccctcaagtcgtagttcaaggtattgatctaattgattatgaagacaacatgtcaactgccactggaacatccaaaagtcagacagattacgaagattccaaatctggaaaacatagcacaaactcagtaaccaaggatggagctattccttcactccccgaggactacatgcaagaaagaagtcgtagtagcagggtaaaggaaaagatgaagggtttcataaaactatttagccctgagagttcaccaaagcgcaaacgagcaccggaaacacaaggccaaacatctgttgggaaaaatggaagcaaaactgaactgcaagataagtttaggttatccagtttggaggccaatgaggatgtggaaacggcaaaaatgaacagccagaatgcttttatcgctgaatcttctccaatgactgaagtgcaagagaggatggacaaaccagttctgtcagaaaatagtaaaatggatacagctatggggagtaatgaagctgcttctaatgagtccatccatgatgatacaaaagacaaagcggacaacacaatgcagcatgaggacatacacattgaagatcttgatggatgtgtggttgagcatttctctgaagatcctgttcttcataatgatcaggaaaaggagctaataaaggcatcagaatctaaaatccgcgaatggtcaagaggaaaagaaggaaatattaggtcattgctttcaacactgcaatatgtcctatggcctgagagtggatggaaaccagttcctcttgttgatataattgaaggagcagcagtcaagaaggcttaccagaaagcattattatgccttcatccagataagttgcagcaacgaggcgctgccatgcatcagaagtatatagcagagaaggtttttgatattttacaggaatcatggaaggaattcaattcaatcacttttggatag

SEQ ID NO: 7356 - protein, 562 aa, Sorghum bicolor
  misc_feature: Ceres ANNOT ID no. 6075528
  misc_feature (410)..(558): NCBI GI: 32441244 NCBI Desc: at4g12780 [arabidopsis thaliana]
  misc_feature (399)..(556): NCBI GI: 3286691 NCBI Desc: auxilin-like protein [arabidopsis thaliana]
  misc_feature (410)..(558): NCBI GI: 110737602 NCBI Desc: auxilin-like protein [arabidopsis thaliana]
  misc_feature (320)..(558): NCBI GI: 4586253 NCBI Desc: auxilin-like protein [arabidopsis thaliana]
  misc_feature (320)..(558): NCBI GI: 4586254 NCBI Desc: auxilin-like protein [arabidopsis thaliana]
MAGAPPLRSDVDFADVFGGPPRRSSGNEHRSSSGSATRARSGGSDTPVFGDRGSSDRRRHPGEEFYKDIFSGSEAASPRRGGAGDWGDVFGGPTSPVSTARPRSSFSMRVNRGTDVSVPSSPSRQISNRNDDGASYAYSVPTSPNASMNNYLAQGPAQQHSKKNPFSWHRHPFLSRFRSQSGEKKSTSNYVSSMDSEYEGTPANLESIMANNKFHFSFYKWAGKGALLVLPATSQEKSEDIIGLRSFPQVVVQGIDLIDYEDNMSTATGTSKSQTDYEDSKSGKHSTNSVTKDGAIPSLPEDYMQERSRSSRVKEKMKGFIKLFSPESSPKRKRAPETQGQTSVGKNGSKTELQDKFRLSSLEANEDVETAKMNSQNAFIAESSPMTEVQERMDKPVLSENSKMDTAMGSNEAASNESIHDDTKDKADNTMQHEDIHIEDLDGCVVEHFSEDPVLHNDQEKELIKASESKIREWSRGKEGNIRSLLSTLQYVLWPESGWKPVPLVDIIEGAAVKKAYQKALLCLHPDKLQQRGAAMHQKYIAEKVFDILQESWKEFNSITFG

SEQ ID NO: 7357 - DNA, 1578 bp, Sorghum bicolor
  misc_feature: Ceres ANNOT ID no. 6075533
  misc_feature: Encodes the peptide sequence at SEQ ID NO 7358
atggaggtggagacgacgcccacgacggccgtgtcgtcttccggcggggccgcgcagctgccgccgcccggcccgcccgccaagaagaagcgtgccctccccggcatgccagatcctgacgcggaggtgatcgcgctgtcgcccaagacgctgctggcgacgaaccggttcgtgtgcgagatctgcaacaaggggttccagcgggaccagaacctgcagcttcaccggcggggccacaacctcccctggaagctgcggcagcggagcggcaaggaggcccggaagcgggtgtacgtgtgcccggagcccagctgcgtgcaccacgacccgtcgcgcgcgctcggcgacctcaccggcatcaagaagcacttctgtcggaagcacggcgagaagaagtggaagtgcgacaagtgctccaagaagtacgccgtgcagtcggactggaaggcgcacgtcaagacctgcggctcccgcgagtaccgctgcgattgcggcaccctcttctcccggagggacagcttcatcacccaccgtgccttctgcgacgcgctcgccgaggagagcgccaaggcgcgggtggaggcgcctcccgcggaggacgggagctcggcagccgccgtagttccgccaccggtgcccccgcctccgcctgcgccggcgccactgaggcagcaaccgcccccgcctgcgccgcatcatgcggagcaacgcaatgaaccggaggccaatgcgaccgagcccgtccagttcgcgccgccgccgccacaggtgccggtgccggtgctttcgcaaactacggtgagcgctgccaatgttagcgccagcagcagcagcaccgtcgcggggacatcgcagagccttctcggcggcatgttcgcaccgtcgtcgatggcctcagcgccgcagttcccggagcgcgccctgcccgtcaagccgccgtcgctgtgcctcgccacggacgcgtcgtcgtcaatcttctcggcacccgtatccaccgagcgccagcagttcgcgccgccgccgcctccgtccccgtccccgtcaccgcacatgtccgccaccacgctgctccagaaggccgcgcagatgggcgccacctcgtcaagctcgtcgttcctccgcgggctaggcctggacgtctcctcttcatcgccgggggcgtcgtcgtcaggccagccgcagcaccaccatgaaggcgccatgcaagtgtcactcccggacgcttcgctgccgcaatggccgccgcggctagagcatgagccgtcgccaatgctgtcggccgggctcgggctcgggctgccatacgactccacaggggctcaggtgtgcttgccggagctcatgatgggtcagtcgtctctgttcagcgggaagccggctacactggacttcctggggctcggaatgagcccgacgggcgcgccagcaagcagaggtatccccgcgttcatccagcccatcggcggcgctgtcggcatggccgggaccggagctggcgccgccgagacgtttggcgccggacgtggcccgcaggcgacgccatgggagaggaatccgagtagctcgccaatcctgtaa

SEQ ID NO: 7358 - protein, 525 aa, Sorghum bicolor
  misc_feature: Ceres ANNOT ID no. 6075533
  misc_feature (57)..(79): Pfam Id: zf-C2H2 Pfam Desc: Zinc finger, C2H2 type
  misc_feature (10)..(508): NCBI GI: 23198204 NCBI Desc: zinc finger protein [arabidopsis thaliana]
  misc_feature (3)..(507): NCBI GI: 140064565 NCBI Desc: zinc finger, c2h2-type [medicago truncatula]
  misc_feature (10)..(500): NCBI GI: 9858780 NCBI Desc: bac19.12 [lycopersicon esculentum]
  misc_feature (233)..(525): NCBI GI: 115451347 NCBI Desc: os03g0197800 [oryza sativa (japonica cultivar-group)]
  misc_feature (26)..(196): NCBI GI: 87162706 NCBI Desc: zinc finger, c2h2-type [medicago truncatula]
  misc_feature: The plant is abnormally small.
  misc_feature: The sequence is a functional homolog of SEQ ID NO 1074 in the 10/666,642US patent application
  misc_feature: The sequence is a functional homolog of SEQ ID NO 1075 in the 10/666,642US patent application
  misc_feature: The sequence is a functional homolog of SEQ ID NO 1076 in the 10/666,642US patent application
  misc_feature: The sequence is a functional homolog of SEQ ID NO 1077 in the 10/666,642US patent application
  misc_feature: The sequence is a functional homolog of SEQ ID NO 1078 in the 10/666,642US patent application
  misc_feature: The sequence is a functional homolog of SEQ ID NO 1079 in the 10/666,642US patent application
  misc_feature: The sequence is a functional homolog of SEQ ID NO 1086 in the 10/666,642US patent application
  misc_feature: The sequence is a functional homolog of SEQ ID NO 1087 in the 10/666,642US patent application
  misc_feature: The sequence is a functional homolog of SEQ ID NO 1785 in the 10/374,780US patent application
  misc_feature: Useful for making plants with modulated biomass
  misc_feature: Useful for making plants with modulated growth and phenotype characteristics
  misc_feature: The sequence is a functional homolog of SEQ ID NO 1785 in the 20060162006 US patent application
  misc_feature: The sequence is a functional homolog of SEQ ID NO 1074 in the 20070033671 US patent application
  misc_feature: The sequence is a functional homolog of SEQ ID NO 1075 in the 20070033671 US patent application
  misc_feature: The sequence is a functional homolog of SEQ ID NO 1076 in the 20070033671 US patent application
  misc_feature: The sequence is a functional homolog of SEQ ID NO 1078 in the 20070033671 US patent application
  misc_feature: The sequence is a functional homolog of SEQ ID NO 1079 in the 20070033671 US patent application
  misc_feature: The sequence is a functional homolog of SEQ ID NO 1086 in the 20070033671 US patent application
  misc_feature: The sequence is a functional homolog of SEQ ID NO 1087 in the 20070033671 US patent application
  misc_feature: GREAT-hit functional homolog of the protein sequence given in SEQ ID NO 13571
  misc_feature: The sequence is a functional homolog of SEQ ID NO 1087 in the 10/666,642 US patent application
  misc_feature: Useful for making plants with altered lignin content
  misc_feature: Functional homolog of the protein sequence given in SEQ ID NO 13275
  misc_feature: The sequence is a functional homolog of SEQ ID NO. 455 in the 11/188,298 US application
MEVETTPTTAVSSSGGAAQLPPPGPPAKKKRALPGMPDPDAEVIALSPKTLLATNRFVCEICNKGFQRDQNLQLHRRGHNLPWKLRQRSGKEARKRVYVCPEPSCVHHDPSRALGDLTGIKKHFCRKHGEKKWKCDKCSKKYAVQSDWKAHVKTCGSREYRCDCGTLFSRRDSFITHRAFCDALAEESAKARVEAPPAEDGSSAAAVVPPPVPPPPPAPAPLRQQPPPPAPHHAEQRNEPEANATEPVQFAPPPPQVPVPVLSQTTVSAANVSASSSSTVAGTSQSLLGGMFAPSSMASAPQFPERALPVKPPSLCLATDASSSIFSAPVSTERQQFAPPPPPSPSPSPHMSATTLLQKAAQMGATSSSSSFLRGLGLDVSSSSPGASSSGQPQHHHEGAMQVSLPDASLPQWPPRLEHEPSPMLSAGLGLGLPYDSTGAQVCLPELMMGQSSLFSGKPATLDFLGLGMSPTGAPASRGIPAFIQPIGGAVGMAGTGAGAAETFGAGRGPQATPWERNPSSSPIL

SEQ ID NO: 7359 - DNA, 1983 bp, Sorghum bicolor
  misc_feature: Ceres ANNOT ID no. 6075555
  misc_feature: Encodes the peptide sequence at SEQ ID NO 7360
  misc_feature: Down-regulated in root tissues in response to aminocyclopropane carboxylic treatment
  misc_feature: Down-regulated in shoot tissues in response to salicylic acid treatment
  misc_feature: Up-regulated in root tissues in response to salicylic acid treatment
atggaggcatcatcggcatcagcggtcgagtcgaccgccaccgtgtccgtcttcgatgtatcatccaacaagcagcgcccagacacggcgaagctcgtgctgaacagccccagcccgccgagcctgcgcgaggagctcgtcggcgtggtcggcaaggcgttccggccacggccccccggcggcggtggccgggcgccgcgctgcccgtggatcctcacggcgctgcagtgcgtgttcccggtcctgcagtgggggaggacctacaccctcaagtccttcaggagtgacgtcatggccggcctcactcttgccagccttggcatccctcagagcattggatatgccaacctagccaaactggaccctcagtacggtctttacacaagtgtcgtgccaccgctgatctacgctgtcatggggacatcgagggagatcgccatcggcccagtcgccgtcgtctcgctgctgctgtcgtcgatgatccagaaggtcgtcgacccggccgccgacccggcaacctacaggtcgctcgtcttcacggtgactttcctcgccggcgtcttccaggtctccttcggcctcttcaggctggggtttctcgtggatttcctgtcgcacgctgccatcgtggggttcatgggcggggcggccatcgtgatcggactgcagcagctcaagggcctgcttgggctcagccatttcaccaacagcaccgatgttgtttctgtcgtcaaggccgtctgctctgcgctacatgacccgtggcacccgggcaacttcctcatcggatgctccttccttatattcatcctcaccacacgcttcatcgggaggaggtacaagaagctgttctggctgtcagcgatttcacctctgctatcggtcatcctgtccaccgctgcagtctacgcaacaagggccgacaagcacggcgtcaagatcatccagaaggtgcacgcaggcttaaacccaagttcagccaagcagatacacctgaacgggccgcacgccacggaatgtgccaagatcgccgtcatctgcgcagtcatcgccctcacggaagctatcgccgttgggcgatctttcgcctcggtaagagggtacaaacttgacggcaacaaggagatgctggcgatggggttctccaacgttgctggatctctgtcctcgtgttatgtggcaacaggttcattctccagaacggcagtgaacttcagcgcgggcgccaggtcgactgtttcgaacatcgtcatgtccatcaccgtgttcgttgccttggagttgttcatgaagctcctctactacacacccatggcggtgctcgcctccatcattctatcagctcttccggggctgatcgacatcaaagaagcttgcaacatatggaaaatagacaagatggatttcctcatctgccttggtgcatttgttggtgtcctgtttgggtcggtggagattgggcttgcagttgcacttgccatttccttcgcaaagatcatcatacagtcaattcgacctcaggtagaggttcttggcaggctacaagggacaaacatcttctgcagcgtcagacaataccctgtagcttgccaaactccgactgtgctaccgatacgcatggacacatccttcctctgtttcatcaatgccactttcatcaaagaaaggatcatagagtgggttcgggaagaagtggagaacccaaatggaaaagcgagagagaggatacaagcagttgtccttgatatgtcaagtgtggtaaacatcgacacttcaggactcactgctctggaagaaatacacaaggagttggtgtctcttggcatacagatggctatagccagtccaggatggaaggcagttcagaagatgaaagtgtcgcgggtggtcgacagagtaggagaagattggatcttcatgacagtaggtgaagcagtggaggcctgtctagctgctcataagggcacagctctcgaatgttga

SEQ ID NO: 7360 - protein, 660 aa, Sorghum bicolor
  misc_feature: Ceres ANNOT ID no. 6075555
  misc_feature (192)..(503): Pfam Id: Sulfate_transp Pfam Desc: Sulfate transporter family
  misc_feature (526)..(645): Pfam Id: STAS Pfam Desc: STAS domain
  misc_feature (24)..(652): NCBI GI: 607188 NCBI Desc: low affinity sulphate transporter [stylosanthes hamata]
  misc_feature (22)..(649): NCBI GI: 20259974 NCBI Desc: sulfate transporter [arabidopsis thaliana]
  misc_feature (28)..(649): NCBI GI: 72384417 NCBI Desc: 4d11_19 [brassica rapa subsp. pekinensis]
  misc_feature (33)..(647): NCBI GI: 125656035 NCBI Desc: plasma membrane sulphate transporter [brassica oleracea var. acephala]
  misc_feature (28)..(649): NCBI GI: 45720461 NCBI Desc: plasma membrane sulphate transporter [brassica oleracea var. acephala]
  misc_feature: Down-regulated in root tissues in response to aminocyclopropane carboxylic treatment
  misc_feature: Down-regulated in shoot tissues in response to salicylic acid treatment
  misc_feature: Up-regulated in root tissues in response to salicylic acid treatment
MEASSASAVESTATVSVFDVSSNKQRPDTAKLVLNSPSPPSLREELVGVVGKAFRPRPPGGGGRAPRCPWILTALQCVFPVLQWGRTYTLKSFRSDVMAGLTLASLGIPQSIGYANLAKLDPQYGLYTSVVPPLIYAVMGTSREIAIGPVAVVSLLLSSMIQKVVDPAADPATYRSLVFTVTFLAGVFQVSFGLFRLGFLVDFLSHAAIVGFMGGAAIVIGLQQLKGLLGLSHFTNSTDVVSVVKAVCSALHDPWHPGNFLIGCSFLIFILTTRFIGRRYKKLFWLSAISPLLSVILSTAAVYATRADKHGVKIIQKVHAGLNPSSAKQIHLNGPHATECAKIAVICAVIALTEAIAVGRSFASVRGYKLDGNKEMLAMGFSNVAGSLSSCYVATGSFSRTAVNFSAGARSTVSNIVMSITVFVALELFMKLLYYTPMAVLASIILSALPGLIDIKEACNIWKIDKMDFLICLGAFVGVLFGSVEIGLAVALAISFAKIIIQSIRPQVEVLGRLQGTNIFCSVRQYPVACQTPTVLPIRMDTSFLCFINATFIKERIIEWVREEVENPNGKARERIQAVVLDMSSVVNIDTSGLTALEEIHKELVSLGIQMAIASPGWKAVQKMKVSRVVDRVGEDWIFMTVGEAVEACLAAHKGTALEC

SEQ ID NO: 7361 - DNA, 1983 bp, Sorghum bicolor
  misc_feature: Ceres ANNOT ID no. 6075557
  misc_feature: Encodes the peptide sequence at SEQ ID NO 7362
atggaatctcagcaattccctcgaggattccctcaacagcaaggagttcacccaaacacttcagaaccagccatggagttcatggcaagtaagtcatacatacccaaaagggcagattttgcagagctggtgctgcaaggtccagagcctccaagcctgtggtatgttctcattggcatgttaagaaaaacagttcattaccaaagcgcagataagcatttcgcactctctgtgtgtgcaatgtcaattctgcatggcctgtttccaatacttgaatggtggaaaagctacagcctgaagtccttccgtagtgacctcatggctggtctcactctcgcgagccttagcattccacagagcattggatatgcaaatcttgctaaactggatcctcagtatggtctttatacaagtgttgtgccacctcttgtctatgctgtaatggggacctctagggagatagccattggaccggttgccattgtgtcactcttgctttcatcaatggctcaaaagatagctgacccagtcatcgatccagctttctatcgaaaaacggttttcactgtgacatgctttactggtatcttccagtttgcatttggtcttttcaggttgggattccttgttgattttctctcgcatgccgcaatcactggatttatgggaggagctgccattgttattggactgcagcagttgaagggcctactggggcttagtcatttcacaagtagcactgacgttgtatctgtcatcagagcagtctgggtttctgttcatgaaccatggcatcccgagaacttctacattggatgttctttcttcttgttcattctcggcatgaggttcataggtagaaagaataagaagcttttctgggtttcagcgattgcacctgtgctctcagttgcattgtctactctcatggtctatatgacaagagctgataagcatggtgtaaagatcatacaaaaagtggatgccggcatcaatgcgagctcaatcaagcagataaatttcaatggatcctatgtttctgaatgtgcaaagatagctcttatttgtgctgttattgctctaacggaagctatcgctgttggccgctctttttcagtcataaatggttataaattggatggaaataaggaaatgcttgcaatgggcttcatgaatgtagcaggatccatgtcgtcttgctatgtggcaactgggtctttctcccgcacagctgtgaacttcaccgctggctgtaagacaacaatgtcaaatgttgtcatggctgtcactgttatggttgccttggagctgctcaccaagctcctgtactatacgccagtgtctatacttgcatcaatcattctatcagccctcccagggctaatcaatttccaggaagtctgcatcctttggaaagtcgacaaattagatttcctcacatgcatgggatccttccttggtgttatattcggatcagtggagattgggctttcagttgcaattgttatctcctttgcgaagattgttgtgcactcagtctggcctcaagtcgagatccttggtagacttcaggggacgaacatattctgcaacatggaacagtatccaatggtttgtcaaacacctgctgttctggccatacggatcagcacctcgttcctttgcttcatcaacggcaattccatcagagagaagattactgggtgggtaatcgataagcgtgacgcaatctgcttggtcgtccttgacatgtcaaatgttgtgaacatcgacacagcaggacttgcggcgctggaagaactgcgccaggagctggtgtcttgtggcatacagatggccatagctagccctggatggcaggtgatccacaagatgaaactagcacggctcatcagcggaattgaagactggatctttctgacggttggcgaagcagtagaagcctgcccggcgaataagaagggtagtgacctagaatgttga

SEQ ID NO: 7362 - protein, 660 aa, Sorghum bicolor
  misc_feature: Ceres ANNOT ID no. 6075557
  misc_feature (201)..(512): Pfam Id: Sulfate_transp Pfam Desc: Sulfate transporter family
  misc_feature (535)..(645): Pfam Id: STAS Pfam Desc: STAS domain
  misc_feature (10)..(649): NCBI GI: 72384417 NCBI Desc: 4d11_19 [brassica rapa subsp. pekinensis]
  misc_feature (10)..(649): NCBI GI: 45720461 NCBI Desc: plasma membrane sulphate transporter [brassica oleracea var. acephala]
  misc_feature (39)..(649): NCBI GI: 20259974 NCBI Desc: sulfate transporter [arabidopsis thaliana]
  misc_feature (41)..(653): NCBI GI: 607188 NCBI Desc: low affinity sulphate transporter [stylosanthes hamata]
  misc_feature (35)..(647): NCBI GI: 125656035 NCBI Desc: plasma membrane sulphate transporter [brassica oleracea var. acephala]
MESQQFPRGFPQQQGVHPNTSEPAMEFMASKSYIPKRADFAELVLQGPEPPSLWYVLIGMLRKTVHYQSADKHFALSVCAMSILHGLFPILEWWKSYSLKSFRSDLMAGLTLASLSIPQSIGYANLAKLDPQYGLYTSVVPPLVYAVMGTSREIAIGPVAIVSLLLSSMAQKIADPVIDPAFYRKTVFTVTCFTGIFQFAFGLFRLGFLVDFLSHAAITGFMGGAAIVIGLQQLKGLLGLSHFTSSTDVVSVIRAVWVSVHEPWHPENFYIGCSFFLFILGMRFIGRKNKKLFWVSAIAPVLSVALSTLMVYMTRADKHGVKIIQKVDAGINASSIKQINFNGSYVSECAKIALICAVIALTEAIAVGRSFSVINGYKLDGNKEMLAMGFMNVAGSMSSCYVATGSFSRTAVNFTAGCKTTMSNVVMAVTVMVALELLTKLLYYTPVSILASIILSALPGLINFQEVCILWKVDKLDFLTCMGSFLGVIFGSVEIGLSVAIVISFAKIVVHSVWPQVEILGRLQGTNIFCNMEQYPMVCQTPAVLAIRISTSFLCFINGNSIREKITGWVIDKRDAICLVVLDMSNVVNIDTAGLAALEELRQELVSCGIQMAIASPGWQVIHKMKLARLISGIEDWIFLTVGEAVEACPANKKGSDLEC

SEQ ID NO: 7363 - DNA, 825 bp, Sorghum bicolor
  misc_feature: Ceres ANNOT ID no. 6075558
  misc_feature: Encodes the peptide sequence at SEQ ID NO 7364
atgggatacaaccgccacaggcgcggccggggatcctcctcatcgtcttcacgccgtaccaagcaagaagtctcgtgtttcagtgatgatggccctgggacatcacttccaaggcaagaagaagatacagaagacgaatttaaaggttcaagaattcagcttgcaatgtgggactttggtcagtgtgatgtcaaaagatgcactggtcgtaagctttcgagatttgggcttttgaaggagttgagagtgaccaatggttttggtggtgttgttctcagccctgttggaacacaatgtgtatccaaggaagatcatcctattgtgcaaagaaaaggattggctgtggttgattgttcctgggcacgtttaagtgatgtcccttttgtgaaactacgttgcggtgctcctcgtctcttaccatggttagtagcggcaaatcctgtgaactatggtcggccatgtgaactgtcttgtgtggaagctttatcagcagccctcataatatgtggggaggaagatacagcacatttgctgcttgggaaattcaagtggggtcacgcattcttgtctctaaacagagatctcctgaaagcgtactcccaatgtgaaaatggatctgagattatcaatgtgcagaactcatggttatcgagtaactcaagtgttccaaagccacccgtaaacgggacagaggaagcacggcaaagcacggaggagggatctgaaggtgattcagacgatgacttgccccctctcgagaagaatctgaaccacctgaaccttgatgaagatgaagaaagcgaggaagagagtgaaagcgaataa

SEQ ID NO: 7364 - protein, 274 aa, Sorghum bicolor
  misc_feature: Ceres ANNOT ID no. 6075558
  misc_feature (52)..(86): Pfam Id: RLI Pfam Desc: Possible metal-binding domain in RNase L inhibitor, RLI
  misc_feature (1)..(274): NCBI GI: 72384473 NCBI Desc: 80a08_4 [brassica rapa subsp. pekinensis]
  misc_feature (1)..(270): NCBI GI: 42573329 NCBI Desc: rnase l inhibitor protein-related [arabidopsis thaliana]
  misc_feature (69)..(268): NCBI GI: 140054012 NCBI Desc: possible metal-binding region in rnase l inhibitor, rli [medicago truncatula]
  misc_feature (41)..(274): NCBI GI: 62858567 NCBI Desc: loc549889 [xenopus tropicalis]
  misc_feature (3)..(255): NCBI GI: 24647066 NCBI Desc: cg4338-pa [drosophila melanogaster]
MGYNRHRRGRGSSSSSSRRTKQEVSCFSDDGPGTSLPRQEEDTEDEFKGSRIQLAMWDFGQCDVKRCTGRKLSRFGLLKELRVTNGFGGVVLSPVGTQCVSKEDHPIVQRKGLAVVDCSWARLSDVPFVKLRCGAPRLLPWLVAANPVNYGRPCELSCVEALSAALIICGEEDTAHLLLGKFKWGHAFLSLNRDLLKAYSQCENGSEIINVQNSWLSSNSSVPKPPVNGTEEARQSTEEGSEGDSDDDLPPLEKNLNHLNLDEDEESEEESESE

SEQ ID NO: 7365 - DNA, 597 bp, Sorghum bicolor
  misc_feature: Ceres ANNOT ID no. 6075570
  misc_feature: Encodes the peptide sequence at SEQ ID NO 7366
atggcggcgaggcgcgacaccgagttggacggcgaagagctcggcggcgagggctccaaccccgtcggtggtggcgcgactccaccgcccctaggcgcagcccctgtcgtatgcgtcctccgctccgctggggacttcgctggcggcgccttcattggatccgtcttcggatatggacaaggcttgctcactaagaagggttttaagggctcattcagcaatgcagggtcctctgccaagacttttgcagttctctctggagttcagagtttggtcgtgtgcttgttgcgaaggctacgtgggaaagatgacattgtcaatgctggtatagctggttgttgtactggtgttgctttgagctttccaggagcgccacaagcgttgcttcaaagctgtgccacctttgcagcattctcatgcatcatggaggggctcaataagcagcaggctgcaatggctcgcacacttggtgggactgccgtgacggtcgtgcatgagaaaggcggtgttctgcccccgttcacgctgccaccaattcttgatgcatctgatgctttagcttcatgctgcttagcgttagtaaagcctaagcactag

SEQ ID NO: 7366 - protein, 198 aa, Sorghum bicolor
  misc_feature: Ceres ANNOT ID no. 6075570
  misc_feature (31)..(149): Pfam Id: Tim17 Pfam Desc: Tim17/Tim22/Tim23 family
  misc_feature (105)..(197): NCBI GI: 115481700 NCBI Desc: os10g0364700 [oryza sativa (japonica cultivar-group)]
  misc_feature (38)..(143): NCBI GI: 42562146 NCBI Desc: mitochondrial import inner membrane translocase subunit tim17/tim22/tim23 family protein [arabidopsis thaliana]
  misc_feature (65)..(143): NCBI GI: 74606456 NCBI Desc: mitochondrial import inner membrane translocase subunit tim22
  misc_feature (77)..(143): NCBI GI: 18398755 NCBI Desc: mitochondrial import inner membrane translocase subunit tim17/tim22/tim23 family protein [arabidopsis thaliana]
  misc_feature (77)..(143): NCBI GI: 89213235 NCBI Desc: at3g10110 [arabidopsis thaliana]
  misc_feature: The plant flowers significantly late compared to wild-type.
  misc_feature: The plant is abnormally large.
  misc_feature: Useful for making plants with modulated biomass
  misc_feature: Useful for making plants with modulated flowering time
  misc_feature: Useful for making plants with modulated heat sensitivity
  misc_feature: Useful for making plants with modulated salt sensitivity
  misc_feature: Useful for making plants with modulated drought sensitivity
  misc_feature: GREAT-hit functional homolog of the protein sequence given in SEQ ID NO 13265
  misc_feature: GREAT-hit functional homolog of the protein sequence given in SEQ ID NO 13270
  misc_feature: GREAT-hit functional homolog of the protein sequence given in SEQ ID NO 13434
  misc_feature: GREAT-hit functional homolog of the protein sequence given in SEQ ID NO 13456
  misc_feature: Useful for making plants with modulated salt sensitivity
  misc_feature: Functional homolog of the protein sequence given in SEQ ID NO 13456
MAARRDTELDGEELGGEGSNPVGGGATPPPLGAAPVVCVLRSAGDFAGGAFIGSVFGYGQGLLTKKGFKGSFSNAGSSAKTFAVLSGVQSLVVCLLRRLRGKDDIVNAGIAGCCTGVALSFPGAPQALLQSCATFAAFSCIMEGLNKQQAAMARTLGGTAVTVVHEKGGVLPPFTLPPILDASDALASCCLALVKPKH

SEQ ID NO: 7367 - DNA, 1539 bp, Sorghum bicolor
  misc_feature: Ceres ANNOT ID no. 6075575
  misc_feature: Encodes the peptide sequence at SEQ ID NO 7368
atgaagacctcctccttagtcgtcgttgctctagcagcggtagtgctgttcgcagcgcatgatgcctccctcgcgggcgcctcctccagctccagccccagggtcatcatcgtcggcgccggcatgtccgggatctcggcggggaagcagctgtgggagtcgggggtgcgggatctgctgatcctggaggcgacggagcgcgtgggcgggcggatgcacaatcacaacttcggcggcatcaacgtggagatcggggccaactgggtggagggcctcggcggcgacaacctcaaccccatctggcccatcgtcaacgacacgctcaagctcaggaccttctactccgacttcgacagcgtcgtcggctgcgtctacaaggagaacggcggtggcctgtacgacgaggagtacgtgcagaagaaaatggaccgtgcctacgaggtgcaagaactgggtgccaaccttaccaaaaagatgcgccccaatggccaggacgacatctccctcttagccatgcaacggctgttcaaccaccagccgaacgggccggcaacgccggtggacatggcgttggactacttcatctacgactacgagttcgcggagccgccgcgcgtgacgagcctgcagaacacgcagccgacgcccaccaacgccgacttcggcgaggacaactacttcgtcgcggaccagcgtgggttcgagtccatcatccacgccatcggcagctcctacctctccaccgacgccaacggcaagctctcagaccgcaggatcctgctcaacaagatcgcgtacaacaaagaaggtgtggtcgtgaagacggaggacgggtcgtcgtacagcgcagactacgtggtggtctccaccagcctgggcgtcctgcagaccgacctcatcaagttcacgccccagctgcccttctggaagatcgctgcgatctaccgtttcgacatgggcgcgtacaccaagatcttcctcaagtttcccagcaagttctggcccgtgggcgaggggaagcagttcttcgtgtacgccagcagccggcgcggctactacgggatgtggcagtcgttcgagcgggagtacccgggcgccaacgtgctcctggtcaccgtcaccgacgacgagtcgcggcggatcgagcagcagagcgacaaccacaccaaggccgaggtggcggcggtgctgcgcgacatgttccccgacgccgacgtgccggcgccggaggagatcgacatctacgtgccgcgctggtggtccaaccgattcttcaagggctcctactccaactggcccatcggcgtcagccgctacgagtacgaccagctcagggctccggttgggagggtctacttcactggtgagcacaccagcgagcgctacaacggttatgtccatggagcataccttgcaggtatcgactctgcaaacatcctcatcaaccacatcttcaagaacgaggagtacaaggtccgtggcaagtacgagcccgacgaccaaattgcaaagtttccaggcagctgttgcctcatgtag

SEQ ID NO: 7368 - protein, 512 aa, Sorghum bicolor
  misc_feature: Ceres ANNOT ID no. 6075575
  misc_feature (42)..(481): Pfam Id: Amino_oxidase Pfam Desc: Flavin containing amine oxidoreductase
  misc_feature (34)..(474): Pfam Id: DAO Pfam Desc: FAD dependent oxidoreductase
  misc_feature (1)..(502): NCBI GI: 14488153 NCBI Desc: flavin containing polyamine oxidase [hordeum vulgare subsp. vulgare]
  misc_feature (259)..(496): NCBI GI: 115478833 NCBI Desc: os09g0368200 [oryza sativa (japonica cultivar-group)]
  misc_feature (6)..(497): NCBI GI: 9843858 NCBI Desc: flavin containing polyamine oxidase [zea mays]
  misc_feature (6)..(497): NCBI GI: 9844871 NCBI Desc: polyamine oxidase [zea mays]
  misc_feature (33)..(497): NCBI GI: 6980741 NCBI Desc: chain c, a 30 angstrom u-shaped catalytic tunnel in the crystal structure of polyamine oxidase
  misc_feature (6)..(497): SWISSPROT Homolog: EC 1.5.3.11 Polyamine oxidase precursor
MKTSSLVVVALAAVVLFAAHDASLAGASSSSSPRVIIVGAGMSGISAGKQLWESGVRDLLILEATERVGGRMHNHNFGGINVEIGANWVEGLGGDNLNPIWPIVNDTLKLRTFYSDFDSVVGCVYKENGGGLYDEEYVQKKMDRAYEVQELGANLTKKMRPNGQDDISLLAMQRLFNHQPNGPATPVDMALDYFIYDYEFAEPPRVTSLQNTQPTPTNADFGEDNYFVADQRGFESIIHAIGSSYLSTDANGKLSDRRILLNKIAYNKEGVVVKTEDGSSYSADYVVVSTSLGVLQTDLIKFTPQLPFWKIAAIYRFDMGAYTKIFLKFPSKFWPVGEGKQFFVYASSRRGYYGMWQSFEREYPGANVLLVTVTDDESRRIEQQSDNHTKAEVAAVLRDMFPDADVPAPEEIDIYVPRWWSNRFFKGSYSNWPIGVSRYEYDQLRAPVGRVYFTGEHTSERYNGYVHGAYLAGIDSANILINHIFKNEEYKVRGKYEPDDQIAKFPGSCCLM

SEQ ID NO: 7369 - DNA, 333 bp, Sorghum bicolor
  misc_feature: Ceres ANNOT ID no. 6075582
  misc_feature: Encodes the peptide sequence at SEQ ID NO 7370
atggggctgctcttcttggagcggctggagggggagggcgtgttcaggtgccggcgctgccgagttgacgccgcctccaaggacgccatcatctccagggacttctacggccgctccggccgcgcctacctcttcgaccacgttgtgaacatatgcctaggccctaatgaggatcgatatcttgtaaccggactccatactgtgaatgacatctactgcagctgctgccaacagattcttggctggagatatgagaaagcctacgagcaaagcgagaaatacaaagaagggaagtacatcctcgagagagccagaatggtgaaagatgggtga

SEQ ID NO: 7370 - protein, 110 aa, Sorghum bicolor
  misc_feature: Ceres ANNOT ID no. 6075582
  misc_feature (1)..(109): Pfam Id: Yippee Pfam Desc: Yippee putative zinc-binding protein
  misc_feature (1)..(109): NCBI GI: 27923882 NCBI Desc: yippee-like protein oj1003c07.11
  misc_feature (3)..(109): NCBI GI: 115488582 NCBI Desc: os12g0484700 [oryza sativa (japonica cultivar-group)]
  misc_feature (1)..(109): NCBI GI: 21554253 NCBI Desc: zinc-binding protein-like [arabidopsis thaliana]
  misc_feature (15)..(109): NCBI GI: 48095962 NCBI Desc: similar to yippee-like protein 1 (digeorge syndrome-related protein fksg3) [apis mellifera]
  misc_feature (15)..(109): NCBI GI: 55244258 NCBI Desc: ensangp00000019801 [anopheles gambiae str. pest]
MGLLFLERLEGEGVFRCRRCRVDAASKDAIISRDFYGRSGRAYLFDHVVNICLGPNEDRYLVTGLHTVNDIYCSCCQQILGWRYEKAYEQSEKYKEGKYILERARMVKDG

SEQ ID NO: 7371 - DNA, 639 bp, Sorghum bicolor
  misc_feature: Ceres ANNOT ID no. 6075591
  misc_feature: Encodes the peptide sequence at SEQ ID NO 7372
atggcgacgacggccatggcaaaacggtcgtcgtggctgctggtcctcgcgctcgcagcgctactactagccgccgccgccgtgcgcgtcgacggcggcgccacggccgcggcgccggcgccggcgccggccgcggactgcggggacgcgcttctgggcctggcggggtgcctgagctacgtgtcggaagggagcacggtggcgacacccgacccgacctgctgctcggggctcaaggacgtggtgcacaaggaggtggcctgcctctgccaggtcttccagagcggtcagaaactcggcatctcgctcaacatgaccaaggccctgcagctgcccgccgcctgcaaggtcaagacgccgcccttcagcaagtgccacgtttctgttcctggtgtgcccaccgcgtctcctgtgcctgctccatctaccggggccccattcttcggccagtcgccgtcgccgtcgtcgtcaattccttcggggtcaccggcagcggcagcaaccgggagccagagccagaccagcaccccagcaccctccccagcgcgttctggcgctgccggcctctcggcaccaccgcggacgttcctcgcggcagctactgctgccgcgactctgttcgtgtgccgactcttgtga

SEQ ID NO: 7372 - protein, 212 aa, Sorghum bicolor
  misc_feature: Ceres ANNOT ID no. 6075591
  misc_feature (47)..(125): Pfam Id: Tryp_alpha_amyl Pfam Desc: Protease inhibitor/seed storage/LTP family
  misc_feature (6)..(168): NCBI GI: 42573786 NCBI Desc: protease inhibitor/seed storage/lipid transfer protein (ltp) family protein [arabidopsis thaliana]
  misc_feature (6)..(156): NCBI GI: 20147301 NCBI Desc: at5g64080/mhj24_6 [arabidopsis thaliana]
  misc_feature (6)..(156): NCBI GI: 21618136 NCBI Desc: nonspecific lipid-transfer protein-like protein [arabidopsis thaliana]
  misc_feature (40)..(166): NCBI GI: 49204581 NCBI Desc: xylogen protein 1 [zinnia elegans]
  misc_feature (5)..(203): NCBI GI: 50509338 NCBI Desc: protease inhibitor-like protein [oryza sativa (japonica cultivar-group)]
MATTAMAKRSSWLLVLALAALLLAAAAVRVDGGATAAAPAPAPAADCGDALLGLAGCLSYVSEGSTVATPDPTCCSGLKDVVHKEVACLCQVFQSGQKLGISLNMTKALQLPAACKVKTPPFSKCHVSVPGVPTASPVPAPSTGAPFFGQSPSPSSSIPSGSPAAAATGSQSQTSTPAPSPARSGAAGLSAPPRTFLAAATAAATLFVCRLL

SEQ ID NO: 7373 - DNA, 1257 bp, Sorghum bicolor
  misc_feature: Ceres ANNOT ID no. 6075601
  misc_feature: Encodes the peptide sequence at SEQ ID NO 7374
atgggaaacaagaagaagccgaagccgagcaggaacaagaagaagcccaaaaccagcgccgaccaggctctggccctagactacgtccgcgcctgggcgcaccccgcgccgccgccaccagaaccctcggcggccgacgccgacgacttcctgccgatcctggctacgcgcggcggcgacgtgctgtttgagctccactcccactcaaaccacagcgacggattcctctccccttccgcgctcgtcgagcgcgcccatcgcaatggggtgaaagttctcgccctaacagatcatgacaccatggctggcataccagaagctgtgtcagcagcttccaagtttggcattagaataattcctggtgttgaaatcagtgcactatataatccaagggaagttgctggtgctggtgagactgttcatatccttgcatactatggtatgtgtggtccgtcaagacctgatgagttggacagcatgctattgaacattagagatgggcgatacttacgcgcaaagaacatgctgcaaaagctaactacactgaaggtgccaataaagtgggagcatgtgactaaaattgctggtgacggagtggcacctggccgattgcatatagcaagggctatggttgaagcgggttatgtagagaatataaggcaagcattcaacaaatacctcggtgatgatggccctgcatatgccagaggaagtgaaccatttgctgagactgtcgtgcagttaattagtcgcactgggggtatttctgcacttgctcatccttggtcattgaagaacccagatgcaataatcaggtctttaaaaggtgctggtcttaattgtatggaggtctacagaagtgacggaaaagttgatggatttagtgaattagcagagaagtatggacttctgaaacttggaggttcagatttccatggaagaggtggaaaagatgaatctgacgttggaacggttaagctcgctattacaactttgtgctgctttttgaagatggctaggtctatctggtcttctgctatgaaagacatcctgcttaagtttgcagaggaaccatctgctgcaaatctaggaaacatgcttaagtttggacgacttaccaatttttctggtttttctccaataaacaatggtattcacgttgttgatttctgcttatcttcatggtcttctgctatggaagatgttgagcttgaagaggtaagattgaagcttgcccattatgtagcagaaagataa

SEQ ID NO: 7374 - protein, 418 aa, Sorghum bicolor
  misc_feature: Ceres ANNOT ID no. 6075601
  misc_feature (63)..(315): Pfam Id: PHP Pfam Desc: PHP domain
  misc_feature (3)..(412): NCBI GI: 20466107 NCBI Desc: at2g13860/f13j11.19 [arabidopsis thaliana]
  misc_feature (64)..(349): NCBI GI: 57233605 NCBI Desc: php domain n-terminal region family protein [dehalococcoides ethenogenes 195]
  misc_feature (64)..(349): NCBI GI: 73749384 NCBI Desc: php domain n-terminal region family protein [dehalococcoides sp. cbdb1]
  misc_feature (64)..(349): NCBI GI: 88932640 NCBI Desc: php, c-terminal [dehalococcoides sp. bav1]
  misc_feature (62)..(323): NCBI GI: 78043953 NCBI Desc: php domain protein [carboxydothermus hydrogenoformans z-2901]
MGNKKKPKPSRNKKKPKTSADQALALDYVRAWAHPAPPPPEPSAADADDFLPILATRGGDVLFELHSHSNHSDGFLSPSALVERAHRNGVKVLALTDHDTMAGIPEAVSAASKFGIRIIPGVEISALYNPREVAGAGETVHILAYYGMCGPSRPDELDSMLLNIRDGRYLRAKNMLQKLTTLKVPIKWEHVTKIAGDGVAPGRLHIARAMVEAGYVENIRQAFNKYLGDDGPAYARGSEPFAETVVQLISRTGGISALAHPWSLKNPDAIIRSLKGAGLNCMEVYRSDGKVDGFSELAEKYGLLKLGGSDFHGRGGKDESDVGTVKLAITTLCCFLKMARSIWSSAMKDILLKFAEEPSAANLGNMLKFGRLTNFSGFSPINNGIHVVDFCLSSWSSAMEDVELEEVRLKLAHYVAER

SEQ ID NO: 7375 - DNA, 642 bp, Sorghum bicolor
  misc_feature: Ceres ANNOT ID no. 6075605
  misc_feature: Encodes the peptide sequence at SEQ ID NO 7376
atggcggtggtgtcggcgctggccaagtacaagctcgtgttcctgggcgaccaggcggtgggcaagacggccatcatcacccgcttcatgtacgacaagttcgacgacacctaccaggcgacgatcgggatcgacttcctgtccaagacgatgtacctcgaagaccgcaccgttcgcctccagctctgggacacagctgggcaggagaggttccgcagcctgatcccgagctacatcagagactcctccgtggccgtcatcgtttacgatgtcaccgacagccaatccttcttgaacacatcaaagtggatcgaggaagtaaacacacaaagaggtggagatgtactcatcttcctcgtcggaaataaaactgaccttgttgacaagaggaaagtgaccactggggaaggagaagccaaggcacaggagcatggtgccatgttcatagagaccagtgcaaaagctgggttcaacgtcaagcctctgttccgcaagatcgctggatcccttccaggactggacgcgctctcgtcagcaaagcatgaagacatggtcgacataaacctcagacctgccagcggctcatcggcgtcaggcgcagtcgcgcagctggagcagaaatcaggtggttgctcctgttga

SEQ ID NO: 7376 - protein, 213 aa, Sorghum bicolor
  misc_feature: Ceres ANNOT ID no. 6075605
  misc_feature (11)..(172): Pfam Id: Ras Pfam Desc: Ras family
  misc_feature (11)..(125): Pfam Id: Miro Pfam Desc: Miro-like protein
  misc_feature (3)..(170): Pfam Id: Arf Pfam Desc: ADP-ribosylation factor family
  misc_feature (1)..(213): NCBI GI: 24059912 NCBI Desc: gtp-binding protein rab6 [oryza sativa (japonica cultivar-group)]
  misc_feature (1)..(213): NCBI GI: 8953407 NCBI Desc: gtp-binding protein [arabidopsis thaliana]
  misc_feature (1)..(213): NCBI GI: 72384491 NCBI Desc: 80a08_22 [brassica rapa subsp. pekinensis]
  misc_feature (1)..(213): NCBI GI: 72384460 NCBI Desc: 52o08_31 [brassica rapa subsp. pekinensis]
  misc_feature (1)..(213): NCBI GI: 72255617 NCBI Desc: 117m18_16 [brassica rapa]
  misc_feature: The sequence is a functional homolog of SEQ ID NO. 400 in the 11/188,298 US application
MAVVSALAKYKLVFLGDQAVGKTAIITRFMYDKFDDTYQATIGIDFLSKTMYLEDRTVRLQLWDTAGQERFRSLIPSYIRDSSVAVIVYDVTDSQSFLNTSKWIEEVNTQRGGDVLIFLVGNKTDLVDKRKVTTGEGEAKAQEHGAMFIETSAKAGFNVKPLFRKIAGSLPGLDALSSAKHEDMVDINLRPASGSSASGAVAQLEQKSGGCSC

SEQ ID NO: 7377 - DNA, 1782 bp, Sorghum bicolor
  misc_feature: Ceres ANNOT ID no. 6075608
  misc_feature: Encodes the peptide sequence at SEQ ID NO 7378
atggaactcctcgacgcgaggcaccgccacacgccggattcgagctcctccccggacgccgcctccgacatggggctcccgctcgccggtgccgcctaccagccctacgtctccgagctcctctccttctccatcgagcgcctccacaaggagccggagcttctgagggtcgacgcggagcgggtgcggcggcagatgcaggaggtggcggtggagaactacggcgccttcatcgccgcctccgaggcgctctccttcgttcgcgcgcagctcgagagcttcgacggccacctcgaggccatgatagaggagataccaaacttgacatctggctgcactgagtttgttgagtccgcacagcaaattttggaggagaggaagcttaatcaaacattactagcaaaccatactacattgcttgacttgcttgaaatcccacaactgatggacacgtgtatacggaatgggaactatgatgaagcacttgatctagaagcttttgttagcaaaatctcgaagttgcaccccgatttacctgttgtccaaggattagctgctgaagtcaagaagacagtacaatcattaatttcacagcttctccagaaacttcgatcaaatattcagttacctgaatgcctccgtattgtagcacatctgcgtcgaattggagttttcagtgagtcagaattgcgcttacagttcctgaggtgcagggaagcttggctttctgggattcttgaagatctggaccaaaggaatgtttatgattacctgaaaggcatggtgacttgccacagagtacatctatttgatgttgttaatcaatatcgagcaatattcaacaatgataaatctggaaatgacgagaactatgacggtgggctgcttttcagctgggcaatgcaacaagttagtaatcacctcactactcttcaagttatgttaccaaacataacagaaggtgggtctctgtccaacattcttgaacaatgcatgtattgtgcaatgggtcttggcttagttggattggatttccgtggcctccttccaccaatctttgagaatgcggttctaaacttattctcaaagaatatgagtacagcggttgaaaattttcaggttgttttggattcacatcgttgggttccgatgccatctgttggctttgtagcaaatggagttgtcgatgatacttctgatgatgtgactccaccttctgttttaatggagcatccacctctcgcagtgtttgttaacggtgtttcagcagcaatgaatgagctaagaccgtgcgcaccgttgagcttgaaagtcgtccttgctcaggaggtggtcaaggcactacatgcagtctctgactccctagttagatacaaagccatgcggatgcttcgtgggaacgagtctgctctgttcctttcactctgccaggcatttatcgaggttgcatacccttattgcactgcatgttttggccgatgctacccgaatggagcaacattgatctctgagtgtcagggcacatttgatgctctccgtcagctattgaccgtgcctgcaagatctaacagttccagcatcgaaagaaggcagtcaggaggcatggaacgaaggcagtcaggaagcattgaaagaaagcagtctgttgagagcactgggacagcagtaactgataacgggctctcagccgatggacctgggctagagaccaacgatgctgttgcaaccaccaccccaccggtagaggacggtgtgagtacccatccactggcaagtaagtag

SEQ ID NO: 7378 - protein, 593 aa, Sorghum bicolor
  misc_feature: Ceres ANNOT ID no. 6075608
  misc_feature (22)..(370): Pfam Id: Dor1 Pfam Desc: Dor1-like family
  misc_feature (15)..(578): NCBI GI: 140066640 NCBI Desc: dor1-like protein [medicago truncatula]
  misc_feature (36)..(496): NCBI GI: 119603672 NCBI Desc: hcg2027080, isoform cra_b [homo sapiens]
  misc_feature (36)..(496): NCBI GI: 119603675 NCBI Desc: hcg2027080, isoform cra_c [homo sapiens]
  misc_feature (36)..(496): NCBI GI: 22653700 NCBI Desc: conserved oligomeric golgi complex component 8
  misc_feature (36)..(328): NCBI GI: 54645132 NCBI Desc: ga19631-pa [drosophila pseudoobscura]
  misc_feature: The sequence is a functional homolog of SEQ ID NO. 494 in the 11/188,298 US application
MELLDARHRHTPDSSSSPDAASDMGLPLAGAAYQPYVSELLSFSIERLHKEPELLRVDAERVRRQMQEVAVENYGAFIAASEALSFVRAQLESFDGHLEAMIEEIPNLTSGCTEFVESAQQILEERKLNQTLLANHTTLLDLLEIPQLMDTCIRNGNYDEALDLEAFVSKISKLHPDLPVVQGLAAEVKKTVQSLISQLLQKLRSNIQLPECLRIVAHLRRIGVFSESELRLQFLRCREAWLSGILEDLDQRNVYDYLKGMVTCHRVHLFDVVNQYRAIFNNDKSGNDENYDGGLLFSWAMQQVSNHLTTLQVMLPNITEGGSLSNILEQCMYCAMGLGLVGLDFRGLLPPIFENAVLNLFSKNMSTAVENFQVVLDSHRWVPMPSVGFVANGVVDDTSDDVTPPSVLMEHPPLAVFVNGVSAAMNELRPCAPLSLKVVLAQEVVKALHAVSDSLVRYKAMRMLRGNESALFLSLCQAFIEVAYPYCTACFGRCYPNGATLISECQGTFDALRQLLTVPARSNSSSIERRQSGGMERRQSGSIERKQSVESTGTAVTDNGLSADGPGLETNDAVATTTPPVEDGVSTHPLASK

SEQ ID NO: 7379 - DNA, 1101 bp, Sorghum bicolor
  misc_feature: Ceres ANNOT ID no. 6075628
  misc_feature: Encodes the peptide sequence at SEQ ID NO 7380
atgggcgcggcgggctccaggctggagaaggcgctgggcgagcagttccccgagggcgagcgctacttcggcctcgagaacttcggcaacacctgctactgcaacagcgtgctgcaggcactttatttttgtgttcctttccgtgatcaattgctggagtactatgcaaacaacaaaaacaccggagatgttgaagagaacatgctaacctgcctggctgatctgttctctcagatcagtaatcagaagaagaaaacaggggttattgctcctaagcgttttatacaacgattgaagaaacaaaatgagattttccgcagctatatgcatcaggatgctcacgagtttctgaattttttgctgaatgagctagttgacattctagagaaggaacataatgctgcaagagaacctcttcaaaatctcccattccaaaagaattcaaatggcactattgatggccaacccaatggtagtcacaaagaattagctgccacatgggttcataaatgcttccagggaatattgactaatgaaacaaggtgtctgagatgtgaaactgtgactgatagagatgaaacattttttgacctgagcctggacattgaacagaatagttcactcaccagctgtcttaagaacttcagctcaacagagactttgaatgctgaggacaagttcttctgtgacaaatgctgcagtttacaggaagcacaaaaaaggatgaagataaaaaaaccaccaaacatcctagtaattcatctcaaacggttcaagtatattgagcagcttcagcgctacaaaaaactatcataccgagtggttttcccactggagcttaaacttcttaacacagttgataattcggacttggaatactcccttttcgctgtggtagttcatgttggaagtgggccaaatcatggccactatatcagtttggttaagagccacaatcattggttattctttgatgacgagaacgttgagatgactgatgagtccatggtacaggcattctttggctcaccgcaagagttcagtggtaacactgataatggctacatactcttctacgaaagccttgctgaaagaagttga

SEQ ID NO: 7380 - protein, 366 aa, Sorghum bicolor
  misc_feature: Ceres ANNOT ID no. 6075628
  misc_feature (20)..(359): Pfam Id: UCH Pfam Desc: Ubiquitin carboxyl-terminal hydrolase
  misc_feature (1)..(366): NCBI GI: 115458702 NCBI Desc: os04g0452400 [oryza sativa (japonica cultivar-group)]
  misc_feature (1)..(362): NCBI GI: 18958042 NCBI Desc: at4g39910/t5j17_80 [arabidopsis thaliana]
  misc_feature (1)..(365): NCBI GI: 4567196 NCBI Desc: ubiquitin-specific protease 4 (ubp4) [arabidopsis thaliana]
  misc_feature (1)..(365): NCBI GI: 21593319 NCBI Desc: ubiquitin-specific protease 4 (ubp4) [arabidopsis thaliana]
  misc_feature (1)..(361): NCBI GI: 119625840 NCBI Desc: ubiquitin specific peptidase 46, isoform cra_b [homo sapiens]
  misc_feature (1)..(362): SWISSPROT Homolog: EC 3.1.2.15 Ubiquitin carboxyl-terminal hydrolase 3
MGAAGSRLEKALGEQFPEGERYFGLENFGNTCYCNSVLQALYFCVPFRDQLLEYYANNKNTGDVEENMLTCLADLFSQISNQKKKTGVIAPKRFIQRLKKQNEIFRSYMHQDAHEFLNFLLNELVDILEKEHNAAREPLQNLPFQKNSNGTIDGQPNGSHKELAATWVHKCFQGILTNETRCLRCETVTDRDETFFDLSLDIEQNSSLTSCLKNFSSTETLNAEDKFFCDKCCSLQEAQKRMKIKKPPNILVIHLKRFKYIEQLQRYKKLSYRVVFPLELKLLNTVDNSDLEYSLFAVVVHVGSGPNHGHYISLVKSHNHWLFFDDENVEMTDESMVQAFFGSPQEFSGNTDNGYILFYESLAERS

SEQ ID NO: 7381 - DNA, 1938 bp, Sorghum bicolor
  misc_feature: Ceres ANNOT ID no. 6075631
  misc_feature: Encodes the peptide sequence at SEQ ID NO 7382
atgggcaagatgaactgcttctccggcctgctcagcggcaagaggaaggcatccaagggtaagaacaagggcgcttacgtcaagaagggtagtggcaatgattgtcccaaggtgaagccggtggagttcatggacatggcggacactgttgtcgacgacgtcgtcagcagaggcggagacagcagcgttcctgcgtctgcatgcaacagtaggtttgtcgttcacgcagccgcccagctgccacgccatgccagtggcgagaatggcgacaaggccgcagctaagaaggagtcgtccgccgccgacgacgacctcgtcgccggcgttggctcctccggtcacagcagctacggaactggcaacagcgatgccaagagcaccgagccggacgacggcgagcgctccagccttggccgcatgtcgccaacggcatcgccgaagctgatgcgctcctgctccaacatcgagacgacgaggtctgtcgtcccggcagggtccgacctgccggcgaagtcgcgctcctacaacgacctgaagatcctgcctcccggaaggtcgaccgccgcccgcagcggcgcgatcgacgcgagcccgacggcgtccttcaggacctcgtgctccgccgaccgcgtcatgctgaagaagcggtcgtcgaggcaggtgctcccgtccaggagccggaagctgtggtggcagatgttcctctggagccaccgcaacctgcaccggccgggcgcgagcgcgaccatgcccacgctgctgccgccatcgccggggcaagaagaagaagaagaagaaggcggtgccgcgcaccagcacgacgggtacacgtccgacacgctgggcgcggtcaccgcggacgccaagaacaaaggcgtcgccatcgaggcggaccccattacgagccagtgggtcgcgttctccgccgaggcctcgccgctggaccgggtcagcgcgtgggtgaacagcctcggggacggctcgttccacgccgtcgacgaggacgatgccacggggcacggcagcggcggcgaaggcgccgctcgcccgcgacggcagcggtgctccgagatcgtggagctgtcgacggcgacggccggcggcaagaggaacccggaggcgaagcggcgcgcggcggacgaggctgcccaggcgagcggcatcgtgcagacgctcaacaccttctcctccgtcgcccacatcgccggcatggggctcaagaccgtcccgacgattgcggctttctcgaccctccgtgccgtcaatctgtctggaaacacgattgttgaaatcagcgctggatcgttgcccaaaggcctgcattcgctggatctgtcgaggaacaagattgcaatcatcgaggggctgcgggagctgacgaggctgcgggtgctcaacctcagctacaaccggatctcacggatcgggcatggcctgtcgagctgcacggcgatcagggagctgtacctggccgggaacaagatcagcgacgtggaggggcttcaccggctgctgaagctggccgtcctggacgtgagcttcaacaagatcaccacggccaagtccctgggccagctcgtggccaactacggctcgctgcgggcgatcaacctgctgggcaacccggtgcaggccaacaccggcgacgacacgctccgcaaggccgtgtcgggcctgctcccgcggatcgagtacctcaacaagcaggccgtcaagccgcagcgcgcgcgggaggtggccaaggacagcgtcgcgcaggcggcgctcgggaacgccggctggaactcgcggaggcggctcacgcggcgcctcagccagagccccgggtcggcggggaagggcggccggggcagggacggcaacggcaacggcagccgcaggggcagcaggagcaggtccatgaccaggccccagagctcgagcttgccaaggagatga

SEQ ID NO: 7382 - protein, 645 aa, Sorghum bicolor
  misc_feature: Ceres ANNOT ID no. 6075631
  misc_feature (271)..(643): NCBI GI: 79384765 NCBI Desc: protein binding [arabidopsis thaliana]
  misc_feature (271)..(643): NCBI GI: 8052541 NCBI Desc: f3f9.22 [arabidopsis thaliana]
  misc_feature (314)..(644): NCBI GI: 50508994 NCBI Desc: protein phosphatase regulatory subunit-like protein [oryza sativa (japonica cultivar-group)]
  misc_feature (417)..(582): NCBI GI: 116118440 NCBI Desc: ensangp00000031500 [anopheles gambiae str. pest]
  misc_feature (438)..(589): NCBI GI: 89297094 NCBI Desc: leucine rich repeat family protein [tetrahymena thermophila sb210]
MGKMNCFSGLLSGKRKASKGKNKGAYVKKGSGNDCPKVKPVEFMDMADTVVDDVVSRGGDSSVPASACNSRFVVHAAAQLPRHASGENGDKAAAKKESSAADDDLVAGVGSSGHSSYGTGNSDAKSTEPDDGERSSLGRMSPTASPKLMRSCSNIETTRSVVPAGSDLPAKSRSYNDLKILPPGRSTAARSGAIDASPTASFRTSCSADRVMLKKRSSRQVLPSRSRKLWWQMFLWSHRNLHRPGASATMPTLLPPSPGQEEEEEEGGAAHQHDGYTSDTLGAVTADAKNKGVAIEADPITSQWVAFSAEASPLDRVSAWVNSLGDGSFHAVDEDDATGHGSGGEGAARPRRQRCSEIVELSTATAGGKRNPEAKRRAADEAAQASGIVQTLNTFSSVAHIAGMGLKTVPTIAAFSTLRAVNLSGNTIVEISAGSLPKGLHSLDLSRNKIAIIEGLRELTRLRVLNLSYNRISRIGHGLSSCTAIRELYLAGNKISDVEGLHRLLKLAVLDVSFNKITTAKSLGQLVANYGSLRAINLLGNPVQANTGDDTLRKAVSGLLPRIEYLNKQAVKPQRAREVAKDSVAQAALGNAGWNSRRRLTRRLSQSPGSAGKGGRGRDGNGNGSRRGSRSRSMTRPQSSSLPRR

SEQ ID NO: 7383 - DNA, 1086 bp, Sorghum bicolor
  misc_feature: Ceres ANNOT ID no. 6075634
  misc_feature: Encodes the peptide sequence at SEQ ID NO 7384
atgccgctcgccggcattgccctcgcgcctctcctcgtctcacccctcgcgtcttcgcctcaccgtagcagcgttgccactgccgccgcgaggagaccaagagctctcaagcgagctcggtgctcggttacagccgcttccggtgaagccggtgagctgtcgcgcgcgacgctgctatggagggcggcaaagctacccatctactccgtggcgctagtgccactcaccgtagggagcgcttctgcttatcatcatgcgggtttattctttaccaagcgctattttgttctcctgacagcagcagtcctcgtgatcacttggctcaatctcagcaatgatgtttatgactcggatacaggggctgataagaacaagaaagaatctgttgtcagcattactggcagtcgagcaatgacacaaaatgccgcaaacatttccctattcctcggctttgcagggctattttgggcctttgcagaagccagggatatcagattcattttattggtgatgtctgcaatcttctgtggttatgtttaccagtgtcctccattccgattaagttatcaaggactaggtgagccattgtgttttgctgcatttggtccattggccaccacaggtttttacttctcaaacagcaacacaaatatttcaagcggaatggcacttctccctctcaccaaaacagttatagcttcgtctgttcttgttgggctgacaactactttgatactcttctgcagccatttccatcagattgatggagaccttgctgttggaaagatgtctccactggtaagaattggcactaaagcaggatcgcggatagtgtcaattgggattctcacgctttacattctcttggctgcatttggcttatgtagatctctcccaccagcttgcattgtcctctgtgcccttactctgcccatgggcaaattggttgtggactatgtgctgaaaaatcacgaggacaacacaaagatattcatggcgaagtactactgcgtgcgcttgcacgcgctgtttgggatggcactagcttcgggtttgttcttggcccgtaatggtatattatcctga

SEQ ID NO: 7384 - protein, 361 aa, Sorghum bicolor
  misc_feature: Ceres ANNOT ID no. 6075634
  misc_feature (68)..(353): Pfam Id: UbiA Pfam Desc: UbiA prenyltransferase family
  misc_feature (52)..(303): NCBI GI: 140039292 NCBI Desc: ubia prenyltransferase [medicago truncatula]
  misc_feature (67)..(356): NCBI GI: 45773758 NCBI Desc: at1g60600 [arabidopsis thaliana]
  misc_feature (59)..(354): NCBI GI: 126660337 NCBI Desc: 1,4-dihydroxy-2-naphthoate octaprenyltransferase [cyanothece sp. ccy0110]
  misc_feature (59)..(354): NCBI GI: 67921376 NCBI Desc: ubia prenyltransferase [crocosphaera watsonii wh 8501]
  misc_feature (43)..(351): NCBI GI: 16330622 NCBI Desc: 1,4-dihydroxy-2-naphtoic acid prenyltransferase [synechocystis sp. pcc 6803]
MPLAGIALAPLLVSPLASSPHRSSVATAAARRPRALKRARCSVTAASGEAGELSRATLLWRAAKLPIYSVALVPLTVGSASAYHHAGLFFTKRYFVLLTAAVLVITWLNLSNDVYDSDTGADKNKKESVVSITGSRAMTQNAANISLFLGFAGLFWAFAEARDIRFILLVMSAIFCGYVYQCPPFRLSYQGLGEPLCFAAFGPLATTGFYFSNSNTNISSGMALLPLTKTVIASSVLVGLTTTLILFCSHFHQIDGDLAVGKMSPLVRIGTKAGSRIVSIGILTLYILLAAFGLCRSLPPACIVLCALTLPMGKLVVDYVLKNHEDNTKIFMAKYYCVRLHALFGMALASGLFLARNGILS

SEQ ID NO: 7385 - DNA, 1146 bp, Sorghum bicolor
  misc_feature: Ceres ANNOT ID no. 6075639
  misc_feature: Encodes the peptide sequence at SEQ ID NO 7386
atggagaaccatggccccaaaccaatccgatgcaaagcggccgtgtgcagggccgccggcgagccgctggccatcgaggagatcgtcgtggacccgcccaaggagcacgaggtcaggataaggatcatctgcacgtcgctctgccacagcgacgtcacgttctggcgcatgaaggatttccctggcattttccccagaatatttggccacgaagccttcggggttgtggagagcgtcggcgagcacgtggaggagttcgccgcgggcgacgccgtggtgccgacgttcctggggcagtgcagcgagtgcgtggactgcaggtccgcgcggagcaacatgtgctccaagtaccggttcgcggtgcgcccggggatgccgcgcgacggcaccacccggttcagcgacgcccaggggcgcccgctccaccacttcctgggcgtgtccagcttcgccgagtacaccgtggtggacgtgaaccacgccgtcaaggtcaaccccgccatgccgccggcgctcgcctgcctgctcagctgcggcgcctccactggtgtcggagccgcatggaagctggcgaaagttgagcctggatcttcggtcgctatctttggcctcggcgctgtaggattggcggtagctgaaggagccaggatttgtggggcgtcaaagataataggcgtggatataaaccctgataaatatgaacttggcaagaagttcggcatgacacattttatcaatccaaaagaacttggcgagaaacctgtctaccaggcgatcgtcgagatgactgacggtggcgcggactactgcttcgagtgcattggactggcagcgctgatgaacgacgcatttcagagctcccgagaggggtggggcaagacgatcattcttggagtggaaatgcacggcgcccctctcgctgtctcttctcatgagatcctccgcgggaagtctgtcattgggtccatgttcggaggggtgaagcctaagcaggacattcccattctcgcagacaagtacctgaacaaggagctggagcttgacaagttcataacccatgaagttggcctcaatgacatcaatgaagcttttgacctgctgctccaagggaagagtgtcaggtgcaccatatggatggacaggtga

SEQ ID NO: 7386 - protein, 381 aa, Sorghum bicolor
  misc_feature: Ceres ANNOT ID no. 6075639
  misc_feature (195)..(338): Pfam Id: ADH_zinc_N Pfam Desc: Zinc-binding dehydrogenase
  misc_feature (35)..(164): Pfam Id: ADH_N Pfam Desc: Alcohol dehydrogenase GroES-like domain
  misc_feature (7)..(381): NCBI GI: 7705214 NCBI Desc: alcohol dehydrogenase adh [lycopersicon esculentum]
  misc_feature (7)..(380): NCBI GI: 144923670 NCBI Desc: alcohol dehydrogenase superfamily, zinc-containing [medicago truncatula]
  misc_feature (7)..(381): NCBI GI: 7705215 NCBI Desc: alcohol dehydrogenase adh [lycopersicon esculentum]
  misc_feature (2)..(380): NCBI GI: 92888659 NCBI Desc: alcohol dehydrogenase superfamily, zinc-containing [medicago truncatula]
  misc_feature (4)..(381): NCBI GI: 21618210 NCBI Desc: alcohol dehydrogenase-like protein [arabidopsis thaliana]
  misc_feature (3)..(380): SWISSPROT Homolog: EC 1.1.1.1 Alcohol dehydrogenase 1
  misc_feature: The sequence is a functional homolog of SEQ ID NO. 530 in the 11/188,298 US application
MENHGPKPIRCKAAVCRAAGEPLAIEEIVVDPPKEHEVRIRIICTSLCHSDVTFWRMKDFPGIFPRIFGHEAFGVVESVGEHVEEFAAGDAVVPTFLGQCSECVDCRSARSNMCSKYRFAVRPGMPRDGTTRFSDAQGRPLHHFLGVSSFAEYTVVDVNHAVKVNPAMPPALACLLSCGASTGVGAAWKLAKVEPGSSVAIFGLGAVGLAVAEGARICGASKIIGVDINPDKYELGKKFGMTHFINPKELGEKPVYQAIVEMTDGGADYCFECIGLAALMNDAFQSSREGWGKTIILGVEMHGAPLAVSSHEILRGKSVIGSMFGGVKPKQDIPILADKYLNKELELDKFITHEVGLNDINEAFDLLLQGKSVRCTIWMDR

SEQ ID NO: 7387 - DNA, 1509 bp, Sorghum bicolor
  misc_feature: Ceres ANNOT ID no. 6075659
  misc_feature: Encodes the peptide sequence at SEQ ID NO 7388
atggccagcacggcggagcgagccgacgaggaggaggaggcgtgccgggtggcgctgctggacgccggcgtgaagaaggaggagtggcaggtggtggtcggcggcggcggcgacggcgacggcggcaataataagcagcagctcgcggcgcgggtgtgggaggagtcgaggaagctgtgggacatcgtggcgccggccatcttcagccgcgtcgtcacctacagcatgaacgtcatcacgcaggccttcgccggccacctcggcgacctcgagctcgccgccatctccatcgccaacaccgtcgtcgtcggcttcagcttcggcctcatgctgggcatggcgagcgcgctggagacgctgtgcggtcaggcgttcggggccaagaagttccacatgatgggcgtgtacatgcagcggtcctggatcgtgctcttcctgtgcgcggtgctgctgctgcccatgtacttcttcgcggaggacgtgctgcttctgacggggcagtcgccggagctgtcggcgatggccggcaaggtctccgtgtggttcatcccgctccacttctccttcgccttcctcttcccgctgcagcggttcctgcagtgccagatgaagaacttcgccaacgccgccgcctccgccgtcgcgctggtaatccacatcttcgtcagctggctcttcgtctccaggttccagttcgggctcgccggcatcgcgctcacgctcaacttctcgtggtgggccaccggcgccatgctcttcgcctacgtctcctgtggagggtgccccgacacgtggcacgggttctcgctcgaggccttcgccggcatgtgggagttcgtcaagctctcctccgcctccggtgtcatgctctgcttggagaactggtactacaggatcctcgtcttgttgaccggaaacctaaaagatgcagctattgccgtcgacgctctctccatatgcatgacaattaacgggtgggagatgatgattccattggcgttcttcgcgggcaccggagtgcgcgtggccaacgagctcggcgccggcaacgggaagggagcccggttcgcgaccatcgtgtcgtcgatcacgtcgctggtgatcgggctcttcttctgggtgctcatcatgggtctccacgacaagttcgctctcatcttcacctccagctccgtcgtcctcgacgccgtcgacaacctctcggttcttctcgccttcaccatcctcctcaacagcatccagcccgtcctctcaggtgtggctgtgggctccggctggcaatccatggtggcctacgtcaacatcggctcctactacctcatcggcattcccttgggcatcctgctcggatggctcttcaaccttggcgtgctgggaatctgggcggggatgatcggcggaaccgccgtccagacgctcatcctggccatcatgacagtccgctgcgactgggaaaaggaggccatggtcgcgagcacgcgcatggacaacatgtcggaagttcggtga

SEQ ID NO: 7388 - protein, 502 aa, Sorghum bicolor
  misc_feature: Ceres ANNOT ID no. 6075659
  misc_feature (65)..(225): Pfam Id: MatE Pfam Desc: MatE
  misc_feature (285)..(448): Pfam Id: MatE Pfam Desc: MatE
  misc_feature (113)..(502): NCBI GI: 115451229 NCBI Desc: os03g0188100 [oryza sativa (japonica cultivar-group)]
  misc_feature (40)..(495): NCBI GI: 91806846 NCBI Desc: ripening-responsive protein [arabidopsis thaliana]
  misc_feature (43)..(471): NCBI GI: 12231296 NCBI Desc: ripening regulated protein ddtfr18 [lycopersicon esculentum]
  misc_feature (47)..(499): NCBI GI: 72384425 NCBI Desc: 4d11_27 [brassica rapa subsp. pekinensis]
  misc_feature (44)..(501): NCBI GI: 92893030 NCBI Desc: multi antimicrobial extrusion protein mate [medicago truncatula]
MASTAERADEEEEACRVALLDAGVKKEEWQVVVGGGGDGDGGNNKQQLAARVWEESRKLWDIVAPAIFSRVVTYSMNVITQAFAGHLGDLELAAISIANTVVVGFSFGLMLGMASALETLCGQAFGAKKFHMMGVYMQRSWIVLFLCAVLLLPMYFFAEDVLLLTGQSPELSAMAGKVSVWFIPLHFSFAFLFPLQRFLQCQMKNFANAAASAVALVIHIFVSWLFVSRFQFGLAGIALTLNFSWWATGAMLFAYVSCGGCPDTWHGFSLEAFAGMWEFVKLSSASGVMLCLENWYYRILVLLTGNLKDAAIAVDALSICMTINGWEMMIPLAFFAGTGVRVANELGAGNGKGARFATIVSSITSLVIGLFFWVLIMGLHDKFALIFTSSSVVLDAVDNLSVLLAFTILLNSIQPVLSGVAVGSGWQSMVAYVNIGSYYLIGIPLGILLGWLFNLGVLGIWAGMIGGTAVQTLILAIMTVRCDWEKEAMVASTRMDNMSEVR

SEQ ID NO: 7389 - DNA, 780 bp, Sorghum bicolor
  misc_feature: Ceres ANNOT ID no. 6075665
  misc_feature: Encodes the peptide sequence at SEQ ID NO 7390
atgaatccgcccgcagcagccgcgtccaccggcggaggaggccacgccgcgccgccagcggcagcccaggcgtacgcgccgtacccgaggctctcgccggatgaggtggccccgcctccgccaccgccttatcacgccgccaccgccgcgccgtccgcctacggaggcaacccctacatctcttcccccgccggcggcgccgcgaccgccccgaagaatacgatggactccgtcaaggatgtgctcggcaagatgggaaagaggttcggcgaggcggcccgcaagaccgagaccatcaccggcaacttctggcagcacttgaaaactggaccaagcattactgatgcagcaatgagcaggatctcccaggtcactaaagtcattgcagaaggtggatatgataaaattttccatcaaacttttgaggtcgcccctggtgaaaagctcaagaagccatatgcatgttatttgtcaacctcagctggtcctgttatgggtgtactttacctatccaatgtaaaactggcattctgcagtgataatccgcttgcataccaggttggagacaaaactgagtggagctactacaaggtggtcatcccccttgctcaactgcgatcaattaattcatcaacaagcagaacaaacgcagcagagaaatacattcaggtggtttctgttgataaccatgagttttggtttatgggcttcgtgtactacgacagtgcagtaaagaatctgcaggaagcacttcaggaggctcagaatttgtgtgcttaa

SEQ ID NO: 7390 - protein, 259 aa, Sorghum bicolor
  misc_feature: Ceres ANNOT ID no. 6075665
  misc_feature (135)..(212): Pfam Id: GRAM Pfam Desc: GRAM domain
  misc_feature (32)..(201): NCBI GI: 42570873 NCBI Desc: gram domain-containing protein / aba-responsive protein-related [arabidopsis thaliana]
  misc_feature (57)..(256): NCBI GI: 140038631 NCBI Desc: gram [medicago truncatula]
  misc_feature (93)..(255): NCBI GI: 38454154 NCBI Desc: at5g13200 [arabidopsis thaliana]
  misc_feature (13)..(231): NCBI GI: 4103635 NCBI Desc: aba-responsive protein [hordeum vulgare]
  misc_feature (118)..(240): NCBI GI: 9581889 NCBI Desc: tel1s.3 [arabidopsis thaliana]
  misc_feature: The sequence is a functional homolog of SEQ ID NO. 430 in the 11/188,298 US application
MNPPAAAASTGGGGHAAPPAAAQAYAPYPRLSPDEVAPPPPPPYHAATAAPSAYGGNPYISSPAGGAATAPKNTMDSVKDVLGKMGKRFGEAARKTETITGNFWQHLKTGPSITDAAMSRISQVTKVIAEGGYDKIFHQTFEVAPGEKLKKPYACYLSTSAGPVMGVLYLSNVKLAFCSDNPLAYQVGDKTEWSYYKVVIPLAQLRSINSSTSRTNAAEKYIQVVSVDNHEFWFMGFVYYDSAVKNLQEALQEAQNLCA

SEQ ID NO: 7391 - DNA, 1809 bp, Sorghum bicolor
  misc_feature: Ceres ANNOT ID no. 6075667
  misc_feature: Encodes the peptide sequence at SEQ ID NO 7392
atgtcagaggaggacgaggaccagccgccgcccaagcgtcccaccagcgcgtcgccctcgccgaccgcggaccaggtgctcgacaacgtgctcgagacggtgctccagttcctggacgccccgcgggaccggagcgccgcctccctcgtctgccgctcctggcaccgcgccgagtccgccacccgcgactccgtcgccgtccgcaacctcctcgccgcctcggccacccgcaccgcgcgccgcttccccaacgccaggagcctcctcctcaagggccgcccgcgcttcgccgacttcaacctcctcccgcacggatgggacgcctccgccttccgaccctgggccgccgccgtcgccgccgggtccttccccgcgctcgcctcgctctacctcaagcgcatccccgtcacggacgccgacctcgacctcctctcccgctccctcccggcgtcattccgcgacctcaccctgcacctctgcgacggcttcacctcgcgcgggctcgcctccatcgcctcccattgcagcggcctgcgagtgctcgacgtggtggagtgcgacatggccgaggagcaggagggggtcgtggactgggtggccgcgttcccgccggagcccaccaaccttgagtcgctctccttcgagtgctacgagccgcccgtggacttcgacgcgctcgaggcgcttgtggcgcggtccccgctcctcaaccgcctgggggtcaacatgcacgtctcgctcggccagctgcgccgcctcatggcgctcgcgccgcgcttgtcgcacctgggcaccgggtccttccgcccggcggatggcggcgaggagggggcaggattcggggaggttttctctgcattcgtgtccgctggacgagcgcgcacgcttgtttctctctccggcttccgtgacctcgcgcaagagtacctgccgaccatcgccgtggtgtgcgcccacttgaagagccttgacttaagctacaccgcggtcaccccgaatcagattctcatgttcattggccaatgctacaaccttgagacactatgggtacttgactcggtgcgtgacgaagggctcgagtccgtgggaatgtcttgcaagaagctccaatctcttcgtgtgctcccgttgaatgcacgtgaggatgccgacgagttggtatcagaggttggccttactgccatctcacggggctgccctgctctccgttcgatattatatttttgccagacgatgaccaatgctgctgttatcgccatgtcgcgcaactgcccggagctcaaggtattccggttatgtataatgggacggcaccagccggaccacgcgactggggagcctatggatgaaggattcggtgccattgttcagaattgcagcaagcttaccaggctatccacgtcggggcaacttactgaccgggcatttgagtacattggcaggtatggcaagtccctgcggacgctctctgtagcgtttgctggaaacagcgatgtggcgctgcaatacatcctccagggctgttcaaagctagagaagcttgagataagggactgccctttcggtgatgctggcctcctctctgggatgcatcatttctataacatgcggttcgtctggatgtcaggctgcaacctgaccctgcaagggtgcaaggaggtggctcagggtctaccacgaatggtggtggagttgataaatggccagcctgatgagaaagaaaggaatgaaagtgtggacatcttatacatgtatcgttcactcgatggtccaagggaagatgtgccaccatttgtgaagatcctgtga

SEQ ID NO: 7392 - protein, 602 aa, Sorghum bicolor
  misc_feature: Ceres ANNOT ID no. 6075667
  misc_feature (9)..(602): NCBI GI: 13249030 NCBI Desc: f-box containing protein tir1 [populus tremula x populus tremuloides]
  misc_feature (13)..(602): NCBI GI: 30102460 NCBI Desc: at4g24390/t22a6_220 [arabidopsis thaliana]
  misc_feature (13)..(602): NCBI GI: 7269289 NCBI Desc: transport inhibitor response-like protein [arabidopsis thaliana]
  misc_feature (28)..(602): NCBI GI: 92887633 NCBI Desc: cyclin-like f-box [medicago truncatula]
  misc_feature (28)..(599): NCBI GI: 110225915 NCBI Desc: auxin-responsive factor tir1-like protein [populus tomentosa]
MSEEDEDQPPPKRPTSASPSPTADQVLDNVLETVLQFLDAPRDRSAASLVCRSWHRAESATRDSVAVRNLLAASATRTARRFPNARSLLLKGRPRFADFNLLPHGWDASAFRPWAAAVAAGSFPALASLYLKRIPVTDADLDLLSRSLPASFRDLTLHLCDGFTSRGLASIASHCSGLRVLDVVECDMAEEQEGVVDWVAAFPPEPTNLESLSFECYEPPVDFDALEALVARSPLLNRLGVNMHVSLGQLRRLMALAPRLSHLGTGSFRPADGGEEGAGFGEVFSAFVSAGRARTLVSLSGFRDLAQEYLPTIAVVCAHLKSLDLSYTAVTPNQILMFIGQCYNLETLWVLDSVRDEGLESVGMSCKKLQSLRVLPLNAREDADELVSEVGLTAISRGCPALRSILYFCQTMTNAAVIAMSRNCPELKVFRLCIMGRHQPDHATGEPMDEGFGAIVQNCSKLTRLSTSGQLTDRAFEYIGRYGKSLRTLSVAFAGNSDVALQYILQGCSKLEKLEIRDCPFGDAGLLSGMHHFYNMRFVWMSGCNLTLQGCKEVAQGLPRMVVELINGQPDEKERNESVDILYMYRSLDGPREDVPPFVKIL

SEQ ID NO: 7393 - DNA, 2175 bp, Sorghum bicolor
  misc_feature: Ceres ANNOT ID no. 6075671
  misc_feature: Encodes the peptide sequence at SEQ ID NO 7394
atggacgaggcggagaagctgaggtggcccttctcggacggcagcgtcaccgatctcctggacgctcgcagcctccacggctcccccggtcatgcaggttgtgtgaatgctatcgcgtggaactcaagtggttcgcttcttgtatcaggatcagatgacactagaattaacatctggaattataataaccgagagctggtgcatgatattgacactggccattctgcaaatatcttttgcacaaagtttgtcccagaaacatgtgacgaagtagtagtctctggagcaggagatgcagaggttcgtgttttcaatatgtctcgattaagtggaagaaggcctagagaaatttctatggaaccaacagcggtttaccagtgtcactcgagaagggtcaagaaactagctgttgaagttggcaatcctaatgtagtgtggagtgcaagcgaggatggtactctaagacagcatgattttcgggagtgtagttcctgtcctcgtgcaggatctgctaaccaggaatgccgtaatgtgcttcttgatctacgatgtggagcaaagaagtctttagctgatctacccaaacatcctttggcactgaagtcttgtgacattagctctgtttgtccccatcaaatccttgttggtgggagcgatgcatttgctaggctgtacgataggagaatgcttccaccattgagctcatgtcaaaccaaaaggaagccaccgacatgcgttaaaatgttctgcccattgcatcttgctgacagtaagaagacatatttgcaccttacacatgttgcattcagcccaaatgggaaggaggttcttttaagttacagtggtgaacatgtttatctgttcgatgttgacccagataatatgagttcagttagatacacagcagactatgtacgggaacaattatttgtaccccctttccacaaagtaccaacaaaagaacatgcaaaagaaaagaagccttcagtaaatacaacttcaagaaatttgtctagggtagatatgtgcaagaaatttatgcaagtcgcagcaagatctctggagacaagcaagaacttaatgcgtgggattgaagcatgcagtgaagttcttgaatcaatgaaacctgatattgatgatgacatgaggcatgaatttttgtgtactcgagcagcattgtacctaaagaggaagtggaaaaatgatgtttacatggcgattcgagattgcaatagagcgcggaagattgatgccacatcatatcaagcacacttacatatggctgaggcactattgcagttaggaagactgaaggaggcatctgagtatgcagaggtggcaaatagtcttcttccacctcattgtcaattgagtgagcaggtggatgatttcaagcaacgtgttgcttcagctgagcttgagaagaacagaacagatcaaaatgggaactccaaagctgatactaatggaaaattacgctcattgagtgatatattatttagacccgatgttggtggttcctcacaggagggacgagaagattcagattatgatgatgaaatggaattggactatgagacatcggtatctggtgatgaaagccgagagaatgatcaaggtgttttccggggtagtttaagtttccgatttcatcaaagagaggatcaaaccaatgaacacactgatgagaatgggttaattgagtctgctcaaaccgatgattctgcttttcagtcagatgttgccattgatatgaaacaaagatatgttgcacactgcaatgtagggacagatataaaacaagccagctttcttggcgagcaaggggagttcattgccagtggaagtgatgatggtagatggttcatatgggagaagagaacaggaaggcttattaaaatgcttgcaggggatggagctgtcgtgaactgcatacagtctcatcccttcgattgtgctgttgcaacaagcggaatcgataacacgataaagctatggacacctgatgcaaatgctacatctatggttgctggaccagaacttgatgtattaagtgccatagagaataatcagcggaagttatgtcggaaccgtcaaattgtactgccttttgaatttttggaacgattccggatgcatgagttttctgaaggtttcgagtgtgcccagagctga

SEQ ID NO: 7394 - protein, 724 aa, Sorghum bicolor
  misc_feature: Ceres ANNOT ID no. 6075671
  misc_feature (22)..(60): Pfam Id: WD40 Pfam Desc: WD domain, G-beta repeat
  misc_feature (629)..(667): Pfam Id: WD40 Pfam Desc: WD domain, G-beta repeat
  misc_feature (339)..(724): NCBI GI: 115451215 NCBI Desc: os03g0187300 [oryza sativa (japonica cultivar-group)]
  misc_feature (30)..(290): NCBI GI: 47122830 NCBI Desc: mgc78868 protein [xenopus laevis]
  misc_feature (30)..(290): NCBI GI: 38014437 NCBI Desc: mgc68614 protein [xenopus laevis]
  misc_feature (30)..(172): NCBI GI: 108884775 NCBI Desc: wd and tetratricopeptide repeat protein [aedes aegypti]
  misc_feature (30)..(205): NCBI GI: 116128148 NCBI Desc: ensangp00000000953 [anopheles gambiae str. pest]
MDEAEKLRWPFSDGSVTDLLDARSLHGSPGHAGCVNAIAWNSSGSLLVSGSDDTRINIWNYNNRELVHDIDTGHSANIFCTKFVPETCDEVVVSGAGDAEVRVFNMSRLSGRRPREISMEPTAVYQCHSRRVKKLAVEVGNPNVVWSASEDGTLRQHDFRECSSCPRAGSANQECRNVLLDLRCGAKKSLADLPKHPLALKSCDISSVCPHQILVGGSDAFARLYDRRMLPPLSSCQTKRKPPTCVKMFCPLHLADSKKTYLHLTHVAFSPNGKEVLLSYSGEHVYLFDVDPDNMSSVRYTADYVREQLFVPPFHKVPTKEHAKEKKPSVNTTSRNLSRVDMCKKFMQVAARSLETSKNLMRGIEACSEVLESMKPDIDDDMRHEFLCTRAALYLKRKWKNDVYMAIRDCNRARKIDATSYQAHLHMAEALLQLGRLKEASEYAEVANSLLPPHCQLSEQVDDFKQRVASAELEKNRTDQNGNSKADTNGKLRSLSDILFRPDVGGSSQEGREDSDYDDEMELDYETSVSGDESRENDQGVFRGSLSFRFHQREDQTNEHTDENGLIESAQTDDSAFQSDVAIDMKQRYVAHCNVGTDIKQASFLGEQGEFIASGSDDGRWFIWEKRTGRLIKMLAGDGAVVNCIQSHPFDCAVATSGIDNTIKLWTPDANATSMVAGPELDVLSAIENNQRKLCRNRQIVLPFEFLERFRMHEFSEGFECAQS

SEQ ID NO: 7395 - DNA, 3603 bp, Sorghum bicolor
  misc_feature: Ceres ANNOT ID no. 6075672
  misc_feature: Encodes the peptide sequence at SEQ ID NO 7396
  misc_feature: Up-regulated in root tissues in response to salicylic acid treatment
atgtacaagctcggcggccgtggcggtgggcgcggcggcagcggcgcggcaaagcgcccgccgcctccccacggccgcggccggggcggcgcctcctctatcggcgggatgtccggggctccccgcggtcgcgccgccgccgccacgcagccggcggggcgcgacgaggcgttcagcctcgagtccagcgggccgcccgccttcgcggctataatacggctgacgcccgacctcgtcgacgagatccggcgggcggaggaggccggtggaggcgcacgcatcaagttcaaccctaacatgtacaactcgtcggaaaacgttatagatgttagtggtaaagaattcaaattcacctgggcatctgaacgtggggaattgtgtgatatttatgaagaacgtcagagtggagaggatggaaatgggttgcttctggagtgtggctctgcttggcgcaaggtgaatgtgcaacgcattttggatgaatcaacaaagaaccttgtgaaaatgcgctcagaggaggctgaacgtctctcaaaatctcgaaaatcaatcgtgctggatcctgccaatccatctgtcaagagtcaggccaagtcaatggctgctgctgctgtagaaggtaatccacgaaggatgcactggaagcagaagaatgaattttttaagaagaataaagctgctgttatcaccccaaccaaatcagtttccaaggtgaagttatctaacaatattcccaaagggaatatctcaagttcacctgcaccttctcctgaacaacctggagcaagcaatccttcgtttcctgttggatcagatgcaaataatgaagtcataacaccttatgatttgaacaaaggggaaaacagtaaatatgagaaatcagctgcaagtaagatgtctaacaaaggtataaatcgccgagcaagttctcatgctgcaaatgtggatgataataatacaaatgaagtacgaagctacttgatatctgtgctctcaaaaaatccaaaaggaatgggcctaaaggccttggagaaagctgctgcagatgcatttccaaatgcaacaaagaaaatagagagcgtcgtcaagaatattgcaaattaccaaggacctgagaggtatgttctcaaaccagggttggaggtagaaagctctaaaaggcatccatctgaaggagtaagcagatccatcagtgagaacattgaggaatctgctccaagcctaaagattgatgatcctgatatatgtgagaggattgacattgtgggctccccacttgctgcaacagatggaaaactcagtaatgacagtgaaggtaaggctggaacttccagtgacagtggaagtgatagcgatagcgatagtgacagcagtgacagtggaagtgatagtgggagccaaagcagaagtgctgcagaaactggtagcgggagcagcagtgatagtgacagtgatgcctcatcaagcagtaaggaaggatctgatgcaattgttgatattacaagtgatgatgacaaaggaaatacagcacatacaaaagtagtagatgaccttaatttgtcttcatcaccaagagatttgacaagacttgatgttgatgatgaacaaattgacattggaacaaatcttgactacaggagtacatcaccccatattgatctgaataattttaatactggcaatgatgatgcagcagcagagggctttagtgctggcaacctgaacaagccatctgaaatgccgggaagcaagaacatgacaagcaccagaatagattctataggaggcgataacaagtataatgaaatgtcttttctggacaacctttttgatgactccatgagaacagccagtgaaaattcacccaagggggaagctggtcaattgagaccgcagcatggcaacaagagaaaatcaacatcaaaggatgaatcaaaactcggcccagtgagtattgccaaacccaaattgaaaaggtcttctggtagtgagaactccacagcaaagcctgagagtgccaaaaaggtcaaagctgacatagcatcgccaataggttctttatcagagcacaaaagaagtttaccccctgaaaaacataccagtgataggttgaacaaggagacagggaatgttagccgcgatgcttcacgggatagcagtcctggcatgaaaggaagaccttcggctcctggaaatttacagaggatagatcagagcccaaatttacctgtcccaacaatgcactctgagaaaacaaaagaaaatactgtgaaatcaagttcgaagaaaaaatcagataagatgcagaaaccatggcatggtatggatggtgactttgggccaggttattcacatggtgtagatcaccatgccaattttgatggctctgatgattcttccacaagaaaaaggagtagacatgggaatcctcttattgatgataaaatgcttaagcgctcgaaggacgttaatgtcaatgtaaattccatgaatttaaccaaagtttccagagaaattgttgtgcctgatgagataactgcttttcctgaatctaacgaaagtaatggtgagccatcaaattcacaaagagataatgttgagagatcaccttatggtaaaaaaaagctccagagagagctctctgatcttgagttgggtgaacttcgtgagacttctttggaaaatgatgatggaaggataaggaagcaatttgagagaaatagttcctccaagtcgcttgatgctaaattaactagtgtaaataactcctaccccagtatgaatgacaggaaggctcctgcaactgtctttcatgataagaggaaaccttcacctcaagaatatggaattggaggccatatacagcaggaagggtttcccaggaaggcagcagggtatgagtttgatgataataggcctcagcaaagagaaaattttccagacaaccagcatttgccaaggattgataattcagattctgagaacgtaatatatccagatagatcaggagaaaaaacaagcaaaagggaaactaggattgcacacggtggaatgctagaatatgctgatatgcagaagaagaaatcaacctcaaggcttccacagaatggtactaataatgtcatggtgtctcgaatgcagaaatcaatatccccatcagataatgaggaaaggagtaggaataactctttgattgagacagaggcaggtaggaagagaagggacagttcttcagatgatgataatttatttttctccaagtatgataaagatgcacccgaacttaaaggtccaataaaagattactcacaatacaaagattatgtgcaggaatacaatgagaagtatggggtttattcttacttgaacagtcagatagacaaaactaagtcggaatttttaaaggttcaggatgatctcaatgttgcgaaagaaagagacaaggaacagtattataacactgtggaaagactcagagacatgtatcgtgaatcaggagcaaggcataaattgatgaagaaggtcttcattttacttcacgaggaactgcagattattaagcaaagaattaaagattttacagaggcctattcaaatgagtag

SEQ ID NO: 7396 - protein, 1200 aa, Sorghum bicolor
  misc_feature: Ceres ANNOT ID no. 6075672
  misc_feature (5)..(633): NCBI GI: 18402946 NCBI Desc: dentin sialophosphoprotein-related [arabidopsis thaliana]
  misc_feature (246)..(922): NCBI GI: 4322670 NCBI Desc: dentin phosphoryn [homo sapiens]
  misc_feature (246)..(953): NCBI GI: 119626398 NCBI Desc: dentin sialophosphoprotein, isoform cra_a [homo sapiens]
  misc_feature (246)..(1082): NCBI GI: 89001107 NCBI Desc: dentin sialophosphoprotein preproprotein [homo sapiens]
  misc_feature (147)..(1078): NCBI GI: 116491877 NCBI Desc: subtilisin-like serine protease [pediococcus pentosaceus atcc 25745]
  misc_feature: Up-regulated in root tissues in response to salicylic acid treatment
MYKLGGRGGGRGGSGAAKRPPPPHGRGRGGASSIGGMSGAPRGRAAAATQPAGRDEAFSLESSGPPAFAAIIRLTPDLVDEIRRAEEAGGGARIKFNPNMYNSSENVIDVSGKEFKFTWASERGELCDIYEERQSGEDGNGLLLECGSAWRKVNVQRILDESTKNLVKMRSEEAERLSKSRKSIVLDPANPSVKSQAKSMAAAAVEGNPRRMHWKQKNEFFKKNKAAVITPTKSVSKVKLSNNIPKGNISSSPAPSPEQPGASNPSFPVGSDANNEVITPYDLNKGENSKYEKSAASKMSNKGINRRASSHAANVDDNNTNEVRSYLISVLSKNPKGMGLKALEKAAADAFPNATKKIESVVKNIANYQGPERYVLKPGLEVESSKRHPSEGVSRSISENIEESAPSLKIDDPDICERIDIVGSPLAATDGKLSNDSEGKAGTSSDSGSDSDSDSDSSDSGSDSGSQSRSAAETGSGSSSDSDSDASSSSKEGSDAIVDITSDDDKGNTAHTKVVDDLNLSSSPRDLTRLDVDDEQIDIGTNLDYRSTSPHIDLNNFNTGNDDAAAEGFSAGNLNKPSEMPGSKNMTSTRIDSIGGDNKYNEMSFLDNLFDDSMRTASENSPKGEAGQLRPQHGNKRKSTSKDESKLGPVSIAKPKLKRSSGSENSTAKPESAKKVKADIASPIGSLSEHKRSLPPEKHTSDRLNKETGNVSRDASRDSSPGMKGRPSAPGNLQRIDQSPNLPVPTMHSEKTKENTVKSSSKKKSDKMQKPWHGMDGDFGPGYSHGVDHHANFDGSDDSSTRKRSRHGNPLIDDKMLKRSKDVNVNVNSMNLTKVSREIVVPDEITAFPESNESNGEPSNSQRDNVERSPYGKKKLQRELSDLELGELRETSLENDDGRIRKQFERNSSSKSLDAKLTSVNNSYPSMNDRKAPATVFHDKRKPSPQEYGIGGHIQQEGFPRKAAGYEFDDNRPQQRENFPDNQHLPRIDNSDSENVIYPDRSGEKTSKRETRIAHGGMLEYADMQKKKSTSRLPQNGTNNVMVSRMQKSISPSDNEERSRNNSLIETEAGRKRRDSSSDDDNLFFSKYDKDAPELKGPIKDYSQYKDYVQEYNEKYGVYSYLNSQIDKTKSEFLKVQDDLNVAKERDKEQYYNTVERLRDMYRESGARHKLMKKVFILLHEELQIIKQRIKDFTEAYSNE

SEQ ID NO: 7397 - DNA, 2121 bp, Sorghum bicolor
  misc_feature: Ceres ANNOT ID no. 6075675
  misc_feature: Encodes the peptide sequence at SEQ ID NO 7398
atgccgccacgcgcggtgctccgccgccttctccccacacacatccaccaccccgccgctcgccgcgctccgcgtcaggcgccgcctccggcttcagcgaccaacgagggaccccttcccgacccgaatgcgctcctcgtccacgaccccatcgacctgctctcctccctgtggcgccgcgcgttcgcgcacccgctcccctccccgttcccgaacctctccggctacgcctcccgcctcgacctttggctcctctcctaccagcgtgcctgcgcccatgccacgggcaccttcccgccacgccacgccgtcccgctcctcactctccactccctcctccgcctccgcgccgccgcgctccgccgccaccccgccttcccctggggcgcatccacgcacctcctcctccgttcccccgccgacaagccctccaccgtcccgatctcccgccgcaagctcgaggcccggttcgcggacgcgccgccgccgttccaggaccgcgtcgtccaggagctcctcctcctcctccttgaaccagtcttcgagccgcgcttctcccctaagtctcatgccttccgccccggtcgcgggccccacagcgccatccgctctgttcggtctcgctttgccgcctacctctggttcgtctccgccgacctcacggcggtggtcgacgggctctcgccggacaccatcctgtcatgcgtccagaaggccgtctccgaccgtaaggtgctgtcattgctcaagtccgcgctcaacgcccctgtccggcctgggtctgtaccgccaacggagaaggacctcgatgggctgaccaagaagaggctgaaaaggaaggtgctcaggaagagcaggaagaagaaggtgcttaacgagaatgagccgaagcctgacccatattggttgaggatgttctttgggtttgctccagaacaggcatgccatgtgccgaattatggacattgtgggataatcagtcctttgcttgccaatgtgtgccttaacgagttggattggtggatggaggagaaaattaaccagtacttttgcccatccaaacatgattcaatttggaaggaggtgggtgatgatgggtgccacaatcccgcttggcctgagttcgtcccgtcagctgggaaggagaagacaaggaagatggatttccttcgatttggttcccatgtcttgattgggatcagggggccgagggaggatgcagttgagataaggagacaactgatggaattttgtgagagaacatttggtttaaggccagagaattcgatggtggaaattgagcatatcacaagggggattgaattcttggatcatgtgatcacgcgcagggtcatctacccaaccttgcgatatactgccagtggagggaacattgtcagcgagaagggtgtcggaacactgttgtctgtaacagcgagcctgcagaggtgcataagacatttcaggaagcttgagcttgtaaagggggacagggatcctgagccattgccatgctcaccgatgctgtactctgggcaggcacacactaattcccagatgaacaagtttcttgagacaatggctgattggtacaggtatgcagataaccggaaaaagattgtagggttctgtgcttatgtcataaggagttcactagcaaagctctacgcggcaagatatagactgaagtctcgagctaaggtctacaagattgcttcacgggatcttagccgtcctttgagagaaagcacaaggaatgatgcaccagaatactctgatcttttgaggatgggactagttgattttattgaaggtgtacaatttgcacgcatgtcatcgattccatcgtgtgactacacacctttccctaggaactgggtgccacaccatgaacttatattgcaagagtatattaagctgcaagatccaaagttcttttgtgaacttcacaagactatcaagcgtcaggaaataagttcaccacaggatgacatatcaaagatggtgtggtattataaagttcatggtgtttatgatgacaaaagatccttggttggcgccaaggaattgagaaatggtgaagttatcaatgggaacaagcaacttctattggatacatag

SEQ ID NO: 7398 - protein, 706 aa, Sorghum bicolor
  misc_feature: Ceres ANNOT ID no. 6075675
  misc_feature (472)..(618): Pfam Id: Intron_maturas2 Pfam Desc: Type II intron maturase
  misc_feature (140)..(447): Pfam Id: RVT_1 Pfam Desc: Reverse transcriptase (RNA-dependent DNA polymerase)
  misc_feature (99)..(704): NCBI GI: 115488292 NCBI Desc: os12g0407300 [oryza sativa (japonica cultivar-group)]
  misc_feature (442)..(685): NCBI GI: 27764956 NCBI Desc: at5g46920/mqd22_6 [arabidopsis thaliana]
  misc_feature (277)..(580): NCBI GI: 786218 NCBI Desc: coxii intron2 orf [marchantia polymorpha]
  misc_feature (317)..(649): NCBI GI: 23505442 NCBI Desc: orf786 [schizosaccharomyces octosporus]
  misc_feature (166)..(255): NCBI GI: 2760356 NCBI Desc: rt-like protein [venturia inaequalis]
MPPRAVLRRLLPTHIHHPAARRAPRQAPPPASATNEGPLPDPNALLVHDPIDLLSSLWRRAFAHPLPSPFPNLSGYASRLDLWLLSYQRACAHATGTFPPRHAVPLLTLHSLLRLRAAALRRHPAFPWGASTHLLLRSPADKPSTVPISRRKLEARFADAPPPFQDRVVQELLLLLLEPVFEPRFSPKSHAFRPGRGPHSAIRSVRSRFAAYLWFVSADLTAVVDGLSPDTILSCVQKAVSDRKVLSLLKSALNAPVRPGSVPPTEKDLDGLTKKRLKRKVLRKSRKKKVLNENEPKPDPYWLRMFFGFAPEQACHVPNYGHCGIISPLLANVCLNELDWWMEEKINQYFCPSKHDSIWKEVGDDGCHNPAWPEFVPSAGKEKTRKMDFLRFGSHVLIGIRGPREDAVEIRRQLMEFCERTFGLRPENSMVEIEHITRGIEFLDHVITRRVIYPTLRYTASGGNIVSEKGVGTLLSVTASLQRCIRHFRKLELVKGDRDPEPLPCSPMLYSGQAHTNSQMNKFLETMADWYRYADNRKKIVGFCAYVIRSSLAKLYAARYRLKSRAKVYKIASRDLSRPLRESTRNDAPEYSDLLRMGLVDFIEGVQFARMSSIPSCDYTPFPRNWVPHHELILQEYIKLQDPKFFCELHKTIKRQEISSPQDDISKMVWYYKVHGVYDDKRSLVGAKELRNGEVINGNKQLLLDT

SEQ ID NO: 7399 - DNA, 693 bp, Sorghum bicolor
  misc_feature: Ceres ANNOT ID no. 6075684
  misc_feature: Encodes the peptide sequence at SEQ ID NO 7400
atggccgggaagagggagcggatagcgatccggaggatcgacaacctggcggcgaggcaggtgaccttctccaaaaggcggcgggggctgttcaagaaggccgaggagctctccatcctctgcgacgccgaggtcggcctcgtcgtcttctccgccaccggcaaactcttccacttcgccagcaccagcatgaagcaggtaatcgatcggtacgactcccattccaagaatctccaaaagtctgaagcgccgtctcagctgcagtcacatattgatgatggcacttgtgcaaggctaaagcaggagcttgctgaaaccagccttaagctcaggcagatgagaggagaggagctccagaggctgagcgtccaacagctgcaagagcttgagaagaccctcgaatctggcctcggctctgtactcaaaaccaagagccaaaaaatccttgacgagatcagcggtctggaaagaaagagaatggaactgatcgaggagaattcaaggctgaaggagcaagtgacccggatggcaaggatggagacgcagcttggcgtcgattcagaaattgtgtatgaggaagggcagtcatctgaatctgtgacaaacacatcctatccgcgcccatcaacagacactgacgactgctccgatacatcgctcaggctagggctaccattcttcagctcgaagtga

SEQ ID NO: 7400 - protein, 230 aa, Sorghum bicolor
  misc_feature: Ceres ANNOT ID no. 6075684
  misc_feature (11)..(61): Pfam Id: SRF-TF Pfam Desc: SRF-type transcription factor (DNA-binding and dimerisationdomain)
  misc_feature (71)..(175): Pfam Id: K-box Pfam Desc: K-box region
  misc_feature (3)..(224): NCBI GI: 33621117 NCBI Desc: transcription factor mads47 [oryza sativa (japonica cultivar-group)]
  misc_feature (3)..(224): NCBI GI: 12964064 NCBI Desc: mads box transcription factor [oryza sativa]
  misc_feature (3)..(224): NCBI GI: 91207152 NCBI Desc: mads-box transcription factor 47 (osmads47)
  misc_feature (3)..(224): NCBI GI: 33621119 NCBI Desc: transcription factor mads47-2 [oryza sativa (japonica cultivar-group)]
  misc_feature (1)..(230): NCBI GI: 71025328 NCBI Desc: mads14 [lolium perenne]
  misc_feature: Abnormal phyllotaxy, leaf number higher than wild-type
  misc_feature: The plant flowers significantly earllier than wild-type.
  misc_feature: The sequence is a functional homolog of SEQ ID NO 12 in the 10/225,066US patent application
  misc_feature: The sequence is a functional homolog of SEQ ID NO 122 in the 10/225,066US patent application
  misc_feature: The sequence is a functional homolog of SEQ ID NO 1889 in the 11/479,226US patent application
  misc_feature: The sequence is a functional homolog of SEQ ID NO 2064 in the 10/374,780US patent application
  misc_feature: The sequence is a functional homolog of SEQ ID NO 234 in the 10/374,780US patent application
  misc_feature: The sequence is a functional homolog of SEQ ID NO 2676 in the 10/374,780US patent application
  misc_feature: The sequence is a functional homolog of SEQ ID NO 572 in the 10/412,699US patent application
  misc_feature: The sequence is a functional homolog of SEQ ID NO 816 in the 10/225,066US patent application
  misc_feature: Useful for making plants with altered alkaloid content
  misc_feature: Useful for making plants with modulated biomass
  misc_feature: Useful for making plants with modulated flowering time
  misc_feature: Useful for making plants with modulated growth and phenotype characteristics
  misc_feature: Functional homolog of the protein sequence given in SEQ ID NO 12958
  misc_feature: GREAT-hit functional homolog of the protein sequence given in SEQ ID NO 13024
  misc_feature: The sequence is a functional homolog of SEQ ID NO 572 in the 20040045049 US patent application
  misc_feature: The sequence is a functional homolog of SEQ ID NO 12 in the 20050160493 US patent application
  misc_feature: The sequence is a functional homolog of SEQ ID NO 122 in the 20050160493 US patent application
  misc_feature: Useful for making plants with altered alkaloid content
  misc_feature: Functional homolog of the protein sequence given in SEQ ID NO 13024
  misc_feature: The sequence is a functional homolog of SEQ ID NO 2064 in the 10/374,780 US patent application
  misc_feature: The sequence is a functional homolog of SEQ ID NO 572 in the 10/412,699 US patent application
  misc_feature: The sequence is a functional homolog of SEQ ID NO 816 in the 10/225,066 US patent application
  misc_feature: Useful for making plants with modulated flowering time
  misc_feature: The sequence is a functional homolog of SEQ ID NO 1453 in the 10/374,780 US patent application
  misc_feature: The sequence is a functional homolog of SEQ ID NO 1701 in the 10/412,699 US patent application
  misc_feature: The sequence is a functional homolog of SEQ ID NO 1965 in the 10/412,699 US patent application
  misc_feature: Useful for biocontainment applications
  misc_feature: Useful for making plants with modulated nitrogen use efficiency
  misc_feature: Functional homolog of the protein sequence given in SEQ ID NO 12982
  misc_feature: The sequence is a functional homolog of SEQ ID NO 1967 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO. 359 in the 11/188,298 US application
  misc_feature: The sequence is a functional homolog of SEQ ID NO. 361 in the 11/188,298 US application
  misc_feature: The sequence is a functional homolog of SEQ ID NO. 273 in the 11/188,298 US application
  misc_feature: The sequence is a functional homolog of SEQ ID NO. 518 in the 11/188,298 US application
  misc_feature: The sequence is a functional homolog of SEQ ID NO. 420 in the 11/188,298 US application
  misc_feature: The sequence is a functional homolog of SEQ ID NO. 377 in the 11/188,298 US application
MAGKRERIAIRRIDNLAARQVTFSKRRRGLFKKAEELSILCDAEVGLVVFSATGKLFHFASTSMKQVIDRYDSHSKNLQKSEAPSQLQSHIDDGTCARLKQELAETSLKLRQMRGEELQRLSVQQLQELEKTLESGLGSVLKTKSQKILDEISGLERKRMELIEENSRLKEQVTRMARMETQLGVDSEIVYEEGQSSESVTNTSYPRPSTDTDDCSDTSLRLGLPFFSSK

SEQ ID NO: 7401 - DNA, 1131 bp, Sorghum bicolor
  misc_feature: Ceres ANNOT ID no. 6075691
  misc_feature: Encodes the peptide sequence at SEQ ID NO 7402
atggcaccgagaggcggacgcccagcggctagttccggttctgaggatgaggaagaggcggccgggttctccaggagctacttcctggccaaggagaaggagccatcatctgggaagaagcgcgcccgtgccgccgcgggcaagctctccgacctcaacctcgtcgacgagcacgtgttgcgtgcatcccttgctgagatccctccgaagcacgaggaagaggtggaggctctgactagatgctacaaggaccagtaccacaactggttgttcgaactaagatgtggttttggtctcctgatgtatgggtttggatctaagaagcaattgctggaggattttgcctccactaccttgactgatttcactgtcattgtaatcaatggctaccttccgtccgtcaatttgaaacaggtcatagcaacaatagctgaaatgttctgggatcaaacaaaagctaaacgcaaaagacagccaggaacaagggcccagttgtcacaacagtttccgtcacaatcaacagaggacatcatctcattcctaatgagacagacatccgatgatgtggattaccctgtttgccttcttattcataatgttgacgggcctgctttgcgtgatactgaatcacaacaatgtctagcacaaatttcttgctgcccacaggtccgtgttgttgcatcaatagaccatgttaatgcccctttattgtgggacaagaagatggtgcacaaacagttcaagtggagctggtatcatgtcccgacatttgcaccttacaaagtcgaaggcgtgttctacccattgatccttgctagtggtggtcacgcccaaaccacaaaaactgctcttgttctgcagagtctgacaccgaatgcacaaagtgttttcagagttcttgctgaatatcagttggcaaatgagaaggaggaaggtatgccagtcaacagtttgtatacaaaatgccgtgagcgctttctggtaagcagtcaagtgacattgaattcacacctgacggagtttaaagaccatgatctggttaagatcaggaagcactctgatggacaagattgcctccgcattcctcttgtttctgatgcactggagaagttgctgcaagagttggcttga

SEQ ID NO: 7402 - protein, 376 aa, Sorghum bicolor
  misc_feature: Ceres ANNOT ID no. 6075691
  misc_feature (36)..(377): Pfam Id: ORC2 Pfam Desc: Origin recognition complex subunit 2
  misc_feature (1)..(376): NCBI GI: 15866776 NCBI Desc: origin recognition complex subunit 2 [zea mays]
  misc_feature (1)..(375): NCBI GI: 66153722 NCBI Desc: origin recognition complex subunit 2 [oryza sativa (japonica cultivar-group)]
  misc_feature (156)..(375): NCBI GI: 42571101 NCBI Desc: origin recognition complex subunit 2 (orc2) [arabidopsis thaliana]
  misc_feature (55)..(370): NCBI GI: 57529768 NCBI Desc: similar to horc2l [gallus gallus]
  misc_feature (55)..(374): NCBI GI: 7650495 NCBI Desc: origin recognition complex subunit 2 [cricetulus griseus]
MAPRGGRPAASSGSEDEEEAAGFSRSYFLAKEKEPSSGKKRARAAAGKLSDLNLVDEHVLRASLAEIPPKHEEEVEALTRCYKDQYHNWLFELRCGFGLLMYGFGSKKQLLEDFASTTLTDFTVIVINGYLPSVNLKQVIATIAEMFWDQTKAKRKRQPGTRAQLSQQFPSQSTEDIISFLMRQTSDDVDYPVCLLIHNVDGPALRDTESQQCLAQISCCPQVRVVASIDHVNAPLLWDKKMVHKQFKWSWYHVPTFAPYKVEGVFYPLILASGGHAQTTKTALVLQSLTPNAQSVFRVLAEYQLANEKEEGMPVNSLYTKCRERFLVSSQVTLNSHLTEFKDHDLVKIRKHSDGQDCLRIPLVSDALEKLLQELA

SEQ ID NO: 7403 - DNA, 2295 bp, Sorghum bicolor
  misc_feature: Ceres ANNOT ID no. 6075724
  misc_feature: Encodes the peptide sequence at SEQ ID NO 7404
atgaacccttccatgccaccgcctccgccgcgaaaccctaactcctcttcgtcatccgcctccatgccgcctcctccgccccaaaacccctcgccgccgacggcgcggccggaggcggcgtccgagcccgacttgtcctcagcgggggtgagtggtcgcgctgaacctagcacatcctcctcgatgccgccgcctccgcctccaaaacccggcccgtcagcaccgcagctggaggcagaggcggcaggggatgagggaagcgcttccctgagccccagcgtgagcgactcgtcagcgaaggaggcgcccaacaccatggggccctcctccggcaacaccgtggtggaggaagcgggcgcgtcgccagtggagcggcagaggcagcagagggcgcgcgcgccgtacgccattcccgagtggagcgccgcgcctagtcaccccttcttccttgaggtgctcaaggacgggacgatcgttgatcaacttgacgtgtccaagaaaggagcttacatgtttggtcgaattgatctgtgcgattttattttggagcatccaaccgtttctcgattccatgctgttttgcagtttagaaatgatgagaaggttttcctttatgatcttggtagcacacatggatccttcatcaataaaagtctgatcaagaagaagctatacacagagattcatgtgggagatgtaattcgatttgggcaatcatcacggttgtacatttttcaaggaccatctgagctaatgcctccagaaaaagacttgcagaagctccgggatgctagaatccagcaagatatgcttgatcgtgaagcttctgttttacgtgcaaaaactcaagcagctttggcagagggaatctcatggggtatggcagatgatgcaatagaagagtctgcagaggatgatgcagatgaaattacttggcaaacctacaaaggtcagcttactgatagacaagagaaaactcgtagcaagatagtaaaacgaatggagaagattgccaacatgaaaaaagaaattgatgcaataagagttaaagacatttctcaaggtgggctaacccaaggtcaacaaacacaaattgcacgaaatgaacaacggatatctcagattatggaggagctagataatctagaagaaactttaaatgacagtatacgggaaagtattggtgctcgttctggaaaggcaaagcgtagcagccataaagcaagtctcgaagaagatgacattcttagtgatgatgacgaattttatgatcgaacgaagaagaaatctagtcagaaatcaagtgagcaacaatcagttgagactgctgatagccttcttgagaaaaaagatttcatcaccaatgatattgaaaataaaacaaaattgcttgaagaagagaagcataagctgtctcagagtgatactccagatgtcagggatgaccttgatgcttatatgagtggcttgtcatctcaattagtacatgataagattgcccgaattcagaaggaactgtctgatcttcacgatgagctggacagagtagtttacctactgaaaatagctgaccctatgggagaagcagcttctaagagggatctaaagccaagagaagcgaaacctccaacatctaatgataatccaaggctagatttgaagaaacaaaataaaattggaaaagctacagctgaggagaaacccaaggattcttctagagaagtaggcacggataaacctgctaaattacagacagatgtctctaagaaccaagaagatggcagcagacctgcatttgccatcccaaaacctcaatggcttggtgacaaaaggatcatagaacctgaagaaaactttataaagaaagaaaagtctgatgcagaggagcctgataattttgtggactacaaagaccggaaaaccattctttcttcaggcagtggaaaggagcttgaagaggccgcccctgggcttattttacggaagagaaagtctgctgaagagtcagttgccagcgaggcaaattcatctttggttgaaagtgaagcatcagttgctgatgctgtggcccttctgcttaagcataaacgtggtctacaaacctcggaagaaatggagaatgagaacgaaccaaattctagcaagagagaagggaagaagtctaaacaaaaacgtgtattgggcccagcaagaccagatttccttgaagccagaccagattctgaaacatgggtgccacctgaaggtcaaactggtgatggccgcactgcgttgaatgaccgtttaggttattga

SEQ ID NO: 7404 - protein, 764 aa, Sorghum bicolor
  misc_feature: Ceres ANNOT ID no. 6075724
  misc_feature (170)..(237): Pfam Id: FHA Pfam Desc: FHA domain
  misc_feature (58)..(764): NCBI GI: 30693307 NCBI Desc: forkhead-associated domain-containing protein / fha domain-containing protein [arabidopsis thaliana]
  misc_feature (191)..(764): NCBI GI: 125774393 NCBI Desc: ga20531-pa [drosophila pseudoobscura]
  misc_feature (203)..(665): NCBI GI: 108875576 NCBI Desc: smad nuclear interacting protein [aedes aegypti]
  misc_feature (183)..(525): NCBI GI: 116127602 NCBI Desc: ensangp00000020993 [anopheles gambiae str. pest]
  misc_feature (197)..(525): NCBI GI: 24648030 NCBI Desc: cg7706-pa [drosophila melanogaster]
MNPSMPPPPPRNPNSSSSSASMPPPPPQNPSPPTARPEAASEPDLSSAGVSGRAEPSTSSSMPPPPPPKPGPSAPQLEAEAAGDEGSASLSPSVSDSSAKEAPNTMGPSSGNTVVEEAGASPVERQRQQRARAPYAIPEWSAAPSHPFFLEVLKDGTIVDQLDVSKKGAYMFGRIDLCDFILEHPTVSRFHAVLQFRNDEKVFLYDLGSTHGSFINKSLIKKKLYTEIHVGDVIRFGQSSRLYIFQGPSELMPPEKDLQKLRDARIQQDMLDREASVLRAKTQAALAEGISWGMADDAIEESAEDDADEITWQTYKGQLTDRQEKTRSKIVKRMEKIANMKKEIDAIRVKDISQGGLTQGQQTQIARNEQRISQIMEELDNLEETLNDSIRESIGARSGKAKRSSHKASLEEDDILSDDDEFYDRTKKKSSQKSSEQQSVETADSLLEKKDFITNDIENKTKLLEEEKHKLSQSDTPDVRDDLDAYMSGLSSQLVHDKIARIQKELSDLHDELDRVVYLLKIADPMGEAASKRDLKPREAKPPTSNDNPRLDLKKQNKIGKATAEEKPKDSSREVGTDKPAKLQTDVSKNQEDGSRPAFAIPKPQWLGDKRIIEPEENFIKKEKSDAEEPDNFVDYKDRKTILSSGSGKELEEAAPGLILRKRKSAEESVASEANSSLVESEASVADAVALLLKHKRGLQTSEEMENENEPNSSKREGKKSKQKRVLGPARPDFLEARPDSETWVPPEGQTGDGRTALNDRLGY

SEQ ID NO: 7405 - DNA, 453 bp, Sorghum bicolor
  misc_feature: Ceres ANNOT ID no. 6075791
  misc_feature: Encodes the peptide sequence at SEQ ID NO 7406
atgggtagcgacacagaggccgagcaaaagagggcgccggtggccctggcacccatcgcgaagccgctcgccggcaagaagctctgcaagcgaaccctcaagctcgtccgccgagcctctgaggccaaatgcttgaagcgaggagtcaaggaggtcgttaagagtattcggcggggaaacaagggactgtgtgtgattgctggcaacatttctccaatcgatgtaataactcatgttccgatactctgtgaagaagccaatattccttatgtatatgttccttcaaaagaggatcttgcaactgctggcaccaccaaaaggcctacctgttgcgtgctggtgctgacgaagccagccaagggggagctcgagggcgaggtcatggagaaactcaagacggactacgaccaggtcatgtctgaagtcgctgaggtcacgtcggcgatgttctaa

SEQ ID NO: 7406 - protein, 150 aa, Sorghum bicolor
  misc_feature: Ceres ANNOT ID no. 6075791
  misc_feature (30)..(124): Pfam Id: Ribosomal_L7Ae Pfam Desc: Ribosomal protein L7Ae/L30e/S12e/Gadd45 family
  misc_feature (1)..(149): NCBI GI: 8346555 NCBI Desc: nhp2-like protein [arabidopsis thaliana]
  misc_feature (9)..(142): NCBI GI: 44980751 NCBI Desc: abl115wp [eremothecium gossypii]
  misc_feature (9)..(142): NCBI GI: 45185115 NCBI Desc: abl115wp [eremothecium gossypii]
  misc_feature (9)..(142): NCBI GI: 1431346 NCBI Desc: nhp2 [saccharomyces cerevisiae]
  misc_feature (9)..(142): NCBI GI: 59799862 NCBI Desc: high mobility group-like nuclear protein 2 (small nucleolar rnp protein nhp2) (h/aca snornp protein nhp2)
MGSDTEAEQKRAPVALAPIAKPLAGKKLCKRTLKLVRRASEAKCLKRGVKEVVKSIRRGNKGLCVIAGNISPIDVITHVPILCEEANIPYVYVPSKEDLATAGTTKRPTCCVLVLTKPAKGELEGEVMEKLKTDYDQVMSEVAEVTSAMF

SEQ ID NO: 7407 - DNA, 1548 bp, Sorghum bicolor
  misc_feature: Ceres ANNOT ID no. 6075837
  misc_feature: Encodes the peptide sequence at SEQ ID NO 7408
atggcgaatcatccccgcgcggcgctgctggaggagtacctcgagcgcgcgcgggagtacctggtcgagggctccggctgctacgacacctccatcaccttcttcaacgccgccatcgtccagatcgacaagcatctaactactttggacaataatgctaagattcgtacgaaatggttggactgcaagaacgcaatatatgaagaaatggaacttacgaaacagttggatgctcaattaaagtcccgtaaagaagctcctgggacgaggcggtcatcgtcacctcctattcgctccaataataaatcatttgttctccaaccattggacgagtatcccacatcttcaccagcaccctttgatgatcctgatgtgtgggctccaccaagggctaaagcaacccgaagaccatcaagacatcaatctggtgcaagaaaatcctcccaagatggagcctgggcacatggttcagcaaggactggaacacctagccaaagcgcaaaacctaatgggagtaaaagaggctatgcggttaaatcgtcagctgcctctaagagttgtgtaaggaaaggaaaaccaagttcaatcaaggctcactcagcgagtagtggcgctgaggaagggccagatatggacttagctgcaatgcttgaaatggatgttctggattctactccaggactaagatgggatgatgttgccggacttagtaaggccaaagacctcctccgtgaagcagttcagcttcctgtctggatgcctgaatattttcagggtattcgtcgaccttgtaaaggagttcttatgtttggtccaccaagcacaggaaagactcttttggcaaaggcagtggccacagaatgtggaacgacattctttaatgtttcctctgcaacattggcctctaaatggcgcggcgagagtgagcgcatggtccgttgtttatttgaccttgcgagggccaaagctccaagtacaattttcattgatgaaattgactccttatgcacatcgcgtggagcatctggtgagcacgaggcatcaagaagggtgaagtctgaacttctagtgcaaattgatggtttaaacaatagctccaccactgaagatggtcagccaaaaattgtaacggttctggctgctacgaattttccatgggatattgatgaggcactgagcaggaggttcgaaaagcgtatttatattccacttccagattttgaaagtagaaaggcacttatcaacattaatcttagaacagttcagatagctgtggatgttaacatcgatgaggttgctcggaggacagaaggctatagtggagatgatctgacaaatgtttgccgtgatgcttcaatgaacggtatgaggtgcaagatagcaggcaagacccgtgaagagatcaagaacatgtcaaagaatgggatagccaaggacccagtgaccatgtgcgactttgtggaggccctcatgaaggtccagaagagtgtctcgtctgcagacatagaaaagcataagaagtggatgactgtgtttgggtccgcctga

SEQ ID NO: 7408 - protein, 515 aa, Sorghum bicolor
  misc_feature: Ceres ANNOT ID no. 6075837
  misc_feature (266)..(457): Pfam Id: AAA Pfam Desc: ATPase family associated with various cellular activities(AAA)
  misc_feature (10)..(515): NCBI GI: 19909896 NCBI Desc: katanin [arabidopsis thaliana]
  misc_feature (10)..(515): NCBI GI: 60390221 NCBI Desc: katanin p60 atpase-containing subunit (katanin p60 subunit) (p60 katanin) (atp60) (cad atpase) (katanin 1) (botero1 protein) (ectopic root hair 3 protein) (fat root protein)
  misc_feature (10)..(515): NCBI GI: 60390221 (continued) (fragile fiber 2 protein) (ataaa1)
  misc_feature (10)..(515): NCBI GI: 32478841 NCBI Desc: katanin [gossypium hirsutum]
  misc_feature (10)..(515): NCBI GI: 34421682 NCBI Desc: katanin-like protein [gossypium hirsutum]
  misc_feature (10)..(515): NCBI GI: 32478843 NCBI Desc: katanin [gossypium barbadense]
  misc_feature (10)..(515): SWISSPROT Homolog: EC 3.6.4.3 Katanin p60 ATPase-containing subunit
  misc_feature: The sequence is a functional homolog of SEQ ID NO. 471 in the 11/188,298 US application
  misc_feature: The sequence is a functional homolog of SEQ ID NO. 462 in the 11/188,298 US application
MANHPRAALLEEYLERAREYLVEGSGCYDTSITFFNAAIVQIDKHLTTLDNNAKIRTKWLDCKNAIYEEMELTKQLDAQLKSRKEAPGTRRSSSPPIRSNNKSFVLQPLDEYPTSSPAPFDDPDVWAPPRAKATRRPSRHQSGARKSSQDGAWAHGSARTGTPSQSAKPNGSKRGYAVKSSAASKSCVRKGKPSSIKAHSASSGAEEGPDMDLAAMLEMDVLDSTPGLRWDDVAGLSKAKDLLREAVQLPVWMPEYFQGIRRPCKGVLMFGPPSTGKTLLAKAVATECGTTFFNVSSATLASKWRGESERMVRCLFDLARAKAPSTIFIDEIDSLCTSRGASGEHEASRRVKSELLVQIDGLNNSSTTEDGQPKIVTVLAATNFPWDIDEALSRRFEKRIYIPLPDFESRKALININLRTVQIAVDVNIDEVARRTEGYSGDDLTNVCRDASMNGMRCKIAGKTREEIKNMSKNGIAKDPVTMCDFVEALMKVQKSVSSADIEKHKKWMTVFGSA

SEQ ID NO: 7409 - DNA, 507 bp, Sorghum bicolor
  misc_feature: Ceres ANNOT ID no. 6075853
  misc_feature: Encodes the peptide sequence at SEQ ID NO 7410
atgacaaacccagccgcgatcctctccgtggcgctgctcatcgtgggcgtctctctgatgctcgccgtgcacatcctagttgttttctgggctctacgacggggactcggctcccgcgacaccggccagcacgccaaccaccaggaccaggagcgcgtggaggacggccacggcaggcggggactgtcgcccggcgagctcgtcacgcttccttgccacgacttcaaggctgcggacggcgaggcggccggggactgcgcggtctgcctcgaggcgttccaggccggcgaccggtgcaggcagctgccgcggtgcgagcactgcttccacgcggagtgcgtggactcgtggctgaggaagagcagcaagtgcccggtgtgccgtgccgacgtggtggaccggccgcccaagggagaggcgaaggcggcggcctcgggaccaggggtcgtggagatggcggggaggagaagctcgaacgccgctttggagatcgtcactgaaagataa

SEQ ID NO: 7410 - protein, 168 aa, Sorghum bicolor
  misc_feature: Ceres ANNOT ID no. 6075853
  misc_feature (86)..(127): Pfam Id: zf-C3HC4 Pfam Desc: Zinc finger, C3HC4 type (RING finger)
  misc_feature (60)..(161): NCBI GI: 52077541 NCBI Desc: ring-h2 zinc finger protein-like [oryza sativa (japonica cultivar-group)]
  misc_feature (12)..(151): NCBI GI: 56201670 NCBI Desc: ring-h2 zinc finger protein-like [oryza sativa (japonica cultivar-group)]
  misc_feature (12)..(151): NCBI GI: 115435244 NCBI Desc: os01g0212700 [oryza sativa (japonica cultivar-group)]
  misc_feature (54)..(159): NCBI GI: 33589686 NCBI Desc: at1g72310 [arabidopsis thaliana]
  misc_feature (6)..(156): NCBI GI: 115445315 NCBI Desc: os02g0249300 [oryza sativa (japonica cultivar-group)]
  misc_feature: The sequence is a functional homolog of SEQ ID NO. 329 in the 11/188,298 US application
  misc_feature: The sequence is a functional homolog of SEQ ID NO. 271 in the 11/188,298 US application
  misc_feature: The sequence is a functional homolog of SEQ ID NO. 424 in the 11/188,298 US application
  misc_feature: The sequence is a functional homolog of SEQ ID NO. 468 in the 11/188,298 US application
MTNPAAILSVALLIVGVSLMLAVHILVVFWALRRGLGSRDTGQHANHQDQERVEDGHGRRGLSPGELVTLPCHDFKAADGEAAGDCAVCLEAFQAGDRCRQLPRCEHCFHAECVDSWLRKSSKCPVCRADVVDRPPKGEAKAAASGPGVVEMAGRRSSNAALEIVTER

SEQ ID NO: 7411 - DNA, 1023 bp, Sorghum bicolor
  misc_feature: Ceres ANNOT ID no. 6075857
  misc_feature: Encodes the peptide sequence at SEQ ID NO 7412
atggccaccatcaaggcatcaatcttggcaatcctcggcctcgccttcttctgcggtgctgcccttgctgctcgtgacctgaacgacgactcagccatggtggcgaggcatgagcagtggatggtgcagtacagccgtgtctacaaagacaccaccgagaaggctcggcggttcgaggtgttcaaagctaatgttaagttcatcgagtcgttcaacgctggtgggaaccgcaagttctggctcggcgtcaaccagtttgctgatctcacgaacgatgaattcagggctaccaagactaacaagggcttcaaacctagccccgtgaaggtttctaccggatttagatatgagaatgttagtgttgatgcacttccggcaaccatcgactggaggaccaagggtgccgtcactcccatcaaggatcaaggccaatgcggctgctgttgggcattctcggctgtggctgccacagaaggcatcgtaaaaataagcaccggcaagctcatctccctctcggaacaagagttagtggattgcgatgtccatggtgaggatcagggttgtgaaggtggtttgatggacgatgctttcaagttcatcatcaagaatggcggcctaaccacggagtctagctatccttacacagctgcggatggcaagtgcaagagtggatcaaacagtgccgcaaccgtcaagggctttgaggatgtccctgcaaatgatgaggctgccctgatgaaggccgtggccaaccaacccgtgtcggtggcagtggatggcggagacatgacgtttcagttctactctggtggtgtgatgactggctcatgtggtactgacctggaccatgggattgcagccattggctatggacaaaccagtgatggcaccaagtactggctactaaagaactcatggggcacgacttggggcgagaatggttacctgagaatggagaaggatatttccgacaagaggggcatgtgtggcctagctatggagccttcctaccccactgagtag

SEQ ID NO: 7412 - protein, 340 aa, Sorghum bicolor
  misc_feature: Ceres ANNOT ID no. 6075857
  misc_feature (124)..(339): Pfam Id: Peptidase_C1 Pfam Desc: Papain family cysteine protease
  misc_feature (37)..(94): Pfam Id: Inhibitor_I29 Pfam Desc: Cathepsin propeptide inhibitor domain (I29)
  misc_feature (1)..(339): NCBI GI: 116309178 NCBI Desc: osigba0147o06.5 [oryza sativa (indica cultivar-group)]
  misc_feature (1)..(339): NCBI GI: 116309130 NCBI Desc: h0825g02.10 [oryza sativa (indica cultivar-group)]
  misc_feature (1)..(310): NCBI GI: 115457264 NCBI Desc: os04g0203500 [oryza sativa (japonica cultivar-group)]
  misc_feature (1)..(339): NCBI GI: 13491750 NCBI Desc: cysteine protease [ipomoea batatas]
  misc_feature (8)..(339): NCBI GI: 24285904 NCBI Desc: cysteine proteinase precursor [ipomoea batatas]
  misc_feature (124)..(339): SWISSPROT Homolog: EC 3.4.22.15 Cathepsin L
MATIKASILAILGLAFFCGAALAARDLNDDSAMVARHEQWMVQYSRVYKDTTEKARRFEVFKANVKFIESFNAGGNRKFWLGVNQFADLTNDEFRATKTNKGFKPSPVKVSTGFRYENVSVDALPATIDWRTKGAVTPIKDQGQCGCCWAFSAVAATEGIVKISTGKLISLSEQELVDCDVHGEDQGCEGGLMDDAFKFIIKNGGLTTESSYPYTAADGKCKSGSNSAATVKGFEDVPANDEAALMKAVANQPVSVAVDGGDMTFQFYSGGVMTGSCGTDLDHGIAAIGYGQTSDGTKYWLLKNSWGTTWGENGYLRMEKDISDKRGMCGLAMEPSYPTE

SEQ ID NO: 7413 - DNA, 1023 bp, Sorghum bicolor
  misc_feature: Ceres ANNOT ID no. 6075863
  misc_feature: Encodes the peptide sequence at SEQ ID NO 7414
atggccaccatcaaggcatcaatcttggcaatcctcggcctcgccttcttctgcggtgctgcccttgctgctcgtgacctgaacgacgactcagccatggtggcgaggcatgagcagtggatggtgcagtacagccgtgtctacaaagacaccaccgagaaggctcggcggttcgaggtgttcaaagctaatgttaagttcatcgagtcgttcaacgccggtgggaaccgcaagttctggctcggcgtcaaccagtttgccgatctcacgaacgatgaattcagggctaccaagactaacaagggcttcaaacctagccccgtgaaggttcctaccggatttagatatgagaatgttagtgttgatgcacttccggcaaccatcgactggaggaccaagggtgccgtcactcccatcaaggatcaaggccaatgcggctgctgttgggcattctcggctgtggctgccacagaaggcatcgtaaaaataagcaccggcaagctcatctccctctcggaacaagagttagtggattgcgatgtccatggtgaggatcagggttgtgaaggtggtttgatggacgatgctttccagttcatcatcaagaatggcggcctaaccacggagtctagctatccttacacagctgcggatggcaagtgcaagagtggatcaaacagtgccgcaaccgtcaagggctttgaggatgtccctgcaaatgatgaggctgccctgatgaaggccgtggccaaccaacccgtgtcggtggcagtggatggcggagacatgacgtttcagttctactctggtggtgtgatgactggctcatgtggtactgacctggaccatgggattgcagccattggctatggacaaaccagtgatggcaccaagtactggctactaaagaactcatggggcacgacttggggcgagaatggttacctgagaatggagaaggatatttccgacaagaggggcatgtgtggcctagctatggagccttcctaccccattgagtag

SEQ ID NO: 7414 - protein, 340 aa, Sorghum bicolor
  misc_feature: Ceres ANNOT ID no. 6075863
  misc_feature (124)..(339): Pfam Id: Peptidase_C1 Pfam Desc: Papain family cysteine protease
  misc_feature (37)..(94): Pfam Id: Inhibitor_I29 Pfam Desc: Cathepsin propeptide inhibitor domain (I29)
  misc_feature (1)..(338): NCBI GI: 116309178 NCBI Desc: osigba0147o06.5 [oryza sativa (indica cultivar-group)]
  misc_feature (1)..(338): NCBI GI: 116309130 NCBI Desc: h0825g02.10 [oryza sativa (indica cultivar-group)]
  misc_feature (1)..(310): NCBI GI: 115457264 NCBI Desc: os04g0203500 [oryza sativa (japonica cultivar-group)]
  misc_feature (1)..(338): NCBI GI: 13491750 NCBI Desc: cysteine protease [ipomoea batatas]
  misc_feature (8)..(338): NCBI GI: 24285904 NCBI Desc: cysteine proteinase precursor [ipomoea batatas]
  misc_feature (124)..(338): SWISSPROT Homolog: EC 3.4.22.15 Cathepsin L
MATIKASILAILGLAFFCGAALAARDLNDDSAMVARHEQWMVQYSRVYKDTTEKARRFEVFKANVKFIESFNAGGNRKFWLGVNQFADLTNDEFRATKTNKGFKPSPVKVPTGFRYENVSVDALPATIDWRTKGAVTPIKDQGQCGCCWAFSAVAATEGIVKISTGKLISLSEQELVDCDVHGEDQGCEGGLMDDAFQFIIKNGGLTTESSYPYTAADGKCKSGSNSAATVKGFEDVPANDEAALMKAVANQPVSVAVDGGDMTFQFYSGGVMTGSCGTDLDHGIAAIGYGQTSDGTKYWLLKNSWGTTWGENGYLRMEKDISDKRGMCGLAMEPSYPIE

SEQ ID NO: 7415 - DNA, 2322 bp, Sorghum bicolor
  misc_feature: Ceres ANNOT ID no. 6075901
  misc_feature: Encodes the peptide sequence at SEQ ID NO 7416
  misc_feature: Up-regulated in shoot tissues in response to salicylic acid treatment
atggatgcagagagcggccgcggcgccgcgagtgcgcgcaagaagtcgtggcggtcggagctggtgctggcgtaccagagcctcggcgtggtgtacggcgaggtggcgacgtcgccgctctacgtgtacaagagcgccttcgccggcggcgacatcgaccactccgagggcaacgaggagatctatggggtgctctcgctcgtgttctggacgctcaccctcatcacgctcctcaagtacgtgctcgtcgtcctgcgcgccgacgacgacggcgagggcggtaccttcgcgctctactccctcatctgccgccgggtccgtgcggggctcctccctggcgtcgtcggcgacagtagcgctgccgacgacgagctcaaggagcagcgcgacggcggcgcgctgccgccgctggcgtcgagcgtgcgcgcggcgctgcagcagcgcagggagctgcagtggctgctgctcatgttcgctctgctcgggacgtccatggtcatcggcgacggcgtcctcacccctgctgtgtccgtattctcagcggtttcagggctcaagctgtcaatggtcaatgaacagcaccaatatgttctgcttccagtaacatgtgtgatcctggtaggcttgttcgccttgcaacacttcggcacacacagggttggatttctcttcgcgcctattgtctgcctgtggcttgcctgcatcagtgccataggggtatacaacatcttcatttggaatccccatatctataaagccctatcaccatactacatgcacagttttatccagaagacacaagttggaggctggatgtcactgggtgggatccttttatgtgtaactggttctgaagctatgtatgcggaccttggacatttttcgcagtcttcaatcaagatcgctttcacaatggtggtttatccatcactcgtacttgcctatatgggacaagctgcttacatttcacagcatcacaattttgagaggaaccaccatattggattttacatatcagtacctgagaaaatcagatggcctgttctggggattgcaatccttgcagctgtagttggcagccaagcagtaatcactggcacattctcagttatcaaacagtgttgctccttaaattgctttccaagggtgaagattgtgcatacatcctccacagtacatggccaaatatacataccagagatcaattggatcttaatgatactgtgcttggctgttactataggcttcagaaacacgaaacagatggcaaatgcacaagggttggcagttataacagttatgattgtcacaacttgctttatgtcactcgtcattgtcctttgctggaacaagaatgttgtgtttgctcttgccttccttcttttctttggtgcaatcgaagctgtctacttctcagcttccctcgtgaagttccatgaaggggcttgggtacctataattctttccttcactttcttgattgtgatgtgtgtttggcactatggcacaacaaagaagtacgagtttgatgtggagaacaaagtctcaataagctggcttttgaatttaggcccttcgttgggtattgttcgagtcagaggcataggtctcatacacacagaacttgtgtctgggattcctgccattttctcccactttgtcaccaacctccctgcatttcatcaggttctggtcttcctatgcattaaatccgtttctgtaccacatgtccaatctgaagagcgatttttggtcggacgcattggcctgaaacaatacaggctatacagggtagttgtccgatacgggtaccgggatgttcagcaggacagcctggaatttgagaaggccttagtgagcagcattgcagagttcatacgctctggggactctgaccaaaatggttatccggatggttcagagagtccctatgagaggttgtctattatcagcaaaggcctgccatttcaagaggcctatggtgaggttgagggatcacctgaatcatctgttcggaaggatacaaaccgaaatttagtatcttccaagtcgacaagggtgaggtttgtgctcccagaaaatgcgcagatcaacagcgaagtgcgcaacgagctgcaagagctgactgaggcaagagaggcaggcatgtccttcatcatggggcgctcttatatgaaggcgaaaagtgggtctagcctgatgaagcggattgccataaacttcatctacgagtttttgacgaggaatagccgaggtcctgcctacgcggctaacgtgccacatgtttccacccttgaggtaggaatggtttgccaagtctga

SEQ ID NO: 7416 - protein, 773 aa, Sorghum bicolor
  misc_feature: Ceres ANNOT ID no. 6075901
  misc_feature (22)..(773): Pfam Id: K_trans Pfam Desc: K+ potassium transporter
  misc_feature (129)..(669): NCBI GI: 62900352 NCBI Desc: potassium transporter 10 (oshak10)
  misc_feature (1)..(627): NCBI GI: 75232649 NCBI Desc: probable potassium transporter 9 (oshak9)
  misc_feature (1)..(770): NCBI GI: 91204708 NCBI Desc: potassium transporter [phragmites australis]
  misc_feature (1)..(770): NCBI GI: 91204712 NCBI Desc: potassium transporter [phragmites australis]
  misc_feature (1)..(770): NCBI GI: 91204710 NCBI Desc: potassium transporter [phragmites australis]
  misc_feature: The plants are small.
  misc_feature: Useful for making plants with modulated biomass
  misc_feature: Functional homolog of the protein sequence given in SEQ ID NO 13565
  misc_feature: Useful for making plants with modulated biomass
  misc_feature: Functional homolog of the protein sequence given in SEQ ID NO 13565
  misc_feature: Up-regulated in shoot tissues in response to salicylic acid treatment
  misc_feature: The sequence is a functional homolog of SEQ ID NO. 279 in the 11/188,298 US application
MDAESGRGAASARKKSWRSELVLAYQSLGVVYGEVATSPLYVYKSAFAGGDIDHSEGNEEIYGVLSLVFWTLTLITLLKYVLVVLRADDDGEGGTFALYSLICRRVRAGLLPGVVGDSSAADDELKEQRDGGALPPLASSVRAALQQRRELQWLLLMFALLGTSMVIGDGVLTPAVSVFSAVSGLKLSMVNEQHQYVLLPVTCVILVGLFALQHFGTHRVGFLFAPIVCLWLACISAIGVYNIFIWNPHIYKALSPYYMHSFIQKTQVGGWMSLGGILLCVTGSEAMYADLGHFSQSSIKIAFTMVVYPSLVLAYMGQAAYISQHHNFERNHHIGFYISVPEKIRWPVLGIAILAAVVGSQAVITGTFSVIKQCCSLNCFPRVKIVHTSSTVHGQIYIPEINWILMILCLAVTIGFRNTKQMANAQGLAVITVMIVTTCFMSLVIVLCWNKNVVFALAFLLFFGAIEAVYFSASLVKFHEGAWVPIILSFTFLIVMCVWHYGTTKKYEFDVENKVSISWLLNLGPSLGIVRVRGIGLIHTELVSGIPAIFSHFVTNLPAFHQVLVFLCIKSVSVPHVQSEERFLVGRIGLKQYRLYRVVVRYGYRDVQQDSLEFEKALVSSIAEFIRSGDSDQNGYPDGSESPYERLSIISKGLPFQEAYGEVEGSPESSVRKDTNRNLVSSKSTRVRFVLPENAQINSEVRNELQELTEAREAGMSFIMGRSYMKAKSGSSLMKRIAINFIYEFLTRNSRGPAYAANVPHVSTLEVGMVCQV

SEQ ID NO: 7417 - DNA, 1515 bp, Sorghum bicolor
  misc_feature: Ceres ANNOT ID no. 6075904
  misc_feature: Encodes the peptide sequence at SEQ ID NO 7418
atggcggcgccagggcgagcggcgctcctggccgtcgcgctcctcttcgccgccttcttcccgtcagcgtccgccgcgtcctcgtaccccgcaaggattgcgggcaggctcctgtccaccacggcgtcggcggtggccaagcagttgtggtcgctcaaatcggccgccaccaagacggcgacggcggccgtggcggcgcggcccaaggtgcggtacgagggcgggtacgcggtggacacggtgttcgacggcagcaagctggggatcgagccgcacgccgtcgagatcacccccgccggcgacctcctcgtgctcgactccatcaacagcaacatctacagggtccagctgccgctgtcaccatatagcagaccaaagctccttgctggttctccagaaggtttatctggccatgtggatggaaggctgagagaagcaaggatgaaccatcctaacgggttcactgtggacgataagggcaacatttatgtcgcagatgctatgaacatggcaataagaaagatcagtgatacaggggttacaaccattgctggggggaaatcaattagaggagggcacatagatgggcccagtgatgatgcaaaattctcaactgattttgagatccagtacatcagtagtagctgctctctcttggtcattgatagaggaaaccaagcaattcgagagattccactcaacgatgatgactgtgcatatcagtatgaaactggttttccactagggtttgcattgctttgtgctgctggtttctttggttatatgcttgcattgctccaacgccgccttttcgggatggcatcaacgacagatgaacctcaagcgcctccaagaccaagtattgcaagtatccctccataccagaagcctttaaatccttatgttcgtcaaccattcatccctagagaagaaactgcaaaacaggaaactgaagaggggttcttcacttcagctggcaaactcattggaggggcaaaatcatctgtggctgagatatttggtttaaagaagaagcgcctgagcaacccataccatcagcagcaacgaagagctaacccttggccagtgcaagaaagctatgccatcccacatgatgaacaccctccagcactggacacaagagcgccaacccctcagaagaactacagcttgatgacaaaggagcctgaaaagatccactatgtccgccatgggcacccgtatttcaatagctgggacggtcaccgtcaccctcagcagcagccagacccgcaactgtatcaccaacagcagcacctgcagcagcacaggcagtactctgcaggcccacagacattttacgagcagagctgtgaggctacaaatgagattgtctttggcgcagtccaggaggtggacagcaagcggcgcatggtcgagatcaaggctgtgaactatggagacacattctatgagcagtacgggatgcgctaccgcaacaatttcatcggctacaacaacaataataactattga

SEQ ID NO: 7418 - protein, 504 aa, Sorghum bicolor
  misc_feature: Ceres ANNOT ID no. 6075904
  misc_feature (148)..(175): Pfam Id: NHL Pfam Desc: NHL repeat
  misc_feature (7)..(503): NCBI GI: 53793193 NCBI Desc: nhl repeat-containing protein-like [oryza sativa (japonica cultivar-group)]
  misc_feature (9)..(498): NCBI GI: 30698020 NCBI Desc: nhl repeat-containing protein [arabidopsis thaliana]
  misc_feature (12)..(466): NCBI GI: 20856013 NCBI Desc: at1g23880/t23e23_8 [arabidopsis thaliana]
  misc_feature (52)..(475): NCBI GI: 3176691 NCBI Desc: contains homology to serine/threonine protein kinase gbx99618 from mycobacterium tuberculosis. ests gbf14403, gbf14404, and gbn96730 come from this gene. [arabidopsis
  misc_feature (52)..(475): NCBI GI: 3176691 (continued) thaliana]
  misc_feature (7)..(389): NCBI GI: 30685100 NCBI Desc: nhl repeat-containing protein [arabidopsis thaliana]
MAAPGRAALLAVALLFAAFFPSASAASSYPARIAGRLLSTTASAVAKQLWSLKSAATKTATAAVAARPKVRYEGGYAVDTVFDGSKLGIEPHAVEITPAGDLLVLDSINSNIYRVQLPLSPYSRPKLLAGSPEGLSGHVDGRLREARMNHPNGFTVDDKGNIYVADAMNMAIRKISDTGVTTIAGGKSIRGGHIDGPSDDAKFSTDFEIQYISSSCSLLVIDRGNQAIREIPLNDDDCAYQYETGFPLGFALLCAAGFFGYMLALLQRRLFGMASTTDEPQAPPRPSIASIPPYQKPLNPYVRQPFIPREETAKQETEEGFFTSAGKLIGGAKSSVAEIFGLKKKRLSNPYHQQQRRANPWPVQESYAIPHDEHPPALDTRAPTPQKNYSLMTKEPEKIHYVRHGHPYFNSWDGHRHPQQQPDPQLYHQQQHLQQHRQYSAGPQTFYEQSCEATNEIVFGAVQEVDSKRRMVEIKAVNYGDTFYEQYGMRYRNNFIGYNNNNNY

SEQ ID NO: 7419 - DNA, 3753 bp, Sorghum bicolor
  misc_feature: Ceres ANNOT ID no. 6075940
  misc_feature: Encodes the peptide sequence at SEQ ID NO 7420
atgatgggaacagaaggcattgcagccacagtcatcgaggaccctgaaccctcaattccgcctggatttggacctttcgctgccccggcatcatggggaatccaaaatgatgttaaacccgctgatgctcattcgagttctgttttagcattacagagcatcgacgacgatgtggaaattttggaatgtctatccagttcagtggatcgccagagtgacacaggttgcagtatttctgggagcaatacctgtaggaaatcactgcgcaatagacctccaatagattatagtcgctttgatcagattgcatatgaagattctgatgctgaagtagcagacaagggtgcaagttcagtgaaacatagacaacaattccctaaaggagtacttcgaggatgtccagaatgtgccgattgtcaaaaggttattgcaagatggaatccatctggtgcacgtaggcctgttcttgatgaggctcctgtttactatcctacagaggaggaattccaggacaccttaaaatacattgagagtatccgcccaacggcagaaccatatggaatatgccgtattgttccaccagcttcatggaagcctccatgccttcttaaagagaaaaacatttgggaatgctcaaaattttctactcgggtacagaaggttgacaagctccaaaatcgtaaatcgtctaagaagagcagaagaggtggaatgatgaagaagcgtagaaagatttcagagactgaagaaatcaatcacaatcaaattgggatgcagcaaaaccaagagagatttggatttgaaccaggaccagagttcacactacagatgtttcagaagtatgcagatgacttcagtgatcagtattttatgaaagataaatgcagagattcaccaccgtcagtggaagatattgaaggcgagtattggcgcatagttgaaaggccgacagaagagatagaggtaatatatggtgccgatttggagactggaacttttggcagtgggtttccaaagttatgtcctgaaatgaaatctgatgcggaggataaatatgcacaatctgggtggaacctaaataatttgcctagactacaaggttcagttctttcttttgaaggcggcgacatttctggtgttttagtgccttggctttatgtcggcatgtgtttttcatctttctgctggcatgttgaagatcatcatttgtactcactgaactacatgcattggggtgctccaaagatgtggtatggagttccaggaaaggatgctgtgaatttggaggctgcaatgaggaaacatcttcctgagttgtttgaggagcaacctgatttgcttcacaatctagttactcagttttcaccatcattgcttaaatctgaaggagtaccagtctaccgttgtgttcagcatgagggagagtttgtcctgacattcccacgggcataccatgctggttttaattgtggcttcaattgtgcagaagctgttaatgtggcacccattgattggttgccagttggacaaaatgctgttgaggtttatcgtgaacaagctcggaaaataactatctcacatgataagctgttgcttggggctgcaagagaagcaataagagctcagtgggacatcctatttctcaagaggaattctgctgataacttgaggtggaaaagcgtatgtggacctgatagcacaatatgcaagacactgaaggcacgaattgaaatggagttggcccaaagacaaaatatatcctctccatgtcaatctaggaaaatggataccgaatttgattctactgatagggaatgtgcattgtgttactatgatctgcatctttcagcttctggctgtccatgctccccagagaaatatgcttgcctggtacatgcaaaacagctttgctcatgtgattggaacaaaaggtttttcctatttcgttatgatgtcaatgagttgaatatcttagctgatgctttagcgggaaagctaagtgccattcacagatggggtgtctctgatcttggattaagtttgagctcgtgtgtcaaacgggaaaaggtccaagattccaagactgttcgcagattaactgatggcccaagacggtcctacttgtcacaggcatcaacagtatcgttggttccttcttctgttagcactgaaccaaaaaaaaatgaaaataagacactggatttaggttgtccaggtatgaatttacttaaaataagtccagaggcaaataatgcgtgtcctttgacaaagcagataaaatcagaaaatgactcacagctgaaggaaccatgcgtgaagaatgaattatcatgtccaaccagcaatggtaccagccgacaacataatggagggattgtaggccacaaagttgcagcaccaagcttgatggttccttctggtcaatcacttcctgcaaatgctgtgacaaaacccttaattacttcaggtgaatctatgagaagtacgcatgtcttggcagtattgaaagagagtagagaaacctcttcccaaactggagactgtacatcttcacttacaattagggagtatcataacaggccactgtcaatgattgataatggagttaacatgaagccagatctggaaaacttagacaattctcataggttgatggcatcatcagacttcaatgcaactctatgtcattcttacaaggatcaaacattcttaacaccggaaactaatacctcagtgatgactgagaaagatagcagtcaggcccgtactgcaagccagcagtttgtcaatactgcttcaaggacacaaaatgtgtctcaggaaccattttgtagtgtcactgctccaaagcatctcatagatcctcaagttgtgaaaaattcatatggtgtttttggttcaggcagtgctcatcttgggcatccaaccgttggtaatcagcaactaaatgagagatggcatcaaagacaatctgattctctatccagtgtggaagttagagctaggggtctttcagctatgatagtgcagcctgctctggaaaatcacagcagaaatggagttgtacagaagggtcctcgcatagctaatgttgtacatagattcaagtgctctgttgaacctatagaaattggtgttgtgctatctgggaagttgtggtcctcaagtcaagcaatcttcccaaaagggtttaagagcagagtaaaatactttagtgttgtagatccagtacaaatgacatactacatatctgaaatattggacgctggacagcagggacctctttttatggtgactgtagaaaactgtcctggggaaattttcataaatatctctcctaccaagtgctggaacatggttcgtgaaaggctcaatatggaaataaggaggcagatcaatatgggaagagctaaccttcctacactgcagcctccaggatcagttgatggtcatgaaatgtttgggttgttaacaccagcaatagttcaggcaattgaggctcgggacagagatcacatctgtacagagtactggagatcaaggtcccatgttacaactgagaatcgagacaatcagaatatgccacctcaggatccattgcttattgcactgagggggctcttccagcgggctaattgtgatgaactgcgagcactacgcagtttattgatgagcaatagaactctggatgacagttctaggcagcaggcttgccaaatcctcgatgaggagattgcaaagcaatggcactga

SEQ ID NO: 7420 - protein, 1250 aa, Sorghum bicolor
  misc_feature: Ceres ANNOT ID no. 6075940
  misc_feature (384)..(500): Pfam Id: JmjC Pfam Desc: JmjC domain
  misc_feature (160)..(204): Pfam Id: JmjN Pfam Desc: jmjN domain
  misc_feature (606)..(659): Pfam Id: zf-C5HC2 Pfam Desc: C5HC2 zinc finger
  misc_feature (1091)..(1184): Pfam Id: FYRC Pfam Desc: F/Y rich C-terminus
  misc_feature (1036)..(1088): Pfam Id: FYRN Pfam Desc: F/Y-rich N-terminus
  misc_feature (2)..(834): NCBI GI: 15223267 NCBI Desc: transcription factor jumonji (jmj) family protein / zinc finger (c5hc2 type) family protein [arabidopsis thaliana]
  misc_feature (218)..(834): NCBI GI: 9802555 NCBI Desc: f22o13.10 [arabidopsis thaliana]
  misc_feature (140)..(682): NCBI GI: 17064818 NCBI Desc: similar to human xe169 protein [arabidopsis thaliana]
  misc_feature (140)..(442): NCBI GI: 42562419 NCBI Desc: transcription factor jumonji (jmj) family protein / zinc finger (c5hc2 type) family protein [arabidopsis thaliana]
  misc_feature (140)..(396): NCBI GI: 4926825 NCBI Desc: t17h7.10 [arabidopsis thaliana]
MMGTEGIAATVIEDPEPSIPPGFGPFAAPASWGIQNDVKPADAHSSSVLALQSIDDDVEILECLSSSVDRQSDTGCSISGSNTCRKSLRNRPPIDYSRFDQIAYEDSDAEVADKGASSVKHRQQFPKGVLRGCPECADCQKVIARWNPSGARRPVLDEAPVYYPTEEEFQDTLKYIESIRPTAEPYGICRIVPPASWKPPCLLKEKNIWECSKFSTRVQKVDKLQNRKSSKKSRRGGMMKKRRKISETEEINHNQIGMQQNQERFGFEPGPEFTLQMFQKYADDFSDQYFMKDKCRDSPPSVEDIEGEYWRIVERPTEEIEVIYGADLETGTFGSGFPKLCPEMKSDAEDKYAQSGWNLNNLPRLQGSVLSFEGGDISGVLVPWLYVGMCFSSFCWHVEDHHLYSLNYMHWGAPKMWYGVPGKDAVNLEAAMRKHLPELFEEQPDLLHNLVTQFSPSLLKSEGVPVYRCVQHEGEFVLTFPRAYHAGFNCGFNCAEAVNVAPIDWLPVGQNAVEVYREQARKITISHDKLLLGAAREAIRAQWDILFLKRNSADNLRWKSVCGPDSTICKTLKARIEMELAQRQNISSPCQSRKMDTEFDSTDRECALCYYDLHLSASGCPCSPEKYACLVHAKQLCSCDWNKRFFLFRYDVNELNILADALAGKLSAIHRWGVSDLGLSLSSCVKREKVQDSKTVRRLTDGPRRSYLSQASTVSLVPSSVSTEPKKNENKTLDLGCPGMNLLKISPEANNACPLTKQIKSENDSQLKEPCVKNELSCPTSNGTSRQHNGGIVGHKVAAPSLMVPSGQSLPANAVTKPLITSGESMRSTHVLAVLKESRETSSQTGDCTSSLTIREYHNRPLSMIDNGVNMKPDLENLDNSHRLMASSDFNATLCHSYKDQTFLTPETNTSVMTEKDSSQARTASQQFVNTASRTQNVSQEPFCSVTAPKHLIDPQVVKNSYGVFGSGSAHLGHPTVGNQQLNERWHQRQSDSLSSVEVRARGLSAMIVQPALENHSRNGVVQKGPRIANVVHRFKCSVEPIEIGVVLSGKLWSSSQAIFPKGFKSRVKYFSVVDPVQMTYYISEILDAGQQGPLFMVTVENCPGEIFINISPTKCWNMVRERLNMEIRRQINMGRANLPTLQPPGSVDGHEMFGLLTPAIVQAIEARDRDHICTEYWRSRSHVTTENRDNQNMPPQDPLLIALRGLFQRANCDELRALRSLLMSNRTLDDSSRQQACQILDEEIAKQWH

SEQ ID NO: 7421 - DNA, 1542 bp, Sorghum bicolor
  misc_feature: Ceres ANNOT ID no. 6075956
  misc_feature: Encodes the peptide sequence at SEQ ID NO 7422
atggacgcgaagaagaaacgcgtagcgatcgtcggagcagggccgagcggcctggcggcatgcaagcacgcgctggccaagggcttccgccccgtggtcttcgagtccggcaccgccgtgggcggcgtgtggaaccggacgctggcctccacgaggctgcagacgccggcgtccgcgtaccggttctccgacttcccgtggccgccgacgacggacgcggccgagcccgacgacgaggggcggcgcttcccgcgccacgaccaggtggcggagtacatggccgcgtacgcgcggcgcttcggcgtcctggagcgcgtccggttcggctgcagggtgctcggcgccagctacgtcggggcgacggagcaggaggtggcggcgtgggaacgctggtccgggaatggccaggcgttcggcgacggcacgggcgagtggttcgatttcctaatcctctgtgtcgggaggtatggcgtcgcgaagctcccgacgtttcctgacgggagaggccccgaggtgttccgcgggcgagtgctccattccatggagtactcagccatggcgcacgcggacgccgccgagctggtcaggggcaagcgcgtcgccgtggttggcgccggcaagtcggccatggacatcgccgcgcagtgcgccgaggcaaacggtatcaggtacccgtgcacaatggtctacagaagcgcccattggatgctggatcctaaacttgctatcaccacctcggctcgatggaccgagctgatggttcacaagcccggagaggggttcgcgctcagccttctagccacggcactcactccactgcgatggcttatctcgaagatggccgaagtccactacaagaggagcatcccgatgcaggagcacgggatggtcccggacggcagcttcttgcaggggagccttggctggcggataggcacactgccggaggggttctacgacaaggtggacgacggcagcgtggagctcaggaggtgccgcgactccgtcggcttctgcccagacggcctcgtcgtggacgacgacggcggcggtgtggtgggcgccgacgtggtcatcctctccacgggcttcgacatcgaccggccgctgcgggacatgttcgcctccccctggttcggcgagatggtcgcgccgccggacgacggcgcggtgctcccgctctacaggcagtgcgtgcacccgcgggtcccgcagatggccgtggtcgggtacgtggagagcgggtccagcatctacccgtacgagatgatggccaagtgggtggcgcacctgctgggcggcgccgtccggctgccggccgtcggcgacatggagcgcgacgtggcggagtgggcgcggtggggccggtgggcgaggcgcgcgtgcggcgggttcttcctcaagtcgtgcatcgcctccgtcacgacgtggtaccacgaccagctctgccgcgacatgggccaccggcccaggaggaaggccggcctcctcgcggagtggctgcagccgtacggcccagcggactacgccggcatccagtga

SEQ ID NO: 7422 - protein, 513 aa, Sorghum bicolor
  misc_feature: Ceres ANNOT ID no. 6075956
  misc_feature (5)..(504): Pfam Id: FMO-like Pfam Desc: Flavin-binding monooxygenase-like
  misc_feature (147)..(512): NCBI GI: 115480525 NCBI Desc: os09g0548700 [oryza sativa (japonica cultivar-group)]
  misc_feature (4)..(509): NCBI GI: 116308895 NCBI Desc: h0515c11.3 [oryza sativa (indica cultivar-group)]
  misc_feature (4)..(509): NCBI GI: 116308896 NCBI Desc: h0515c11.4 [oryza sativa (indica cultivar-group)]
  misc_feature (5)..(512): NCBI GI: 50725113 NCBI Desc: flavin containing monooxygenase 3 -like [oryza sativa (japonica cultivar-group)]
  misc_feature (228)..(512): NCBI GI: 51091276 NCBI Desc: flavin-containing monooxygenase-like [oryza sativa (japonica cultivar-group)]
MDAKKKRVAIVGAGPSGLAACKHALAKGFRPVVFESGTAVGGVWNRTLASTRLQTPASAYRFSDFPWPPTTDAAEPDDEGRRFPRHDQVAEYMAAYARRFGVLERVRFGCRVLGASYVGATEQEVAAWERWSGNGQAFGDGTGEWFDFLILCVGRYGVAKLPTFPDGRGPEVFRGRVLHSMEYSAMAHADAAELVRGKRVAVVGAGKSAMDIAAQCAEANGIRYPCTMVYRSAHWMLDPKLAITTSARWTELMVHKPGEGFALSLLATALTPLRWLISKMAEVHYKRSIPMQEHGMVPDGSFLQGSLGWRIGTLPEGFYDKVDDGSVELRRCRDSVGFCPDGLVVDDDGGGVVGADVVILSTGFDIDRPLRDMFASPWFGEMVAPPDDGAVLPLYRQCVHPRVPQMAVVGYVESGSSIYPYEMMAKWVAHLLGGAVRLPAVGDMERDVAEWARWGRWARRACGGFFLKSCIASVTTWYHDQLCRDMGHRPRRKAGLLAEWLQPYGPADYAGIQ

SEQ ID NO: 7423 - DNA, 1776 bp, Sorghum bicolor
  misc_feature: Ceres ANNOT ID no. 6076014
  misc_feature: Encodes the peptide sequence at SEQ ID NO 7424
atgtgcggcatcctcgccgtcctcggcgtcgccgaggtctccctcgccaagcgctcccgcatcattgagctctcgcgcaggttacggcaccgagggcctgattggagcggtttgcactgtcatcaggattgctaccttgcacaccagcggttggctattattgatcctacatctggagaccagccattgtacaatgaggacaaaacagttgttgtaacggtgaatggagaaatatataaccatgaagaactgaaagctaagttgaaaactcatgaatttcaaactggcagtgactgtgaagttatagctcatctttacgaagaatatggggaagaatttgtggatatgttggatggaatgttctccttcgttcttcttgatacacgtgataaaagcttcatggcagctcgtgatgctattggcatctgccctttatacatgggatggggtcttgatggatcagtctggtttgcttcagagatgaaggcattgagcgatgattgtgaacgcttcataaccttcccccctgggcatctctactccagcaaaacaggtggtctaaggagatggtacaacccaccatggttttcagagacgatcccttcaaccccttacaatgctctcttcctccgggagatgtttgagaaggctgttattaagaggctgatgactgatgtgccatttggtgtgcttttatctggtggacttgactcttctttggttgcatctgttgcttcacggcacttaaacgaaacaaaggttgccaggcagtggggaaataaattgcatacattctgtataggcttgaagggttctcctgatcttaaagctgctaaggaagttgctgattacctcggcactgtacatcatgagttccacttcacagtgcaggaggggatagatgccttggaggaagtcatctatcatgttgagacatatgatgttacaacaatcagagcgagtaccccaatgtttttgatgtcacgcaaaatcaaatctttgggggtgaagatggttatttctggagaaggttcagatgaaatttttggcggttacctttattttcacaaggcaccaaacaagaaagaattccatgaggaaacatgtcggaagataaaagcactacatctgtatgattgcttgagagctaacaaatcaacttctgcctggggtgttgaggctcgtgttccattccttgacaaaagtttcatcaatgtagcaatggacattgatccggaatggaagatgataaaacgtgatctcggtcgaattgagaaatgggttatccgtaatgcatttgatgacgaggagcggccctatttacctaagcacattctttacaggcaaaaggaacagttcagtgatggtgtcggctatagttggatcgatggattgaaagaccatgccaaccaacatgtcacggattccatgatgatgaatgctagctttgtttacccagagaacacacccacaacaaaagaagggtattactacagaacaatattcgagaaattcttccccaagcctgcagcaaggtctactgttcctggaggtcctagcgtggcatgcagcaccgccaaagctgttgaatgggacgcatcctggtccaagaaccttgatccatctggtcgtgctgctctgggtgttcacgatgctgcgtatgaagatactccaggggaagctcctgcctctgctgatccggtctcagacaagggccttcgtccagctattggcgaaagtttagtgacaccagttgcttcagccacagctgtctaa

SEQ ID NO: 7424 - protein, 591 aa, Sorghum bicolor
  misc_feature: Ceres ANNOT ID no. 6076014
  misc_feature (209)..(450): Pfam Id: Asn_synthase Pfam Desc: Asparagine synthase
  misc_feature (2)..(161): Pfam Id: GATase_2 Pfam Desc: Glutamine amidotransferases class-II
  misc_feature (1)..(591): NCBI GI: 115467482 NCBI Desc: os06g0265000 [oryza sativa (japonica cultivar-group)]
  misc_feature (1)..(591): NCBI GI: 3182921 NCBI Desc: asparagine synthetase [glutamine-hydrolyzing] (glutamine-dependent asparagine synthetase)
  misc_feature (1)..(556): NCBI GI: 984262 NCBI Desc: asparragine synthetase [zea mays]
  misc_feature (1)..(572): NCBI GI: 21700903 NCBI Desc: at5g65010/mxk3_25 [arabidopsis thaliana]
  misc_feature (1)..(577): NCBI GI: 3859534 NCBI Desc: asparagine synthetase [arabidopsis thaliana]
  misc_feature (1)..(591): SWISSPROT Homolog: EC 6.3.5.4 Asparagine synthetase [glutamine-hydrolyzing]
MCGILAVLGVAEVSLAKRSRIIELSRRLRHRGPDWSGLHCHQDCYLAHQRLAIIDPTSGDQPLYNEDKTVVVTVNGEIYNHEELKAKLKTHEFQTGSDCEVIAHLYEEYGEEFVDMLDGMFSFVLLDTRDKSFMAARDAIGICPLYMGWGLDGSVWFASEMKALSDDCERFITFPPGHLYSSKTGGLRRWYNPPWFSETIPSTPYNALFLREMFEKAVIKRLMTDVPFGVLLSGGLDSSLVASVASRHLNETKVARQWGNKLHTFCIGLKGSPDLKAAKEVADYLGTVHHEFHFTVQEGIDALEEVIYHVETYDVTTIRASTPMFLMSRKIKSLGVKMVISGEGSDEIFGGYLYFHKAPNKKEFHEETCRKIKALHLYDCLRANKSTSAWGVEARVPFLDKSFINVAMDIDPEWKMIKRDLGRIEKWVIRNAFDDEERPYLPKHILYRQKEQFSDGVGYSWIDGLKDHANQHVTDSMMMNASFVYPENTPTTKEGYYYRTIFEKFFPKPAARSTVPGGPSVACSTAKAVEWDASWSKNLDPSGRAALGVHDAAYEDTPGEAPASADPVSDKGLRPAIGESLVTPVASATAV

SEQ ID NO: 7425 - DNA, 1446 bp, Sorghum bicolor
  misc_feature: Ceres ANNOT ID no. 6076070
  misc_feature: Encodes the peptide sequence at SEQ ID NO 7426
atgagtccatccattcatatgtgcttcaatatcgtctacgagaagattgtagacaatttcctcctgatagtcgctgtgccactcaccattgccgcagctactattgcgatggcaagactagagcctaacgaatccgcagatccaattcaaaccttcagtcattcacagatcttgtcaattttgttgttcttggctaccgcggtgatcgtatattacatgcagcgcccacgcatggtgtacctcgtcgactatgcttgcttccgcgccacatataactaccgtgttccctctgctgcttttgttgagcatgtccgccaagtcagccatttcagtgagcgcagcgtccgtttcttgacacgcctactcgagcgatcaggccttggagaggagacatgccttcccccagtgggccagtacattgaaccctacaattactgcacgttggaggttgctcgcgaggaagctcagctcgtcgtcttctcagccattgacgatctatttgccaaaacgagcattgcccctcacaccattgacattctcgtcgtaaactgcagcggatttagtccaacaccaggtttccccgacatgatcatcaacaagtacaagatgcgtagtgacatccgcaacgtccatctatctggaatggggtgcagcgcgggtttagcctccgtagatctcgccaagaaccttctgcaagccatgcctccaggggcacgggcgttggtcgtatcaactgaaactctcacgcccaactactattttgggaacgagagagctatgctgcttccatattgcttgttccggatgggcggagctgccgtgctactttcaacatcacccgaaaaggcccgtttcagactcaagtttgtcgttcggacacacactgcagcagacgacaaatcataccagtgcatctatcagaaagaggatgacaagggaaacaaaggggtagatctctccattgatctcatgaccgttgctgctaggacgctcaaagccaacatcaccaccattgcgccgctcgtccttccggcctccgagaaactcttgtttgcaatttccttcgtatctacgaagcttctcaaaatggggaccaagttgtacgtgcctaacttcctcactgcgttcgagcatatttgcatccatgcaggtgggcgtgcagtgattgatgagatccagcgcagcctaggcctgtcagacaagcatgttgagtcctccaggatgacactgcatcgattcggcaacatatctagcagctgcttatggtatgaattggcatacatcgaggccaagcacaacatgcaaaagagtgatcgagtatggatgattggatttggttctggattcaagtgcaacagtgcagtatgggagtgcatcgttccaacccatagtgaagatgggccatgggctacgtgcatccatcgttatccagtacatgatccttaa

SEQ ID NO: 7426 - protein, 481 aa, Sorghum bicolor
  misc_feature: Ceres ANNOT ID no. 6076070
  misc_feature (71)..(360): Pfam Id: FAE1_CUT1_RppA Pfam Desc: FAE1/Type III polyketide synthase-like protein
  misc_feature (373)..(458): Pfam Id: ACP_syn_III_C Pfam Desc: 3-Oxoacyl-[acyl-carrier-protein (ACP)] synthase III C terminal
  misc_feature (323)..(460): Pfam Id: Chal_sti_synt_C Pfam Desc: Chalcone and stilbene synthases, C-terminal domain
  misc_feature (12)..(481): NCBI GI: 115448487 NCBI Desc: os02g0731900 [oryza sativa (japonica cultivar-group)]
  misc_feature (2)..(481): NCBI GI: 21593111 NCBI Desc: very-long-chain fatty acid condensing enzyme cut1 [arabidopsis thaliana]
  misc_feature (2)..(481): NCBI GI: 12324880 NCBI Desc: very-long-chain fatty acid condensing enzyme (cut1); 56079-54227 [arabidopsis thaliana]
  misc_feature (13)..(481): NCBI GI: 74273645 NCBI Desc: 3-ketoacyl-coa synthase [gossypium hirsutum]
  misc_feature (4)..(481): NCBI GI: 92896567 NCBI Desc: imp dehydrogenase/gmp reductase [medicago truncatula]
  misc_feature (58)..(478): SWISSPROT Homolog: EC 2.3.1.119 3-ketoacyl-CoA synthase 1 (EC 2.3.1.-)
  misc_feature: The sequence is a functional homolog of SEQ ID NO 2 in US patent 7038112
MSPSIHMCFNIVYEKIVDNFLLIVAVPLTIAAATIAMARLEPNESADPIQTFSHSQILSILLFLATAVIVYYMQRPRMVYLVDYACFRATYNYRVPSAAFVEHVRQVSHFSERSVRFLTRLLERSGLGEETCLPPVGQYIEPYNYCTLEVAREEAQLVVFSAIDDLFAKTSIAPHTIDILVVNCSGFSPTPGFPDMIINKYKMRSDIRNVHLSGMGCSAGLASVDLAKNLLQAMPPGARALVVSTETLTPNYYFGNERAMLLPYCLFRMGGAAVLLSTSPEKARFRLKFVVRTHTAADDKSYQCIYQKEDDKGNKGVDLSIDLMTVAARTLKANITTIAPLVLPASEKLLFAISFVSTKLLKMGTKLYVPNFLTAFEHICIHAGGRAVIDEIQRSLGLSDKHVESSRMTLHRFGNISSSCLWYELAYIEAKHNMQKSDRVWMIGFGSGFKCNSAVWECIVPTHSEDGPWATCIHRYPVHDP

SEQ ID NO: 7427 - DNA, 4128 bp, Sorghum bicolor
  misc_feature: Ceres ANNOT ID no. 6076119
  misc_feature: Encodes the peptide sequence at SEQ ID NO 7428
atgtcgtcgaccgcgggccccgtggccttcgtcggcgcggacgagctcagcgtcgagctcgccgcctccttcctccgctccggcgcccgcgtccgctccttcgtccccgaggcggaacggtcgccacctgcggcgctcgcggagctgaatggcctcctccggtgcgggagcccagtggaagccgcgcgagatgctgcgctggtcgtcgtgctaagcgatgctggtgcggttgacgagttgttcttcggggttgagggtatcgcgaaaggattacgcgcgggttctattatattgattcgttcgacattgctgcctagccagctggagaagctggagcagaagcttacagatgagaagaaggatatcttccttctggatggatacattttcagtggtttatctgatgaactaaagcaacagattgttattgttgcatctgggagacagtacatagcagaaggagctagaaagtttttccatagtctaaacaataccatttactttgctgaaggtgaattttgcactagcagcaaacttagggtggtaaatgatttgctggagggcattcattttgttgcgtctattgaagcaatgtatcttggtgttcgagctgggattcatccatcaattatctatgacataatatcgaatgctgctgggagctcgaggatatttgtggagttagttccaaaacttctgagtggggatcctttgcttattgattttctaaactcagcaaggaaaaatgctagccatgtgatggatatggcaaaatcagtaacatttccactgccacttctgggtgttgcctatcaacaattgatacatgtaactggagatggatctgcctcaccgctgaaggtttgggaagcatcgtttggagttaatattgtagatgctgccagtcaacaaatctatgatgcaagcaaattagctgatcagcttgttatggaatctaaagcagcaaagcggattggcttcattggtcttggagctatgggctttggaatggcatcccatttgctgaaatcagggttctatgttgttgcttatgatgtctacaagccatcaatggccaggtttgctgatttaggtggatcaacaaaaggttctcctgaggaagtagcaaaagatgtggaaatacttattatcatggttgcaaatgagtctcaagctgatagtgttctttttggaaatgctggtgctataccagtgttatctgctggaacatctatcatcctttcttctacagtttctcctggatttgtgattcacctcaacagaagattagaagctgaacgccgacagataaagttggttgatgctccagtatctggtggtgtcaaaagggcggcagatgggacactaactataatgacttcagggacagatgaagctctgcattgcactggttctgttctatcagcgctgagtgaaaagttgtatgtaatcaaaggaggatgtggagctgcaagttctgttaagatggtcaaccaacttcttgctggggttcatatagcctcagcagctgaagccatgtcatttgctgctcgactaaatttgagaacaagaagagtcttcgaaattatgcaacatgcaagaggttattcatggatgtttggaaatcgtgtgccacacatgcttgataatgattacacaccttattctgcagtggatatatttgtcaaggatctgggtatagtatcttctgaaagttccaattcgaggataccagtgcacgtttctactattgcccaccagctgtttatttcaggatctgcttctgggtggggtagatatgacgatgctgccgttgtgaaggtctatgagacattaactggtgtaaaagttgaagggaaggctcccatgctcagtaaagaagatgtccttcattctcttcctgctgaatggccagaagatccaattgataatcttgtatctattgcatctcatagtagcaaaaagattcttgtagttttagatgatgatccaactgggactcaaacagttcatgatatagaagttttaactgaatggcctgttgaagcccttgtcgaacagtttctcaagctaccgacttgcttttttattttgacaaactctcgttccatgactgctgataaggccatgctgctagtacaaactatatgcagaaatcttgaagctgcggcaaagaaggtccctggtgttagttatacagtagtcttgagaggtgattcaactctacgtggtcatttcccagaggaagctgacgctgctgtctcagtactaggtgagatggatgcctggataatctgtccattttttcttcaaggtgggagatacactattaatgacgtccactatgtcgcagactctgatagattaattcctgctggtgaaaccgaatttgccaaggatgcagcttttggctataaatcttccaatctcagacagtgggttgaagagaagactagaggacgggtttcggagaaccaagtttcaacaatttccataactctcttgcgtaaacaaggaccaactgctgtctgtgagcatctctgtagcttggcgaagggctctgtgtgcatcgtcaatgctgctagtgacagggacatggccgtctttgcttctggaatgatccaggctgaattgaaaggaaagcggtttctctgccgcacagctgcaagttttgtgagtgcaaggattgggatcaagccaaagccacctatctgtccaaatgaccttggcttaaaaagagctttaactggaggcctcataattgttggttcatatgtgccaaaaactacaaagcaggttgatgagctgcgatcacagtgcgggcaatctcttcgagtaatagaggtgtctgtcgagatggtttcaatgaaatcaatggaggacagagatcaagaaatcagccgaattgttgaactagggaatgcttatatacaatccagaaaagacactctagttctcaccagccgccaactcattactggaaaaactcctgaagaaagcttagaaattaattataaagtgagttcagcactagtggagattgtgagaaggattgatagtaaacctcattacatcattgcaaagggaggaatcacttcatctgatattgccacaaaagctttggaagctaaacgtgccaaagtcatgggacaagcattagctggtgtaccattgtggcagcttggtcctgagagtagatttcctggggtcccttacattgtttttcctggtaatgttggtgataacagtgctcttgctaaagtggtgaaaagttgggcttccccatctagaagttctacaaaagaacttcttcttaatgcagagaagggtggttatgctgttggtgctttcaatgtgtataaccttgagggaattgaagctgttgttgcagcagcagaggctgaaaagagtcctgctatcctgcagattcatcccagtgctctgaagcaaggtggagtcccattggtagcatgttgcattgctgctgcagaacaatccagtgtgcctatcagtgttcactatgatcacggcatttccaagtcagacttgcttcaagctcttgaagcgggatttgattcagtgatggtggatggttcccatctaactttaagggagaacatcttatacacaaagagcatgtcttccttggctcatgcaaaaggtttacttgtggaagctgagttgggtaggctctcaggctctgaagatggcctgaccgttgaagaatatgaagcaagatttactgatgttgcccaggctgagggatttattgatgagacaagcattgatgcactagcagtttgcattggaaatgttcatggaaaatatccacctagtggaccaaacctcagatttgacttgctaaaggatcttcgtgcattgaccttaaagaaaggagttagcttggttctccatggagcatctggtctacctcatgagctcgtaaaggagtgcatagacttgggcgtgagaaaattcaatgtgaacaccgaggttcggaacagctacctggagtcccttagaaagccagaaaaggacctgattcaggtcatggcgtctgctaaagaagcaatgaaagctgtggtagcagagaagctgcgcctctttggatcttctgggaaagcctga

SEQ ID NO: 7428 - protein, 1375 aa, Sorghum bicolor
  misc_feature: Ceres ANNOT ID no. 6076119
  misc_feature (1096)..(1375): Pfam Id: F_bP_aldolase Pfam Desc: Fructose-bisphosphate aldolase class-II
  misc_feature (322)..(487): Pfam Id: NAD_binding_2 Pfam Desc: NAD binding domain of 6-phosphogluconate dehydrogenase
  misc_feature (5)..(869): NCBI GI: 6714293 NCBI Desc: f15h18.21 [arabidopsis thaliana]
  misc_feature (100)..(852): NCBI GI: 8671773 NCBI Desc: t10o22.24 [arabidopsis thaliana]
  misc_feature (875)..(1375): NCBI GI: 144923503 NCBI Desc: ketose-bisphosphate aldolase, class-ii [medicago truncatula]
  misc_feature (866)..(1188): NCBI GI: 52077151 NCBI Desc: ketose-bisphosphate aldolase class-ii family-like [oryza sativa (japonica cultivar-group)]
  misc_feature (1106)..(1375): NCBI GI: 6714294 NCBI Desc: f15h18.22 [arabidopsis thaliana]
  misc_feature: The sequence is a functional homolog of SEQ ID NO. 509 in the 11/188,298 US application
  misc_feature: The sequence is a functional homolog of SEQ ID NO. 352 in the 11/188,298 US application
MSSTAGPVAFVGADELSVELAASFLRSGARVRSFVPEAERSPPAALAELNGLLRCGSPVEAARDAALVVVLSDAGAVDELFFGVEGIAKGLRAGSIILIRSTLLPSQLEKLEQKLTDEKKDIFLLDGYIFSGLSDELKQQIVIVASGRQYIAEGARKFFHSLNNTIYFAEGEFCTSSKLRVVNDLLEGIHFVASIEAMYLGVRAGIHPSIIYDIISNAAGSSRIFVELVPKLLSGDPLLIDFLNSARKNASHVMDMAKSVTFPLPLLGVAYQQLIHVTGDGSASPLKVWEASFGVNIVDAASQQIYDASKLADQLVMESKAAKRIGFIGLGAMGFGMASHLLKSGFYVVAYDVYKPSMARFADLGGSTKGSPEEVAKDVEILIIMVANESQADSVLFGNAGAIPVLSAGTSIILSSTVSPGFVIHLNRRLEAERRQIKLVDAPVSGGVKRAADGTLTIMTSGTDEALHCTGSVLSALSEKLYVIKGGCGAASSVKMVNQLLAGVHIASAAEAMSFAARLNLRTRRVFEIMQHARGYSWMFGNRVPHMLDNDYTPYSAVDIFVKDLGIVSSESSNSRIPVHVSTIAHQLFISGSASGWGRYDDAAVVKVYETLTGVKVEGKAPMLSKEDVLHSLPAEWPEDPIDNLVSIASHSSKKILVVLDDDPTGTQTVHDIEVLTEWPVEALVEQFLKLPTCFFILTNSRSMTADKAMLLVQTICRNLEAAAKKVPGVSYTVVLRGDSTLRGHFPEEADAAVSVLGEMDAWIICPFFLQGGRYTINDVHYVADSDRLIPAGETEFAKDAAFGYKSSNLRQWVEEKTRGRVSENQVSTISITLLRKQGPTAVCEHLCSLAKGSVCIVNAASDRDMAVFASGMIQAELKGKRFLCRTAASFVSARIGIKPKPPICPNDLGLKRALTGGLIIVGSYVPKTTKQVDELRSQCGQSLRVIEVSVEMVSMKSMEDRDQEISRIVELGNAYIQSRKDTLVLTSRQLITGKTPEESLEINYKVSSALVEIVRRIDSKPHYIIAKGGITSSDIATKALEAKRAKVMGQALAGVPLWQLGPESRFPGVPYIVFPGNVGDNSALAKVVKSWASPSRSSTKELLLNAEKGGYAVGAFNVYNLEGIEAVVAAAEAEKSPAILQIHPSALKQGGVPLVACCIAAAEQSSVPISVHYDHGISKSDLLQALEAGFDSVMVDGSHLTLRENILYTKSMSSLAHAKGLLVEAELGRLSGSEDGLTVEEYEARFTDVAQAEGFIDETSIDALAVCIGNVHGKYPPSGPNLRFDLLKDLRALTLKKGVSLVLHGASGLPHELVKECIDLGVRKFNVNTEVRNSYLESLRKPEKDLIQVMASAKEAMKAVVAEKLRLFGSSGKA

SEQ ID NO: 7429 - DNA, 1521 bp, Sorghum bicolor
  misc_feature: Ceres ANNOT ID no. 6076148
  misc_feature: Encodes the peptide sequence at SEQ ID NO 7430
atggcgcgcccggtgtcgtcgtcgacggcgaaggcaatgtcggtcgtggtggtggcgctgctcctcgcggcgtcgtcgtcggcggtgctggccgtgcacgactacggcgacgccctccgcaagagcatcctcttcttcgagggccagcggtccggccgtctgccacccacccagcgcctccggtggcgccaggactcggccatccacgacggcgccgacgccggggtggacctgacgggcgggtactacgacgccggcgacaacgtgaagttcggcttcccaatggcgttcacggcgacactcatctcctggggcctaatcgacttcggccggagcttcggcgcgcacgagtccgacgcccgcgcggcgctgcggtgggcgacggactacctgctgaaggcgacgtcgacgccgggggtggtgtacgtgcaggtcggggacgcgtcgcgggaccacgcgtgctgggagcggccggaggacatggacaccccgcggaccgtgtacaaggtggacgcgtcgcacccgggctccgacgtggccgccgagacggcggcggcgctggcggcggcgtccatcgtgttccgcgaaggcggcggcgacccagggtacgcggcgcggctcctggagcgcgccgtggaggtgttcgcgttcgcggacgcgcaccgcggcgcgtacagcgggagcctccgggacgcggtgtgcccctgctactgcgactacgacgggtaccaggacgagctgctgtggggcgccgcgtggctgcacagggcgtcccgccggagggagtaccgcgagtacatcaagaggaacgaggtggcgcttggtgctagcgtctccatcaacgagttcggctgggataacaagcacgccggcatcaacgtcctcatctccaaggaggtgctgatgggcaaggacgagtacttccggtcgttccgtgagaacgccgacaacttcatctgcagcctcctaccgggcatctccggccaccctcagatccagtactccccaggtggcctcctcttcaaggtgggcaacagcaacatgcagcacgtgacgtcgctctccttcctcctcctcgcctactccaactacctcagccacgccgacgcccgcgtctcctgcggctccggcgcctccgccgcgtcgccggtgcagctccggcgcgtggccaagcggcaggtggactacatcctgggcgacaacccgctgcggatgtcgtacatggtgggttacgggccgcggtacccgctgcggatccaccaccgggcgagctcgctgccgtcggtgtcggcgcacccggcgcggatcgggtgcaaggccggcgccgcctactacggcagcccgaggccgaacccgaacctgctggtgggcgccgtcgtgggcgggcccagcaacagcaccgacgcgttcccggacgcgcgggccgtgttccagcagtccgagcccaccacgtacatcaacgcgccgctgctcgccctgctcgcctacttctcccagcaccccgacccggcccagcactga

SEQ ID NO: 7430 - protein, 506 aa, Sorghum bicolor
  misc_feature: Ceres ANNOT ID no. 6076148
  misc_feature (34)..(495): Pfam Id: Glyco_hydro_9 Pfam Desc: Glycosyl hydrolase family 9
  misc_feature (18)..(505): NCBI GI: 75253245 NCBI Desc: endoglucanase 17 precursor (endo-1,4-beta glucanase 17) (osglu13)
  misc_feature (6)..(505): NCBI GI: 75225300 NCBI Desc: endoglucanase 6 precursor (endo-1,4-beta glucanase 6)
  misc_feature (14)..(500): NCBI GI: 33341256 NCBI Desc: endo-1,4-beta-glucanase isoform 08 [fragaria x ananassa]
  misc_feature (14)..(500): NCBI GI: 33341248 NCBI Desc: endo-1,4-beta-glucanase isoform 04 [fragaria x ananassa]
  misc_feature (14)..(500): NCBI GI: 33341254 NCBI Desc: endo-1,4-beta-glucanase isoform 07 [fragaria x ananassa]
  misc_feature (18)..(505): SWISSPROT Homolog: EC 3.2.1.4 Endoglucanase 17 precursor
  misc_feature: Useful for making plants with altered cell wall content and/or composition
  misc_feature: GREAT-hit functional homolog of the protein sequence encoded by LOCUS at1g23210
  misc_feature: GREAT-hit functional homolog of the protein sequence encoded by LOCUS at1g70710
  misc_feature: Useful for making plants with altered cell wall content and/or composition
  misc_feature: Functional homolog of the protein sequence given in SEQ ID NO 13992
  misc_feature: Useful for making plants with altered carbohydrate content
  misc_feature: Functional homolog of the protein sequence given in SEQ ID NO 13993
  misc_feature: Useful for biocontainment applications
  misc_feature: Useful for making plants with modulated nitrogen use efficiency
  misc_feature: Functional homolog of the protein sequence given in SEQ ID NO 13445
MARPVSSSTAKAMSVVVVALLLAASSSAVLAVHDYGDALRKSILFFEGQRSGRLPPTQRLRWRQDSAIHDGADAGVDLTGGYYDAGDNVKFGFPMAFTATLISWGLIDFGRSFGAHESDARAALRWATDYLLKATSTPGVVYVQVGDASRDHACWERPEDMDTPRTVYKVDASHPGSDVAAETAAALAAASIVFREGGGDPGYAARLLERAVEVFAFADAHRGAYSGSLRDAVCPCYCDYDGYQDELLWGAAWLHRASRRREYREYIKRNEVALGASVSINEFGWDNKHAGINVLISKEVLMGKDEYFRSFRENADNFICSLLPGISGHPQIQYSPGGLLFKVGNSNMQHVTSLSFLLLAYSNYLSHADARVSCGSGASAASPVQLRRVAKRQVDYILGDNPLRMSYMVGYGPRYPLRIHHRASSLPSVSAHPARIGCKAGAAYYGSPRPNPNLLVGAVVGGPSNSTDAFPDARAVFQQSEPTTYINAPLLALLAYFSQHPDPAQH

SEQ ID NO: 7431 - DNA, 1356 bp, Sorghum bicolor
  misc_feature: Ceres ANNOT ID no. 6076153
  misc_feature: Encodes the peptide sequence at SEQ ID NO 7432
atgtcggtgagttgtgggctcgagtgggtggtgtgcctgggctgcacgcgctgggcgtggaagcggctcacctacatcggcgcctacgacagcgagacgtggccgccggcgtcccccgacgagttcgagcccatcccgcgcctctgccgcgccgtgctggcaaactacgacgaggacctctccaaccccaagttcgcgccaccggagcgcggctacttcgacatcgaccccagtggcatcgtcaagcgggccacctacgcggacgtcggcaacgcgtgcccgccctaccttgtctacgtcgacgaggcgcacaaggagatcatcctcgccgtgcgcggcctcaacctcgtgcgcaacgccgactacaaggtgctcatggacaacaagctcgggatgcagatgttcgacggcggctacgtgcaccacggcctgctcaaggccgccaagttcatcctggagcgggagacggagacgctgcggtacctgctgcgccgctacgggcccgagtacaagctcgtgctcacgggccactcgctcggctccggcatcgccgcgctcatgaccgtgctggtggtcaacaaccgcaaggagttcgacaacatacccaggagccgagtcaagtgctacgcgctcgcgcccgccaggtgtatgtcgctcaacctcgccgtcaagtacgctgacgtcatcaactccgtcgtgctccaggatgactttttgccaagaacgccaacaccactagagtacatttttgggtctatcttctgcttgccctgcttgctattcctcatctgcttgagagatacatttaaacaagacaagagaaaatttaaagatccaagaagattgtatgctcctgggcgaatgtatcatatcgttgagaggaaattttgcagatgtggaagattcccacctgaggtcagaactgcaattccagtggaaggacgatttgagcatgttgtgttatcatgcagtaccacttctgatcatgccattgcttggattgaacgggaatcacaaaaggctttagagctaatgatggacagcaagaaggaaatgactccacctccgcagcaaaagatggagagattgcaaagttttgaggaggaacacaagaatgctctccagcgagcgaagaccctggatgttcctcatgccgcggacttgtctgaagaggacattcaggaggatggtggcactggcccaccctctgaaactcatagcgagacaaccacagaaacaaaatctgcaggtaaaacgagttgggacgaactgatggagaagcttttcaccagggatgaagatgggaaacttgtcgtgaacaaggatgcgatggcgaaggaaattattgtcgagtaa

SEQ ID NO: 7432 - protein, 451 aa, Sorghum bicolor
  misc_feature: Ceres ANNOT ID no. 6076153
  misc_feature (108)..(247): Pfam Id: Lipase_3 Pfam Desc: Lipase (class 3)
  misc_feature (6)..(74): Pfam Id: Lipase3_N Pfam Desc: Lipase 3 N-terminal region
  misc_feature (1)..(447): NCBI GI: 1087073 NCBI Desc: calmodulin-binding heat-shock protein; cambp [nicotiana tabacum]
  misc_feature (1)..(449): NCBI GI: 9757980 NCBI Desc: calmodulin-binding heat-shock protein [arabidopsis thaliana]
  misc_feature (1)..(441): NCBI GI: 140060405 NCBI Desc: lipase, class 3; lipase 3, n-terminal; zinc finger, c2h2-type [medicago truncatula]
  misc_feature (1)..(441): NCBI GI: 55793838 NCBI Desc: calmodulin-binding heat shock protein [gossypium hirsutum]
  misc_feature (1)..(441): NCBI GI: 56118085 NCBI Desc: calmodulin binding heat shock protein [gossypium hirsutum]
MSVSCGLEWVVCLGCTRWAWKRLTYIGAYDSETWPPASPDEFEPIPRLCRAVLANYDEDLSNPKFAPPERGYFDIDPSGIVKRATYADVGNACPPYLVYVDEAHKEIILAVRGLNLVRNADYKVLMDNKLGMQMFDGGYVHHGLLKAAKFILERETETLRYLLRRYGPEYKLVLTGHSLGSGIAALMTVLVVNNRKEFDNIPRSRVKCYALAPARCMSLNLAVKYADVINSVVLQDDFLPRTPTPLEYIFGSIFCLPCLLFLICLRDTFKQDKRKFKDPRRLYAPGRMYHIVERKFCRCGRFPPEVRTAIPVEGRFEHVVLSCSTTSDHAIAWIERESQKALELMMDSKKEMTPPPQQKMERLQSFEEEHKNALQRAKTLDVPHAADLSEEDIQEDGGTGPPSETHSETTTETKSAGKTSWDELMEKLFTRDEDGKLVVNKDAMAKEIIVE

SEQ ID NO: 7433 - DNA, 951 bp, Sorghum bicolor
  misc_feature: Ceres ANNOT ID no. 6076209
  misc_feature: Encodes the peptide sequence at SEQ ID NO 7434
atggccgccgccgccgccaccgcagcagcagcagtctcctccccggctgccccacgcgctggggctgccgccgcctcccgccgggggttcgtcacgttcggtggaggtgccgcccgctcctcgccaacgctgcggtccggccgcgggttctgtggtgtgcaaacccatgttgccgctgttgaacaagcagttgtaaaagatgctaccaggctggaagctccagttgttattgttacaggtgcctctagagggattggaaaggcaactgctctagcccttggaaaagcaggatgcaaggttctggttaactatgcccggtcctcgaaagaggctgaagaggtctccaaagagattgaagcatctggtggtgaagctgtcacctttggaggagatgtttcaaaagaagctgatgtagaatctatgatgaaagcagctctagataaatggggaacaatagatgtgctggtaaataatgcagggattacacgagacacgttattgatgaggatgaagaaatctcagtggcaagatgtaattgatctcaatcttacaggtgtcttcctgtgtacacaggctgcaacaaaagtaatgatgaagaagaaaaagggaaaaattatcaacattgcatctgttgttggccttactggcaatgttggccaagctaattatagtgcagccaaggctggggtgattggtttcacgaaaacagttgccagggagtatgcaagcagaaatatcaatgtgaatgctattgcaccagggttcattgcatctgatatgactgccgaacttggagaagagcttgagaagaaaatcttgtcaaccattccattagggagatacggccaaccagaggaagttgcagggctagtcgagttcctggcccttaaccccgcagctagctatatgaccggacaggtgcttacaattgatggagggatggtaatgtaa

SEQ ID NO: 7434 - protein, 316 aa, Sorghum bicolor
  misc_feature: Ceres ANNOT ID no. 6076209
  misc_feature (74)..(242): Pfam Id: adh_short Pfam Desc: short chain dehydrogenase
  misc_feature (74)..(259): Pfam Id: KR Pfam Desc: KR domain
  misc_feature (3)..(316): NCBI GI: 38346116 NCBI Desc: osjnbb0006n15.11 [oryza sativa (japonica cultivar-group)]
  misc_feature (3)..(316): NCBI GI: 18046 NCBI Desc: 3-oxoacyl-[acyl-carrier protein] reductase; beta-ketoacyl-acp reductase [cuphea lanceolata]
  misc_feature (53)..(316): NCBI GI: 14422251 NCBI Desc: 3-oxyacyl-[acyl carrier protein] reductase [brassica napus]
  misc_feature (53)..(316): NCBI GI: 14422263 NCBI Desc: beta-oxyacyl-[acyl-carrier protein] reductase [brassica napus]
  misc_feature (10)..(316): NCBI GI: 14422249 NCBI Desc: 3-oxyacyl-[acyl carrier protein] reductase [brassica napus]
  misc_feature (3)..(316): SWISSPROT Homolog: EC 1.1.1.100 3-oxoacyl-[acyl-carrier-protein] reductase, chloroplast precursor
  misc_feature: The sequence is a functional homolog of SEQ ID NO. 389 in the 11/188,298 US application
MAAAAATAAAAVSSPAAPRAGAAAASRRGFVTFGGGAARSSPTLRSGRGFCGVQTHVAAVEQAVVKDATRLEAPVVIVTGASRGIGKATALALGKAGCKVLVNYARSSKEAEEVSKEIEASGGEAVTFGGDVSKEADVESMMKAALDKWGTIDVLVNNAGITRDTLLMRMKKSQWQDVIDLNLTGVFLCTQAATKVMMKKKKGKIINIASVVGLTGNVGQANYSAAKAGVIGFTKTVAREYASRNINVNAIAPGFIASDMTAELGEELEKKILSTIPLGRYGQPEEVAGLVEFLALNPAASYMTGQVLTIDGGMVM

SEQ ID NO: 7435 - DNA, 582 bp, Sorghum bicolor
  misc_feature: Ceres ANNOT ID no. 6076678
  misc_feature: Encodes the peptide sequence at SEQ ID NO 7436
atggctgctcctaccgatgaggccgccggctcagggacgccgggaactaccgatccgttgctcgccgactggagggaacggatcatcattccggccgtcgcggctggtgtggttggagccgcgttcgggctgctgtcgcggcaccgggcgcgccttggcgccgcccgcgccgccgtcacctacgccgcgaacctcgccatcgtcgccgggtgctacggaggtgcacgtgaacttgcaagagatgctcgagccacaacacctaatgatcccatgaattctgttgttggtgggctagcaagtggagctgtccttggtcgaatacaaggtggacactttggagcagtgaaatatgcagtcacttttgcagctgccggtaccgcattggactacgctgcactgaagtatgccccagaatggcatgccctgaaagaacatttgtctggaaagaaagactggtttacgctacctgagtggtcacctatccaagtgttggatgaggaagccttggctaagaaaaaagctcgagaggagaagttgtttgcccaacgagcactaggtaaacttgacaaggaggatccctag

SEQ ID NO: 7436 - protein, 193 aa, Sorghum bicolor
  misc_feature: Ceres ANNOT ID no. 6076678
  misc_feature (17)..(135): Pfam Id: Tim17 Pfam Desc: Tim17/Tim22/Tim23 family
MAAPTDEAAGSGTPGTTDPLLADWRERIIIPAVAAGVVGAAFGLLSRHRARLGAARAAVTYAANLAIVAGCYGGARELARDARATTPNDPMNSVVGGLASGAVLGRIQGGHFGAVKYAVTFAAAGTALDYAALKYAPEWHALKEHLSGKKDWFTLPEWSPIQVLDEEALAKKKAREEKLFAQRALGKLDKEDP

SEQ ID NO: 7437 - DNA, 1482 bp, Sorghum bicolor
  misc_feature: Ceres ANNOT ID no. 6076953
  misc_feature: Encodes the peptide sequence at SEQ ID NO 7438
atggcgtcgccgccgccgccgccgcctcccgccgcagcctctgccccacccgccgcggcgtccggatcgccgccgccggcgcaagtggtgggcaacgccttcgtgcatcagtactacaacatcctgcaccagtcgccggagctcgtctaccgcttctaccaggaggccagccgcctcgggcgccccgccggcaccggcgccgacggcatggacacggtcaccaccatggacgcgattaacgagaagatcgtctcaatgggcatcgaccgggcggagatcaaggcggtggacgcacaggaatctctctgtggcggcgtcactgtgctcgtcatgggccaccttacggggaggaacggcgtcagccgcgagttcgtgcagtccttcttccttgcgccgcaggagaagggctacttcgttctcaacgacatactgcgctacgttggggagggggtaggggacgaggggaccaagcagcagccggcaccggaggttgctgcggatgtggagaccgccacccctgctcctatcctggccaacggcactgtcggaggggacacagggaccgtgcctcagaatgcttcgccgcagcccgagtgccaggtagctgagcctgcacttaatcaaaaggaggaagttgtgaacggggaggaggtttgtaacccgacaaatgatgtggagaagcctgttgttgaggaaacactggttcctgaggacataaatgaagtgccaaataatgtagcagtggctccaatttcatctccccctgtaccactggaggaggcaccaaagaagtcatatgcatcaattgtaaaagtgatgaaagaatatcgaccaccaggatctgcagttccttccaggcctgcacccctgaaaacagagaagcaagcgtctcctgcccccgctcaggttgctgatgctctagctttcacctctaatcctcagagtggcagctttcaagatccagaagttgatgcacatgccatatatgtgcgaagtctgccattaaatgccacaccacaacaattagaggaagagttcaagagatttggcgccattaaacatgaaggcatccaagttagaagcaataagatccaagggttttgttatggctttgtagaatttgaggatgccagtgcagttcaaactgcaatagaggcttctcctgttactattggtgaacggcaatgttatgttgaagaaaaaagaactaccggttctcgtggtggtagcaggggaggaaggttttcaccgggtagaggtggcaactttcgaggtgaaggcattagaggccgtggtacatacaatggaggtagagggtatggaaggggtgagttcagttatcgatctgattatggaggccgaggtggtggcaggggtggctcatcacgtggtgatgtcagctaccagcgggttgaccactctggtacagccagtggtcgtggtgcccgggcaccatcggctgccactgctgttgcaaagtga

SEQ ID NO: 7438 - protein, 493 aa, Sorghum bicolor
  misc_feature: Ceres ANNOT ID no. 6076953
  misc_feature (30)..(146): Pfam Id: NTF2 Pfam Desc: Nuclear transport factor 2 (NTF2) domain
  misc_feature (328)..(398): Pfam Id: RRM_1 Pfam Desc: RNA recognition motif. (a.k.a. RRM, RBD, or RNP domain)
  misc_feature (1)..(493): NCBI GI: 116309580 NCBI Desc: osigba0140a01.7 [oryza sativa (indica cultivar-group)]
  misc_feature (13)..(489): NCBI GI: 21360395 NCBI Desc: at3g25150/mjl12_9 [arabidopsis thaliana]
  misc_feature (30)..(489): NCBI GI: 9294171 NCBI Desc: rna-binding protein-like [arabidopsis thaliana]
  misc_feature (322)..(493): NCBI GI: 115446231 NCBI Desc: os02g0497700 [oryza sativa (japonica cultivar-group)]
  misc_feature (29)..(469): NCBI GI: 92891722 NCBI Desc: rna-binding protein-like [medicago truncatula]
  misc_feature: The sequence is a functional homolog of SEQ ID NO. 458 in the 11/188,298 US application
MASPPPPPPPAAASAPPAAASGSPPPAQVVGNAFVHQYYNILHQSPELVYRFYQEASRLGRPAGTGADGMDTVTTMDAINEKIVSMGIDRAEIKAVDAQESLCGGVTVLVMGHLTGRNGVSREFVQSFFLAPQEKGYFVLNDILRYVGEGVGDEGTKQQPAPEVAADVETATPAPILANGTVGGDTGTVPQNASPQPECQVAEPALNQKEEVVNGEEVCNPTNDVEKPVVEETLVPEDINEVPNNVAVAPISSPPVPLEEAPKKSYASIVKVMKEYRPPGSAVPSRPAPLKTEKQASPAPAQVADALAFTSNPQSGSFQDPEVDAHAIYVRSLPLNATPQQLEEEFKRFGAIKHEGIQVRSNKIQGFCYGFVEFEDASAVQTAIEASPVTIGERQCYVEEKRTTGSRGGSRGGRFSPGRGGNFRGEGIRGRGTYNGGRGYGRGEFSYRSDYGGRGGGRGGSSRGDVSYQRVDHSGTASGRGARAPSAATAVAK

SEQ ID NO: 7439 - DNA, 1482 bp, Sorghum bicolor; identical to SEQ ID NO: 7437
  misc_feature: Ceres ANNOT ID no. 6076955
  misc_feature: Encodes the peptide sequence at SEQ ID NO 7440

SEQ ID NO: 7440 - protein, 493 aa, Sorghum bicolor; identical to SEQ ID NO: 7438
  misc_feature: Ceres ANNOT ID no. 6076955
  misc_feature (30)..(146): Pfam Id: NTF2 Pfam Desc: Nuclear transport factor 2 (NTF2) domain
  misc_feature (328)..(398): Pfam Id: RRM_1 Pfam Desc: RNA recognition motif. (a.k.a. RRM, RBD, or RNP domain)
  misc_feature (1)..(493): NCBI GI: 116309580 NCBI Desc: osigba0140a01.7 [oryza sativa (indica cultivar-group)]
  misc_feature (13)..(489): NCBI GI: 21360395 NCBI Desc: at3g25150/mjl12_9 [arabidopsis thaliana]
  misc_feature (30)..(489): NCBI GI: 9294171 NCBI Desc: rna-binding protein-like [arabidopsis thaliana]
  misc_feature (322)..(493): NCBI GI: 115446231 NCBI Desc: os02g0497700 [oryza sativa (japonica cultivar-group)]
  misc_feature (29)..(469): NCBI GI: 92891722 NCBI Desc: rna-binding protein-like [medicago truncatula]
  misc_feature: The sequence is a functional homolog of SEQ ID NO. 458 in the 11/188,298 US application

SEQ ID NO: 7441 - DNA, 1209 bp, Sorghum bicolor
  misc_feature: Ceres ANNOT ID no. 6077515
  misc_feature: Encodes the peptide sequence at SEQ ID NO 7442
atggcaaagccactcaatggcattagccgtagcagtatgccaaggtcgaacgagggtatgcggctcatattttcggcagttgtaggtgtcatgctgggttacctgtttgggatctccttccctacagtcaacataaccaagcttcacttcccttcgagtatcatctcttatattgaagatagaaactctggcatcacaacccagacattgttgaaccatgcttgggcatctgcaaacaatcgtaaaaagaatagttctgaatctaacactgatgaaattcccaagatttatgttcctacaaacccaaaaggtgctgagagacttccaccaggcattgtagtgtctgaaacagatctttatccccgaagactatggggtgatcctagtgaggaccttactagcgagccgaggtatcttgttacttttactgttggtattggacaaaagtcaaatattgatgcagcagtcaaaaagttttcagacaaattcaccattatgttgttccattatgatggtcggactactgagtgggatgaatttgagtggtctaaaagagcaatccatgtgagtgttaggaagcagacaaaatggtggtatgcaaaacgatttttgcatcccgacattgttgccagatatgaatacattttcatctgggatgaggatctaggtgtagagcatttcaatgcagagaagtacattgagcttgttagaaagcatgggttggaaatctctcagcctggtttgcagcctgataaaggactaacatggcaaatgactaaacgacgtggtgaccaggaagttcacaaagtaactgaggagagaccaggctggtgcactgatccacatctaccaccatgtgcagcatttgttgaaattatggcaacagtgttctccagaaatgcatggcgctgtgtatggcatatgattcagaatgacttggtccatggatggggtcttgactttgctctgaggaaatgtgtggagccggctcatgagaagattggagttgttgatgctcaatggattgttcatcaagcagttccttcacttgggaaccagggcaagtcagataatggaagagcaccatgggaaggggtaagagcacgctgcagaaaagaatgggggatatttcagacaaggctggctgatgcggagaaggcttattacctggagcgaggcatcacacccccgaattcaacagtagtttag

SEQ ID NO: 7442 - protein, 402 aa, Sorghum bicolor
  misc_feature: Ceres ANNOT ID no. 6077515
  misc_feature (95)..(388): NCBI GI: 8778842 NCBI Desc: t6d22.12 [arabidopsis thaliana]
  misc_feature (90)..(290): NCBI GI: 4850384 NCBI Desc: f3f19.3 [arabidopsis thaliana]
  misc_feature (8)..(288): NCBI GI: 115441749 NCBI Desc: os01g0910400 [oryza sativa (japonica cultivar-group)]
  misc_feature (6)..(400): NCBI GI: 23309021 NCBI Desc: at3g26440/f20c19_16 [arabidopsis thaliana]
  misc_feature (93)..(400): NCBI GI: 9743342 NCBI Desc: f21j9.23 [arabidopsis thaliana]
MAKPLNGISRSSMPRSNEGMRLIFSAVVGVMLGYLFGISFPTVNITKLHFPSSIISYIEDRNSGITTQTLLNHAWASANNRKKNSSESNTDEIPKIYVPTNPKGAERLPPGIVVSETDLYPRRLWGDPSEDLTSEPRYLVTFTVGIGQKSNIDAAVKKFSDKFTIMLFHYDGRTTEWDEFEWSKRAIHVSVRKQTKWWYAKRFLHPDIVARYEYIFIWDEDLGVEHFNAEKYIELVRKHGLEISQPGLQPDKGLTWQMTKRRGDQEVHKVTEERPGWCTDPHLPPCAAFVEIMATVFSRNAWRCVWHMIQNDLVHGWGLDFALRKCVEPAHEKIGVVDAQWIVHQAVPSLGNQGKSDNGRAPWEGVRARCRKEWGIFQTRLADAEKAYYLERGITPPNSTVV

SEQ ID NO: 7443 - DNA, 759 bp, Sorghum bicolor
  misc_feature: Ceres ANNOT ID no. 6077813
  misc_feature: Encodes the peptide sequence at SEQ ID NO 7444
atggtctccaaggataccatccgtacggctatcggcgtcatcggcaatgggaccgcccttgtgctcttcctctccccggtgcccaccttcgtcggcatctggaagaagcgtgcagtggagcagtactcgccgatcccgtacgtggcgacgctgcttaactgcatgatgtgggtggtgtacggcttgccggtggtgcacccgcacagcatgctggtggtcaccatcaacggcaccggcatgctcatccagctctcctacgtcgtcctcttcatcctctgctccacgggggcggtgcgccgcaaggtcgtcctcctgttcgccgccgaggtcgcctttgtcgtcgccctggccgcgttagtgctcagcctggcgcatacgcacgagcgtaggtccatggtcgtcggcatcgtctccgtcttctttggcaccggcatgtacgccgcgccgctctctgtcatgaaaatggtgatcgagacaaagagcgtggaatacatgccgctgttcctgtccctggcctccctcgcgaatagcatttgctggactgcctacgcgctcatccgctttgatgtctatatcaccatccccaacgggctgggcgtgttgttcgcgctgggtcagctggtcctgtacgccatgttctacaagaacacccagcagatcatcgaggcacgcaagcgcaaggctgaccaccagcagggaaccgtgatggaggtggtcaccgacgccacgccccccaacaacaacggcaacacctactga

SEQ ID NO: 7444 - protein, 252 aa, Sorghum bicolor
  misc_feature: Ceres ANNOT ID no. 6077813
  misc_feature (9)..(101): Pfam Id: MtN3_slv Pfam Desc: MtN3/saliva family
  misc_feature (132)..(218): Pfam Id: MtN3_slv Pfam Desc: MtN3/saliva family
  misc_feature (39)..(229): NCBI GI: 431154 NCBI Desc: orf [lilium longiflorum]
  misc_feature (7)..(227): NCBI GI: 21592843 NCBI Desc: contains similarity to medicago truncatula mtn3 (gb:y08726) [arabidopsis thaliana]
  misc_feature (17)..(251): NCBI GI: 115438370 NCBI Desc: os01g0606000 [oryza sativa (japonica cultivar-group)]
  misc_feature (1)..(217): NCBI GI: 37050896 NCBI Desc: seven-transmembrane-domain protein 1 [lycopersicon esculentum]
  misc_feature (1)..(217): NCBI GI: 21592355 NCBI Desc: contains similarity to nodulin mtn3 protein [arabidopsis thaliana]
  misc_feature: The sequence is a functional homolog of SEQ ID NO. 328 in the 11/188,298 US application
MVSKDTIRTAIGVIGNGTALVLFLSPVPTFVGIWKKRAVEQYSPIPYVATLLNCMMWVVYGLPVVHPHSMLVVTINGTGMLIQLSYVVLFILCSTGAVRRKVVLLFAAEVAFVVALAALVLSLAHTHERRSMVVGIVSVFFGTGMYAAPLSVMKMVIETKSVEYMPLFLSLASLANSICWTAYALIRFDVYITIPNGLGVLFALGQLVLYAMFYKNTQQIIEARKRKADHQQGTVMEVVTDATPPNNNGNTY

SEQ ID NO: 7445 - DNA, 1629 bp, Sorghum bicolor
  misc_feature: Ceres ANNOT ID no. 6077849
  misc_feature: Encodes the peptide sequence at SEQ ID NO 7446
atggccgccgccgccgccgccgccgacgccgacgcagcagaggtggagcggctttacgagctcggcgagcgcctctcctccgccaaggacaagtccgagcatgcggcggactacgaggcgattattgcagcggtgaagggacagagtgtcaaggcgaagcagctcgcagcgcagctcatccccaggttcttccggagcttccctgcactcgccacgcgtgccatgtcggccatgttcgacctcgtcgatatggaggagctcgcgatcagaatacaagctattcgggggtttccacttcttggcaaagatactgaatttgtgtcaaaaattgcagatgttttgggacaactccttacaagtgaggaaaatgtagagcgtgatgctgttcataaagcgctcatgtcccttatacgacaagatgttaaaaattctttacaacctttatttaagcatgtggagcaaggatcagagattcgtgagaagattatttcttttcttcgagacaaggtctttcctcttaaagcagagctactgaaacctcaagcagaaatggagagatttataacagatttgataaagaaaagtgtgcaagatgtaactggttcagaatttgaactattcatgggattcctgcgaagcttgagcatatttggggatactgctcctagagagtcctttcaagaactaattgaaattattcaagcacaggctgatctgaattcacaattcaatgtttctgacattgaccacattgagaggtggatttcatgcatgtatatggctcttccaatcttcatgagaggaggatcagcaagcaagttcctcaattacttcgtcaagcaaattgttccagcatttgagaagattcctgaagaaaagaaactggatttgctcaagactattgcttcaagttcaccatatgcgacagcacaagattcacgtcagctgcttccatctgttgttcagttactcaagaagtatatgcctgggaagaaggtggaagatatcaaccataattatgttgagtgcttgctgtacacttttcatcatttggctcataagactccaaacacaacaaacagtctatgtggctacaagattgttaccgggcaaccatccgatagacttggggaggacttctctgagcattacaaagattttacggagaggttaattggaacagaagagacggtacgagcagcctcaaagcgactaactcaggggatggcagatttcaacaaggcaatatcttcagcaaaaactgaaggggaaaagactaaaattaaaggcgatcagcaaacttcaacaaggacaatgaggtcatataacaatatattgtcaatggcacagttgttgcatttgaaatcccctttatttattggtgataagaaaatcactctatcatggatggagcagcccaagaaaccagaagctacaacagcaagggggaagaggtcacaacctgctacaaatgggaatggccctgcaaataagaaggggagaggaggaatgcaaaaccagcttgtgaacagagcttttgaaggattgtctcgtggtggtagaggcagtggaagggggcaggtcaggggtggccgaggaagaggaagaggatggggtggctaccgctga

SEQ ID NO: 7446 - protein, 542 aa, Sorghum bicolor
  misc_feature: Ceres ANNOT ID no. 6077849
  misc_feature (14)..(542): Pfam Id: API5 Pfam Desc: Apoptosis inhibitory protein 5 (API5)
  misc_feature (11)..(428): NCBI GI: 30685906 NCBI Desc: apoptosis inhibitory 5 (api5) family protein [arabidopsis thaliana]
  misc_feature (271)..(542): NCBI GI: 115445753 NCBI Desc: os02g0313400 [oryza sativa (japonica cultivar-group)]
  misc_feature (265)..(542): NCBI GI: 10764848 NCBI Desc: f1k23.1 [arabidopsis thaliana]
  misc_feature (15)..(329): NCBI GI: 2623761 NCBI Desc: aac11 [homo sapiens]
  misc_feature (13)..(540): NCBI GI: 50415431 NCBI Desc: api5-prov protein [xenopus laevis]
MAAAAAAADADAAEVERLYELGERLSSAKDKSEHAADYEAIIAAVKGQSVKAKQLAAQLIPRFFRSFPALATRAMSAMFDLVDMEELAIRIQAIRGFPLLGKDTEFVSKIADVLGQLLTSEENVERDAVHKALMSLIRQDVKNSLQPLFKHVEQGSEIREKIISFLRDKVFPLKAELLKPQAEMERFITDLIKKSVQDVTGSEFELFMGFLRSLSIFGDTAPRESFQELIEIIQAQADLNSQFNVSDIDHIERWISCMYMALPIFMRGGSASKFLNYFVKQIVPAFEKIPEEKKLDLLKTIASSSPYATAQDSRQLLPSVVQLLKKYMPGKKVEDINHNYVECLLYTFHHLAHKTPNTTNSLCGYKIVTGQPSDRLGEDFSEHYKDFTERLIGTEETVRAASKRLTQGMADFNKAISSAKTEGEKTKIKGDQQTSTRTMRSYNNILSMAQLLHLKSPLFIGDKKITLSWMEQPKKPEATTARGKRSQPATNGNGPANKKGRGGMQNQLVNRAFEGLSRGGRGSGRGQVRGGRGRGRGWGGYR

SEQ ID NO: 7447 - DNA, 2754 bp, Sorghum bicolor
  misc_feature: Ceres ANNOT ID no. 6078169
  misc_feature: Encodes the peptide sequence at SEQ ID NO 7448
atgcagggcctcgcggtagcaagcccgcttcctcccgccgcggccgcagctcggcggcggccgcgcgcgtcctcctctaccagggaagcagtttcacaatgctggaagtacgaattaagtcgagatcaatatctaggaggcttcctaaggataagtcagtctcaaggaagcttgcacagacatcgctcaacaaatttgctcagaccagctgctgcagctatttcagttgaacaagatgaactcaatacttatcttccaaaaggtgatatgtggtctgtgcacaagttcggtggaacctgtatgggaacaccccaaagaatccagagtgtcgctgatatagttctcggtgattcttctgagaggaagctgataattgtttcagcaatgtccaaagtaaccgacatgatgtacaaccttgtacagaaggctcagtcaagggatgattcatatacaatagcattggaagaagtttttgagaagcatatggctgcagcaaaggatctccttgatggagaagatcttgcaagtttcttgtctcagctgcactcagacgtcagcaacttgcgagccatgctccgtgctatctatatagctgggcatgcgacagaatctttctctgactttgttgttgggcatggagaattgtggtcttcgcagatgctttcatatgcaataaagaagtctggggcaccctgcagttggatggatacaagagaagttcttgttgtaaaacccagtggttctaatcaagtagaccctgattgtttggaatctgagaagcgacttcagaaatggttttctcggcaaccagctgacataatagttgctacagggtttattgcaagtacagctgaaaacattcctacaactctaaaaagggatggaagtgatttctcagcagccataattggttctcttgtcagggcacgccaggtcactatttggactgatgttgacggggtatttagcgctgatccaagaaaagttagtgaggctgtgatcttaagaactttgtcttaccaggaggcctgggaaatgtcatattttggggcaaatgttttgcatccgcgcaccattatacctgtgatgaaagacaacattcccattgttattaagaacatgttcaatctctgtgcccctggaaccatgatttgcaagcagcctgccaatgaaaatggtgatttagacgcatgtgtgaaatcatttgctactatcgataatttagctcttgttaatgttgaaggaactggaatggctggtgttccaggtacagcaagtgctatatttagtgctgttaaagatgttggagctaatgttatcatgatatctcaggctagcagtgaacattcagtatgctttgctgttccagaaaaggaagttgctgcggtttctgctgcattacatgttaggtttcgtgaggcattagcagcagggaggttatctaaggttgaagttattaaaggttgcagcattctggctgctgttggactgaggatggctagcactcctggagtcagtgcaatactttttgatgcattagccaaggcaaacattaatgttcgagcaatagctcaaggttgcagtgaatacaatattactgttgtattgaagcaagaagattgtgtaagggctctgagagctgctcactcaaggttcttcctctccaaaaccacacttgctgttgggatcataggacctggtttaattggtggaacactccttaaccagctgaaggatcaggctgctgttcttaaggaaaatatgaacattgatctacgtgtcattggaataactggttcaagtacaatgcttttgagcgacacgggaatagacttaacccagtggaaacagcttctacaaaaggaagcagaaccagctaatattgatagttttgttcatcatttatctgataatcatatatttccaaacaaagttttggtggactgcacagcggatacaagtgtggcatcccattattacgattggttaaagaagggtattcatgtcatcacgccgaataagaaagcaaattctgggccacttgatcggtacctgaaattacggactctgcagcgtgcctcatacactcattacttttatgaagcaactgttggtgctggcctcccaatcattagcaccctgcgaggtcttctggagacgggtgataagatactgcgtattgagggcattttcagtggaactttgagttatatatttaacaatttcgaaggaacaaggccttttagtgatgttgttgctgaagcaaaagaggcaggatacactgaacctgatccaagagatgatctatctggaactgatgttgcccgaaaggtcattatccttgcaagggaatctggtttgaggctcgaacttcctgatattcctgtgaagagccttgtgccagaaacacttgcatcatgctcgtcagcagatgaattcatgcaaaagctaccaacctttgatgaggactgggccaggcaacgcagtgatgctgaagctgcagacgaagtcctgcgttacgttggagtggtggacacggtgaacaagaaaggacaggtggagctacgtagatacaagagggatcacccgttcgcgcagctctccggctccgacaacatcatcgccttcaccacctctaggtacaaggagcagccactgatcgtgcggggtccaggcgcgggcgcggaggtgactgcgggtggcgtcttctgcgaccttctgcggctggcgtcttacctcggcgctccttcgtag

SEQ ID NO: 7448 - protein, 917 aa, Sorghum bicolor
  misc_feature: Ceres ANNOT ID no. 6078169
  misc_feature (709)..(907): Pfam Id: Homoserine_dh Pfam Desc: Homoserine dehydrogenase
  misc_feature (90)..(373): Pfam Id: AA_kinase Pfam Desc: Amino acid kinase family
  misc_feature (565)..(701): Pfam Id: NAD_binding_3 Pfam Desc: Homoserine dehydrogenase, NAD binding domain
  misc_feature (411)..(472): Pfam Id: ACT Pfam Desc: ACT domain
  misc_feature (493)..(553): Pfam Id: ACT Pfam Desc: ACT domain
  misc_feature (1)..(917): NCBI GI: 500853 NCBI Desc: aspartate kinase-homoserine dehydrogenase
  misc_feature (1)..(917): NCBI GI: 50726450 NCBI Desc: aspartate kinase-homoserine dehydrogenase [oryza sativa (japonica cultivar-group)]
  misc_feature (1)..(917): NCBI GI: 1777375 NCBI Desc: aspartate kinase-homoserine dehydrogenase [oryza sativa (japonica cultivar-group)]
  misc_feature (1)..(917): NCBI GI: 500851 NCBI Desc: aspartate kinase-homoserine dehydrogenase
  misc_feature (155)..(917): NCBI GI: 115475992 NCBI Desc: os08g0342400 [oryza sativa (japonica cultivar-group)]
MQGLAVASPLPPAAAAARRRPRASSSTREAVSQCWKYELSRDQYLGGFLRISQSQGSLHRHRSTNLLRPAAAAISVEQDELNTYLPKGDMWSVHKFGGTCMGTPQRIQSVADIVLGDSSERKLIIVSAMSKVTDMMYNLVQKAQSRDDSYTIALEEVFEKHMAAAKDLLDGEDLASFLSQLHSDVSNLRAMLRAIYIAGHATESFSDFVVGHGELWSSQMLSYAIKKSGAPCSWMDTREVLVVKPSGSNQVDPDCLESEKRLQKWFSRQPADIIVATGFIASTAENIPTTLKRDGSDFSAAIIGSLVRARQVTIWTDVDGVFSADPRKVSEAVILRTLSYQEAWEMSYFGANVLHPRTIIPVMKDNIPIVIKNMFNLCAPGTMICKQPANENGDLDACVKSFATIDNLALVNVEGTGMAGVPGTASAIFSAVKDVGANVIMISQASSEHSVCFAVPEKEVAAVSAALHVRFREALAAGRLSKVEVIKGCSILAAVGLRMASTPGVSAILFDALAKANINVRAIAQGCSEYNITVVLKQEDCVRALRAAHSRFFLSKTTLAVGIIGPGLIGGTLLNQLKDQAAVLKENMNIDLRVIGITGSSTMLLSDTGIDLTQWKQLLQKEAEPANIDSFVHHLSDNHIFPNKVLVDCTADTSVASHYYDWLKKGIHVITPNKKANSGPLDRYLKLRTLQRASYTHYFYEATVGAGLPIISTLRGLLETGDKILRIEGIFSGTLSYIFNNFEGTRPFSDVVAEAKEAGYTEPDPRDDLSGTDVARKVIILARESGLRLELPDIPVKSLVPETLASCSSADEFMQKLPTFDEDWARQRSDAEAADEVLRYVGVVDTVNKKGQVELRRYKRDHPFAQLSGSDNIIAFTTSRYKEQPLIVRGPGAGAEVTAGGVFCDLLRLASYLGAPS

SEQ ID NO: 7449 - DNA, 1884 bp, Sorghum bicolor
  misc_feature: Ceres ANNOT ID no. 6078209
  misc_feature: Encodes the peptide sequence at SEQ ID NO 7450
atggtcaccacttcgccggccactctacagccatcatcgtcatcatgcaagcacgcgagccgcggcgtggcccggtgctgccctgctcctcctcctcctctgctgtcgtggaagagacgaagcagcggccagcagcaggtgacgacgacaagggccacggcggcgagctcccgtgggcagccgcccatcggcgtcgcgggtgtggccggcggcgaggaggagggcgacagcatccggcggctgcagaacgggtcggacgtgcggggcgtcgcgctggagggcgagaaatgccgtgccgtggacctcaccccgctggccgtcgaggccatcgccgagagcttcggggagtggctgcgggaggaggagctccggctccggggcgaggagccccagcagcagctccgggtgtccgtcggccgcgaccctcggctgtcggggccgcggctcggcgcggcgctcttcgcggggctcgccagcgccggctgctccgtcttcgacatggggctcgccaccacgccggcctgcttcatgagcaccatactgccacgcttcaactatgacgcctctatcatgctgacggcgtcacacctcccctacacccgcaacggcctcaagttcttcaccaagcgcggcgggctcacctcgggcgacgtcgagaccatctgcgaccgcgcggcgcagaagtacgtggcgcgccggaagatgggcctcggagacacgccgccgccgccgccggtggtgatgcgcgtggacctgatgagcgcctacgcgcagcacctccgcgacatcatcaagcagcgcgtggcgcacccggagcactacgacacgccgctgagggggttcaaggtcgtggtgaacgccggcaacgggtgcggcgggttcttcacgcgggacgtgctggagaagctgggcgccgacaccacgggcagcctgcacctggatcccgacgggcggttccccaaccacatgcccaacccggaggacgcgacggccatgtcgctgacccggggcgccgtgctggcgcagggcgcggacctgggcgtcgtcttcgacacggacgtggaccgcagcggcgtggtggacgccgggggcgcggccatcaacggcgaccgcctcatcgcgctcatgtcggccatcgtgctgggcgagcacgggggcaccatggtcgtcacggacgcgcgcgccagcgacgggctcacgaggttcatcgagtccagagggggacgccactgcctgtaccgcgtcggctaccgcaacgtgatcgacaagggcgtgcagctcaacgacgacggcgtggagacgcacctgatgatggagaccaccgggcacggcgcgctcagggagaactacttcctcgacgacggcgcctacatggtggtgaagatcatcattgagatggtccggatgaagctggcaggggtggagggaggggtagggagcctcatcgcggatctggaggagcccgcagagtccgtgctcttgaggatggacgtcttgggggagcccaagcatgccaaacaaagggcgacacaggcagtggaggctttcaagaaatacatcatggaggacaaactttccggttgggtgctcgatgattgcggggattgctcagtgtccgagggatgcctcgaggactcaaatgatcgtcccatcgatgtcgatgcatacatgtacagagcgaaactttacgacgagaatgagagagcactaggcatggtccaccttcgtcaaagtgtgcataaccccaatatagcactgaacatgcagtcctatgttcctggtggttgcaaatccatggcaaaggatcttcatcagaggtttttgctcgcaagtgggctgaacgagtttgttgacatcagcgaagtggagaaatttatcaagtag

SEQ ID NO: 7450 - protein, 627 aa, Sorghum bicolor
  misc_feature: Ceres ANNOT ID no. 6078209
  misc_feature (79)..(233): Pfam Id: PGM_PMM_I Pfam Desc: Phosphoglucomutase/phosphomannomutase, alpha/beta/alphadomain I
  misc_feature (254)..(366): Pfam Id: PGM_PMM_II Pfam Desc: Phosphoglucomutase/phosphomannomutase, alpha/beta/alphadomain II
  misc_feature (54)..(627): NCBI GI: 534982 NCBI Desc: phosphoglucomutase [spinacia oleracea]
  misc_feature (79)..(519): NCBI GI: 126657950 NCBI Desc: phosphoglucomutase/phosphomannomutase family protein [cyanothece sp. ccy0110]
  misc_feature (79)..(521): NCBI GI: 67922212 NCBI Desc: phosphoglucomutase/phosphomannomutase c terminal:phosphoglucomutase/phosphomannomutase alpha/beta/alpha domain i:phosphoglucomutase/phosphomannomutase alpha/beta/alpha
  misc_feature (79)..(521): NCBI GI: 67922212 (continued) domain ii:phosphoglucomutase/phosphomannomutase alpha/beta/alpha domain iii [crocosphaera watsonii wh 8501]
  misc_feature (78)..(548): NCBI GI: 82746588 NCBI Desc: similar to phosphoglucomutases [clostridium beijerincki ncimb 8052]
  misc_feature (78)..(548): NCBI GI: 82748168 NCBI Desc: similar to phosphoglucomutases [clostridium beijerincki ncimb 8052]
MVTTSPATLQPSSSSCKHASRGVARCCPAPPPPLLSWKRRSSGQQQVTTTRATAASSRGQPPIGVAGVAGGEEEGDSIRRLQNGSDVRGVALEGEKCRAVDLTPLAVEAIAESFGEWLREEELRLRGEEPQQQLRVSVGRDPRLSGPRLGAALFAGLASAGCSVFDMGLATTPACFMSTILPRFNYDASIMLTASHLPYTRNGLKFFTKRGGLTSGDVETICDRAAQKYVARRKMGLGDTPPPPPVVMRVDLMSAYAQHLRDIIKQRVAHPEHYDTPLRGFKVVVNAGNGCGGFFTRDVLEKLGADTTGSLHLDPDGRFPNHMPNPEDATAMSLTRGAVLAQGADLGVVFDTDVDRSGVVDAGGAAINGDRLIALMSAIVLGEHGGTMVVTDARASDGLTRFIESRGGRHCLYRVGYRNVIDKGVQLNDDGVETHLMMETTGHGALRENYFLDDGAYMVVKIIIEMVRMKLAGVEGGVGSLIADLEEPAESVLLRMDVLGEPKHAKQRATQAVEAFKKYIMEDKLSGWVLDDCGDCSVSEGCLEDSNDRPIDVDAYMYRAKLYDENERALGMVHLRQSVHNPNIALNMQSYVPGGCKSMAKDLHQRFLLASGLNEFVDISEVEKFIK

SEQ ID NO: 7451 - DNA, 585 bp, Sorghum bicolor
  misc_feature: Ceres ANNOT ID no. 6078224
  misc_feature: Encodes the peptide sequence at SEQ ID NO 7452
atgccgctgcggcgcggggcccctccctgcccgccgcgggctctggccggggtgctgtgttggggcggcggctccatgggcgcggggggctggtgctgcgcccccatcatccgccgggcatgcttcctgcgaccaaccaaggagaagagcggaggggctctcggatggaggccaacttttgccttggagactggtgggccatctaacactgatggccaagactttgatgaggacagtggttttcttggtaggactagactgggaagtctcatccaagctgctgcaagggagctacttgacaagctgaactctgccagaacgaattcgccaacaaagatattccttgtcctccttggtttttacacagccaatgccttggcaacaatactagggcagaccggtgactgggatgttcttgttgctggtgttgtagtggctgccattgagggaattggcatgctcatgtacagaaaaccaattaccaggcctcctggtaggtttcaatctttgatttcaatggtgaactactggaaagctggtgtatgcctgggcctttttgtggacgccttcaagctgggtagctga

SEQ ID NO: 7452 - protein, 194 aa, Sorghum bicolor
  misc_feature: Ceres ANNOT ID no. 6078224
  misc_feature (56)..(194): NCBI GI: 50251788 NCBI Desc: antigen receptor-like [oryza sativa (japonica cultivar-group)]
  misc_feature (1)..(194): NCBI GI: 50252920 NCBI Desc: antigen receptor-like protein [oryza sativa (japonica cultivar-group)]
  misc_feature (82)..(194): NCBI GI: 3335348 NCBI Desc: t8f5.20 [arabidopsis thaliana]
  misc_feature (74)..(191): NCBI GI: 115456649 NCBI Desc: os03g0852600 [oryza sativa (japonica cultivar-group)]
  misc_feature (83)..(194): NCBI GI: 38344242 NCBI Desc: oj991113_30.19 [oryza sativa (japonica cultivar-group)]
MPLRRGAPPCPPRALAGVLCWGGGSMGAGGWCCAPIIRRACFLRPTKEKSGGALGWRPTFALETGGPSNTDGQDFDEDSGFLGRTRLGSLIQAAARELLDKLNSARTNSPTKIFLVLLGFYTANALATILGQTGDWDVLVAGVVVAAIEGIGMLMYRKPITRPPGRFQSLISMVNYWKAGVCLGLFVDAFKLGS

SEQ ID NO: 7453 - DNA, 918 bp, Sorghum bicolor
  misc_feature: Ceres ANNOT ID no. 6078278
  misc_feature: Encodes the peptide sequence at SEQ ID NO 7454
atggcgaccgcgcgcctcctcgcgcgagtctccaggcaatgcgccggcgcagtggctgcgtcatcagccgcggggcggcaccggagggccccggcggcggcgtccgtggagcagttcgccggttcctgtttgtctgccagggttccacgtattttgaatcatcatttcagatactcaaccagcatttttcaaaagtttggtttctcctctgtttcacctcaacaaagtgataatgaactgaaagaccaggaaagggccttagatgaatcaagtgaagactgttcatctggaagtgagaacacatcagaaccaggtattgaaggccttgatctgtcaaaagatgatttggtgaagctagtttgtgagaaggacggattgttgaagtccaaagatgatgaaatcaaagatatgaaggataaggttttgcgcagctatgcagaaatggaaaatatcattgctcggacaaaacgtgaatctgaaaactccaaaaaatatgcagtacagaacttcgctaagagcctgctagatgttgctgacaatttgtctagagcatcatctgttgtcaaggaaagcttctcgaaaattgatgcctcaaaagattctgctggagctatcccactactgaaaaccctgctggagggtgtggacatgactgagaagcaactagcagaggtcttcaagaagtttggagttgaaaagtttgatccgctaaatgagaaatttgatcctaacaggcattgtgcagtttttcaaattcctgatccttcaaaaccatcaggaactgttgcttctgttgtaaaggttggctacatgttacatgaccgcgtcctccgccctgcggaagtcggtgtcacagcgggaggtgcagatgcaactgaagaggcagagcagccggaggagaaaacagcaagggactaa

SEQ ID NO: 7454 - protein, 305 aa, Sorghum bicolor
  misc_feature: Ceres ANNOT ID no. 6078278
  misc_feature (79)..(286): Pfam Id: GrpE Pfam Desc: GrpE
  misc_feature (1)..(305): NCBI GI: 48525531 NCBI Desc: grpe2 [saccharum hybrid cultivar]
  misc_feature (1)..(303): NCBI GI: 48525529 NCBI Desc: grpe1 [saccharum hybrid cultivar]
  misc_feature (1)..(296): NCBI GI: 7269530 NCBI Desc: grpe like protein [arabidopsis thaliana]
  misc_feature (61)..(297): NCBI GI: 3851638 NCBI Desc: chaperone grpe type 1 [nicotiana tabacum]
  misc_feature (58)..(300): NCBI GI: 3851640 NCBI Desc: chaperone grpe type 2 [nicotiana tabacum]
MATARLLARVSRQCAGAVAASSAAGRHRRAPAAASVEQFAGSCLSARVPRILNHHFRYSTSIFQKFGFSSVSPQQSDNELKDQERALDESSEDCSSGSENTSEPGIEGLDLSKDDLVKLVCEKDGLLKSKDDEIKDMKDKVLRSYAEMENIIARTKRESENSKKYAVQNFAKSLLDVADNLSRASSVVKESFSKIDASKDSAGAIPLLKTLLEGVDMTEKQLAEVFKKFGVEKFDPLNEKFDPNRHCAVFQIPDPSKPSGTVASVVKVGYMLHDRVLRPAEVGVTAGGADATEEAEQPEEKTARD

SEQ ID NO: 7455 - DNA, 1638 bp, Sorghum bicolor
  misc_feature: Ceres ANNOT ID no. 6078524
  misc_feature: Encodes the peptide sequence at SEQ ID NO 7456
atgagcatcgtgcccaaggagacgattgaggtcatcgctcagagcgtcggcatccccagcctcggcgccgatgtcgccgtcgcgctcgcccccgacgtcgaataccgcctccgcgagatcatgcaggaatccattaaatgtatgcggcatgcaaagcggactgttctgacggcggatgatgttgacagtgccctgggcctcaggaatgttgagcctgtgtatggatttgcttctggtgacccattgcgttttaagagagctgttgggcataaagatctcttctatcttgatgatcgggaggtagacttcaaagagattattgaagctcctctgcccaaagccccactggacacatcagttgtagcccattggctagcgattgagggggtacagcctgcaataccggagaatcctgctattgacgcaattgtaccaccaactgaaaataaaaggtctgagcatggtaaggatgatggactgccagttgacatcaagcttcctgttaagcatgtattatctagagaactacagatgtactttgataaaatagctgagcttactatgagtagatctgatacatccctttttaaagaagctttagtgagcttggcaaaagattctggtcttcatcctttggttccttacttttcctacttcattgcagacgaggttacccggagtttgggtgatcttcctgttttatttgctctaatgagagtagtccaaagtcttctccgtaatccacatattcatattgaaccttatttgcaccagctgatgccatcaatgatcacttgcattgttgcaaaaaggctagggcataggctctcagataatcactgggaacttagagacttctctgccaatttggtcgcctcggtatgtcggaggtttggtcatgtctatcacaaccttcaaaatcggttaactaaaacattgatccatgcatttcttgatcctgccaaatcactgacacaacattatggtgctgttcaagggatatctgcattgggtcccagcgcgattagacttcttcttttgcccaaccttgtaacatatatgcaacttctggagccggaactgcagcttgagaagcagaaaaacgagatgaaaaggaaggaagcttggcgtgtttatggtgccttgctgtgtgctgcaggcaaatgcttgtatgatcggttgaaattatttcctggtttgctttctccatcgatgcggcctcttttacggagcaacaaaagggtctcaaccaacaacccaaataagcgaaaatctagcacaaatctctctgcaactcagccacctctgaagaagatggcaacagacgcaacagccaactccatggcctcagcttccatgggaggaaacatgcaaggtgccatggatggctttcctaaccagttagccaaccctggcatgatgcaggcctcgtcctctggccagatagtggagagcatcccatcagctgtgatccggagagatcagggcagtgatctcgcacagagagtttctgcagtgcttaggcaagcttggaaggaggatcaggacaccggtcatctcttggggtctctgtacgatgtctttggtgaagccatcttctcctttgtccaaccaccagagatatccttgtttgtgtag

SEQ ID NO: 7456 - protein, 545 aa, Sorghum bicolor
  misc_feature: Ceres ANNOT ID no. 6078524
  misc_feature (2)..(68): Pfam Id: TAF Pfam Desc: TATA box binding protein associated factor (TAF)
  misc_feature (1)..(518): NCBI GI: 2196466 NCBI Desc: tata binding protein-associated factor [arabidopsis thaliana]
  misc_feature (3)..(459): NCBI GI: 42495554 NCBI Desc: tata binding protein associated factor 6b isoform 1 [arabidopsis thaliana]
  misc_feature (135)..(459): NCBI GI: 42495556 NCBI Desc: tata binding protein associated factor 6b isoform 2 [arabidopsis thaliana]
  misc_feature (122)..(459): NCBI GI: 4585980 NCBI Desc: very similar to tata binding protein-associated factor [arabidopsis thaliana]
  misc_feature (41)..(459): NCBI GI: 28059031 NCBI Desc: very similar to tata binding protein-associated factor [arabidopsis thaliana]
MSIVPKETIEVIAQSVGIPSLGADVAVALAPDVEYRLREIMQESIKCMRHAKRTVLTADDVDSALGLRNVEPVYGFASGDPLRFKRAVGHKDLFYLDDREVDFKEIIEAPLPKAPLDTSVVAHWLAIEGVQPAIPENPAIDAIVPPTENKRSEHGKDDGLPVDIKLPVKHVLSRELQMYFDKIAELTMSRSDTSLFKEALVSLAKDSGLHPLVPYFSYFIADEVTRSLGDLPVLFALMRVVQSLLRNPHIHIEPYLHQLMPSMITCIVAKRLGHRLSDNHWELRDFSANLVASVCRRFGHVYHNLQNRLTKTLIHAFLDPAKSLTQHYGAVQGISALGPSAIRLLLLPNLVTYMQLLEPELQLEKQKNEMKRKEAWRVYGALLCAAGKCLYDRLKLFPGLLSPSMRPLLRSNKRVSTNNPNKRKSSTNLSATQPPLKKMATDATANSMASASMGGNMQGAMDGFPNQLANPGMMQASSSGQIVESIPSAVIRRDQGSDLAQRVSAVLRQAWKEDQDTGHLLGSLYDVFGEAIFSFVQPPEISLFV

SEQ ID NO: 7457 - DNA, 963 bp, Sorghum bicolor
  misc_feature: Ceres ANNOT ID no. 6078525
  misc_feature: Encodes the peptide sequence at SEQ ID NO 7458
atggcgcttctcctgcgcctcgctgctccgtcagcgccgccccggcggagctccggcggcagggctttgccgcgcgtcgtcctcccggaggccatttccaaacaatcatttcttcttcctttacgagttgacaacactgcaagtctgtcctgtcctattaagtgttcagcggctcggcatgccccatcactgattgatcacaccgattctaggaatggtggcatccatgcagctagtgtatatggacatgatctcatgaaatccatatctgatcttcaggaagttgtattttcttcttttagcaaagcatgtcttctcagtagttgtatcatatatggtctaccacccagttgtatagcagaaccatgtgagcaagcatactctctccctaacatgcctttgctattcgcgatagccatggttggtgctactgttggagggctccttgcgagacagaggagaggggagcttgcacgtctaaatgatcaattacgtcagataaatgctgcactgagaagacaagccaagattgaatcttatgctcctgccttgagctatgccccagttggtagtaagataccggaatcagaagttattgttgatcctcagaaagagcgcctaattgcatatctcaggactgggaagaactatctgagaaaccaagctcctgagaaggcatttcctgagtttaaggcagctcttgatcttgcacaatctttaggtgatcatgttgaagagaagaaggcagcacgaggattaggggcatccttgcaaagacaaggcaagtacaaggaagccataaattatcactccatggtgctaaacatctccaagatgaccggagaggatgcaggtgtcactgaagcatacggagcaatagcagattgctacaccgagcttggtgagctcgagaaggcaggcaagttctatgataagtacatagcaagattggagaatgaatga

SEQ ID NO: 7458 - protein, 320 aa, Sorghum bicolor
  misc_feature: Ceres ANNOT ID no. 6078525
  misc_feature (1)..(320): NCBI GI: 20804493 NCBI Desc: tetratricopeptide repeat(tpr)-containing protein-like [oryza sativa (japonica cultivar-group)]
  misc_feature (13)..(320): NCBI GI: 112735174 NCBI Desc: chloroplast flu-like protein [gymnadenia conopsea]
  misc_feature (103)..(320): NCBI GI: 42572429 NCBI Desc: tetratricopeptide repeat (tpr)-containing protein [arabidopsis thaliana]
  misc_feature (175)..(320): NCBI GI: 51950311 NCBI Desc: chloroplast flu-like protein short form [chlamydomonas reinhardtii]
  misc_feature (175)..(320): NCBI GI: 51950309 NCBI Desc: chloroplast flu-like protein long form [chlamydomonas reinhardtii]
  misc_feature: The plant is abnormally small.
  misc_feature: The plant produces a reduced number of seeds.
  misc_feature: Useful for biocontainment applications
  misc_feature: Useful for making plants with altered Lignin content
  misc_feature: Useful for making plants with altered alkaloid content
  misc_feature: Useful for making plants with modulated biomass
  misc_feature: GREAT-hit functional homolog of the protein sequence given in SEQ ID NO 13174
  misc_feature: Useful for biocontainment applications
  misc_feature: Useful for making plants with altered alkaloid content
  misc_feature: Useful for making plants with altered lignin content
  misc_feature: Useful for making plants with modulated biomass
  misc_feature: Functional homolog of the protein sequence given in SEQ ID NO 13174
MALLLRLAAPSAPPRRSSGGRALPRVVLPEAISKQSFLLPLRVDNTASLSCPIKCSAARHAPSLIDHTDSRNGGIHAASVYGHDLMKSISDLQEVVFSSFSKACLLSSCIIYGLPPSCIAEPCEQAYSLPNMPLLFAIAMVGATVGGLLARQRRGELARLNDQLRQINAALRRQAKIESYAPALSYAPVGSKIPESEVIVDPQKERLIAYLRTGKNYLRNQAPEKAFPEFKAALDLAQSLGDHVEEKKAARGLGASLQRQGKYKEAINYHSMVLNISKMTGEDAGVTEAYGAIADCYTELGELEKAGKFYDKYIARLENE

SEQ ID NO: 7459 - DNA, 1668 bp, Sorghum bicolor
  misc_feature: Ceres ANNOT ID no. 6078526
  misc_feature: Encodes the peptide sequence at SEQ ID NO 7460
atggccactcccgcgcctgcggccaacgccgacggcgctgctccgggcggcgtggacagccgcagcggctactgcgaggtgaccaggacgttccgtagcctgcgcccgccggtgccgctgccgccgccggacgcgccggtctcgtttccggagttcgccttctcgcgcctgacgtcgtccccgctccccgcgcacccggctctcctcgacgccgccaccggcgaggtcctatcgttcccggagttcctgtcccaggtgcgcgcgctcgcgggggcgcttcgctccgtggtccggctcggccgcggcgacgtcgcgttcatcctcgcgccgacgcggctggacatcccggtgctctactttgcgctgctctcgttcggcgccgtcgtgtcgccggtaaaccccacgctcaccgcggacgaggtcgcgcgcctcgtggcgctgtcgggcgcgtccgtcgccttcgccgtgtcggcgaccaccgcaaagctgccggctggcctccccaccatcctcctcgactcggaccgcttccgctcctttctgcagaggcagaacgacggccgtggggaggagggactggcggaggtgcggcagtcggacacggcggtgatccagtactcgtcggggacaacagggcgggtgaaggccgcggcgctgccgcaccggagcttcgtcgcgatggtggcaggagcccacgctgtgctcgggaaaccgaggcacggtcgcgagaggacgctgctgggcgcgcccatgttccactcgctggggttctactccgcgctgaagggtgtggcgctggggcacacgacggtggtggtgaccgacgcggtggcgcggcgcggcgtgaagggggtggtcgaggcggcggagaggtgggcggtcgctgagatgacggcgtcgccaccggtggtggtggccatggccaaggagcggtgccgcctggaggcactggagcgcgtggtgtgtggcggcgcgccgctgccgaggacggcagccgacagtttccgacgacggttccccaacgtggatctatgcatgggctacggttcaactgaggctggtggcatatcgctgatgatcagccgggaggagtgcgcccgcatcggttccgccggccgtgtctcggagaacgtggaggtgaagatcgtggaccacgtcaccggcaatgccctgtccgtgggccaaaaaggggagcttctcgtgagagggcctgccgtcatgactggatatgttggcgacgaggaggccaacgctagtagttttgactctgaaggatggcttaggactggggacctttgctacattgatcaggacggcttcttgttcgtggtggacaggctgaaagagctcatcaagtacaagggctatcaggttccacctgcagagctggagcttgtcctgcagtctttgccggaagttatcgatgccgcagtcatgccgtatcctcatgaggaggcagggcagataccggtggcgcttgtggtcaggcagcctggtagcaaggtcacggaggctcaagtcatagaccacgtcgcaaagagggtggccccttacaagaagatccgcaaggtgctcttcgtcgactccatacccaagtctccggctggcaagatactgagaaggcagctgaccaaccatgtgcaagctggggctgtctctagaatgtaa

SEQ ID NO: 7460 - protein, 555 aa, Sorghum bicolor
  misc_feature: Ceres ANNOT ID no. 6078526
  misc_feature (78)..(478): Pfam Id: AMP-binding Pfam Desc: AMP-binding enzyme
  misc_feature (18)..(555): NCBI GI: 29888154 NCBI Desc: 4-coumarate-coa ligase-like protein [arabidopsis thaliana]
  misc_feature (18)..(555): NCBI GI: 36312839 NCBI Desc: 4-coumarate coa ligase isoform 4 [arabidopsis thaliana]
  misc_feature (18)..(547): NCBI GI: 140056579 NCBI Desc: amp-dependent synthetase and ligase [medicago truncatula]
  misc_feature (18)..(543): NCBI GI: 29893225 NCBI Desc: 4-coumarate-coa ligase-like protein [arabidopsis thaliana]
  misc_feature (18)..(538): NCBI GI: 8778604 NCBI Desc: f5m15.18 [arabidopsis thaliana]
  misc_feature: Useful for making plants with altered cell wall content and/or composition
  misc_feature: Functional homolog of the protein sequence encoded by LOCUS at5g63380
MATPAPAANADGAAPGGVDSRSGYCEVTRTFRSLRPPVPLPPPDAPVSFPEFAFSRLTSSPLPAHPALLDAATGEVLSFPEFLSQVRALAGALRSVVRLGRGDVAFILAPTRLDIPVLYFALLSFGAVVSPVNPTLTADEVARLVALSGASVAFAVSATTAKLPAGLPTILLDSDRFRSFLQRQNDGRGEEGLAEVRQSDTAVIQYSSGTTGRVKAAALPHRSFVAMVAGAHAVLGKPRHGRERTLLGAPMFHSLGFYSALKGVALGHTTVVVTDAVARRGVKGVVEAAERWAVAEMTASPPVVVAMAKERCRLEALERVVCGGAPLPRTAADSFRRRFPNVDLCMGYGSTEAGGISLMISREECARIGSAGRVSENVEVKIVDHVTGNALSVGQKGELLVRGPAVMTGYVGDEEANASSFDSEGWLRTGDLCYIDQDGFLFVVDRLKELIKYKGYQVPPAELELVLQSLPEVIDAAVMPYPHEEAGQIPVALVVRQPGSKVTEAQVIDHVAKRVAPYKKIRKVLFVDSIPKSPAGKILRRQLTNHVQAGAVSRM

SEQ ID NO: 7461 - DNA, 1437 bp, Sorghum bicolor
  misc_feature: Ceres ANNOT ID no. 6078564
  misc_feature: Encodes the peptide sequence at SEQ ID NO 7462
atggagcgcggggttctgggctccaggggcgccggcgccgtccgaatcttggggatggagaccggggccgcgacgtcatgtggcaaaacaacctctataagttttactggttctaccaaacatgagcagaacttgcatgagaatgttaagccgtcgcaatttgcaacaaatggatcctctcgtctggtttacagaagttcagtacttaaaaatcagtggaatctttctgctagttcttcctctgcgaatgtggttaccacttttgatgatgacaaagatgtatcttccagtgttgttgaagaaaaaattggagtactgttattaaatcttggtggtccagagaccctcgacgatgttcaaccgttcttgttcaacctatttgctgatccagatatcattcgactgcctaggctattcaggtttctccaaagaccactggccaaacttatttctacttttagagctcctaagagtaaagaagggtatgcttcaatcggtggtgggtcaccattgaggaaaattactgatgagcaggcaaatgctttgaaggctgctctgaaaaagaaaaatttgaatgcaaatatatatgttgggatgcggtattggtatcctttcacagaagaagccattgatcagattaagaaggataagatttcgaagctcgttgttcttccactctaccctcagtactccatatcaacaagtgggtcaagcattcgtgttctccaaaacattgtcaaggaagattcatatttttctggcttgccaatttccattatcgaatcatggtaccaacgtgatggctatgtgaaatcaatggctgacctaattgaaaaagagctatctgccttttccaatcctgaagaggttatgatattcttcagtgcacatggtgtgccacttacctatgttgaggatgctggagatccttacagagatcagatggaggattgtatttctttgataatgggggagctgagatccagaggaatcttaaatggtcacactttggcgtatcagagtcgggtggggccagttcaatggctgaagccatatactgatgaagttttagtagaacttggtaaaaacggtgtgaagagcctcctggctgttccagtaagctttgtgagtgagcacattgagacattggaagaaatcgacatggagtacaaggagttggctctagaatcaggcattgagaactggggtcgggttcctgctcttggatgcacttcaacgttcatctccgaccttgcagatgctgttgtcgaagccctgccctctgcttcagcacttgcaaccagaaagcctgaagacactgattccaacatggacctgatgcattacctgaccaagatgttctttggctcgatcttggcatttatgctgctgttatcaccaaggctagtttctgctttccgaaacaccatgctttag

SEQ ID NO: 7462 - protein, 478 aa, Sorghum bicolor
  misc_feature: Ceres ANNOT ID no. 6078564
  misc_feature (102)..(426): Pfam Id: Ferrochelatase Pfam Desc: Ferrochelatase
  misc_feature (17)..(477): NCBI GI: 2460251 NCBI Desc: ferrochelatase [hordeum vulgare]
  misc_feature (17)..(477): NCBI GI: 1170242 NCBI Desc: ferrochelatase ii, chloroplast precursor (protoheme ferro-lyase) (heme synthetase)
  misc_feature (17)..(477): NCBI GI: 474966 NCBI Desc: ferrochelatase [hordeum vulgare subsp. vulgare]
  misc_feature (12)..(478): NCBI GI: 1170239 NCBI Desc: ferrochelatase ii, chloroplast precursor (protoheme ferro-lyase) (heme synthetase)
  misc_feature (26)..(475): NCBI GI: 79328715 NCBI Desc: ferrochelatase [arabidopsis thaliana]
  misc_feature (17)..(477): SWISSPROT Homolog: EC 4.99.1.1 Ferrochelatase-2, chloroplast precursor
MERGVLGSRGAGAVRILGMETGAATSCGKTTSISFTGSTKHEQNLHENVKPSQFATNGSSRLVYRSSVLKNQWNLSASSSSANVVTTFDDDKDVSSSVVEEKIGVLLLNLGGPETLDDVQPFLFNLFADPDIIRLPRLFRFLQRPLAKLISTFRAPKSKEGYASIGGGSPLRKITDEQANALKAALKKKNLNANIYVGMRYWYPFTEEAIDQIKKDKISKLVVLPLYPQYSISTSGSSIRVLQNIVKEDSYFSGLPISIIESWYQRDGYVKSMADLIEKELSAFSNPEEVMIFFSAHGVPLTYVEDAGDPYRDQMEDCISLIMGELRSRGILNGHTLAYQSRVGPVQWLKPYTDEVLVELGKNGVKSLLAVPVSFVSEHIETLEEIDMEYKELALESGIENWGRVPALGCTSTFISDLADAVVEALPSASALATRKPEDTDSNMDLMHYLTKMFFGSILAFMLLLSPRLVSAFRNTML

SEQ ID NO: 7463 - DNA, 1881 bp, Sorghum bicolor
  misc_feature: Ceres ANNOT ID no. 6078606
  misc_feature: Encodes the peptide sequence at SEQ ID NO 7464
atgaacgccgacgacctgggctcgccgagggagctcaccgggctgcagcggaggagggcgctgtaccaaccggagttgcctccatgtcttgttcagggaacgagaatcagagtggagtttggtgactcaacaacgaccattgattcaaaatgcgcagatatcgtcgcacaggcattcccacacatctttggtcagaagttggtgcgttttctagagccacacatggacacggtggtctctgaatctgatgcacaagtcatccaagaaaactcaccaattagggtgggtgtggtgttttctggaaggcaatcacctggcgggcataatgtcatatggggtacttatgatgctctgaaagctcagaatccacataatgttctgcttggatttataggtggcacggaaggcctatttgcaaagaagacgctggagatcacagatgatgtgctttcgtcatacaaaaatcaaggtggttttgatttgctgggcaggactgttgatcaaatccgtacgacagagcaaataaatgctgctaaggcaacatgctgtgatcttaacttggatggcctaatcatcattggaggggtgacctccaattcagatgctgctcagcttgcagagatctttgcagagcataactgcaagacaaaagttataggagtccctgtaacgctgagtggcgatctcaggaatcagttcgtcgaaacaactgttggttttgatacagtgtgcaaggtgaactctcagcttataagcaatgtttgcctcgatgcaatctcagctgggaagtactactattttgttcgcttgatgggtggcaaagcatctcatgttgcattagaatgtgcacttcagtcacacccaaacatggttatattaggagaggaggtggcgttttcaaagctcacattgaaggaaattacaaacaagatatgtgacggagtagaagcaagggcggaacaagggaaacaccatggagtgctagttattcctgagggactaatagaaagcataccagaaatgtatgcactcattcaggaaatcaataatctccacagtaataatatttctgaagcagacattccatctcaactttctccatgggccgctgccttgttcaagttcttgccatcgttcattaggagagagttgatcctgcatcaagaatctgataactcagcacagctatctcagatcgataccgagcagctcttagctcatttagtagaagcagaaatgaacaagagaacaaaagaaggaaagtacaagggaagaaaattcagttcagtgtgccacttctttggttctcaagcccgaggatcgctaccatcaaacttcgactgcaactatgcttatgttcttggccatatttgtgtgcaaataatagcagctggattgaatggctacatggctactgtaacaaatctaaaggactcgacaaacaagtggcgatgcgctgctgttcctctagcggcaatgatgagtgtgaggaggcacttgcgtggtcctggagctgttcctattgggaagccagtcatccatccttctcctattgacctgaaagcagagtcatatgcggtcctgagagagaaagcctcaagctttctgttagatgatttctacagaactccaggaggcattcagttcgaaggacctggcgcaggcaccaagcctatcacattgaccatagaagagcaggactatctgggtgacatcgagatactgcaagcctacttggacaaggttaggaccatcctgaagcctggatgctcacgggagattctcaaggcatcaataagctcgattgcgtcagtaaacgatgtgctcaagttcatgtcggcgcccctcaatacagagcttcctctctaccacttcaactga

SEQ ID NO: 7464 - protein, 626 aa, Sorghum bicolor
  misc_feature: Ceres ANNOT ID no. 6078606
  misc_feature (94)..(374): Pfam Id: PFK Pfam Desc: Phosphofructokinase
  misc_feature (5)..(622): NCBI GI: 483547 NCBI Desc: pyrophosphate-dependent phosphofructokinase alpha subunit [ricinus communis]
  misc_feature (5)..(615): NCBI GI: 115467858 NCBI Desc: os06g0326400 [oryza sativa (japonica cultivar-group)]
  misc_feature (5)..(614): NCBI GI: 3790102 NCBI Desc: pyrophosphate-dependent phosphofructokinase alpha subunit [citrus x paradisi]
  misc_feature (1)..(621): NCBI GI: 169538 NCBI Desc: pyrophosphate-fructose 6-phosphate 1-phosphotransferase alpha-subunit
  misc_feature (5)..(614): NCBI GI: 30725422 NCBI Desc: at1g20950 [arabidopsis thaliana]
  misc_feature (5)..(622): SWISSPROT Homolog: EC 2.7.1.90 Pyrophosphate--fructose 6-phosphate 1-phosphotransferase alpha subunit
MNADDLGSPRELTGLQRRRALYQPELPPCLVQGTRIRVEFGDSTTTIDSKCADIVAQAFPHIFGQKLVRFLEPHMDTVVSESDAQVIQENSPIRVGVVFSGRQSPGGHNVIWGTYDALKAQNPHNVLLGFIGGTEGLFAKKTLEITDDVLSSYKNQGGFDLLGRTVDQIRTTEQINAAKATCCDLNLDGLIIIGGVTSNSDAAQLAEIFAEHNCKTKVIGVPVTLSGDLRNQFVETTVGFDTVCKVNSQLISNVCLDAISAGKYYYFVRLMGGKASHVALECALQSHPNMVILGEEVAFSKLTLKEITNKICDGVEARAEQGKHHGVLVIPEGLIESIPEMYALIQEINNLHSNNISEADIPSQLSPWAAALFKFLPSFIRRELILHQESDNSAQLSQIDTEQLLAHLVEAEMNKRTKEGKYKGRKFSSVCHFFGSQARGSLPSNFDCNYAYVLGHICVQIIAAGLNGYMATVTNLKDSTNKWRCAAVPLAAMMSVRRHLRGPGAVPIGKPVIHPSPIDLKAESYAVLREKASSFLLDDFYRTPGGIQFEGPGAGTKPITLTIEEQDYLGDIEILQAYLDKVRTILKPGCSREILKASISSIASVNDVLKFMSAPLNTELPLYHFN

SEQ ID NO: 7465 - DNA, 1533 bp, Sorghum bicolor
  misc_feature: Ceres ANNOT ID no. 6078607
  misc_feature: Encodes the peptide sequence at SEQ ID NO 7466
atggcgacggcgatgggcgcgttggctgccacctccctgaccccggtcccggctgccgctacgttccccggtgatctcggcctcggacgccgccgggcggctgtgtcagggtggcgcgccggcgggagacggctgcgtgcgtcgccgcctgcccggaggccgttcctgttctcgccgaggggcgtttcggactctcggagctcgcaaacgtgccttgatccggacgccagcacgagtgttcttgggatcatccttggaggtggtgctgggacaaggctgtatccactgacgaagaagagggcgaaaccagcagtgccgttgcgcgccaactacaggctcatagatatccctgtcagcaactgtctgaacagtaacgtctccaagatatatgtgctaacacagttcaactctgcttcgctcaaccgccacctctcaagggcctatgggaacaacattgccgggtacaagaatgagggattcgttgaggtccttgcagcacaacagagtccagagaatcccaactggtttcagggtactgcagatgctgtgcgtcaatatatgtggctatttgaggagcacaatatcatggagttccttattctggctggagatcacctgtaccgtatggactaccaaaagttcattcaagcccatagagaaacagatgctgatataactgttgcagccctgccaatggatgaacaacgtgcaactgcatttggtcttatgaaaattgatgatgaagggagaatagttgagtttgcagaaaaaccaaaaggagagaagctgagatcaatgatggttgacaccactatattgggccttgatcctgagagggccaaggaactgccttatattgctagtatgggaatctatgtttttagcaaagatgtgatgcttcggcttctcagagaaaactttcctgcagcaaatgactttggaagtgaggttattcctggcgcaacagaaattggattaagggtgcaagcttacttatatgatggttactgggaagatattggtactattgaagcattttataatgcaaacttgggaataaccaagaaacctgtaccggattttagcttctatgaccgttctgctccaatttatacgcaacctagatacttgcctccttcaaaggttcttgatgccgatgtgacagacagtgttattggcgaaggttgtgttattaaacattgcacaatcaaccattctgtagttggactccgttcctgcatttctgaaggtgcagttatagaggattctttgctgatgggtgcagactattatgagactgaggatgataagaaagtcctttctgagaatggtggcattcccattggtattgggaagaatgcacatatcagaaaagcaataatcgacaaaaatgctcgtattggagaaaatgtgaagataatcaattttgataatgtccaagaagcagtaagggagacggaaggatactttatcaaaagtggcattgtcacagtgattaaagatgccttaatccctagtggaaccatcatataa

SEQ ID NO: 7466 - protein, 510 aa, Sorghum bicolor
  misc_feature: Ceres ANNOT ID no. 6078607
  misc_feature (81)..(356): Pfam Id: NTP_transferase Pfam Desc: Nucleotidyl transferase
  misc_feature (1)..(510): NCBI GI: 13892040 NCBI Desc: adp-glucose pyrophosphorylase small subunit [zea mays]
  misc_feature (4)..(510): NCBI GI: 50725517 NCBI Desc: adp-glucose pyrophosphorylase small subunit [oryza sativa (japonica cultivar-group)]
  misc_feature (4)..(510): NCBI GI: 13508485 NCBI Desc: adp-glucose pyrophosphorylase small subunit [oryza sativa]
  misc_feature (1)..(510): NCBI GI: 27464770 NCBI Desc: adp-glucose pyrophosphorylase small subunit [hordeum vulgare subsp. vulgare]
  misc_feature (1)..(510): NCBI GI: 52430025 NCBI Desc: adp-glucose pyrophosphorylase small subunit [triticum aestivum]
  misc_feature (1)..(510): SWISSPROT Homolog: EC 2.7.7.27 Glucose-1-phosphate adenylyltransferase small subunit, chloroplastprecursor
  misc_feature: The sequence is a functional homolog of SEQ ID NO 37 in US patent 7312378
  misc_feature: The sequence is a functional homolog of SEQ ID NO. 451 in the 11/188,298 US application
  misc_feature: The sequence is a functional homolog of SEQ ID NO. 521 in the 11/188,298 US application
MATAMGALAATSLTPVPAAATFPGDLGLGRRRAAVSGWRAGGRRLRASPPARRPFLFSPRGVSDSRSSQTCLDPDASTSVLGIILGGGAGTRLYPLTKKRAKPAVPLRANYRLIDIPVSNCLNSNVSKIYVLTQFNSASLNRHLSRAYGNNIAGYKNEGFVEVLAAQQSPENPNWFQGTADAVRQYMWLFEEHNIMEFLILAGDHLYRMDYQKFIQAHRETDADITVAALPMDEQRATAFGLMKIDDEGRIVEFAEKPKGEKLRSMMVDTTILGLDPERAKELPYIASMGIYVFSKDVMLRLLRENFPAANDFGSEVIPGATEIGLRVQAYLYDGYWEDIGTIEAFYNANLGITKKPVPDFSFYDRSAPIYTQPRYLPPSKVLDADVTDSVIGEGCVIKHCTINHSVVGLRSCISEGAVIEDSLLMGADYYETEDDKKVLSENGGIPIGIGKNAHIRKAIIDKNARIGENVKIINFDNVQEAVRETEGYFIKSGIVTVIKDALIPSGTII

SEQ ID NO: 7467 - DNA, 2925 bp, Sorghum bicolor
  misc_feature: Ceres ANNOT ID no. 6078640
  misc_feature: Encodes the peptide sequence at SEQ ID NO 7468
atgaaacctcatcatctgcattttaggtccctaatttcttcctatgctactgtgcgaccccaaagaaggagagaactgaaactgctgtcaacgcctgattatttctcctcctgttttaacacccctcagatcagctgttatcattcaggtcatctccggctagtctcatccccagggccctgcaagcgagcaccatcagcaattgctggttgccattcatatcccaccagcagcagccatggcggccgtgacaagaacgctattggaaacaaggaaaagagcaagaggaggaagaggaagcaaacagcaaccaaacaaggtgtgctgtcaccaccatcagaggaggaattgtcgactaggatggtgaataatctgtaccagagtggtgacccccttgggcgaaaggaactgggccaacgcgtggtccaatggctgaagcagggcatgcacctgatggcctccaaattcgcttcctcagatcagtcagagacacaagataatgatccattgtgttttcatggccatatggggtttgtgatgcaggcacaggcatacctttctgccactgccatgcccaggggacaggaagctctgtgcctcaaggcctctacgcactaccccacgctctttgacaactttcagagagagcttcgtgatgtcctgctgcagcagcaagaagagggccttgttaccgactggcgctctacgcgttcgtggatgcttatgaaagaaatggctagatcagctgagcatcggacagccgcacgcagacctacagctcctgttatgcacaagcacactacacttggcataagcctggacaggacaaggctgatgcaggctaaaatagatgagtttgttcagaagatgaccggccttcttcaactagaacgagatgcagaactggatgtaacccagaccacccaggatgagttgatgagtgccagttcaatgatggatggaaagtcaaagaagccagtggagtatttggtaactcatggtcaggcccaagaggagtgtgacaccatttgcaatttgaaagttatcagtagttcaactggattaactggtcaacatctagtcttatttagagtcgagggaagccaaaaacttccaccaaccagactctctcctggagacatggtttgtgtgagaacgtgcaacagccagggcgaggttgccactacttcttgcatggaagcctttgtccataatctcggtgaggatggatgcagcatcacagtggcattgaaatcacgacgcagtgatcctaccttctccaagtttcttgggaaaattgcgcggattgatcgcatacaggctctagcagatgcagtgacatacgagaagagagggttacagaaaagaaatgcatccattggggtagtagccactctgtttggagacaaggaagatgtgatgaagctggagggaaataatctgatggattgtggtggatcagaagtacctgatgatggtttgttggagaggcacagctacagctttgatacctctcagtcaagggctcttgcactggccttggacaaggagaggcctgtcctagttatccaagggcctcctggaacaggcaagactcgtttacttagctatcttatcacgtgtgttgcgcgccggggtgaacgtgttctcgtgacagctccaagcaacgcagcgattgataacatagtggagagtttatcaagaagtggactgaaaattgtacgagttggaaatccttctaggatatctccatctgtcacttcaatgtccttgggagagatcgttaccaagaggcttgaaaaattcacccaagagtttgagaggaaaaaatatgccttgagaaaggacttgaagcgttgcatacaggacgacgattctttagcttcaggtattcgtcaacgattgaaaaagctcggcaaggactataagaaggaggagaaggaagcaatcagggaggttctgtcaaatgctgaggtggtgctatcaactaatacaggggcagccgacccactgatcaggggaatgggttgctttgacctggtaattatagatgaagctggacaagcaactgagccctcatgttggatccctatactacagggaaagcgttgcattcttgcaggtgatcaccgtcagcttgcaccagtaatattatcaagagaggctatggaaggtgggctaggaatatctttgttagaaagggcttcatcactgcatgatggactgctcactacaacattaacaacacaataccgaatgcatgaatctatagcaagttgggcatcaaaggagatgtatgatggattgctccaatcgttcccacctgttgcttctcgacttcttgtcgattatccatttgtcaaggccacctggatgactcagtgtgccttgcttttacttgatactcgaaaggaatatggaagtctaaatattgactgtgaggagagtttagacctagctggtactggttcattttacaacaatggtgaggcggatatagttgcacaacatgttttcaatctcatacaatgtggagtccctccaacttcaattgttgttcagtccccttacatcgcacaagtacaattgttacggggaagactagaagaatatccagtggcttccaatgttgaggtttcaacaatagacagcttccagggtcgggaagcagatgcagttgtcatatccatggttcggtcaaactccttgggagcagtagggttccttggtgatataaggcgcatgaatgtagctattacaagggcaaggtcacatgttgcagtggtgtgtgatacttctactatttgtaacaatgctttcctagcaaggctccttcgccatatccggcagcatggtcaggttagacatgtggaacccagttccttcgatgggggctttgatctaccagccttaccctcaggttag

SEQ ID NO: 7468 - protein, 974 aa, Sorghum bicolor
  misc_feature: Ceres ANNOT ID no. 6078640
  misc_feature (499)..(703): Pfam Id: ResIII Pfam Desc: Type III restriction enzyme, res subunit
  misc_feature (13)..(973): NCBI GI: 115478052 NCBI Desc: os09g0130800 [oryza sativa (japonica cultivar-group)]
  misc_feature (233)..(972): NCBI GI: 9758800 NCBI Desc: dna helicase-like [arabidopsis thaliana]
  misc_feature (650)..(973): NCBI GI: 115448159 NCBI Desc: os02g0704300 [oryza sativa (japonica cultivar-group)]
  misc_feature (723)..(973): NCBI GI: 50252651 NCBI Desc: dna helicase-like [oryza sativa (japonica cultivar-group)]
  misc_feature (501)..(953): NCBI GI: 92897615 NCBI Desc: aaa atpase; dead/deah box helicase, n-terminal [medicago truncatula]
  misc_feature: Useful for making plants with altered sterol content
  misc_feature: Useful for making plants with modulated salt sensitivity
  misc_feature: Useful for making plants with modulated seed size
  misc_feature: Useful for making plants with modulated nitrogen use efficiency
  misc_feature: GREAT-hit functional homolog of the protein sequence given in SEQ ID NO 13481
  misc_feature: GREAT-hit functional homolog of the protein sequence given in SEQ ID NO 13504
  misc_feature: GREAT-hit functional homolog of the protein sequence given in SEQ ID NO 13507
  misc_feature: Useful for making plants with modulated salt sensitivity
  misc_feature: Functional homolog of the protein sequence given in SEQ ID NO 13507
MKPHHLHFRSLISSYATVRPQRRRELKLLSTPDYFSSCFNTPQISCYHSGHLRLVSSPGPCKRAPSAIAGCHSYPTSSSHGGRDKNAIGNKEKSKRRKRKQTATKQGVLSPPSEEELSTRMVNNLYQSGDPLGRKELGQRVVQWLKQGMHLMASKFASSDQSETQDNDPLCFHGHMGFVMQAQAYLSATAMPRGQEALCLKASTHYPTLFDNFQRELRDVLLQQQEEGLVTDWRSTRSWMLMKEMARSAEHRTAARRPTAPVMHKHTTLGISLDRTRLMQAKIDEFVQKMTGLLQLERDAELDVTQTTQDELMSASSMMDGKSKKPVEYLVTHGQAQEECDTICNLKVISSSTGLTGQHLVLFRVEGSQKLPPTRLSPGDMVCVRTCNSQGEVATTSCMEAFVHNLGEDGCSITVALKSRRSDPTFSKFLGKIARIDRIQALADAVTYEKRGLQKRNASIGVVATLFGDKEDVMKLEGNNLMDCGGSEVPDDGLLERHSYSFDTSQSRALALALDKERPVLVIQGPPGTGKTRLLSYLITCVARRGERVLVTAPSNAAIDNIVESLSRSGLKIVRVGNPSRISPSVTSMSLGEIVTKRLEKFTQEFERKKYALRKDLKRCIQDDDSLASGIRQRLKKLGKDYKKEEKEAIREVLSNAEVVLSTNTGAADPLIRGMGCFDLVIIDEAGQATEPSCWIPILQGKRCILAGDHRQLAPVILSREAMEGGLGISLLERASSLHDGLLTTTLTTQYRMHESIASWASKEMYDGLLQSFPPVASRLLVDYPFVKATWMTQCALLLLDTRKEYGSLNIDCEESLDLAGTGSFYNNGEADIVAQHVFNLIQCGVPPTSIVVQSPYIAQVQLLRGRLEEYPVASNVEVSTIDSFQGREADAVVISMVRSNSLGAVGFLGDIRRMNVAITRARSHVAVVCDTSTICNNAFLARLLRHIRQHGQVRHVEPSSFDGGFDLPALPSG

SEQ ID NO: 7469 - DNA, 918 bp, Sorghum bicolor
  misc_feature: Ceres ANNOT ID no. 6078685
  misc_feature: Encodes the peptide sequence at SEQ ID NO 7470
atgtactcaccaaaaccagaatctagttttgccccaaatcccaactcaggcacacaccagcagcaaatggaattacctggagccaacatgggtcctagtaatggagcaaataacaataccaacatggctgcaaggcaacgcttacgctggacaaatgaactgcatgaaagatttgttgaggctgttactcaacttggtggccctgatagagcaactccaaaaggagttctaagaattatgggtgtacaaggattaacaatataccatgtaaaaagtcacttgcagaaatacaggctagcaaaatatattcctgatgcttcaactgatggaaacaaagccgataacaaagacccaggggatttgcttgccggacttgagggatcctctggattgccgatatctgaagccctcaagctgcagatggaggtccaaaagcggctgcacgaacagttagaagtacaaaggcagctgcagttgcgaattgaggctcagggaaagtacctccagaagatcattgaagagcagcagcgcttaactggtgtgaaatctgaaactcctgctggaggtgcttctgtcacagtatcaagtgatcaattccctgactccgagcggactgagccctcgactcctgcaccaacatccgagtctccaactcaagttggtgcttccaatagggaccccggagatcgaactgaaggaaccaagagcacctgtcatgagccactaacccccgattccaactgccagaatggctctcccgttgctagtccaaaccatgagagggcagcaaagaggcagcggggcagtggtactgaattcttagattctgagtctgagttttcccttccacgccacatctttgagtcgagctcaggctcagagttccaacaatactcaatgtcctactcaggacagtag

SEQ ID NO: 7470 - protein, 305 aa, Sorghum bicolor
  misc_feature: Ceres ANNOT ID no. 6078685
  misc_feature (47)..(98): Pfam Id: Myb_DNA-binding Pfam Desc: Myb-like DNA-binding domain
  misc_feature (34)..(297): NCBI GI: 77403669 NCBI Desc: myb-cc type transfactor [solanum tuberosum]
  misc_feature (30)..(267): NCBI GI: 23197610 NCBI Desc: transfactor-like protein [arabidopsis thaliana]
  misc_feature (80)..(267): NCBI GI: 42570623 NCBI Desc: myb family transcription factor [arabidopsis thaliana]
  misc_feature (28)..(258): NCBI GI: 124359545 NCBI Desc: peptidase m22, glycoprotease; homeodomain-related [medicago truncatula]
  misc_feature (1)..(210): NCBI GI: 51572282 NCBI Desc: myb transcription factor [triticum aestivum]
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 1857 in the 10/374,780US patent application
  misc_feature: The sequence is a functional homolog of SEQ ID NO 1990 in the 11/479,226US patent application
  misc_feature: The sequence is a functional homolog of SEQ ID NO 1992 in the 11/479,226US patent application
  misc_feature: The sequence is a functional homolog of SEQ ID NO 1999 in the 11/479,226US patent application
  misc_feature: The sequence is a functional homolog of SEQ ID NO 2000 in the 11/479,226US patent application
  misc_feature: The sequence is a functional homolog of SEQ ID NO 933 in the 10/666,642US patent application
  misc_feature: The sequence is a functional homolog of SEQ ID NO 935 in the 10/666,642US patent application
  misc_feature: Useful for making plants with altered Lignin content
  misc_feature: Useful for making plants with altered terpenoid content
  misc_feature: Useful for making plants with modulated growth and phenotype characteristics
  misc_feature: GREAT-hit functional homolog of the protein sequence given in SEQ ID NO 12902
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 1990 in the 20070022495 US patent application
  misc_feature: The sequence is a functional homolog of SEQ ID NO 1992 in the 20070022495 US patent application
  misc_feature: The sequence is a functional homolog of SEQ ID NO 1999 in the 20070022495 US patent application
  misc_feature: The sequence is a functional homolog of SEQ ID NO 2000 in the 20070022495 US patent application
  misc_feature: The sequence is a functional homolog of SEQ ID NO 933 in the 20070033671 US patent application
  misc_feature: The sequence is a functional homolog of SEQ ID NO 935 in the 20070033671 US patent application
  misc_feature: Useful for making plants with altered lignin content
  misc_feature: Useful for making plants with altered terpenoid content
  misc_feature: Functional homolog of the protein sequence given in SEQ ID NO 12902
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
MYSPKPESSFAPNPNSGTHQQQMELPGANMGPSNGANNNTNMAARQRLRWTNELHERFVEAVTQLGGPDRATPKGVLRIMGVQGLTIYHVKSHLQKYRLAKYIPDASTDGNKADNKDPGDLLAGLEGSSGLPISEALKLQMEVQKRLHEQLEVQRQLQLRIEAQGKYLQKIIEEQQRLTGVKSETPAGGASVTVSSDQFPDSERTEPSTPAPTSESPTQVGASNRDPGDRTEGTKSTCHEPLTPDSNCQNGSPVASPNHERAAKRQRGSGTEFLDSESEFSLPRHIFESSSGSEFQQYSMSYSGQ

SEQ ID NO: 7471 - DNA, 480 bp, Sorghum bicolor
  misc_feature: Ceres ANNOT ID no. 6078781
  misc_feature: Encodes the peptide sequence at SEQ ID NO 7472
atgtcaagtgggacttcgtctgggtcaagccaggggacccagagttccaggtcggaggatgatctggatcttcaggcccagatggagaggaggaggaagcgaaggaaggagtcgaaccgggaatcggctcggaggtctaggctaaggaagcaacaacaccttgacgacctcacctcacaggtaaatcagctgaaggaccagaacaagcagctcagcatggcactgagcataaccagccaaaaccttgtggcagtgcaagcacaaaactctgtccttcagacccagaagatggagctggacagcaggctgggcgccctgacagagatcctctggtacatcaactcaagcaccagccccagcactgctcctgcagatccagccatggtgaacagcttcacaacatggagcagcgcctctgatattcttggcgccaacgcatggaaccagcagcagcccatagacctgtaccaatgcttctag

SEQ ID NO: 7472 - protein, 159 aa, Sorghum bicolor
  misc_feature: Ceres ANNOT ID no. 6078781
  misc_feature (27)..(90): Pfam Id: bZIP_1 Pfam Desc: bZIP transcription factor
  misc_feature (27)..(80): Pfam Id: bZIP_2 Pfam Desc: Basic region leucine zipper
  misc_feature (2)..(118): NCBI GI: 22597162 NCBI Desc: bzip transcription factor atb2 [glycine max]
  misc_feature (2)..(116): NCBI GI: 92879198 NCBI Desc: camp response element binding (creb) protein [medicago truncatula]
  misc_feature (2)..(117): NCBI GI: 113367218 NCBI Desc: bzip transcription factor bzip124 [glycine max]
  misc_feature (2)..(124): NCBI GI: 113367220 NCBI Desc: bzip transcription factor bzip125 [glycine max]
  misc_feature (2)..(153): NCBI GI: 24460973 NCBI Desc: bzip transcription factor [capsicum chinense]
  misc_feature: The sequence is a functional homolog of SEQ ID NO 1116 in the 11/479,226US patent application
  misc_feature: The sequence is a functional homolog of SEQ ID NO 2140 in the 10/374,780US patent application
  misc_feature: The sequence is a functional homolog of SEQ ID NO 2406 in the 10/374,780US patent application
  misc_feature: The sequence is a functional homolog of SEQ ID NO 248 in the 10/225,066US patent application
  misc_feature: The sequence is a functional homolog of SEQ ID NO 2508 in the 10/374,780US patent application
  misc_feature: The sequence is a functional homolog of SEQ ID NO 286 in the 10/666,642US patent application
  misc_feature: The sequence is a functional homolog of SEQ ID NO 42 in the 10/225,066US patent application
  misc_feature: The sequence is a functional homolog of SEQ ID NO 484 in the 10/412,699US patent application
  misc_feature: The sequence is a functional homolog of SEQ ID NO 74 in the 10/286,264US patent application
  misc_feature: Useful for making plants with modulated growth and phenotype characteristics
  misc_feature: The sequence is a functional homolog of SEQ ID NO 74 in the 20030093837 US patent application
  misc_feature: The sequence is a functional homolog of SEQ ID NO 484 in the 20040045049 US patent application
  misc_feature: The sequence is a functional homolog of SEQ ID NO 2140 in the 20060162006 US patent application
MSSGTSSGSSQGTQSSRSEDDLDLQAQMERRRKRRKESNRESARRSRLRKQQHLDDLTSQVNQLKDQNKQLSMALSITSQNLVAVQAQNSVLQTQKMELDSRLGALTEILWYINSSTSPSTAPADPAMVNSFTTWSSASDILGANAWNQQQPIDLYQCF

SEQ ID NO: 7473 - DNA, 2592 bp, Sorghum bicolor
  misc_feature: Ceres ANNOT ID no. 6078845
  misc_feature: Encodes the peptide sequence at SEQ ID NO 7474
  misc_feature: Up-regulated in root tissues in response to salicylic acid treatment
atggcggctgcagataggcagcttgtggttgccgtcgagggaacggcggcgctggggccctactggtccaccattgtggcggagtacgtcgagaagatcgtgcggagcttttgtgcaagtgaactgccaggccagaagcttgcagggcctccgcctgagcttgcattagttgtttttcatacccatggaccctacagtgcttttgatgtgcagcgaagtggatggacaaaagataccgatgctttcctatcatggttatctggaatatcattcagtggtggaggattcagtgaagcttctacttgtgaaggtcttgcagaagcactgaagatacttcaaggtagtcctaatgcaacccaaagtcatcaaaaccatgaagcacaaaagcattgcatacttgtcgctgcaagtaatccttatcctttgccgacacctgtatactgtcttcctactcaaagtactgatcacaaagagaacattgagacatcaaaagaaccttctattgctgatgctgagaccgttgcaaagtcatttgctcagtgctctgtctcactgtcggtgatatctccaaaacagcttccaacattaaaggcgatatacaatgcgggcaagcgaaaccctcgagctgctgatccatcagtcgaccatgcgaaaaatccacacttccttgttttgctatctgagaatttcatggaggcgcgaactgctctaagtcgtcctttacatggaaacatggccccaaatcaaagcattacaaagatggacactgcacctgcagtgactatgccaggaccgacttcaaatgccaacccctcagtgaatgcagtgacaggccgtcaaccagttgttggaggtatttctaccgcaactgttaaactggaaccagcaaccatgccaccaatagtttctgcacctgctttctcacatgtaacacctatttcaaatgtggcttcacaaggaatatcagcacttcaaacctcatcaccatctcttatttcacaagaagcaaatatggcaaatgataatgtgcaagaacacaagcctataataaaccctgttcaacagccagttcggcctggtggtcatggcagcctcctcaacaatctgtcacaggttcggttgatgaactcaacttctttaggaggaggagctacctcaatgggacttcctaacatgggggcaacaccaatacaagtccacatgtcaaacatgatatcaagcggcatgacatcaacaccctctgtcatctcctctatgtctggacctggacaacctattggtactcaacagatggtacagagcacagctcttggttcctttggctcaaacacttctactgtatcaggcaattcaaatgttgctgtatcatcctctctgactaacaaccaaagcagtatgggcatgggtcaatcagtgcaacctgtggcacaaggaggcttggtggctggttcacaattaggacaaggtggaattggtgcaaaccaaaatgtgatgagtagccttggatctacagctatctcttcagcacctgcgatgatgccaacacctgggatggtcccacagacaggagtcaattccttaggtgtgaataacaatcctgctatgaatatgcctattccacagcatgccaatgcccaacagccgccaccaaagtatgtcaaaatttgggagggaactttatctggccaaaggcaaggacagcctgtatttatttgtaaactcgaaggttataggagtggaacagcatctgaaacacttgcagcggactggccagaaactatgcagattgttcgcctcatagcccaggagcatatgaacaacaaacaatatgttggcaaggccgactttcttgtttttcggactttaaatcagcacgggtttcttggacaactacaagagaagaagctgtgtgctgtgatacagttaccatcgcaaactctgctgctgtcaatgtctgacaaagcaggtcgtttgattggcatgctcttccctggggacatggtggtgttcaaaccgcaggtcccaactcagcagacaccaatgcagcagcagcagctacaacaacagcaacttcaacaacaacagttacagcagcagcagctgcaacaacaacacatgcatatgcagcagcaaggcctcccacttcagcagtcgcagatgcaacttcagcaacagcagcagccacagatgcaaccgatgcagcagcagccaacacagatgcaacaccagcagcagcaaccttcgcagatgcagccgatgcagcatcagcagccgcagccacagcagatgcaatcgatgcagcaccagcagcagatgcagcaccagcagcagcagcagcagcagatgcaaccaatgcagcaacagcagcagatgcaacacatgcagcatcaacagcaacagatgcagcaaatgcaacagcagcagcaacagatgcagcaaatgcagcctcaacagcagcagcaaccccagatggtgggtacaggaatggggcagcagttcatgcaggggcagaatcgggcagtgcagatgatgcaagggaagattatgccacagggcccgggcagcatgcctgggggaggcttcctaccttaa

SEQ ID NO: 7474 - protein, 863 aa, Sorghum bicolor
  misc_feature: Ceres ANNOT ID no. 6078845
  misc_feature (1)..(836): NCBI GI: 32478899 NCBI Desc: phytochrome and flowering time 1 protein [arabidopsis thaliana]
  misc_feature (115)..(836): NCBI GI: 145324014 NCBI Desc: pft1 (phytochrome and flowering time 1) [arabidopsis thaliana]
  misc_feature (364)..(605): NCBI GI: 61611689 NCBI Desc: phytochrome and flowering time 1 [pisum sativum]
  misc_feature (672)..(835): NCBI GI: 61353791 NCBI Desc: clock [macrobrachium rosenbergii]
  misc_feature (673)..(847): NCBI GI: 60475205 NCBI Desc: adenylyl cyclase [dictyostelium discoideum]
  misc_feature: The sequence is a functional homolog of SEQ ID NO 824 in the 10/374,780US patent application
  misc_feature: Useful for making plants with modulated flowering time
  misc_feature: Useful for making plants with modulated growth and phenotype characteristics
  misc_feature: GREAT-hit functional homolog of the protein sequence given in SEQ ID NO 13390
  misc_feature: The sequence is a functional homolog of SEQ ID NO 824 in the 20060162006 US patent application
  misc_feature: Useful for making plants with modulated flowering time
  misc_feature: Functional homolog of the protein sequence given in SEQ ID NO 13390
  misc_feature: Up-regulated in root tissues in response to salicylic acid treatment
MAAADRQLVVAVEGTAALGPYWSTIVAEYVEKIVRSFCASELPGQKLAGPPPELALVVFHTHGPYSAFDVQRSGWTKDTDAFLSWLSGISFSGGGFSEASTCEGLAEALKILQGSPNATQSHQNHEAQKHCILVAASNPYPLPTPVYCLPTQSTDHKENIETSKEPSIADAETVAKSFAQCSVSLSVISPKQLPTLKAIYNAGKRNPRAADPSVDHAKNPHFLVLLSENFMEARTALSRPLHGNMAPNQSITKMDTAPAVTMPGPTSNANPSVNAVTGRQPVVGGISTATVKLEPATMPPIVSAPAFSHVTPISNVASQGISALQTSSPSLISQEANMANDNVQEHKPIINPVQQPVRPGGHGSLLNNLSQVRLMNSTSLGGGATSMGLPNMGATPIQVHMSNMISSGMTSTPSVISSMSGPGQPIGTQQMVQSTALGSFGSNTSTVSGNSNVAVSSSLTNNQSSMGMGQSVQPVAQGGLVAGSQLGQGGIGANQNVMSSLGSTAISSAPAMMPTPGMVPQTGVNSLGVNNNPAMNMPIPQHANAQQPPPKYVKIWEGTLSGQRQGQPVFICKLEGYRSGTASETLAADWPETMQIVRLIAQEHMNNKQYVGKADFLVFRTLNQHGFLGQLQEKKLCAVIQLPSQTLLLSMSDKAGRLIGMLFPGDMVVFKPQVPTQQTPMQQQQLQQQQLQQQQLQQQQLQQQHMHMQQQGLPLQQSQMQLQQQQQPQMQPMQQQPTQMQHQQQQPSQMQPMQHQQPQPQQMQSMQHQQQMQHQQQQQQQMQPMQQQQQMQHMQHQQQQMQQMQQQQQQMQQMQPQQQQQPQMVGTGMGQQFMQGQNRAVQMMQGKIMPQGPGSMPGGGFLP

SEQ ID NO: 7475 - DNA, 1113 bp, Sorghum bicolor
  misc_feature: Ceres ANNOT ID no. 6078910
  misc_feature: Encodes the peptide sequence at SEQ ID NO 7476
atgcacagctacagagccatgcacccgtacactcacccgtaccagcaccacaccgccgccgttgcgcccaccaagcacggccacggccatggcgaggaggaggacgatcagtccatgctgctcctctccctctggcctcccggccaacaccatggcatcgccgctgcttcctcggcgtgctcgtctcccccaatctgcgccaccaccaccaccaccacctccatggccgccgccgcttcttacccttggctcactacccaccaaagccattacaatggcggctgcggcggagggagcagcagcagcagccacagtagcttcctgttccacgagcaccagcagcaggagcccgacgtgagcatctcactgtccatagccccgccgtgcagcaacaccgctgcttcctgtggtgccgccgccggtggcttcgctgccccggccgcaccgtcgacggtgacgaccgtgacgcccggcgggagccaggtgcccagccagtactggatcccctccgccgccgagatcctggtcggctccacgcagttctcctgcgccgtctgcaacaagaccttcaaccgcttcaacaacatgcagatgcacatgtggggccacggttcgcagtaccggaaggggtccgagtccctgcgcggcgccatcacggtgggcacggcgccgccggcgtcgctgatgcggctgccgtgctactgctgcgcggagggctgccggaacaacatcgagcacccgcgggcgcggccgctcaaggacttccgcacgctgcagacgcactaccgccgcaagcacggcgcgcggccgtacgcgtgccgccgctgcggcaagcgcttcgccgtgcgcggcgactggcgcacgcacgagaagaactgcggcaagctctggttctgcgtctgcggctccgacttcaagcacaagcggtcgctcaaggaccacgtccgctccttcggcggagggcacgcgccgcacatcgtcgagtccgtcgccgtcgaggacgacgaggaggacgacgacgaccacgacgacgcagacctgcacgcttttgacgacaacgtcggaaacggcggcggtgccggaggagaacccagcgacatggtcgtcgtctag

SEQ ID NO: 7476 - protein, 370 aa, Sorghum bicolor
  misc_feature: Ceres ANNOT ID no. 6078910
  misc_feature (166)..(338): NCBI GI: 18376500 NCBI Desc: wip4 protein [arabidopsis thaliana]
  misc_feature (120)..(335): NCBI GI: 115444823 NCBI Desc: os02g0196100 [oryza sativa (japonica cultivar-group)]
  misc_feature (165)..(343): NCBI GI: 59958298 NCBI Desc: at3g57670 [arabidopsis thaliana]
  misc_feature (166)..(338): NCBI GI: 9294415 NCBI Desc: zinc finger-like protein [arabidopsis thaliana]
  misc_feature (165)..(344): NCBI GI: 92897606 NCBI Desc: zinc finger, c2h2-type [medicago truncatula]
  misc_feature: The sequence is a functional homolog of SEQ ID NO 1074 in the 10/666,642US patent application
  misc_feature: The sequence is a functional homolog of SEQ ID NO 1075 in the 10/666,642US patent application
  misc_feature: The sequence is a functional homolog of SEQ ID NO 1076 in the 10/666,642US patent application
  misc_feature: The sequence is a functional homolog of SEQ ID NO 1077 in the 10/666,642US patent application
  misc_feature: The sequence is a functional homolog of SEQ ID NO 1078 in the 10/666,642US patent application
  misc_feature: The sequence is a functional homolog of SEQ ID NO 1079 in the 10/666,642US patent application
  misc_feature: The sequence is a functional homolog of SEQ ID NO 1086 in the 10/666,642US patent application
  misc_feature: The sequence is a functional homolog of SEQ ID NO 1087 in the 10/666,642US patent application
  misc_feature: The sequence is a functional homolog of SEQ ID NO 1785 in the 10/374,780US patent application
  misc_feature: Useful for making plants with modulated growth and phenotype characteristics
  misc_feature: The sequence is a functional homolog of SEQ ID NO 1785 in the 20060162006 US patent application
  misc_feature: The sequence is a functional homolog of SEQ ID NO 1074 in the 20070033671 US patent application
  misc_feature: The sequence is a functional homolog of SEQ ID NO 1075 in the 20070033671 US patent application
  misc_feature: The sequence is a functional homolog of SEQ ID NO 1076 in the 20070033671 US patent application
  misc_feature: The sequence is a functional homolog of SEQ ID NO 1078 in the 20070033671 US patent application
  misc_feature: The sequence is a functional homolog of SEQ ID NO 1079 in the 20070033671 US patent application
  misc_feature: The sequence is a functional homolog of SEQ ID NO 1086 in the 20070033671 US patent application
  misc_feature: The sequence is a functional homolog of SEQ ID NO 1087 in the 20070033671 US patent application
  misc_feature: The sequence is a functional homolog of SEQ ID NO 630 in the 10/666,642 US patent application
  misc_feature: The sequence is a functional homolog of SEQ ID NO. 455 in the 11/188,298 US application
MHSYRAMHPYTHPYQHHTAAVAPTKHGHGHGEEEDDQSMLLLSLWPPGQHHGIAAASSACSSPPICATTTTTTSMAAAASYPWLTTHQSHYNGGCGGGSSSSSHSSFLFHEHQQQEPDVSISLSIAPPCSNTAASCGAAAGGFAAPAAPSTVTTVTPGGSQVPSQYWIPSAAEILVGSTQFSCAVCNKTFNRFNNMQMHMWGHGSQYRKGSESLRGAITVGTAPPASLMRLPCYCCAEGCRNNIEHPRARPLKDFRTLQTHYRRKHGARPYACRRCGKRFAVRGDWRTHEKNCGKLWFCVCGSDFKHKRSLKDHVRSFGGGHAPHIVESVAVEDDEEDDDDHDDADLHAFDDNVGNGGGAGGEPSDMVVV

SEQ ID NO: 7477 - DNA, 1134 bp, Sorghum bicolor
  misc_feature: Ceres ANNOT ID no. 6079035
  misc_feature: Encodes the peptide sequence at SEQ ID NO 7478
atgctggcctcggcaagggggttctgggcgcggcaccgccgcaagatcctcgtctccatgggcgtcgccggggtggggtacgccgcctaccgcttctacgacgcgcgacgcgcccagctcgtgcgggtccagcagctgcgcgccatggaggagcaggccgccgaggacctcgtcaaagaccagctccaggcacactttgagaaggtgaagaggatctgcgacactacaacattgcctttggccatgcatcatctcagtgataaggtagcaagtgaactggatatttcgaaattgacggacaagctacgtcaagggaaggtagactcaagtgcactgacaccaaaggagaagtatgatacttgggaggagattaaaattaagagtttcacaaagacagtttcttcaatgtgggcaatgacattgcttagcttgtacgttagagttcaggtcaccatattaggcaggcatctctacttagatattgcccggggtaccaatggtgcacagttgcaggcagaatctgacacctttagtgaaaatggacacaagagcttccttgcaatggctgattatcttgtcactgacaaaatcactgcattcataacgcaaatgcagcgtgcagcaacagaagtcctaaaagagaagcaactgaaagaccgtatgaacatggaccaagtattgcaaacagtaatacaaatattggacacattcatgggtctttgtgaagataactcatggataaattatcttgttcctgagaatccctctgtttatgcacagttgatggctgtgtccagtagtggctttgatgattcatcactcctgaatgatttcagaaagctagaccaactaatgtctgagacacgaatagtactggcaagtgatgatttcagaaatatcatggagaggtcactaaggaagatagcagaagtggtggtagaggacctggctgtgcagattgtaactccaggatcgggattgcccctagcgacgctcttgcccaaagttggtcatttgagttccccgttacttgaggagccaaacaagaacaaacacattcagatcatccgaagtatgcctgaagtggaactcttctacacattcctctacgcaaacatgccaccagaagcataa

SEQ ID NO: 7478 - protein, 377 aa, Sorghum bicolor
  misc_feature: Ceres ANNOT ID no. 6079035
  misc_feature (2)..(373): Pfam Id: Peroxin-3 Pfam Desc: Peroxin-3
  misc_feature (1)..(376): NCBI GI: 50726384 NCBI Desc: peroxisomal biogenesis factor 3-like [oryza sativa (japonica cultivar-group)]
  misc_feature (6)..(374): NCBI GI: 18401790 NCBI Desc: peroxin-3 family protein [arabidopsis thaliana]
  misc_feature (61)..(374): NCBI GI: 42572473 NCBI Desc: peroxin-3 family protein [arabidopsis thaliana]
  misc_feature (44)..(370): NCBI GI: 62287020 NCBI Desc: peroxisomal biogenesis factor 3 (peroxin-3) (peroxisomal assembly protein pex3) (qnpa-14710)
  misc_feature (44)..(370): NCBI GI: 13786194 NCBI Desc: peroxisomal biogenesis factor 3 [rattus norvegicus]
MLASARGFWARHRRKILVSMGVAGVGYAAYRFYDARRAQLVRVQQLRAMEEQAAEDLVKDQLQAHFEKVKRICDTTTLPLAMHHLSDKVASELDISKLTDKLRQGKVDSSALTPKEKYDTWEEIKIKSFTKTVSSMWAMTLLSLYVRVQVTILGRHLYLDIARGTNGAQLQAESDTFSENGHKSFLAMADYLVTDKITAFITQMQRAATEVLKEKQLKDRMNMDQVLQTVIQILDTFMGLCEDNSWINYLVPENPSVYAQLMAVSSSGFDDSSLLNDFRKLDQLMSETRIVLASDDFRNIMERSLRKIAEVVVEDLAVQIVTPGSGLPLATLLPKVGHLSSPLLEEPNKNKHIQIIRSMPEVELFYTFLYANMPPEA

SEQ ID NO: 7479 - DNA, 462 bp, Sorghum bicolor
  misc_feature: Ceres ANNOT ID no. 6079055
  misc_feature: Encodes the peptide sequence at SEQ ID NO 7480
atggccaacagcaacctcccccgccgcatcatcaaggagacgcagcggttgctcagcgagccagctccaggaatcagtgcctcgccatcagaggagaacatgcgctacttcaatgtcatgatccttggaccatcgcagtcgccatacgagggaggagttttcaagctcgagttattcttgcctgaagaatatccaatggctccaccaaaggttcgttttctcacaaaaatttatcaccctaacattgacaagcttggtaggatatgccttgatattttgaaggacaagtggagtcctgcccttcagattcgaacagttttattgagcatccaggcattgcttagtgctccaaaccctgatgacccacttgccgacaatgtggcaaagcactggaaggctaatgaagctgaagctgtagaaacagctaaagagtggacccgtgtatatgcaagcggagcttga

SEQ ID NO: 7480 - protein, 153 aa, Sorghum bicolor
  misc_feature: Ceres ANNOT ID no. 6079055
  misc_feature (9)..(146): Pfam Id: UQ_con Pfam Desc: Ubiquitin-conjugating enzyme
  misc_feature (1)..(153): NCBI GI: 71040675 NCBI Desc: ubiquitin-conjugating enzyme 1 [arachis hypogaea]
  misc_feature (1)..(153): NCBI GI: 5381319 NCBI Desc: ubiquitin-conjugating enzyme e2 [catharanthus roseus]
  misc_feature (1)..(153): NCBI GI: 79590480 NCBI Desc: ubiquitin conjugating enzyme/ ubiquitin-like activating enzyme [arabidopsis thaliana]
  misc_feature (1)..(153): NCBI GI: 115187678 NCBI Desc: ubiquitin-conjugating enzyme 1 like protein [arachis hypogaea]
  misc_feature (1)..(141): NCBI GI: 3834310 NCBI Desc: similar to ubiquitin-conjugating enzyme e2-17 kd gbd83004 from homo sapiens. ests gbt88233, gbz24464, gbn37265, gbh36151, gbz34711, gbaa040983, and gbt22122 come from this gene.
  misc_feature (1)..(141): NCBI GI: 3834310 (continued) [arabidopsis thaliana]
  misc_feature (4)..(150): SWISSPROT Homolog: EC 6.3.2.19 Ubiquitin-conjugating enzyme E2 N
  misc_feature: Useful for biocontainment applications
  misc_feature: Functional homolog of the protein sequence given in SEQ ID NO 13996
  misc_feature: The sequence is a functional homolog of SEQ ID NO. 431 in the 11/188,298 US application
MANSNLPRRIIKETQRLLSEPAPGISASPSEENMRYFNVMILGPSQSPYEGGVFKLELFLPEEYPMAPPKVRFLTKIYHPNIDKLGRICLDILKDKWSPALQIRTVLLSIQALLSAPNPDDPLADNVAKHWKANEAEAVETAKEWTRVYASGA

SEQ ID NO: 7481 - DNA, 1281 bp, Sorghum bicolor
  misc_feature: Ceres ANNOT ID no. 6079069
  misc_feature: Encodes the peptide sequence at SEQ ID NO 7482
atgcagagggacaccggcgccggcgaccggacgccgggcaccccgagcccgacgcacggtggccgcctcaggcaccggaagcgctccaacgaggtgcccagcgatgtgaacacggctaatggcgccaacctgctcttgaacgatcagaacaagtacaagtcgatgctagttcgtacctactcctcactgtggatgatggctggtgtcgtgttcttgatatatatggggcatctctacatctgggccatggtggtggtcgtccaaatcttcatggccaaggagctcttcaaccttctccggaaggccaatgaggaccggcagctcccagggttcaggatgctcaactggcattttttctttaccgcaatgctgtttacctatggccgcttccttagccgccagcttgttaacacggtaacctcagataagttgttgtacaagctggtgagcaggctcatcaagtaccagatgtttatttgctactttctctacatagcaggttttgtttggtttattatcacactaaagaaaaaggcatacaagtaccagttcagtcaatatgcatggactcacatgatccttctcatggtatttgcccagtcatctttcactgtggcaaacatttttgatggaatattctggttcctcttcccagcttcgttaattgctatcaatgatgttgctgcatatttctttggattcttctttgggaaaacaccgctgatcaagctctctcccaagaaaacatgggaaggatttataggtgcatcagtgacaacattgctttctgcatttgtgcttgctaatttcatgggtcatttccagtggttgacatgcccaagaaaggatttatcaactggatggcttcattgtgacccaggtcctatgtttacaccagaaagttacgatctaccaggatggataccacaatggtttccatggagagaaattgcagttatgcccgttcagtggcatgccttagctcttggcttgtttgcttcaataatagcaccctttggtggcttttttgcaagtggcttcaagagggcattcaaatttaaggattttggggacagcatacctggtcatggtggatttacagataggatggactgccaaatggtcatggctgtcttcgcatacatctattaccaatcatttgtgatggtacaggacttatctgttgagacaatcctagagcagatactacggaatctgacctttgaggagcagcatgagctgtatgaacagctaggcaagttacttgtgagagcgaactga

SEQ ID NO: 7482 - protein, 426 aa, Sorghum bicolor
  misc_feature: Ceres ANNOT ID no. 6079069
  misc_feature (56)..(387): Pfam Id: CTP_transf_1 Pfam Desc: Cytidylyltransferase family
  misc_feature (1)..(422): NCBI GI: 2182104 NCBI Desc: cdp-diacylglycerol synthetase [solanum tuberosum]
  misc_feature (1)..(422): NCBI GI: 87241162 NCBI Desc: phosphatidate cytidylyltransferase [medicago truncatula]
  misc_feature (14)..(422): NCBI GI: 91806728 NCBI Desc: phosphatidate cytidylyltransferase/cdp-diglyceride synthetase [arabidopsis thaliana]
  misc_feature (9)..(422): NCBI GI: 2181182 NCBI Desc: cdp-diacylglycerol synthetase [arabidopsis thaliana]
  misc_feature (1)..(422): NCBI GI: 79325225 NCBI Desc: phosphatidate cytidylyltransferase [arabidopsis thaliana]
  misc_feature (1)..(422): SWISSPROT Homolog: EC 2.7.7.41 Phosphatidate cytidylyltransferase
MQRDTGAGDRTPGTPSPTHGGRLRHRKRSNEVPSDVNTANGANLLLNDQNKYKSMLVRTYSSLWMMAGVVFLIYMGHLYIWAMVVVVQIFMAKELFNLLRKANEDRQLPGFRMLNWHFFFTAMLFTYGRFLSRQLVNTVTSDKLLYKLVSRLIKYQMFICYFLYIAGFVWFIITLKKKAYKYQFSQYAWTHMILLMVFAQSSFTVANIFDGIFWFLFPASLIAINDVAAYFFGFFFGKTPLIKLSPKKTWEGFIGASVTTLLSAFVLANFMGHFQWLTCPRKDLSTGWLHCDPGPMFTPESYDLPGWIPQWFPWREIAVMPVQWHALALGLFASIIAPFGGFFASGFKRAFKFKDFGDSIPGHGGFTDRMDCQMVMAVFAYIYYQSFVMVQDLSVETILEQILRNLTFEEQHELYEQLGKLLVRAN

SEQ ID NO: 7483 - DNA, 366 bp, Sorghum bicolor
  misc_feature: Ceres ANNOT ID no. 6079086
  misc_feature: Encodes the peptide sequence at SEQ ID NO 7484
atggcctcctcatcgtccttctgcttcctactcgtggtggtggcattggcggcactgtttgccatcggctcatgcggcactacgctcaccatcgaggtcggtaaggactccacctccaccaaattaacccttatcaccaacgtcgccatctccgaggtgtcggtcaagcccaagggagccacagatttcacggacgacctcaaggagtcagaacccaagacttttacgctcgacagcaaggagccaatcgagggacctatcgccttccgcttccttgcgaagggtggtggctaccgagttgtcgataatgcgatccctgccgacttcaaggccggctcagtttacaagaccaccgaacaagtctaa

SEQ ID NO: 7484 - protein, 121 aa, Sorghum bicolor
  misc_feature: Ceres ANNOT ID no. 6079086
  misc_feature (4)..(118): NCBI GI: 33188338 NCBI Desc: group 3 pollen allergen [zea mays]
  misc_feature (1)..(121): NCBI GI: 38347338 NCBI Desc: osjnba0082e08.9 [oryza sativa (japonica cultivar-group)]
  misc_feature (1)..(121): NCBI GI: 116309489 NCBI Desc: osigba0113k06.3 [oryza sativa (indica cultivar-group)]
  misc_feature (1)..(117): NCBI GI: 115469368 NCBI Desc: os06g0662500 [oryza sativa (japonica cultivar-group)]
  misc_feature (23)..(116): NCBI GI: 115469372 NCBI Desc: os06g0662700 [oryza sativa (japonica cultivar-group)]
MASSSSFCFLLVVVALAALFAIGSCGTTLTIEVGKDSTSTKLTLITNVAISEVSVKPKGATDFTDDLKESEPKTFTLDSKEPIEGPIAFRFLAKGGGYRVVDNAIPADFKAGSVYKTTEQV

SEQ ID NO: 7485 - DNA, 1071 bp, Sorghum bicolor
  misc_feature: Ceres ANNOT ID no. 6079140
  misc_feature: Encodes the peptide sequence at SEQ ID NO 7486
atggcgtcaacctctccgcgccgctcctccggcggggacccaccttccccgtccacgccgctcatctcctcgccgacctccccggcatccggcccctccggaggcggcccgctggggcggctcacgagcctccgcggcgcggcgcggttcatccgccgcactgggagccggcgcctgatgagggagccctccgtggcggtgcgggagacggccgccgagcacctcgaggagcgccagaccgactgggcctactccaagcccgtcgtcgtgctcgacatgctctggaacctcgccttcgtcgccgtcgccgcggccgtactcgccgcgtcgacgggcgagagccccgccgtgccgctccgtgtctggatcgcgggctacgtgctccagtgcctcctccacatcctctgcgtcaccgtcgagtacaggcgtcggagcagggacgcggaccaggagggagccggtgatgaggatttcaagctcagtgttgtgaagcacttggagtctgcaaacacgatgttttccttcatatggtggattgtcgggttctattgggtctctgcaggcggtcaagctttatcacatgatgctcctcagctttattggctgtcaattgtttttctggcatttgatgttttctttgtggtcttctgtgttgccttggcttgtgtgattggaatcgctgtttgttgctgccttccctgcattattgctatcttatatgctgtaactgatcaggagggagcatctgaagatgacataaacaacctttccaaattcaaatttcggacaatgagtgatgcagacaagctagctgccggcattgcagcacctgtgggtggagtgatgacagagtgtggtaccaatcctcctgtcgaacatattctttcagctgaggatgcggagtgctgtatctgcctatgcccatatgaagatggtgtggagctacgtgagctcccttgcaaccaccattttcactgcagctgcatagacaagtggcttcacataaatgctacttgcccattatgcaagttcaacattgtcaagagcaatctcgacagagaagaggtctag

SEQ ID NO: 7486 - protein, 356 aa, Sorghum bicolor
  misc_feature: Ceres ANNOT ID no. 6079140
  misc_feature (302)..(342): Pfam Id: zf-C3HC4 Pfam Desc: Zinc finger, C3HC4 type (RING finger)
  misc_feature (161)..(356): NCBI GI: 50253212 NCBI Desc: ring zinc finger protein-like [oryza sativa (japonica cultivar-group)]
  misc_feature (164)..(354): NCBI GI: 38564282 NCBI Desc: at4g11680/t5c23_110 [arabidopsis thaliana]
  misc_feature (143)..(356): NCBI GI: 79317862 NCBI Desc: protein binding / ubiquitin-protein ligase/ zinc ion binding [arabidopsis thaliana]
  misc_feature (160)..(349): NCBI GI: 38344371 NCBI Desc: osjnbb0032e06.5 [oryza sativa (japonica cultivar-group)]
  misc_feature (160)..(349): NCBI GI: 116310006 NCBI Desc: osigba0139p06.5 [oryza sativa (indica cultivar-group)]
  misc_feature: The sequence is a functional homolog of SEQ ID NO. 271 in the 11/188,298 US application
  misc_feature: The sequence is a functional homolog of SEQ ID NO. 329 in the 11/188,298 US application
MASTSPRRSSGGDPPSPSTPLISSPTSPASGPSGGGPLGRLTSLRGAARFIRRTGSRRLMREPSVAVRETAAEHLEERQTDWAYSKPVVVLDMLWNLAFVAVAAAVLAASTGESPAVPLRVWIAGYVLQCLLHILCVTVEYRRRSRDADQEGAGDEDFKLSVVKHLESANTMFSFIWWIVGFYWVSAGGQALSHDAPQLYWLSIVFLAFDVFFVVFCVALACVIGIAVCCCLPCIIAILYAVTDQEGASEDDINNLSKFKFRTMSDADKLAAGIAAPVGGVMTECGTNPPVEHILSAEDAECCICLCPYEDGVELRELPCNHHFHCSCIDKWLHINATCPLCKFNIVKSNLDREEV

SEQ ID NO: 7487 - DNA, 510 bp, Sorghum bicolor
  misc_feature: Ceres ANNOT ID no. 6079141
  misc_feature: Encodes the peptide sequence at SEQ ID NO 7488
atgggggacggagagccggggcataagctgtcgccggcggaatcccgggaggtgatgctggcattcctccgcttcctaggcgccgacgcgcgcctcccggcctcggccgaccagcccgacgcctactctgcgctcgtacgcgccatcctctcctcggttgccgtctccgcctccccgaccccgcgggtctcctgcaccatcaccgtctcacacgccgtgaccaacccgtacaacacgctccacggcggcgtggtggcggccgtggccgaggccgtcgggatggcgtgcgcgcgggcagccgccggggataaagagatgttcctcggcgagcttagcaccgcgtacctcgctgcagcgcgatgcgattctgaagtggatgttgaagcgcagatactgaggaagggcagatcagtcgtggttaccacaatcgatttcagactaaaggataccaaaaggctctgctacacatctcgagccaccttttacatcatgcccatggcaagcctataa

SEQ ID NO: 7488 - protein, 169 aa, Sorghum bicolor
  misc_feature: Ceres ANNOT ID no. 6079141
  misc_feature (77)..(154): Pfam Id: 4HBT Pfam Desc: Thioesterase superfamily
  misc_feature (94)..(169): NCBI GI: 115471971 NCBI Desc: os07g0463500 [oryza sativa (japonica cultivar-group)]
  misc_feature (30)..(168): NCBI GI: 13605902 NCBI Desc: at1g04290/f19p19_27 [arabidopsis thaliana]
  misc_feature (33)..(169): NCBI GI: 21740488 NCBI Desc: osjnba0006b20.3 [oryza sativa (japonica cultivar-group)]
  misc_feature (49)..(163): NCBI GI: 94733762 NCBI Desc: novel protein similar to vertebrate thioesterase superfamily member 2 (them2) [danio rerio]
  misc_feature (53)..(164): NCBI GI: 47169131 NCBI Desc: chain b, x-ray structure of yb61_haein northeast structural genomics consortium target ir63
MGDGEPGHKLSPAESREVMLAFLRFLGADARLPASADQPDAYSALVRAILSSVAVSASPTPRVSCTITVSHAVTNPYNTLHGGVVAAVAEAVGMACARAAAGDKEMFLGELSTAYLAAARCDSEVDVEAQILRKGRSVVVTTIDFRLKDTKRLCYTSRATFYIMPMASL

SEQ ID NO: 7489 - DNA, 1452 bp, Sorghum bicolor
  misc_feature: Ceres ANNOT ID no. 6079187
  misc_feature: Encodes the peptide sequence at SEQ ID NO 7490
atggccggggagaaggcgccgcgcgcgttctccatcgaggagctcccgggccacctcatcggggaggtcctgacctcgggcgggctcgcggccgccgacctcgccaggctcgaggccacctgccgcgcgctcaggccgctcgccgagtacgccgcgtccaagctctgcgctgctcgggcggcgttcgcggccatggggcccgccgcccgcggggagctgctggagaggtgcgggggaagctggaagaaggtgctcaggttcctgcagtccgtcgagcagtcgtcaggcacggtcgagacctcatcgggcagcatgcaagtagccacaggaagatatcacacacttttggtccatgactcttctgtctattcttgtgggtccagcttgtgtggtgtgctaggtcatggcccagatactacacagtgtgcggcattcagtcgggtttccttcccatcactttctcgtgttataaacatctctgcttcacacaatcatgctgctttcgttacggagtctggggaggttttcacatgtggtgataattcatcattatgctgtggtcatggcgaagtggggagaactatatttcgaccaatgcaagtagaagcacttaaagggattccctgcaaacaggttgctactggtctaagttttactgtgattcttacaagggatggacaagtatatacttgtggaagtaatacacatggccaacttggtcatggtgacaccatagacagggccactccaaagcttattgaattgtttgaaggccccactaaggtggtgcagattgcagccggtgcaagttacacgtttgctgtaacagatgatggaacagtccattcctttggatcttgcactaatttctgccttggacatggggatcagcatgatgaacttcttccacgtgcaatccaatcatttaagaggaggaacattcatgtagtccgtgtttctgctggagatgagcatgctgtggctcttgatgcactaggatacgtttatacttggggcagaggatactgcggagccttgggtcatggtgatgagaatgataaaactagcccagaattgatcagcagcttgaagggccaagttgctgtacaggtatgtgcaaggaagagaaagacatttgttctcacggatgagggctcagttgttgcgtttggatggatgggctttgggagtttagggttccctgaccgaggatcatcggacaaagtaatgaggccccgcgttcttgagagcctgcaggatcactacgtctcccaaataagcaccggactgtatcacactgttgcagtgacaaataagggcattgtattcgggtttggggacaatgagcgagcacagcttgggcaggagtacattcgtgggtgcttaaaacctactgagataatgttccaaaagagtatggaagacataccaattgcggcgcctagtggttaa

SEQ ID NO: 7490 - protein, 483 aa, Sorghum bicolor
  misc_feature: Ceres ANNOT ID no. 6079187
  misc_feature (225)..(275): Pfam Id: RCC1 Pfam Desc: Regulator of chromosome condensation (RCC1)
  misc_feature (278)..(329): Pfam Id: RCC1 Pfam Desc: Regulator of chromosome condensation (RCC1)
  misc_feature (3)..(460): NCBI GI: 47847831 NCBI Desc: rjs-like protein [oryza sativa (japonica cultivar-group)]
  misc_feature (107)..(454): NCBI GI: 23308399 NCBI Desc: at5g63860/mgi19_6 [arabidopsis thaliana]
  misc_feature (107)..(454): NCBI GI: 5478530 NCBI Desc: uvb-resistance protein uvr8 [arabidopsis thaliana]
  misc_feature (88)..(454): NCBI GI: 92869653 NCBI Desc: regulator of chromosome condensation/beta-lactamase-inhibitor protein ii [medicago truncatula]
  misc_feature (121)..(480): NCBI GI: 119880501 NCBI Desc: regulator of chromosome condensation, rcc1 [salinispora arenicola cns205]
MAGEKAPRAFSIEELPGHLIGEVLTSGGLAAADLARLEATCRALRPLAEYAASKLCAARAAFAAMGPAARGELLERCGGSWKKVLRFLQSVEQSSGTVETSSGSMQVATGRYHTLLVHDSSVYSCGSSLCGVLGHGPDTTQCAAFSRVSFPSLSRVINISASHNHAAFVTESGEVFTCGDNSSLCCGHGEVGRTIFRPMQVEALKGIPCKQVATGLSFTVILTRDGQVYTCGSNTHGQLGHGDTIDRATPKLIELFEGPTKVVQIAAGASYTFAVTDDGTVHSFGSCTNFCLGHGDQHDELLPRAIQSFKRRNIHVVRVSAGDEHAVALDALGYVYTWGRGYCGALGHGDENDKTSPELISSLKGQVAVQVCARKRKTFVLTDEGSVVAFGWMGFGSLGFPDRGSSDKVMRPRVLESLQDHYVSQISTGLYHTVAVTNKGIVFGFGDNERAQLGQEYIRGCLKPTEIMFQKSMEDIPIAAPSG

SEQ ID NO: 7491 - DNA, 1632 bp, Sorghum bicolor
  misc_feature: Ceres ANNOT ID no. 6079303
  misc_feature: Encodes the peptide sequence at SEQ ID NO 7492
atggcagctgctcaaggtggtaccgttgtctcttcctctgagaaagttgagtttttgaagcttcaaaatggcagtgatattcggggtgttgctgttgctggggttgaaggtgagcctgtcaatctcacggaacctgccactgaagctatagctgcagctttttctgcatggctgttaaacaggaagaaagcagatggtttgagacgtttaagaatctctgttggacatgattcacgaatttctgcacataaattgcagaatgcagttactcatggaatcacttctgctgggcatgatatcgtacagtttggattggcttcaacacctgcaatgttcaacagtacacttacggaagatgagagaagtcatttacctgttgacggagccataatgataacagcaagccatcttccctacaatcggaatggtttcaagttttttaccagtgatggtgggctaaataaagctgacatcaaagatatcctggagcgtgcttccaaaatatacgaggaatctgcacatggcaacctgaaagaacaggaggaagcttcgaggggagttgtggctaatgttgactacatgtcaatttacgcttctgatcttgtacaagcagttcgtaaatctgctggagacaaagaaaaaccattggagggactgcatataatcgttgatgcagggaatggtgctggtggtttttttgtggataaggtactcaaaccattaggagctgttactactggaagtcaattccttgagcctgatggtttgtttcccaatcacattcccaatcctgaggacaaaactgcaatgaagtctattacacaagcagttcttgataacaaggcagacttaggcatcatatttgatactgatgtcgacaggtctgctgctgttgattcgagtggtcgtgagttgaaccgtaaccgattgattgctttgatggctgccatagttcttgaggaacatccaggaactacagttgtgacagatagtgtgacttcagatggattgactgtatttattgaaaataaacttggagggaagcatcaccgtttcaaacgagggtacaagaatgtaatagatgaggctattcgtctgaattctattggtgaggagtcacatttagccatggaaacaagtggccatggagcactgaaagagaaccactggcttgatgatggagcataccttatggtcaaacttctgaataaacttgctgctgctagaacactgggttcaagtattggtagtaaagttttgactgatttggttgagggtcttgaggaagctgctgtgtcagttgagataagactgaagattgatcagaatcattcagatttgaaaggagggtccttccgtgactatggagaatcagtcttgaggcatttagagaatgcaatcagcaaagatccaaatctccatatagcccccaagaactatgaaggcgtaagggtttcaggatatggtgggtggttcctgctgaggctctctctccatgaccctgttcttcccctaaacattgaggcaccaagtaaagatgatgcgattaaactggggcttgcggttcttgctgctgtgaatgaattttcagcactggatgtgacggcactgaacaaattcgtgcagcagtga

SEQ ID NO: 7492 - protein, 543 aa, Sorghum bicolor
  misc_feature: Ceres ANNOT ID no. 6079303
  misc_feature (19)..(172): Pfam Id: PGM_PMM_I Pfam Desc: Phosphoglucomutase/phosphomannomutase, alpha/beta/alphadomain I
  misc_feature (195)..(304): Pfam Id: PGM_PMM_II Pfam Desc: Phosphoglucomutase/phosphomannomutase, alpha/beta/alphadomain II
  misc_feature (3)..(538): NCBI GI: 9755778 NCBI Desc: phosphoglucomutase-like protein [arabidopsis thaliana]
  misc_feature (3)..(538): NCBI GI: 22136534 NCBI Desc: at5g17530/k10a8_10 [arabidopsis thaliana]
  misc_feature (14)..(538): NCBI GI: 126657950 NCBI Desc: phosphoglucomutase/phosphomannomutase family protein [cyanothece sp. ccy0110]
  misc_feature (14)..(538): NCBI GI: 67922212 NCBI Desc: phosphoglucomutase/phosphomannomutase c terminal:phosphoglucomutase/phosphomannomutase alpha/beta/alpha domain i:phosphoglucomutase/phosphomannomutase alpha/beta/alpha
  misc_feature (14)..(538): NCBI GI: 67922212 (continued) domain ii:phosphoglucomutase/phosphomannomutase alpha/beta/alpha domain iii [crocosphaera watsonii wh 8501]
  misc_feature (17)..(537): NCBI GI: 146346315 NCBI Desc: pgm1 [clostridium kluyveri dsm 555]
MAAAQGGTVVSSSEKVEFLKLQNGSDIRGVAVAGVEGEPVNLTEPATEAIAAAFSAWLLNRKKADGLRRLRISVGHDSRISAHKLQNAVTHGITSAGHDIVQFGLASTPAMFNSTLTEDERSHLPVDGAIMITASHLPYNRNGFKFFTSDGGLNKADIKDILERASKIYEESAHGNLKEQEEASRGVVANVDYMSIYASDLVQAVRKSAGDKEKPLEGLHIIVDAGNGAGGFFVDKVLKPLGAVTTGSQFLEPDGLFPNHIPNPEDKTAMKSITQAVLDNKADLGIIFDTDVDRSAAVDSSGRELNRNRLIALMAAIVLEEHPGTTVVTDSVTSDGLTVFIENKLGGKHHRFKRGYKNVIDEAIRLNSIGEESHLAMETSGHGALKENHWLDDGAYLMVKLLNKLAAARTLGSSIGSKVLTDLVEGLEEAAVSVEIRLKIDQNHSDLKGGSFRDYGESVLRHLENAISKDPNLHIAPKNYEGVRVSGYGGWFLLRLSLHDPVLPLNIEAPSKDDAIKLGLAVLAAVNEFSALDVTALNKFVQQ

SEQ ID NO: 7493 - DNA, 939 bp, Sorghum bicolor
  misc_feature: Ceres ANNOT ID no. 6079357
  misc_feature: Encodes the peptide sequence at SEQ ID NO 7494
atggcgaagctttgcactttgctgttggccgcagtggtggtcctgtcactcctagtgagccccattgcctgcaaccgaaagttcagcaagcccaagccaaagccggccagccacaggcggccggtgactgcggtcaagccaaagccaaaaccggtcagctacaagccggcgcctgtggcggccaaacctccccgcagcaaccacactgctacacccaggccatcgccgatcgtctacggctccggtggctggctgtcaggcgccggcgccacgtactacggcgcgaccaacggcgacgggagcgacggcggcgcgtgcggctaccagactgctgtcgggaagaagccgttcgactcgatgatcgccgccgggagcacgccactgtacaagggtggcgagggctgcggcgcctgctacgaggtgaaatgcaagaccaacgccgcgtgctccggccagcccgtgaccatcgtaatcaccgaccagtcccctggcgatctgttccccggcgaggttgagcactttgacatgagcggcaccgccatgggcgccatggcgcggcccggcatggccgacaagctccgcgctggcggcgtgctcaggatcctgtacaggagggtgccgtgcaagtaccccggcgtgaacgtcgcgttcaaggtggaccagggcgcgaacccgttctacttcgacgtgctgatcgagttcgaggacgacgacggcgacctcaaggccgtcgacctgatggaggccggcagcagcgtgtggacacccatggcgcacaactggggcgcgacgtggcgcctcaacaacggcaggagactcagagcgccgttcgggctccggctcacctccgactccggcagggtgctcgtcgccaacaacgccatcccggccgcgtggaagcccggcaaggcctaccgttccttggtcaactacccctga

SEQ ID NO: 7494 - protein, 312 aa, Sorghum bicolor
  misc_feature: Ceres ANNOT ID no. 6079357
  misc_feature (121)..(203): Pfam Id: DPBB_1 Pfam Desc: Rare lipoprotein A (RlpA)-like double-psi beta-barrel
  misc_feature (215)..(296): Pfam Id: Pollen_allerg_1 Pfam Desc: Pollen allergen
  misc_feature (1)..(312): NCBI GI: 14193767 NCBI Desc: beta-expansin 4 [zea mays]
  misc_feature (35)..(311): NCBI GI: 75123238 NCBI Desc: expansin-b11 precursor (osexpb11) (beta-expansin-11) (osaexpb1.20)
  misc_feature (35)..(311): NCBI GI: 16517013 NCBI Desc: beta-expansin osexpb11 [oryza sativa]
  misc_feature (55)..(312): NCBI GI: 44894810 NCBI Desc: expansin expb9 [triticum aestivum]
  misc_feature (65)..(311): NCBI GI: 34101049 NCBI Desc: beta-expansin 1 precursor [hordeum vulgare]
  misc_feature: Useful for making plants with altered cell wall content and/or composition
  misc_feature: Functional homolog of the protein sequence encoded by LOCUS at2g45110
  misc_feature: Useful for making plants with altered carbohydrate content
  misc_feature: Functional homolog of the protein sequence given in SEQ ID NO 13767
  misc_feature: Useful for making plants with altered cell wall content and/or composition
  misc_feature: Functional homolog of the protein sequence given in SEQ ID NO 13995
MAKLCTLLLAAVVVLSLLVSPIACNRKFSKPKPKPASHRRPVTAVKPKPKPVSYKPAPVAAKPPRSNHTATPRPSPIVYGSGGWLSGAGATYYGATNGDGSDGGACGYQTAVGKKPFDSMIAAGSTPLYKGGEGCGACYEVKCKTNAACSGQPVTIVITDQSPGDLFPGEVEHFDMSGTAMGAMARPGMADKLRAGGVLRILYRRVPCKYPGVNVAFKVDQGANPFYFDVLIEFEDDDGDLKAVDLMEAGSSVWTPMAHNWGATWRLNNGRRLRAPFGLRLTSDSGRVLVANNAIPAAWKPGKAYRSLVNYP

SEQ ID NO: 7495 - DNA, 2028 bp, Sorghum bicolor
  misc_feature: Ceres ANNOT ID no. 6079490
  misc_feature: Encodes the peptide sequence at SEQ ID NO 7496
atgccaccggccgaggacgccccaccgcagaccccgcctcccgcgcgcgggacggcggccggatcgcgggtgctgctgcagtcgccgcctccggcgttcccgctcggctccaacgacgaccagcaagagcgcgcccgcgcccgagccgcggcgcgtgccgcctccgtccgccgccgatccctcgctgcctccatcgcgccctccaaggatccgcgccacgacctcctcaaccgcgagcaggtcatggacctcttccaaaactgtatcaagctcgcatccgagaacaaaattaaccagaagaacacgtgggagctgggcctaatcgaccatctgagcgagatcatccaagcgggggcggacgaggacgaggagaccaactttcagaaggcaagctgcacactggaggcgggggtcaagatctattcacttcgtgtggattcggtgcactctgaagcttacaaggtgcttggcgggatcaaccgtgccggaaggggtgaagaggctgatttggatgaaggcagcaatgttgcacctgcacaggatgaaggcatcaacaaaaaggatgctgataggaggatttcacctgcttcaacgttggagtcatcatttgaggctctcaatgtaaagaaatttgatgttgctttcacggtggatcctctataccatcaaactactgctcagtttgatgaaggtggggcaaagggccttttgttgtataaccttggagtttatggcagctgccgtgtgctgtttgattcatttgaagctccagacaaatgcatcttaagtgatatgcaaactgagcaggctgaggcagttgacctttcatttgctaaagagcaaattgaggaaatggtcactgaaatgcgtctatgtaatgatatttctccaaccctaagggatattgttgcacaatttgatgaagaaaaccaaaggccatcacataggttatctcctgggcaaatgccagtaatggaagatccgatggatgatgataatgaagcagacgataatgatagcatactacctgattctggaacttgggattttggtggttgccatgaccatgaggatgcatataatgaaaactgcaacccaatggattccatctcaacaaactaccaagaggaattcaatgaatacactgttgaaattcctcagggtactattgtagatgaaaggcttgacaaaattgcagatcttttattacttggcatgggctcttcaaaagcaaatgcttgggcaggacctgagcactggaaatatcggaaagctaaagatttggaagctgtcccaacttcatctggtgattcagaaataacaaataagatgaagaaaagatacaaggataaacctgacattgatttcacaaaagcattggacaatgagcatccaaatatcttttcacctcccaaaaatccaaagtcattagtattgcctgtaaatagggctatgtgcagcaataaacttccagaagattgccattacaggcctgaaagccttgtgaaattatttcttcttccagatgttttgtgtcttgctaagagaagaagaaaatcacttgacgctccagtggataatgatgatgactttatcccatctgaaccttgggaagacgacaacttttgcactgatcatgttgatgaaggacatgtgtgtagtgatgtagaagagcctgtaaatcttatcaataaaccgagacaggtcaacaagattgatatacagtatgacaaggtatcaaaacaagtggatgttcatgctttaaaagaagtgctctggaatcacatccaagcatcttctgagactgattgtcaggaaagagaggaaactggatcaccgctgcacctctctcaggtgttacatgaccttccaagcagcaacccagatgctgtaacaactgatatttcgccacacctgtatttcatctgccttttgcatctggcaaatgagcacagtttgaagctgtgtgaccgccccacgttggatgaagtcgacatatacatgccgacttcaccgattgtgaagtaa

SEQ ID NO: 7496 - protein, 675 aa, Sorghum bicolor
  misc_feature: Ceres ANNOT ID no. 6079490
  misc_feature (6)..(669): Pfam Id: Barren Pfam Desc: Barren protein
  misc_feature (26)..(670): NCBI GI: 124359763 NCBI Desc: barren [medicago truncatula]
  misc_feature (360)..(675): NCBI GI: 115437256 NCBI Desc: os01g0532800 [oryza sativa (japonica cultivar-group)]
  misc_feature (30)..(302): NCBI GI: 4704278 NCBI Desc: spcc306.03c [schizosaccharomyces pombe]
  misc_feature (7)..(666): NCBI GI: 33417152 NCBI Desc: brrn1-prov protein [xenopus laevis]
  misc_feature (9)..(666): NCBI GI: 46249466 NCBI Desc: loc398069 protein [xenopus laevis]
MPPAEDAPPQTPPPARGTAAGSRVLLQSPPPAFPLGSNDDQQERARARAAARAASVRRRSLAASIAPSKDPRHDLLNREQVMDLFQNCIKLASENKINQKNTWELGLIDHLSEIIQAGADEDEETNFQKASCTLEAGVKIYSLRVDSVHSEAYKVLGGINRAGRGEEADLDEGSNVAPAQDEGINKKDADRRISPASTLESSFEALNVKKFDVAFTVDPLYHQTTAQFDEGGAKGLLLYNLGVYGSCRVLFDSFEAPDKCILSDMQTEQAEAVDLSFAKEQIEEMVTEMRLCNDISPTLRDIVAQFDEENQRPSHRLSPGQMPVMEDPMDDDNEADDNDSILPDSGTWDFGGCHDHEDAYNENCNPMDSISTNYQEEFNEYTVEIPQGTIVDERLDKIADLLLLGMGSSKANAWAGPEHWKYRKAKDLEAVPTSSGDSEITNKMKKRYKDKPDIDFTKALDNEHPNIFSPPKNPKSLVLPVNRAMCSNKLPEDCHYRPESLVKLFLLPDVLCLAKRRRKSLDAPVDNDDDFIPSEPWEDDNFCTDHVDEGHVCSDVEEPVNLINKPRQVNKIDIQYDKVSKQVDVHALKEVLWNHIQASSETDCQEREETGSPLHLSQVLHDLPSSNPDAVTTDISPHLYFICLLHLANEHSLKLCDRPTLDEVDIYMPTSPIVK

SEQ ID NO: 7497 - DNA, 600 bp, Sorghum bicolor
  misc_feature: Ceres ANNOT ID no. 6079510
  misc_feature: Encodes the peptide sequence at SEQ ID NO 7498
atggggggagcttctaattctaacctgcttcctcctggcttccacttcttcccatcagacgaagagctcgtcgtccatttcctccgccgcaaagcctcgctcttaccatgccagccagacatcgtccctacagtgtgtatgaatcactatgatccatgggaactgaatggtaaccagtggtacttcttcagccatgcgaagcacagcagggtcacaccaaacgggtactggagctctgtttgtgcagacgagacggtgagcagtggtggctgtagtgtcggtctgaagaagacacttgtcttctccactggagagccctctgaatctgaggggaccgagaccaactggatcatgcatgagtatcacttactggatgggaggaaggggattagcagtagcactacctcaactaatagttcaagcaagaaattgcatcacccaaacacagagtccaataactgggtgatatgccgagtgtttgattcgacgaccggtggatcgcaagcgagctgccatgaggagggtatggagctttcatgcttagatgaggtgttcctatccctcgacgactatgatgaagtcagtttgtcaaataattag

SEQ ID NO: 7498 - protein, 199 aa, Sorghum bicolor
  misc_feature: Ceres ANNOT ID no. 6079510
  misc_feature (10)..(124): Pfam Id: NAM Pfam Desc: No apical meristem (NAM) protein
  misc_feature (1)..(197): NCBI GI: 38344065 NCBI Desc: osjnba0006b20.9 [oryza sativa (japonica cultivar-group)]
  misc_feature (1)..(193): NCBI GI: 115458512 NCBI Desc: os04g0437000 [oryza sativa (japonica cultivar-group)]
  misc_feature (4)..(198): NCBI GI: 92871467 NCBI Desc: no apical meristem (nam) protein [medicago truncatula]
  misc_feature (5)..(186): NCBI GI: 21554255 NCBI Desc: nac domain protein nac2 [arabidopsis thaliana]
  misc_feature (5)..(183): NCBI GI: 117586720 NCBI Desc: nac domain protein [cymbidium hybrid cultivar]
  misc_feature: The sequence is a functional homolog of SEQ ID NO 2694 in the 10/374,780US patent application
  misc_feature: The sequence is a functional homolog of SEQ ID NO 290 in the 10/374,780US patent application
  misc_feature: The sequence is a functional homolog of SEQ ID NO 6 in the 10/225,066US patent application
  misc_feature: The sequence is a functional homolog of SEQ ID NO 662 in the 10/225,066US patent application
  misc_feature: Useful for making plants with modulated growth and phenotype characteristics
  misc_feature: The sequence is a functional homolog of SEQ ID NO 6 in the 20050160493 US patent application
  misc_feature: The sequence is a functional homolog of SEQ ID NO 662 in the 20050160493 US patent application
  misc_feature: Useful for making plants with altered carbohydrate content
  misc_feature: Functional homolog of the protein sequence given in SEQ ID NO 13994
  misc_feature: The sequence is a functional homolog of SEQ ID NO. 362 in the 11/188,298 US application
  misc_feature: The sequence is a functional homolog of SEQ ID NO. 335 in the 11/188,298 US application
MGGASNSNLLPPGFHFFPSDEELVVHFLRRKASLLPCQPDIVPTVCMNHYDPWELNGNQWYFFSHAKHSRVTPNGYWSSVCADETVSSGGCSVGLKKTLVFSTGEPSESEGTETNWIMHEYHLLDGRKGISSSTTSTNSSSKKLHHPNTESNNWVICRVFDSTTGGSQASCHEEGMELSCLDEVFLSLDDYDEVSLSNN

SEQ ID NO: 7499 - DNA, 1563 bp, Sorghum bicolor
  misc_feature: Ceres ANNOT ID no. 6079516
  misc_feature: Encodes the peptide sequence at SEQ ID NO 7500
atggctgtctccctggtgcttccgttcaccatcctcctcgctgccgttctcctctctggtcctgtcttggctgaggtggagaccgccgtggagctgggcgaggtggtcctgacgcttgacgccagtaacttctcggaggtggtggccaagcaccagttcatcgtcgtcgagttctacgcgccatggtgtggccactgcaagcaactcgctccagagtacgagaaggcagctgctgttctgaggaatcacgacccgccgttggtgctcgccaaagtggacgcgtacgacgagaggaacaaggagatcaaggacaagtaccaggtgcatgcgtaccccaccatcaagatcatagagaacggagggaaggatgtacgtggctatggtggtccgagggacgccgatggcattgtggggtacctcaagaagcaggtcggcccagcttccatcgagctcagttcggcggaggctgctcagtcgtccatcggtgacaagggggtggttcttgttggagttttccccgagtttgctggcgtggagtatgagaatttcatggccgtggcagagaaaaaacggtcagactatgatttctttcacacgtcagacgcaagcattctgccacgtggtgatcagactatcaagggccctgttgttcgtctcttcaaaccatttgacgagctctttgctgattcacgggattttgatacggatgctcttgaaaaattcattgacgtgtctggtttcccagcagtagttacattcgatgctgatccaaccaaccataagtttcttgagagatactacagcactcctagtgccaaagcaatgcttttcttgaacttcagtgacgacagagtggaggccttcaagaatcagattcaagaagctgccaagaaattcagtgctaataacataagttttctaattggtgatgttgaagctgctgaccgtgccttccagtactttgggcttaaagagaacgatgcgcccctcctttttgtgattgcacagggtgggaaatatctcaatccaactattgaccctgatcaaatcatcccttggttgaaggagtacatagttgagtatggaaacttgacaccttatgttaagtcagagccaatcccaaaggtgaatgaccaacctgttaaggtcgttgtggctgacagtatcgatgatgtcgttttcaactctggcaaaaatgtactgctcgagttctatgcaccttggtgtggccattgccggaagctggccccaatcttggaggaagttgcagtctcattacaagacgacgaagacgtcgtcattgcaaagatggatggcactgcaaacgatatccctaccgacttggcggtggagggatatcccacgatctacttctactcgaccaccggtgacctttattcctacaatggtggaagaacggccgaggacatcatcagtttcatcaagaagaacaagggccccagagctggtgccgtggacgaagtgacgcagacggatgctggtgctgtagaagagggcactgcaccttcatcgacgtcagagcttccgaaagacgaactctga

SEQ ID NO: 7500 - protein, 520 aa, Sorghum bicolor
  misc_feature: Ceres ANNOT ID no. 6079516
  misc_feature (35)..(143): Pfam Id: Thioredoxin Pfam Desc: Thioredoxin
  misc_feature (380)..(484): Pfam Id: Thioredoxin Pfam Desc: Thioredoxin
  misc_feature (1)..(520): NCBI GI: 60202586 NCBI Desc: protein disulfide isomerase-like [oryza sativa (japonica cultivar-group)]
  misc_feature (1)..(520): NCBI GI: 19654 NCBI Desc: protein disulfide isomerase [medicago sativa]
  misc_feature (1)..(498): NCBI GI: 62546209 NCBI Desc: protein disulfide isomerase [oryza sativa (japonica cultivar-group)]
  misc_feature (9)..(489): NCBI GI: 1134968 NCBI Desc: protein disulphide isomerase pdi
  misc_feature (1)..(500): NCBI GI: 4704766 NCBI Desc: protein disulfide isomerase homolog; pdi [datisca glomerata]
  misc_feature (1)..(520): SWISSPROT Homolog: EC 5.3.4.1 Protein disulfide-isomerase precursor
MAVSLVLPFTILLAAVLLSGPVLAEVETAVELGEVVLTLDASNFSEVVAKHQFIVVEFYAPWCGHCKQLAPEYEKAAAVLRNHDPPLVLAKVDAYDERNKEIKDKYQVHAYPTIKIIENGGKDVRGYGGPRDADGIVGYLKKQVGPASIELSSAEAAQSSIGDKGVVLVGVFPEFAGVEYENFMAVAEKKRSDYDFFHTSDASILPRGDQTIKGPVVRLFKPFDELFADSRDFDTDALEKFIDVSGFPAVVTFDADPTNHKFLERYYSTPSAKAMLFLNFSDDRVEAFKNQIQEAAKKFSANNISFLIGDVEAADRAFQYFGLKENDAPLLFVIAQGGKYLNPTIDPDQIIPWLKEYIVEYGNLTPYVKSEPIPKVNDQPVKVVVADSIDDVVFNSGKNVLLEFYAPWCGHCRKLAPILEEVAVSLQDDEDVVIAKMDGTANDIPTDLAVEGYPTIYFYSTTGDLYSYNGGRTAEDIISFIKKNKGPRAGAVDEVTQTDAGAVEEGTAPSSTSELPKDEL

SEQ ID NO: 7501 - DNA, 465 bp, Sorghum bicolor
  misc_feature: Ceres ANNOT ID no. 6079517
  misc_feature: Encodes the peptide sequence at SEQ ID NO 7502
atggacccggaagcggtgcggaaaagcctggagcccaccgcaaccgcagagaaaatcacgggctccacccctgcgcggctccacttctacgaccccttcgtcctcagcggcgtcagcatcgaagccgccgagcacggccgcctcctctgctccttcgtcgtgacacctcgccttgcgagtcccgtggggtacctccgcagcggggtcacagcgacgctcgccgaccagctgggatcggccgtgttcttctgcagcgggctccccagcagcggggtctccatcgagatcagcgtctcctttgtcgacgcggctgcagtcggggaggaaatagaggttgaggggaagttgttgcgtgctggaaagtcagttggtgttgtctctgtcgatttcaggaagaaaaagacaggaaaattgatggcacaggcccgtcatacaaagtatcttgtggcatcaagcaaattgtga

SEQ ID NO: 7502 - protein, 154 aa, Sorghum bicolor
  misc_feature: Ceres ANNOT ID no. 6079517
  misc_feature (62)..(139): Pfam Id: 4HBT Pfam Desc: Thioesterase superfamily
  misc_feature (1)..(154): NCBI GI: 21740488 NCBI Desc: osjnba0006b20.3 [oryza sativa (japonica cultivar-group)]
  misc_feature (1)..(152): NCBI GI: 13605902 NCBI Desc: at1g04290/f19p19_27 [arabidopsis thaliana]
  misc_feature (65)..(154): NCBI GI: 20161439 NCBI Desc: b1065e10.13 [oryza sativa (japonica cultivar-group)]
  misc_feature (17)..(148): NCBI GI: 119575864 NCBI Desc: thioesterase superfamily member 2 [homo sapiens]
  misc_feature (34)..(148): NCBI GI: 110590536 NCBI Desc: chain d, crystal structure of human thioesterase superfamily member 2 (casp target)
MDPEAVRKSLEPTATAEKITGSTPARLHFYDPFVLSGVSIEAAEHGRLLCSFVVTPRLASPVGYLRSGVTATLADQLGSAVFFCSGLPSSGVSIEISVSFVDAAAVGEEIEVEGKLLRAGKSVGVVSVDFRKKKTGKLMAQARHTKYLVASSKL

SEQ ID NO: 7503 - DNA, 1332 bp, Sorghum bicolor
  misc_feature: Ceres ANNOT ID no. 6079519
  misc_feature: Encodes the peptide sequence at SEQ ID NO 7504
atggactcggtcatggccgccgtccccgactcgccgccgcagactgtcgtgctcgtctccgccggcgccagccactccgtcgcgctcctcacgggcaatgtcctgtgctcgtggggcaggggcgaggacgggcagctcggccacggcgacgcggaggaccggctcgtgcccaccgtgctgagcggcttcgacgcgcccgggatcacgtcggtcatctgcggcgccgaccacaccaccgcctactccgaggacgagctgcaggtctacagctggggctggggagacttcgggaggctcggccatggcaactccagcgacgtcttcacgccccagccggtcaaggcgctgcaggggctcaagatcaagcagattgcctgcggggacagccattgtcttgccgtcaccatggccggacaagtgcagagttggggccgtaaccagaatggacagctaggccttggaaccactgaagactcgctgcttccacagaagattcaggctttcgagggtgtttgcgtgaaaatgattgctgctggcgccgaacatactgctgcagttactgaagatggtgacctctatggatggggttggggtcgatatggaaacttaggtcttggtgaccgtaatgatcgtttgcttcctgaaaaagtatcttctgtggagggtgagaagatggtgcttgtggcatgtggatggcgccatacaatcactgtttctgactctggtaatctgtacacttatggttggagcaaatacggtcaactgggacatggtgattttgaagatcatttagttccacataaactagaagctttgaaagatagcactatatcccagatttcaggcggttggaggcatacgatggcacttacatcagagggaaagctttacggatggggatggaacaagtttggacaagttggagtcggcaacaatgatgatcactgctccccagtacaagttcattttcccgaggatcagaaaatttcccaagttgcatgcggatggaggcatacacttgccctttctgagaagaaaaatgttttctcctggggaaggggtactagcggacagctcggcaatggtgaaatagttgacaggaatacacctgtactgattgatgccttaagcactgatggttctggctgcaagaagttggagtcatcaacggcagccccatttgcagccaaagtttgggtatcgccatcagaaagatatgccatagttcctgacgaaaacgttcctaaagcaggcgaaggcacagcacgaggcaacggcgccgacgcgaacgtaccagagaacgacgtaaagaggatgcgcgtgcagtcgtag

SEQ ID NO: 7504 - protein, 443 aa, Sorghum bicolor
  misc_feature: Ceres ANNOT ID no. 6079519
  misc_feature (85)..(134): Pfam Id: RCC1 Pfam Desc: Regulator of chromosome condensation (RCC1)
  misc_feature (137)..(186): Pfam Id: RCC1 Pfam Desc: Regulator of chromosome condensation (RCC1)
  misc_feature (189)..(238): Pfam Id: RCC1 Pfam Desc: Regulator of chromosome condensation (RCC1)
  misc_feature (293)..(342): Pfam Id: RCC1 Pfam Desc: Regulator of chromosome condensation (RCC1)
  misc_feature (11)..(441): NCBI GI: 23308399 NCBI Desc: at5g63860/mgi19_6 [arabidopsis thaliana]
  misc_feature (11)..(441): NCBI GI: 5478530 NCBI Desc: uvb-resistance protein uvr8 [arabidopsis thaliana]
  misc_feature (1)..(441): NCBI GI: 92869653 NCBI Desc: regulator of chromosome condensation/beta-lactamase-inhibitor protein ii [medicago truncatula]
  misc_feature (1)..(221): NCBI GI: 21741206 NCBI Desc: osjnbb0086g13.15 [oryza sativa (japonica cultivar-group)]
  misc_feature (19)..(377): NCBI GI: 106890093 NCBI Desc: regulator of chromosome condensation, rcc1 [roseiflexus sp. rs-1]
MDSVMAAVPDSPPQTVVLVSAGASHSVALLTGNVLCSWGRGEDGQLGHGDAEDRLVPTVLSGFDAPGITSVICGADHTTAYSEDELQVYSWGWGDFGRLGHGNSSDVFTPQPVKALQGLKIKQIACGDSHCLAVTMAGQVQSWGRNQNGQLGLGTTEDSLLPQKIQAFEGVCVKMIAAGAEHTAAVTEDGDLYGWGWGRYGNLGLGDRNDRLLPEKVSSVEGEKMVLVACGWRHTITVSDSGNLYTYGWSKYGQLGHGDFEDHLVPHKLEALKDSTISQISGGWRHTMALTSEGKLYGWGWNKFGQVGVGNNDDHCSPVQVHFPEDQKISQVACGWRHTLALSEKKNVFSWGRGTSGQLGNGEIVDRNTPVLIDALSTDGSGCKKLESSTAAPFAAKVWVSPSERYAIVPDENVPKAGEGTARGNGADANVPENDVKRMRVQS

SEQ ID NO: 7505 - DNA, 744 bp, Sorghum bicolor
  misc_feature: Ceres ANNOT ID no. 6079542
  misc_feature: Encodes the peptide sequence at SEQ ID NO 7506
atgccactcgtcggctgtccccgccgcggcccgccgctttctcccgcctgccgccaccgccgcagcctgtatcgggcccgagccgtcgcgcccaaatgcgaggcctcctcctcctctcctccgccgctcctgaccaggagactgtccgctgcctcgctgcttctcgctgtcctccccgtccccgcgtcgtcgccgcaactccccgtcgcctccgcgtcgcaggcggaggcgaaggaggcggaaggagaaagcggagcttccgaggggatagaactggagcggtacactgaccaggagcagggcttcaccctcctcaagccgacctcttggcccaaggtggagaaggcgggcgcgacggcgctgtttcagcaggagggcaaagggagtaacaatatcggggtcgtcgtcaaccccgtccggctcaattcgctgacggagttcgggacgccgcagttcgtcgcggacagacttctgcaagcagagaagaaaaaggaaagtaccaagactgccgaggtgatctcagtgggagagagatcaggtcatggtggcctgacagtgtatgaaatcgagtacacactggatagcactaggggagggatgaaacggatcttctcgggtgcatttgttgcttcaaggaagctctatctgctcaacatagcctgttcagacacccaggagaagcccttggacagcgagacaagaattgttctggaaaaagttctacattcttttgattctgtatag

SEQ ID NO: 7506 - protein, 247 aa, Sorghum bicolor
  misc_feature: Ceres ANNOT ID no. 6079542
  misc_feature (60)..(247): Pfam Id: PsbP Pfam Desc: PsbP
  misc_feature (1)..(247): NCBI GI: 116310283 NCBI Desc: osigba0102d10.5 [oryza sativa (indica cultivar-group)]
  misc_feature (87)..(236): NCBI GI: 113474070 NCBI Desc: photosystem ii oxygen evolving complex protein psbp [trichodesmium erythraeum ims101]
  misc_feature (92)..(245): NCBI GI: 119492446 NCBI Desc: photosystem ii oxygen evolving complex protein psbp [lyngbya sp. pcc 8106]
  misc_feature (85)..(244): NCBI GI: 119513527 NCBI Desc: photosystem ii oxygen evolving complex protein psbp [nodularia spumigena ccy9414]
  misc_feature (85)..(237): NCBI GI: 22299618 NCBI Desc: photosystem ii oxygen-evolving complex 23k protein psbp homolog [thermosynechococcus elongatus bp-1]
MPLVGCPRRGPPLSPACRHRRSLYRARAVAPKCEASSSSPPPLLTRRLSAASLLLAVLPVPASSPQLPVASASQAEAKEAEGESGASEGIELERYTDQEQGFTLLKPTSWPKVEKAGATALFQQEGKGSNNIGVVVNPVRLNSLTEFGTPQFVADRLLQAEKKKESTKTAEVISVGERSGHGGLTVYEIEYTLDSTRGGMKRIFSGAFVASRKLYLLNIACSDTQEKPLDSETRIVLEKVLHSFDSV

SEQ ID NO: 7507 - DNA, 1863 bp, Sorghum bicolor
  misc_feature: Ceres ANNOT ID no. 6079547
  misc_feature: Encodes the peptide sequence at SEQ ID NO 7508
  misc_feature: Down-regulated in root tissues in response to salicylic acid treatment
atggaggacatcgaggacgtgctgggtccggccgacctctctggcggcggagcgcctccggggctccggctcccgctagccgccgtcgcggtgaagcccaagcgacggtcgtccagggtcgcgcaggcgccgcctcagcccgaggcccggatccccggcacgcagacgatttacgtcaagactttcgggtgctcacataaccagagtgacagtgaatacatgtcaggtcagctctctgcatttggatatgcgatcactgaagagcccgaaggagcagatttgtggctaattaacacatgcacagtgaaaaatccaagtcaatctgcaatgacaaccctcatatctaaatgcaagaatgcaaacaagccactagtagtggctggatgtgtaccccaaggaagccagggcctcaaggagcttgaaggtattagtataattggagtgcaacagatagaccgggttgttgaagtggttgaggaaactttaaagggccatgaggttcggctgttgagtcggaaaacactgccctcgcttgatttacctaaggtaagaaagaacaagtttatcgagattcttcctattaatgtgggatgtttaggtgcctgcacatactgtaagacaaagcatgctcgtggtcatttgggaagctatactattgacagcttggtggatcgtgtgaaaactgttgtctccgaaggtgtcagggagatctggttgagcagcgaagatactggacgggatatcagtacgaaccttcccaatttgttaaatgcgattgttgcagagcttcctgttgaccaaagcacaatgctccgcataggcatgacaaatcctcctttcatactagagcatttgaaggagatagctgccgttttgtgtcatccctgcgtttactctttcctccatgttcctgtgcaatctggaagcgatgctgttttaacggcaatgaatcgtgaatacactgttgctgagttcagaaaggtagttgacactctgtatgagcttgtccctggaatgcaaattgctacagacattatctgtggctttcctggcgagactgatgaagatttctctgagactgttaacctcgtaaaggaatatcaattccctcaagttcacatttcacagttttacccgaggccagggacacctgctgctaggatgaagaaagtaccaagcaatgaagtgaaaaagcggagtcgtgaactgacttcagttttcgaattattttcaccataccaaggaatggaaggcaaagtagagaggatctggatcaccgagattgcgactgatggtgttcacttagttggacataccaagggatatatccaggttctggtaattgctcctgatagcttgttaggaacgtcagcaaatgtgaagatcacatctgttggacgatggtctgtctttggtgaagtgatagaaggatctgttgtagtaggagaagcaccaaagcaaactagtgccaaactgcagaaagaacacatacagaatcaggtggaggaagctggttgttgtgccactgactcttgtggcacctgtgcatgctccaatgaggcacagcagtgcagtccagaacgatgtgaagacacatctcatgctccggagacctgtggtgatgttactcgtcaggaggcactccagcctacgcttgtgaggagaagcgtagagggaactacgaaaggaagtaaaagcagtgcagcacattcactagggaaggaacagcaggtgaaagtagtaactaggagaggggtaaatatcgacacgattttgtggtgcggtttggccgtcagcttcgccgtaacgatagccctgcttgtaatccttaccagcaagatttcatcgacatcgtccccctag

SEQ ID NO: 7508 - protein, 620 aa, Sorghum bicolor
  misc_feature: Ceres ANNOT ID no. 6079547
  misc_feature (192)..(364): Pfam Id: Radical_SAM Pfam Desc: Radical SAM superfamily
  misc_feature (1)..(619): NCBI GI: 38345374 NCBI Desc: osjnba0088k19.13 [oryza sativa (japonica cultivar-group)]
  misc_feature (4)..(619): NCBI GI: 115458480 NCBI Desc: os04g0434300 [oryza sativa (japonica cultivar-group)]
  misc_feature (1)..(503): NCBI GI: 47122802 NCBI Desc: mgc78779 protein [xenopus laevis]
  misc_feature (1)..(491): NCBI GI: 56205108 NCBI Desc: cdk5 regulatory subunit associated protein 1-like 1 [homo sapiens]
  misc_feature (1)..(476): NCBI GI: 125807910 NCBI Desc: ga19679-pa [drosophila pseudoobscura]
  misc_feature: Down-regulated in root tissues in response to salicylic acid treatment
MEDIEDVLGPADLSGGGAPPGLRLPLAAVAVKPKRRSSRVAQAPPQPEARIPGTQTIYVKTFGCSHNQSDSEYMSGQLSAFGYAITEEPEGADLWLINTCTVKNPSQSAMTTLISKCKNANKPLVVAGCVPQGSQGLKELEGISIIGVQQIDRVVEVVEETLKGHEVRLLSRKTLPSLDLPKVRKNKFIEILPINVGCLGACTYCKTKHARGHLGSYTIDSLVDRVKTVVSEGVREIWLSSEDTGRDISTNLPNLLNAIVAELPVDQSTMLRIGMTNPPFILEHLKEIAAVLCHPCVYSFLHVPVQSGSDAVLTAMNREYTVAEFRKVVDTLYELVPGMQIATDIICGFPGETDEDFSETVNLVKEYQFPQVHISQFYPRPGTPAARMKKVPSNEVKKRSRELTSVFELFSPYQGMEGKVERIWITEIATDGVHLVGHTKGYIQVLVIAPDSLLGTSANVKITSVGRWSVFGEVIEGSVVVGEAPKQTSAKLQKEHIQNQVEEAGCCATDSCGTCACSNEAQQCSPERCEDTSHAPETCGDVTRQEALQPTLVRRSVEGTTKGSKSSAAHSLGKEQQVKVVTRRGVNIDTILWCGLAVSFAVTIALLVILTSKISSTSSP

SEQ ID NO: 7509 - DNA, 963 bp, Sorghum bicolor
  misc_feature: Ceres ANNOT ID no. 6079556
  misc_feature: Encodes the peptide sequence at SEQ ID NO 7510
atggagtcgcttgcctcgcaagcgaggccggcggcggtgctctggctcgccggcttcttccaggccgcgcgcctccaccgcgttgtctccttctgcgctagctcgagggcactatccatcaggattgcacagtgcttcctgctgaacgggcttatcttcctggggagcttgctaaccctgaaatcggtggtcattccaactctattgtggatactacctgaccaatgcaatcaaacggggggacatctttgtgagcacacggcagccatatctatctattcattcttacgctctggccttgttgagattttttatgtgagtgtactttggttttatccactttatgtcttcagcttcatattaagtacgatttggtataatgacattgccaagcatgctttggatgttgtgaaaagtaaacgcctagttttgactcgagccctggatgatcacaacacaactgaaacagaagagcagcctgaaggatttgacagggttgcacttggtattggggaacaggtctattcaatccttcttttaaccattttctttgttgaggtttcagtgattggttacataccttactttggcaaggcaatgaacttcctgctcttgtcattgatgtatgcctactactgcttcgagtacaagtggaacttctttgcagtgagtctccatgagagacttgatttctttgagtcaaattgggcattctttgctggatttggtgctccatgcgtccttccaattttcttcttctctcctcttactagctatggatttttggctatactttacccattgtttgtcatgactgctgcaggcactcaagctgagcaagtaattgatggactgagacctgcacatgaagggaaactacaaagaatacctgtgttctttgtggcaaagcgactgacgacaaaagtgctgcaactgtttccattggcacagaaagaacaatga

SEQ ID NO: 7510 - protein, 320 aa, Sorghum bicolor
  misc_feature: Ceres ANNOT ID no. 6079556
  misc_feature (3)..(321): Pfam Id: EI24 Pfam Desc: Etoposide-induced protein 2.4 (EI24)
  misc_feature (1)..(135): NCBI GI: 115458470 NCBI Desc: os04g0433200 [oryza sativa (japonica cultivar-group)]
  misc_feature (1)..(135): NCBI GI: 116310113 NCBI Desc: h0315e07.10 [oryza sativa (indica cultivar-group)]
  misc_feature (159)..(273): NCBI GI: 12803171 NCBI Desc: etoposide induced 2.4, isoform 1 [homo sapiens]
  misc_feature (159)..(273): NCBI GI: 123980916 NCBI Desc: etoposide induced 2.4 mrna [synthetic construct]
  misc_feature (159)..(273): NCBI GI: 61369590 NCBI Desc: etoposide induced 2.4 [synthetic construct]
MESLASQARPAAVLWLAGFFQAARLHRVVSFCASSRALSIRIAQCFLLNGLIFLGSLLTLKSVVIPTLLWILPDQCNQTGGHLCEHTAAISIYSFLRSGLVEIFYVSVLWFYPLYVFSFILSTIWYNDIAKHALDVVKSKRLVLTRALDDHNTTETEEQPEGFDRVALGIGEQVYSILLLTIFFVEVSVIGYIPYFGKAMNFLLLSLMYAYYCFEYKWNFFAVSLHERLDFFESNWAFFAGFGAPCVLPIFFFSPLTSYGFLAILYPLFVMTAAGTQAEQVIDGLRPAHEGKLQRIPVFFVAKRLTTKVLQLFPLAQKEQ

SEQ ID NO: 7511 - DNA, 1257 bp, Sorghum bicolor
  misc_feature: Ceres ANNOT ID no. 6079558
  misc_feature: Encodes the peptide sequence at SEQ ID NO 7512
atggcaacgagagtcctgccgccggcgctgctctcgctcatactcctgccgctgctcttgctctcagcccgcgacaccgtcgccgcgggcgaggatttcccacgcgacgggcgggtgatcgacctcgacgagagcaacttcgaggcggcgctgggcgccatcgacttcctcttcgtcgacttctacgccccatggtgcggccactgcaagcgccttgcgcccgagttagatgaagctgcaccagtgttggcagggttgagtgagcctattgttgttgccaaagtcaatgctgataaatacaggaaactaggatcaaaatatggagtggatgggttccctactctcatgctttttatccacggcgtcccaattgaatacactggttcgaggaaagctgaccagcttgtgcgcaatctaaagaagtttgtctcgccagatgtttcgatccttgagtcagactctgcgataaagacctttgttgagaatgctggtacaagctttcctatgttccttggttttggggtgaatgactcattgattgctgaatatggaaggaaatacaagaaaagagcgtggtttgctgttgctaaagaattctctgaggacatcatggtagcctatgaatttgataaggttccagcactagttgcaatccatccaaagtataaggaacaaagtttgttctatggcccatttgaagaaaatttcttggaagattttgtacggcaatcccttctccctttggttgttccaatcaatacagagacgctaaaaatgctgaatgatgatcagaggaaagttgttctcacaattttggaggatgattcagatgaaaattctacacagctggtaaagattttgagatctgctgctaatgcaaaccgtgatttggtgtttggatatgttggaatcaagcaatgggacgagtttgtggagacttttgatgtttccaagagctcacagctgccaaagctacttgtgtgggatagaaacgaggagtacgagctagtggatggttcagagagattagaagaaggtgaccaagcatctcaaataagccaattccttgagggatacagagcaggaagaacaacaaagaagaaaatcagcggcccttcttttatgggtttcctgaactctctcgtcagcttgagctcgctgtacatccttatatttgtcattgcccttctggttgtcatggtttactttgctgggcaagatgatactcctcagccaagacgaattcatgaagagtga

SEQ ID NO: 7512 - protein, 418 aa, Sorghum bicolor
  misc_feature: Ceres ANNOT ID no. 6079558
  misc_feature (38)..(142): Pfam Id: Thioredoxin Pfam Desc: Thioredoxin
  misc_feature (1)..(418): NCBI GI: 59861277 NCBI Desc: protein disulfide isomerase [zea mays]
  misc_feature (1)..(418): NCBI GI: 59861279 NCBI Desc: protein disulfide isomerase [zea mays]
  misc_feature (2)..(418): NCBI GI: 116310104 NCBI Desc: h0315e07.1 [oryza sativa (indica cultivar-group)]
  misc_feature (2)..(411): NCBI GI: 115458462 NCBI Desc: os04g0432500 [oryza sativa (japonica cultivar-group)]
  misc_feature (11)..(410): NCBI GI: 8778373 NCBI Desc: f15o4.20 [arabidopsis thaliana]
MATRVLPPALLSLILLPLLLLSARDTVAAGEDFPRDGRVIDLDESNFEAALGAIDFLFVDFYAPWCGHCKRLAPELDEAAPVLAGLSEPIVVAKVNADKYRKLGSKYGVDGFPTLMLFIHGVPIEYTGSRKADQLVRNLKKFVSPDVSILESDSAIKTFVENAGTSFPMFLGFGVNDSLIAEYGRKYKKRAWFAVAKEFSEDIMVAYEFDKVPALVAIHPKYKEQSLFYGPFEENFLEDFVRQSLLPLVVPINTETLKMLNDDQRKVVLTILEDDSDENSTQLVKILRSAANANRDLVFGYVGIKQWDEFVETFDVSKSSQLPKLLVWDRNEEYELVDGSERLEEGDQASQISQFLEGYRAGRTTKKKISGPSFMGFLNSLVSLSSLYILIFVIALLVVMVYFAGQDDTPQPRRIHEE

SEQ ID NO: 7513 - DNA, 891 bp, Sorghum bicolor
  misc_feature: Ceres ANNOT ID no. 6079563
  misc_feature: Encodes the peptide sequence at SEQ ID NO 7514
atggaggccgcggtcgctcacgctccacctgctccggccctgcgccgctcgctcgccctcagacccaccacgcccgccgtccggccggacccaaagccctggcagggggtagtgcgatcggcgaggcgccagtcgaacgccgtcaggtgcgagccgtcccggcgcccggagccgcggctgcgtctgcgcgcggcgcagccgggtggtgctgacgcggcggcggcggcggcggcggccgggaggaggaagcggctggcggtgttcgtgtccggagggggatccaacttccgggcgatccacgaggccgcgctgggcggggccgtgcacggggatgtcgtcgcgcttgtcaccgacaagccaggttgcggcggcgcggagtatgccaggagcaatggcattcctgtgctcgtgtttcccaagtccaagtctgcgcccgaggggatttcggttgctcaactgctggataccctgaggggatacagtgtagactttgttcttcttgctggttacttgaagcttatacccgctgaattggtccaggaatacccaaagtccatattaaatatccatccttctctccttccggcattcggaggcaaaggtttttatggttcaaaggtgcataaagccgttattgcctctggagcaagatactcaggtccaactgtacattttgtggatgagcactatgataccgggaaaacattagcccagagggttgtgcctgtgtttgcggatgacacaccagagttgttggctgcaagagtccttcatgaggagcatcaagtctatgttgaagcagttgctgctttgtgcgaggaccgcgtcgtatggagggaagatggtgtcccacttatcagaagtccgataaatcctgatgtgtacctctaa

SEQ ID NO: 7514 - protein, 296 aa, Sorghum bicolor
  misc_feature: Ceres ANNOT ID no. 6079563
  misc_feature (83)..(268): Pfam Id: Formyl_trans_N Pfam Desc: Formyl transferase
  misc_feature (65)..(296): NCBI GI: 27922945 NCBI Desc: glycinamide ribonucleotide transformylase [vigna unguiculata]
  misc_feature (65)..(292): NCBI GI: 7433568 NCBI Desc: phosphoribosylglycinamide formyltransferase (ec 2.1.2.2) - cowpea
  misc_feature (81)..(295): NCBI GI: 37992753 NCBI Desc: glycinamide ribonucleotide transformylase [solanum tuberosum]
  misc_feature (81)..(295): NCBI GI: 32815066 NCBI Desc: glycinamide ribonucleotide transformylase [glycine max]
  misc_feature (81)..(295): NCBI GI: 32815065 NCBI Desc: glycinamide ribonucleotide transformylase [glycine max]
  misc_feature (65)..(296): SWISSPROT Homolog: EC 2.1.2.2 Phosphoribosylglycinamide formyltransferase, chloroplast precursor
MEAAVAHAPPAPALRRSLALRPTTPAVRPDPKPWQGVVRSARRQSNAVRCEPSRRPEPRLRLRAAQPGGADAAAAAAAAGRRKRLAVFVSGGGSNFRAIHEAALGGAVHGDVVALVTDKPGCGGAEYARSNGIPVLVFPKSKSAPEGISVAQLLDTLRGYSVDFVLLAGYLKLIPAELVQEYPKSILNIHPSLLPAFGGKGFYGSKVHKAVIASGARYSGPTVHFVDEHYDTGKTLAQRVVPVFADDTPELLAARVLHEEHQVYVEAVAALCEDRVVWREDGVPLIRSPINPDVYL

SEQ ID NO: 7515 - DNA, 987 bp, Sorghum bicolor
  misc_feature: Ceres ANNOT ID no. 6079569
  misc_feature: Encodes the peptide sequence at SEQ ID NO 7516
atgtctcctcatgcagatatctctgttgatattcgtcctgacataaactcgtttgatcatttcctaagcatgcgatacattgcaacagatagaccctggctgaaattatatggaataagagttcagcctgtgccaccattcagcagtttgagctacaaacctgatccagcactcattcaccattgcctacctgatgaactaatgctcgagattttcacaagaatgagcccatatactttagggagggctgcatgtgtctgccgcaagtggaaatatactgcacgtaatcctactttgtggcgtgctgcatgcttgaaaacttggcagaggagtggattggaggcaaactacatgatggttcggtcgttgtatgattcctcttggaggagaatgtggctgcagagaccaagaatccgaattgacggtctctatgtgagcaggaacacatatattcatactggagttacagaatggcaattcaagaaaactgtcaatgtggtttgctactaccgttacttgagattttttcctagtgggaagtttctctataagatctccccagataaagttaaagacgctgttaagtgcatgcatttccgggcatcaaaggctgattgtgtatttaaaggcgactacatactgtcagaggatggccagatagaaatggctctcctgtatccaggacatcggtacacgcttgtcaggatgcgccttaggcttagaggaaccacagttggtgcaaataacaggttggatgtactgaagattctaaccactggagtgaatgcaactgaactgcaaaattggaaaggcagcatactagaacttgttgacggctgggaagaggatgagacacatgacccagatgtgcctgctgtttcccacagcaggggtttgtcgccctttgtgtttgttccgtttgaggaggctgatacttcggtgctaaacctccctgtggagaagatggactactacgtccctgggtga

SEQ ID NO: 7516 - protein, 328 aa, Sorghum bicolor
  misc_feature: Ceres ANNOT ID no. 6079569
  misc_feature (58)..(105): Pfam Id: F-box Pfam Desc: F-box domain
  misc_feature (5)..(328): NCBI GI: 116309981 NCBI Desc: osigba0160i14.7 [oryza sativa (indica cultivar-group)]
  misc_feature (5)..(328): NCBI GI: 115458446 NCBI Desc: os04g0431200 [oryza sativa (japonica cultivar-group)]
  misc_feature (5)..(328): NCBI GI: 78498846 NCBI Desc: defense-related f-box protein [oryza sativa (indica cultivar-group)]
  misc_feature (1)..(328): NCBI GI: 92870503 NCBI Desc: cyclin-like f-box [medicago truncatula]
  misc_feature (59)..(217): NCBI GI: 6164737 NCBI Desc: f-box protein fbx9 [homo sapiens]
  misc_feature: The sequence is a functional homolog of SEQ ID NO. 354 in the 11/188,298 US application
MSPHADISVDIRPDINSFDHFLSMRYIATDRPWLKLYGIRVQPVPPFSSLSYKPDPALIHHCLPDELMLEIFTRMSPYTLGRAACVCRKWKYTARNPTLWRAACLKTWQRSGLEANYMMVRSLYDSSWRRMWLQRPRIRIDGLYVSRNTYIHTGVTEWQFKKTVNVVCYYRYLRFFPSGKFLYKISPDKVKDAVKCMHFRASKADCVFKGDYILSEDGQIEMALLYPGHRYTLVRMRLRLRGTTVGANNRLDVLKILTTGVNATELQNWKGSILELVDGWEEDETHDPDVPAVSHSRGLSPFVFVPFEEADTSVLNLPVEKMDYYVPG

SEQ ID NO: 7517 - DNA, 828 bp, Sorghum bicolor
  misc_feature: Ceres ANNOT ID no. 6079570
  misc_feature: Encodes the peptide sequence at SEQ ID NO 7518
atggcggcaaccttctgcgccgggcccgccgcatccgcggtagcaaaccctagctccgccggctgccgacgccagaacctacctcgggctggcgtgctgtctgcctgctggcggcccacccggccgattcccgccttcctctccctccggcgccccaatgccgagctgcggccgctacgcgtggccgccggctccggcgttgacccgaaggttgtcaatggggaagattttcctcccatgaaggacctaattcaactatacaggacagcttttcaacaaggaaatgatgaggttcttggtgaagttgagaaggcaatcactgctgtggaaaaagagaagagtagggtagcttctcagtttgaaagtattacaaccgaaataacttctgggaaggagaagtttattcgcttaaatgctgatctggagaatttccggaaacagactgaaaaggatcgtgcaaagtttacatcaaatatgcgggtgcaagttgttcagagtctgttacctctggttgatagttttgagaaaacgaatttagagaacacaccagagactgagaaggagcaaaagatcagcacaagctatcaaggcatatacaagcagttagttgaaacactaagatatttgggtgtaggagtagtggaaacagttggcaagccatttgatccttcagtccatgaagccatctcacgagaagcatccatgcaattcaaggcagggattgtcatgcatgaagtccgcagagggttccatttgaaggagaggctgctaaggcctgctactgttaaggtctctactggctctggcaaacaaagcgcaagctcataa

SEQ ID NO: 7518 - protein, 275 aa, Sorghum bicolor
  misc_feature: Ceres ANNOT ID no. 6079570
  misc_feature (89)..(266): Pfam Id: GrpE Pfam Desc: GrpE
  misc_feature (1)..(275): NCBI GI: 116309980 NCBI Desc: osigba0160i14.6 [oryza sativa (indica cultivar-group)]
  misc_feature (83)..(271): NCBI GI: 9759048 NCBI Desc: grpe protein [arabidopsis thaliana]
  misc_feature (99)..(275): NCBI GI: 15384277 NCBI Desc: co-chaperone cge1 precursor isoform a [chlamydomonas reinhardtii]
  misc_feature (99)..(275): NCBI GI: 15384279 NCBI Desc: co-chaperone cge1 precursor isoform b [chlamydomonas reinhardtii]
  misc_feature (94)..(275): NCBI GI: 52782942 NCBI Desc: grpe protein (hsp-70 cofactor)
MAATFCAGPAASAVANPSSAGCRRQNLPRAGVLSACWRPTRPIPAFLSLRRPNAELRPLRVAAGSGVDPKVVNGEDFPPMKDLIQLYRTAFQQGNDEVLGEVEKAITAVEKEKSRVASQFESITTEITSGKEKFIRLNADLENFRKQTEKDRAKFTSNMRVQVVQSLLPLVDSFEKTNLENTPETEKEQKISTSYQGIYKQLVETLRYLGVGVVETVGKPFDPSVHEAISREASMQFKAGIVMHEVRRGFHLKERLLRPATVKVSTGSGKQSASS

SEQ ID NO: 7519 - DNA, 576 bp, Sorghum bicolor
  misc_feature: Ceres ANNOT ID no. 6079583
  misc_feature: Encodes the peptide sequence at SEQ ID NO 7520
atggccgccgccgccgtcgccgctcctccctgccccgcgcctccgcgcgggctccgctgcgccaagacggtgccttttccctcctccgccgccgcacccagccgcggaagggtcgtctacggctcctcctacgcccgccggtggcagtgccgccgctgggcccaccggccggacgctgcgacgacgcggatccggcggccaacggcgcgccgcacggcggcactgagggtgacctgcgcctactcccccggcgctgaaagaatcactgcatgctcttggaatgaatatgtgatctgcagtgatgtacctgtgcttattgagttttgggcctcctggtgtggaccttgcaaaatggtcacacggattgtcgatgagatagcacaagaatatgctgggagaataaaatgctacaagcttgacactgacgattacccacaggttgctacggcttacagcatcgataggattccaactgttttactcttcaaggatggagagaaaatacatagtattaccgggacactgccaaaggctgtttatgtgaaagccattgagaaatctatttcagaacaatga

SEQ ID NO: 7520 - protein, 191 aa, Sorghum bicolor
  misc_feature: Ceres ANNOT ID no. 6079583
  misc_feature (84)..(187): Pfam Id: Thioredoxin Pfam Desc: Thioredoxin
  misc_feature (5)..(190): NCBI GI: 116309977 NCBI Desc: osigba0160i14.3 [oryza sativa (indica cultivar-group)]
  misc_feature (88)..(188): NCBI GI: 83776783 NCBI Desc: chloroplast thioredoxin m-type [arachis hypogaea]
  misc_feature (92)..(188): NCBI GI: 1388088 NCBI Desc: thioredoxin m
  misc_feature (92)..(188): NCBI GI: 431957 NCBI Desc: thioredoxin m [pisum sativum]
  misc_feature (64)..(189): NCBI GI: 4138290 NCBI Desc: thioredoxin m [oryza sativa]
MAAAAVAAPPCPAPPRGLRCAKTVPFPSSAAAPSRGRVVYGSSYARRWQCRRWAHRPDAATTRIRRPTARRTAALRVTCAYSPGAERITACSWNEYVICSDVPVLIEFWASWCGPCKMVTRIVDEIAQEYAGRIKCYKLDTDDYPQVATAYSIDRIPTVLLFKDGEKIHSITGTLPKAVYVKAIEKSISEQ

SEQ ID NO: 7521 - DNA, 555 bp, Sorghum bicolor
  misc_feature: Ceres ANNOT ID no. 6079594
  misc_feature: Encodes the peptide sequence at SEQ ID NO 7522
atgatcatccccaagaagaaccgcaatgagatctgcaagtacctcttcaaggagggcgtgctctatgccaagaaggactacaacctggcgaagcacccgcagattgatgtgcccaacctccaggtgatcaagctcatgcagagcttcaagtccaaggagtacgtcagggagaccttctcctggcagtactactactggtacctcaccaacgatggcattgagcacctccgcaactacctgaacctcccgtctgagatcgtgcctgccacgctcaagaagtctgccaggccaccgggccgcccattcggctctggccctcctggtgaccgcccaccaaggggcccaggtcgttttgaaggcgacaggccaaggtttggtgacagggatgggtaccgtggtggtcctcgtggtgctcctggtgactttggtggtgacaagggtggagctcctgctgagttccagccatctttcaggagttctggtggcaggcctgggtttggacgtggtggcggcagtggctttggtgctggcccgacctcttcttccatggagtga

SEQ ID NO: 7522 - protein, 184 aa, Sorghum bicolor
  misc_feature: Ceres ANNOT ID no. 6079594
  misc_feature (3)..(98): Pfam Id: S10_plectin Pfam Desc: Plectin/S10 domain
  misc_feature (1)..(184): NCBI GI: 109940154 NCBI Desc: 40s ribosomal protein s10
  misc_feature (1)..(184): NCBI GI: 116309307 NCBI Desc: b0222c05.3 [oryza sativa (indica cultivar-group)]
  misc_feature (1)..(184): NCBI GI: 12246885 NCBI Desc: ribosomal protein s10 [oryza sativa (japonica cultivar-group)]
  misc_feature (1)..(182): NCBI GI: 81076822 NCBI Desc: 40s ribosomal protein s10-like [solanum tuberosum]
  misc_feature (1)..(182): NCBI GI: 81074037 NCBI Desc: 40s ribosomal protein s10-like [solanum tuberosum]
  misc_feature: Useful for making plants with modulated nitrogen use efficiency
  misc_feature: GREAT-hit functional homolog of the protein sequence given in SEQ ID NO 13175
  misc_feature: Useful for making plants with modulated nitrogen use efficiency
  misc_feature: Functional homolog of the protein sequence given in SEQ ID NO 13175
MIIPKKNRNEICKYLFKEGVLYAKKDYNLAKHPQIDVPNLQVIKLMQSFKSKEYVRETFSWQYYYWYLTNDGIEHLRNYLNLPSEIVPATLKKSARPPGRPFGSGPPGDRPPRGPGRFEGDRPRFGDRDGYRGGPRGAPGDFGGDKGGAPAEFQPSFRSSGGRPGFGRGGGSGFGAGPTSSSME

SEQ ID NO: 7523 - DNA, 2301 bp, Sorghum bicolor
  misc_feature: Ceres ANNOT ID no. 6079608
  misc_feature: Encodes the peptide sequence at SEQ ID NO 7524
atggcgggcatcaaggcgaagctgcagctgcaggagaaggtcccgctcccacgcacggcgtggaagctggccgacctcgccgttctcttccttctcctggccctcctcgctcaccgtgtgtcctcgctgatggtgaccagcggcagcggcgcggcggcggcgtgcacgtggtgctgggtcgccgcgctcatctgcgaggcgtggttcacggtggtgtggctcatcaacatgaacgccaaatggaacccggtccgcttcgatacgcaccctgaacgtctcgccggacgcagcgccgacgagctgccggcggtggacatgttcgtgacgacggcggacccgaagctggagccaccggtggtgacggtgaacacggtgctgtcgctgatggcgctggactaccccgcgggcaagctgacgtgctacgtctccgacgacggctgctcggcggtgacctgctacgcgctgcgcgaggccgccgagttcgccaagctctgggtgccgttctgcaagaagcacggcgtcggggtccgggcccccttcgtgtacttctccggcggcggcacggcggagcgcggtggcgccaccaccgacgacgttgccgagttcatgcgcgcctggacgtccatgaagaacgagtacgaggagttggtccaccggatcgagaacgccgaggaggagtctctagtccggcgcggcgacggcgagttcgccgagttcgtgggtgctgaccgcaggaaccacccgaccataatcaaggtgctgtcggacaatcaggatgctgcaggcgatggaatcccaagcctcatatacgtctcgagggagaagagccccacacagccccaccacttcaaggccggcgccatgaacgtcctgacgagggtgtccggcgtggtgaccaacgctcccatcgtgctaaacgtggactgcgacatgttcgccaacaacccgcaggtggcactccacgccatgtgcctgctcatgggcttcgacgacgacgtccacagcggcttcgtccaggtgccacagaagttctacggcgccctcaaggacgatccttttggcaaccagatgcaggttatgttcgagaaaattggatacggagttgccggacttcaaggcatatattactgtgggacgggttgctttcaccgtaggaaagtcatgtatggcgtgccaccataccacgccaccaccagcagcagcagcatgaaagattcaccatcttacaaggagctacagaacaggttcggcagatcgaatgaactgatcgagtcggcgaggagcatcatctccggggacatgttcaaagcaccaacgactctggtggcagacctaacgagtcgcatcgaagcagcgaaacaagtttctgcctgccgctacgaaactggcacaagctggggccaggaggttggctgggtctacgggtccatgaccgaggatgtcctgaccgggcagcgtgacccgccagcgttcctcggcggcgcgcccaccggcggaccagccagcctcacccagtacaagaggtgggcaacaggcctgctggagatactcctcagccgccataacccatgccttgtctctgcgttcaagcgcctcgatttccggcagtgcgtcgcctacctggtcatcgacgtgtggcccgtcagggcaccttttgagctgtgctacgccctgctaggaccttactgcctcatcgcaaaccactccttcctgccaaaggcgtcagagccgagtttcctcatcccactggccctcttcctgggctacaacgcgtacaacctgggcgagtacaaggactgccggctctcggcgcgtgcctggtggaacaaccacaggatgcagcggatcgtgtcgtcctccgcctggctgctcgccttcctcaccgtcgtcctcaagatgctgggcctctcggagacggtgttcgaggtgacacgcaaagagcagcagagctcgtccgacggaggcgccggcgacggcgcggacccagcagggcggttcacctttgactcgtcgccagtgttcgtcccaccgacagcgctcacggtgctgagcatcgtcgccatcgccgtcggggcgtggagggcggtggtcgccggtgcggtggaaggccgcgtgcccaccaccggtggtggcccgggcgtcggggagctcgcgtgctgcgtctggctggtgctctgcttctggccgttcgtgagggggctcgtcgccgtcggcaggggaagctacggcatcccctggagcgtcaggctcaaggcggctctgctcgtcgccgcgttcgtgcacttgtccacacgcaactaa

SEQ ID NO: 7524 - protein, 766 aa, Sorghum bicolor
  misc_feature: Ceres ANNOT ID no. 6079608
  misc_feature (9)..(767): Pfam Id: Cellulose_synt Pfam Desc: Cellulose synthase
  misc_feature (2)..(766): NCBI GI: 34419212 NCBI Desc: tpa: cellulose synthase-like h1 [oryza sativa]
  misc_feature (11)..(766): NCBI GI: 17385973 NCBI Desc: cslh1 [oryza sativa]
  misc_feature (20)..(766): NCBI GI: 116309324 NCBI Desc: osigba0093l02.6 [oryza sativa (indica cultivar-group)]
  misc_feature (290)..(766): NCBI GI: 34419214 NCBI Desc: tpa: cellulose synthase-like h2 [oryza sativa (indica cultivar-group)]
  misc_feature (290)..(766): NCBI GI: 68611262 NCBI Desc: osjnba0042l16.13 [oryza sativa (japonica cultivar-group)]
  misc_feature: Useful for making plants with altered cell wall content and/or composition
  misc_feature: GREAT-hit functional homolog of the protein sequence encoded by LOCUS at2g32530
  misc_feature: GREAT-hit functional homolog of the protein sequence encoded by LOCUS at2g32540
  misc_feature: Functional homolog of the protein sequence encoded by LOCUS at2g32610
  misc_feature: Functional homolog of the protein sequence encoded by LOCUS at2g32620
MAGIKAKLQLQEKVPLPRTAWKLADLAVLFLLLALLAHRVSSLMVTSGSGAAAACTWCWVAALICEAWFTVVWLINMNAKWNPVRFDTHPERLAGRSADELPAVDMFVTTADPKLEPPVVTVNTVLSLMALDYPAGKLTCYVSDDGCSAVTCYALREAAEFAKLWVPFCKKHGVGVRAPFVYFSGGGTAERGGATTDDVAEFMRAWTSMKNEYEELVHRIENAEEESLVRRGDGEFAEFVGADRRNHPTIIKVLSDNQDAAGDGIPSLIYVSREKSPTQPHHFKAGAMNVLTRVSGVVTNAPIVLNVDCDMFANNPQVALHAMCLLMGFDDDVHSGFVQVPQKFYGALKDDPFGNQMQVMFEKIGYGVAGLQGIYYCGTGCFHRRKVMYGVPPYHATTSSSSMKDSPSYKELQNRFGRSNELIESARSIISGDMFKAPTTLVADLTSRIEAAKQVSACRYETGTSWGQEVGWVYGSMTEDVLTGQRDPPAFLGGAPTGGPASLTQYKRWATGLLEILLSRHNPCLVSAFKRLDFRQCVAYLVIDVWPVRAPFELCYALLGPYCLIANHSFLPKASEPSFLIPLALFLGYNAYNLGEYKDCRLSARAWWNNHRMQRIVSSSAWLLAFLTVVLKMLGLSETVFEVTRKEQQSSSDGGAGDGADPAGRFTFDSSPVFVPPTALTVLSIVAIAVGAWRAVVAGAVEGRVPTTGGGPGVGELACCVWLVLCFWPFVRGLVAVGRGSYGIPWSVRLKAALLVAAFVHLSTRN

SEQ ID NO: 7525 - DNA, 1611 bp, Sorghum bicolor
  misc_feature: Ceres ANNOT ID no. 6079609
  misc_feature: Encodes the peptide sequence at SEQ ID NO 7526
atggggaagtttatgcatgacaatcgactgctttctccgagcgaagtaaatagacgtcagtatagtcttgcggcagttgctgtcggtttgggactaggagttgccgggttatgcaaggcattgcatagtggtttgtccataccatgggtttctccaaggaatttatttttggggtcagggagagtatactatgttggaggtctgcgaaatcttggcaacaattgctttcttaatgtcatcctccaggcacttgccagctgtggtggttttatttcctttctagataatttgcttgcaactgatggcttgctacctgaagaaaaggctgtaagaatgcctcttcttcttgctctaagttctctcttggaagacttgagcatagttcgagatgaaagaactgtgttgaatccacatggagtaatgcatgctttgagtttctatgttagtcacttcaatttgaccagacagcaggacgcttcggaagcttttctccatcttctgatctcactgagggacgaattttcccattgttatgtaccacataggagttctctggcagacatcaccctttctcactccaaagtatacaagcaaagggaaggtaacctgcctgaatgcaagcgctggaaacaaaatctatttggtcccttcgatgggacaattggcagcatattgtcttgcagaaactgttcatctgtgctgtcattggactttgagaatttccactgcttgcctctttcaccagtgcttaatacaaatggggatattaccagtgggtgtagcttggtggattgcctaaagtacttcactgtggtggagcaccttgacaattatcgctgtgatcggtgttggcacatcattgctgccaaatatctatctcttaaatcagaagttgatgaggaaaaggttagcaagcttcacacctgtgtcgactatggcacttgcagttgcaggaatatgttccccctggagaaaatgccatgttcaccatcttcacgagcaacaaagcagttaattatcagccagtgcccaaagattctatgcattcatttgctacgtgcttcagtcggtcttgatggtgagcccatcaaacatcagggacatatttctttccctttacttctcaatctgtccccgtttgcgggaggtgcatcgggcgctggacctttagcaatgaatgtgcaaagagatggccagcaagctcttcatctatatcgacaactgaatatgcagatgagcttaaatgtcttaccgactggagggtacttatcaagtcagccatgtaaggaagaagcaacaaatgatagtggccgctcaattcacatggcaaatgttgatgtgtctagtagttcatcatcatcatcaccgcagccatcaatgagcaagttatatggtctctcggctgtcgtggagcattacgggaaatgtggaggagggcattatgcagtttacaggagagttgcatcaaatcctgaccctgatgatccagggaaaccacttgcaggccttggcaggcggtggttttacatctcggatggccaggtatcagaagtttcagaggaggatgttttgtgtgcggaggccaccctcctcttctatgaaagattgtag

SEQ ID NO: 7526 - protein, 536 aa, Sorghum bicolor
  misc_feature: Ceres ANNOT ID no. 6079609
  misc_feature (63)..(533): Pfam Id: UCH Pfam Desc: Ubiquitin carboxyl-terminal hydrolase
  misc_feature (1)..(536): NCBI GI: 116309321 NCBI Desc: osigba0093l02.3 [oryza sativa (indica cultivar-group)]
  misc_feature (222)..(536): NCBI GI: 68611259 NCBI Desc: osjnba0042l16.10 [oryza sativa (japonica cultivar-group)]
  misc_feature (114)..(441): NCBI GI: 115458416 NCBI Desc: os04g0429200 [oryza sativa (japonica cultivar-group)]
  misc_feature (234)..(380): NCBI GI: 140071358 NCBI Desc: peptidase c19, ubiquitin carboxyl-terminal hydrolase 2 [medicago truncatula]
  misc_feature (22)..(238): NCBI GI: 92899297 NCBI Desc: peptidase c19, ubiquitin carboxyl-terminal hydrolase 2 [medicago truncatula]
MGKFMHDNRLLSPSEVNRRQYSLAAVAVGLGLGVAGLCKALHSGLSIPWVSPRNLFLGSGRVYYVGGLRNLGNNCFLNVILQALASCGGFISFLDNLLATDGLLPEEKAVRMPLLLALSSLLEDLSIVRDERTVLNPHGVMHALSFYVSHFNLTRQQDASEAFLHLLISLRDEFSHCYVPHRSSLADITLSHSKVYKQREGNLPECKRWKQNLFGPFDGTIGSILSCRNCSSVLSLDFENFHCLPLSPVLNTNGDITSGCSLVDCLKYFTVVEHLDNYRCDRCWHIIAAKYLSLKSEVDEEKVSKLHTCVDYGTCSCRNMFPLEKMPCSPSSRATKQLIISQCPKILCIHLLRASVGLDGEPIKHQGHISFPLLLNLSPFAGGASGAGPLAMNVQRDGQQALHLYRQLNMQMSLNVLPTGGYLSSQPCKEEATNDSGRSIHMANVDVSSSSSSSSPQPSMSKLYGLSAVVEHYGKCGGGHYAVYRRVASNPDPDDPGKPLAGLGRRWFYISDGQVSEVSEEDVLCAEATLLFYERL

SEQ ID NO: 7527 - DNA, 1527 bp, Sorghum bicolor
  misc_feature: Ceres ANNOT ID no. 6079616
  misc_feature: Encodes the peptide sequence at SEQ ID NO 7528
atggccgctctcgcctccgccgcccgctcgaggcgccggctcctcccctacctcaaccgcctcctccacacctcctccaccacccctgtctccccgtcgccctccaccagccgcttcctccgccacgcctcgccggtgccccgcacccctgaccactcccctcacctccggttccccgccgcgcgcgtctccacgctcccctcgggcctccgcgtcgtcacgcaggcctacccggccgccacacggatggcctccgtcggcgtctgggtcgatgcggggagccgcttcgagctccctggaaccaacggaaccgcgcacttcctcgagcacatggccttcaagggcagccggcgccggcccaacgcgcaggcgctcgaggtggagatcgaggacatgggcgcgcgcctcaacgcgtatacctcccgcgagcagaccaccttcttcgctgacgtgcaggcgcgccacgttccggcggcgctcgacgtcctcagcgacatcctacagcacccgcgattccccgaaaaggccatccagcgggagcgcggcgtcatcctccgtgagatggaggaggtgcaaggtatgatggaagaggtgatatttgatcacttgcatgcagcagcattccaaggccatccactaggggacacaatattaggtcctgaagagaatattaggtccatatctaagaaagacttggagcagtatatctcaactcactatacctgtcctcgaatggttgtatctgctgctggaagtgtcagtcacgatgagtttgttgatcaagtgaaagaattattcacagaattttccactgatccaactactgctgatcagcttgtcgaggcgaacccagctgtttttactggatctgaggttcgtgtagaaaatgcagagttgcctctagcacatgttgcaatagctttcaaaggttcatcatggactgatcctagctccattccccttatggtgatccaaagcatattgggatcctggaacaggagcattggggttgggaactgctcagggtcttctttagctcgtggtatcagcaatgctaatttagctgagagcctcatggcgttcaatactaactatcgggacacaggaatatttggcatttataccattgctccgcctgacaccctgcatgacttgtcacggctaataatggcggagtttagaagacttgcatcccaagtgtcagaaacagaggttgctcgtgcccgcaatcagctgaaatctgctctgttacttcacattgatggatccaccgcagtttctgagaataatggtcgccagatgctaacttatgggcgagttatgccattcctagagctttttgcgcgcattgatgctgttgactgtgctacagtaatggaaactgccaaggagtacataattgataaggatgttgctctggctggagtgggacagctcacgaatttgccagagcttagttggtttcgctcggaaacctgttctgatgatgattttactcgaagaatattctttgggaatgcaaaatag

SEQ ID NO: 7528 - protein, 508 aa, Sorghum bicolor
  misc_feature: Ceres ANNOT ID no. 6079616
  misc_feature (71)..(221): Pfam Id: Peptidase_M16 Pfam Desc: Insulinase (Peptidase family M16)
  misc_feature (226)..(412): Pfam Id: Peptidase_M16_C Pfam Desc: Peptidase M16 inactive domain
  misc_feature (176)..(508): NCBI GI: 115439529 NCBI Desc: os01g0711100 [oryza sativa (japonica cultivar-group)]
  misc_feature (31)..(492): NCBI GI: 12802327 NCBI Desc: mitochondrial processing peptidase beta subunit [cucumis melo]
  misc_feature (37)..(492): NCBI GI: 13959067 NCBI Desc: mitochondrial processing peptidase [avicennia marina]
  misc_feature (37)..(490): NCBI GI: 82621176 NCBI Desc: mitochondrial processing peptidase-like [solanum tuberosum]
  misc_feature (37)..(492): NCBI GI: 587564 NCBI Desc: mitochondrial processing peptidase [solanum tuberosum]
MAALASAARSRRRLLPYLNRLLHTSSTTPVSPSPSTSRFLRHASPVPRTPDHSPHLRFPAARVSTLPSGLRVVTQAYPAATRMASVGVWVDAGSRFELPGTNGTAHFLEHMAFKGSRRRPNAQALEVEIEDMGARLNAYTSREQTTFFADVQARHVPAALDVLSDILQHPRFPEKAIQRERGVILREMEEVQGMMEEVIFDHLHAAAFQGHPLGDTILGPEENIRSISKKDLEQYISTHYTCPRMVVSAAGSVSHDEFVDQVKELFTEFSTDPTTADQLVEANPAVFTGSEVRVENAELPLAHVAIAFKGSSWTDPSSIPLMVIQSILGSWNRSIGVGNCSGSSLARGISNANLAESLMAFNTNYRDTGIFGIYTIAPPDTLHDLSRLIMAEFRRLASQVSETEVARARNQLKSALLLHIDGSTAVSENNGRQMLTYGRVMPFLELFARIDAVDCATVMETAKEYIIDKDVALAGVGQLTNLPELSWFRSETCSDDDFTRRIFFGNAK

SEQ ID NO: 7529 - DNA, 930 bp, Sorghum bicolor
  misc_feature: Ceres ANNOT ID no. 6079621
  misc_feature: Encodes the peptide sequence at SEQ ID NO 7530
atggccaccatcgcgccacggtcgcatctcctcctcctcggcctgacaaggccgcagcagccgacagcgcttcgtgcctgcgccgccttctcccgctcgcgcggcgcgccagtcccaccgcgggccgcgcagccgcggcgcgtcttcctcggcctcggcgccaccttcatcgaccaggtcacccgcatggcctccggcggcacctcgtcccgctctttcgttgccggagcgcggccgaggcagggggtttccccagtcgagcagattctgaagaatgtggagtggcccgacgagttccctttcaagcctgaggacttcagccgtttcgacgaatcatcagatactctgttctactcagttccacgttttgtcactcacattgatgaccaagcaatccgagctctcacagagtactactctgaagttcttcctccaattaatactcctggggcgaccattctcgacatgtgcagcagctgggtgagccattatcctcccggttacaaacaggagaagatcgtggggatgggtatgaatgaagatgaactgaaaaagaactcggtattaactgagtatgttgtgcaagacctcaatgtgaacccaaagcttcctttcgaagataacactttcgatgttatcaccaatgtggttagtgtagattacctgacaaaaccaatagatgtttttaaggagatgcgacgaatactcaagccaagcggccttgctataatgagcttttcaaatcggtgcttttggacaaaagctatatctatatggacatcaactggtgatgtcgatcatgcctggatagttggcgcttacttccattatgctggaggttttgaacctcctcaggcagttgatatatctcctaatccaggacgaactgacccaatgtatgctgtatgctcaagaaagaaaatagggtaa

SEQ ID NO: 7530 - protein, 309 aa, Sorghum bicolor
  misc_feature: Ceres ANNOT ID no. 6079621
  misc_feature (154)..(244): Pfam Id: Methyltransf_11 Pfam Desc: Methyltransferase domain
  misc_feature (1)..(308): NCBI GI: 20146336 NCBI Desc: b1142c05.17 [oryza sativa (japonica cultivar-group)]
  misc_feature (65)..(306): NCBI GI: 21464553 NCBI Desc: at4g29590/t16l4_100 [arabidopsis thaliana]
  misc_feature (103)..(308): NCBI GI: 118047690 NCBI Desc: methyltransferase type 11 [chloroflexus aggregans dsm 9485]
  misc_feature (153)..(308): NCBI GI: 32394624 NCBI Desc: methyltrasferase [griffithsia japonica]
  misc_feature (102)..(302): NCBI GI: 23129867 NCBI Desc: cog0500: sam-dependent methyltransferases [nostoc punctiforme pcc 73102]
MATIAPRSHLLLLGLTRPQQPTALRACAAFSRSRGAPVPPRAAQPRRVFLGLGATFIDQVTRMASGGTSSRSFVAGARPRQGVSPVEQILKNVEWPDEFPFKPEDFSRFDESSDTLFYSVPRFVTHIDDQAIRALTEYYSEVLPPINTPGATILDMCSSWVSHYPPGYKQEKIVGMGMNEDELKKNSVLTEYVVQDLNVNPKLPFEDNTFDVITNVVSVDYLTKPIDVFKEMRRILKPSGLAIMSFSNRCFWTKAISIWTSTGDVDHAWIVGAYFHYAGGFEPPQAVDISPNPGRTDPMYAVCSRKKIG

SEQ ID NO: 7531 - DNA, 951 bp, Sorghum bicolor
  misc_feature: Ceres ANNOT ID no. 6079623
  misc_feature: Encodes the peptide sequence at SEQ ID NO 7532
atgggggaggagcaggcggcgccaaagccggcggaggccgcggccgcggcgttggagctgacggggttcgtcatgagcgcggaggatgccgagcgccgcgccgctgccgccggagtggcgaccgtgcaggacctgctgccgcttctgatcccgtccgcgaggaagcgcgcgcaagtcccgatctcggacttccaagtgggcgccgtggggctgggcgccagcggccgcgtctacgtcggcgtcaacctcgagttccgcggcgtcccgctgtgccactccgtccacgcggagcagttcctcgtggccaacgccgccgccgcgggggagtccgcgctgcgcgccgtcgccgtctcccacatgccctgcggccactgccgccagttcctccaggagatccgcggcgcggcgggcatccagatcctcgtgaccagcgacgccgagcagggccgcgcgcccgagtggcgcacggtggcgtccctcctcctccgtccctttgggccccacgatcttctcgacgagaatgtgcccctcgtcctcgaggcgcacgacaacgccctgggcgatcccgtcgtcgccgcggccgccaatggcttcgcccccggcgacctggacgcgcgcctcagggacgccgcggaggcggccgcgcgggcggcgcacgcgccgtacagccagtgtccgtcgggcttcgcggtggcagacggtgacgggaggatctacgccgggggctgcctggagtccgccgcctacaacccgacgctgggccccgtccaggcggccatcatcgcgatggtggcagccggaggcggacccgccggggacgtggtcgcggcggcgctcgtggagaaggagcaggcggcggtggcgcaggaggcgacggccaggatcttccttgatgccatggccccacacgccagcttccacgtctacaagtacaggccgtccgatgcttga

SEQ ID NO: 7532 - protein, 316 aa, Sorghum bicolor
  misc_feature: Ceres ANNOT ID no. 6079623
  misc_feature (157)..(296): Pfam Id: dCMP_cyt_deam_2 Pfam Desc: Cytidine and deoxycytidylate deaminase zinc-binding region
  misc_feature (40)..(142): Pfam Id: dCMP_cyt_deam_1 Pfam Desc: Cytidine and deoxycytidylate deaminase zinc-binding region
  misc_feature (23)..(309): NCBI GI: 92891009 NCBI Desc: cmp/dcmp deaminase, zinc-binding [medicago truncatula]
  misc_feature (18)..(309): NCBI GI: 92869610 NCBI Desc: cmp/dcmp deaminase, zinc-binding [medicago truncatula]
  misc_feature (18)..(301): NCBI GI: 6090831 NCBI Desc: cytidine deaminase 1 [arabidopsis thaliana]
  misc_feature (18)..(309): NCBI GI: 4836452 NCBI Desc: cytidine deaminase [arabidopsis thaliana]
  misc_feature (34)..(310): NCBI GI: 3818575 NCBI Desc: cytidine deaminase 6 [arabidopsis thaliana]
  misc_feature: The sequence is a functional homolog of SEQ ID NO. 280 in the 11/188,298 US application
MGEEQAAPKPAEAAAAALELTGFVMSAEDAERRAAAAGVATVQDLLPLLIPSARKRAQVPISDFQVGAVGLGASGRVYVGVNLEFRGVPLCHSVHAEQFLVANAAAAGESALRAVAVSHMPCGHCRQFLQEIRGAAGIQILVTSDAEQGRAPEWRTVASLLLRPFGPHDLLDENVPLVLEAHDNALGDPVVAAAANGFAPGDLDARLRDAAEAAARAAHAPYSQCPSGFAVADGDGRIYAGGCLESAAYNPTLGPVQAAIIAMVAAGGGPAGDVVAAALVEKEQAAVAQEATARIFLDAMAPHASFHVYKYRPSDA

SEQ ID NO: 7533 - DNA, 1134 bp, Sorghum bicolor
  misc_feature: Ceres ANNOT ID no. 6079629
  misc_feature: Encodes the peptide sequence at SEQ ID NO 7534
atggcgacggctcgcgccggcgacgacgcggccgcgtgcccggtggcggcggcgggacgcgccggtgttggggccgagcctgacggtagtggccgcgccggcggcaggcggaggagcgtgtacgacctcagcgagtgcgtgccgttgtggggtcgcgccactacgcgcggccgccgcaacgcgatggaggacgcgtgcgccgccgtgccgcccttcgccgacgtgccggtgcggatgcttgcgagcgcgcggaagctggacgcgctcgggcgggccggcgtcgacgacgcctccgccgccatgcacctgttcggcgtgtacgacgggcacggcggttccgaggtggccaactactgcggggacaggatccacgtcgtgctgagggaggcgctgggcagagccgcggccgcgagggggctatcgggggagctggggggcatccaggagctctgggagaaggcgttttgcgagtgtttccagagggtggatgacgaggtgtccggggaagcaagcaggttcatgctcgccggtggcgtcagcgaggcccgatacgaaccagtggccgctcacgacgtcggctccaccgccgttgtggcgcttgtctgctcttcccatgtcatagttgccaactgcggagattcacgcgtgcccgacaggcaagacgagcgcgcaaggattgaggcggcaggaggacatgtcgtcaactggcatggtcatcgagtcgaaggcgtacttgctatgtcacggtcaatcggggacagatacataaaaccatttatcattccaaagccagaagtcagagtcgttcctcgcacaaatggcgacgactgcctgattctagctagcgatgggctgtgggatgtcatctcaaatgaggacgcatgcaaagctgctcgcctaaagatcctccggtggcacgagaaaaatgacggcacatgtttcagtgaaggtggtgaaccgacaataagcgaccctgcttcacaagcagccgcggcatatcttgtgaggctagctctgaggaaagggagcaaggacaatatcaccgtcatcgtgatcgacctgaaacgacggaagatgatcaaagataaaacggcgcaagatggtcaaagatactcgtccgaattccgagcatga

SEQ ID NO: 7534 - protein, 377 aa, Sorghum bicolor
  misc_feature: Ceres ANNOT ID no. 6079629
  misc_feature (48)..(347): Pfam Id: PP2C Pfam Desc: Protein phosphatase 2C
  misc_feature (31)..(364): NCBI GI: 144225779 NCBI Desc: abscisic insensitive 1b [populus tremula]
  misc_feature (31)..(364): NCBI GI: 144225745 NCBI Desc: abscisic insensitive 1b [populus tremula]
  misc_feature (31)..(364): NCBI GI: 144225727 NCBI Desc: abscisic insensitive 1b [populus tremula]
  misc_feature (31)..(364): NCBI GI: 144225749 NCBI Desc: abscisic insensitive 1b [populus tremula]
  misc_feature (31)..(364): NCBI GI: 144225757 NCBI Desc: abscisic insensitive 1b [populus tremula]
  misc_feature: The sequence is a functional homolog of SEQ ID NO. 386 in the 11/188,298 US application
  misc_feature: The sequence is a functional homolog of SEQ ID NO. 363 in the 11/188,298 US application
  misc_feature: The sequence is a functional homolog of SEQ ID NO. 448 in the 11/188,298 US application
  misc_feature: The sequence is a functional homolog of SEQ ID NO. 406 in the 11/188,298 US application
MATARAGDDAAACPVAAAGRAGVGAEPDGSGRAGGRRRSVYDLSECVPLWGRATTRGRRNAMEDACAAVPPFADVPVRMLASARKLDALGRAGVDDASAAMHLFGVYDGHGGSEVANYCGDRIHVVLREALGRAAAARGLSGELGGIQELWEKAFCECFQRVDDEVSGEASRFMLAGGVSEARYEPVAAHDVGSTAVVALVCSSHVIVANCGDSRVPDRQDERARIEAAGGHVVNWHGHRVEGVLAMSRSIGDRYIKPFIIPKPEVRVVPRTNGDDCLILASDGLWDVISNEDACKAARLKILRWHEKNDGTCFSEGGEPTISDPASQAAAAYLVRLALRKGSKDNITVIVIDLKRRKMIKDKTAQDGQRYSSEFRA

SEQ ID NO: 7535 - DNA, 1197 bp, Sorghum bicolor
  misc_feature: Ceres ANNOT ID no. 6079630
  misc_feature: Encodes the peptide sequence at SEQ ID NO 7536
atggcgtcggaggacgaagcgaacgccgcggcggcggtggcggaggatgccgaggcggcagagggaaggaactggcggcggaaggggaagcacgacaagcccaagccgtgggacgaggaccccaacatcgaccgctggaagatcgagaagttcgaccctgcctggaacgagggcggcatgctcgaagtcagctccttctccaccctctttccgcagtaccgagagaagtacctgcaggaggcgtggccgctcgtgaagggcgcattgaaggagtacgggatctcgtgcgagctcaatttggtggagggatccatgactgtttcgaccaccaggaagacaagggaccccttcattattgtcaaggccagagaactgattaagctattgtccaggagcgtccctgcacctcaggcaatcaaaattcttgacgatgagatgaactgtgatattattaagattggtggtcttgtgagaaataaggaacggtttgttaaaaggagggaacggcttttaggccctaacttgtctacactcaaggctattgagattttgactggctgctacatcttagtgcagggaaatactgttgcagccatgggaaactataggggaaggggactgaaacaagtgagaaggattgtagaggattgcatgaagaatgtaaagcatccagtgtaccacatcaaggaactactaatcaaacgtgagctagcaaaaaatcctgctctagccactgaaagctgggatagatttctcccaaagttcaagaagaagaatgtcaagcagaagaagcctcaaactaaggagaagaaaccatacacaccctttccaccgcctcaacagcctagcaagattgatcttgaacttgagaatggtgagtatttcatgagtgacaaaaagaaatcagcaaagaaatggcaagagaagctggagaagcaatctgggagagctgaagagaacaaaagaaagagagaggctgcatttgttcctccaaaggagaacactgcaggtccatctgaatctgacaagaatgccagtgacaacagtgagatagctgatatagcaaagtcattaaagaaaaaggcaaaggaatttagaaagaatgaggcccaggagagtgttatagctgaatcatatctcgcaagtaatgatgaattgcggcaaaaaaagaaaaagaaaccaactaagtccaagtag

SEQ ID NO: 7536 - protein, 398 aa, Sorghum bicolor
  misc_feature: Ceres ANNOT ID no. 6079630
  misc_feature (13)..(396): NCBI GI: 21592614 NCBI Desc: rev interacting protein mis3-like [arabidopsis thaliana]
  misc_feature (31)..(374): NCBI GI: 115384518 NCBI Desc: ribosomal rna assembly protein mis3 [aspergillus terreus nih2624]
  misc_feature (30)..(335): NCBI GI: 3738208 NCBI Desc: spbc25b2.05 [schizosaccharomyces pombe]
  misc_feature (30)..(335): NCBI GI: 19112865 NCBI Desc: strong similarity to yeast cell division and spore germination protein krr1p [schizosaccharomyces pombe]
  misc_feature (32)..(361): NCBI GI: 44985404 NCBI Desc: afr744wp [eremothecium gossypii]
  misc_feature: The plant flowers significantly late compared to wild-type.
  misc_feature: The plant is abnormally small.
  misc_feature: The plant produces a reduced number of seeds.
  misc_feature: Useful for biocontainment applications
  misc_feature: Useful for making plants with modulated biomass
  misc_feature: Useful for making plants with modulated flowering time
  misc_feature: GREAT-hit functional homolog of the protein sequence given in SEQ ID NO 13066
  misc_feature: Useful for biocontainment applications
  misc_feature: Useful for making plants with modulated biomass
  misc_feature: Useful for making plants with modulated flowering time
  misc_feature: Functional homolog of the protein sequence given in SEQ ID NO 13066
MASEDEANAAAAVAEDAEAAEGRNWRRKGKHDKPKPWDEDPNIDRWKIEKFDPAWNEGGMLEVSSFSTLFPQYREKYLQEAWPLVKGALKEYGISCELNLVEGSMTVSTTRKTRDPFIIVKARELIKLLSRSVPAPQAIKILDDEMNCDIIKIGGLVRNKERFVKRRERLLGPNLSTLKAIEILTGCYILVQGNTVAAMGNYRGRGLKQVRRIVEDCMKNVKHPVYHIKELLIKRELAKNPALATESWDRFLPKFKKKNVKQKKPQTKEKKPYTPFPPPQQPSKIDLELENGEYFMSDKKKSAKKWQEKLEKQSGRAEENKRKREAAFVPPKENTAGPSESDKNASDNSEIADIAKSLKKKAKEFRKNEAQESVIAESYLASNDELRQKKKKKPTKSK

SEQ ID NO: 7537 - DNA, 834 bp, Sorghum bicolor
  misc_feature: Ceres ANNOT ID no. 6079647
  misc_feature: Encodes the peptide sequence at SEQ ID NO 7538
atgggtccaggcctctactccgacatcggcaagaaggccagggatctcctgagcaaggacttccatacggaccagaagtttatcctcactacctacagctccaatggaaccgtgataacagcttcgagcacaaagaaaaatgagtccatctttagtgagatccaggcccagctgaagcagaagaatgtcacggtggatgtgaaagcaaattcagactctctgctcttaactacagtcacagttgaggaacttggggtaccaggcttgaaaaagacaatgaccattccttttccacatcgaggctttgggaagtttgaaatccagtacttgcatgattatgctggtatcagcgccagtgctggcatgaacgcaaaacctttggttaatctttctgctgtatttggcaacaaagctattgctgccggtgctgatgttgcatatgatactgctactcgggatttcaccaagtacaatgctgggttgagtttcaccaatgcagatctcattgctgctgtgaccttgaacaacaaaggggagagcctcactgcgtcatactaccacattgtgaacacagagaagaacacagctgttggtgcggaggtgacccacaacttctcaaccaaggggagcacagtcacctttgggacgcagcacgccctggaccctaccaccactgtgaaggcgcgctacagcagcaatggaatggccagcgccctcatccagcacgagtggagacccaagtcattcttcaccctatccaccgaggttgacatcgacgcgtctggtgtcaagaagtccccgaaggttgggctgtcactggttctcaagccctga

SEQ ID NO: 7538 - protein, 277 aa, Sorghum bicolor
  misc_feature: Ceres ANNOT ID no. 6079647
  misc_feature (2)..(270): Pfam Id: Porin_3 Pfam Desc: Eukaryotic porin
  misc_feature (2)..(277): NCBI GI: 5929932 NCBI Desc: voltage-dependent anion channel protein 2 [zea mays]
  misc_feature (2)..(277): NCBI GI: 18076158 NCBI Desc: voltage-dependent anion channel [oryza sativa (japonica cultivar-group)]
  misc_feature (1)..(277): NCBI GI: 7339529 NCBI Desc: voltage-dependent anion channel [oryza sativa]
  misc_feature (1)..(277): NCBI GI: 48716662 NCBI Desc: voltage-dependent anion channel [oryza sativa (japonica cultivar-group)]
  misc_feature (1)..(277): NCBI GI: 5929928 NCBI Desc: voltage-dependent anion channel protein 1a [zea mays]
  misc_feature: Useful for making plants with modulated drought sensitivity
  misc_feature: Functional homolog of the protein sequence given in SEQ ID NO 13169
  misc_feature: Useful for making plants with modulated drought sensitivity
  misc_feature: Functional homolog of the protein sequence given in SEQ ID NO 13169
MGPGLYSDIGKKARDLLSKDFHTDQKFILTTYSSNGTVITASSTKKNESIFSEIQAQLKQKNVTVDVKANSDSLLLTTVTVEELGVPGLKKTMTIPFPHRGFGKFEIQYLHDYAGISASAGMNAKPLVNLSAVFGNKAIAAGADVAYDTATRDFTKYNAGLSFTNADLIAAVTLNNKGESLTASYYHIVNTEKNTAVGAEVTHNFSTKGSTVTFGTQHALDPTTTVKARYSSNGMASALIQHEWRPKSFFTLSTEVDIDASGVKKSPKVGLSLVLKP

SEQ ID NO: 7539 - DNA, 1110 bp, Sorghum bicolor
  misc_feature: Ceres ANNOT ID no. 6079659
  misc_feature: Encodes the peptide sequence at SEQ ID NO 7540
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
atggtggcgatcgagaacaaccagagccaggtccaagtggcggtggcggcggaggcggtgccggtgccggtgccggggccgcggatccccagggaggcgcggagcctgctgcacgagctggcggcggcgtgggcggacgtggcggactgccgcgcgctggaggtcgtgccgctcaagggtgccatgaccaacgaggtctaccaggtgcgctggctcaccggccctgccgctgccggcgagaaggaggagcctaggagggagagggaggtgaggaaggtgctcgtgcggatttacggcgacggcgtcgaccttttcttcgaccgcgaggacgaggtgcgcaccttcgagtgcatgtcccgccatggccagggtccccgcctcctcggccgcttccccaacggccgcgtcgaggagttcatccacgcaaggacattgtcagctgccgaccttcgtgatccggaaatttcagctcttgtggcgtctaaactgagagaattccacaaccttgacatgcctggtcccaaatctgtgctcatttgggacagactgaggaactggctcagaactgccaagaacttgtgcccatctgaagaagccaaggaatttcggttggacagtctggagaacgagattactgcattggagaatgagtgttcaggtgattaccaatggattggtttctgtcacaatgatcttcagtatggcaatatcatgattgatgaagagaccaacgtgctgaccatcattgattttgagtatgcaagcttcaacccggttgcatatgacattgctaaccatttctgtgagatggcagcagactatcattcatcaaagcctcatatactggactacagcagatatccagatgttgatgagcagaagcgcttcgttaagacctacctgaacatttctggtgaggaaccggatgcagaagttgtggagaacctgctccaacgcattgataagtacatgctcgccagccatctagtatggggcctctggggaataatttcggaccacgttaacgacattgactttgactacaaggagtatgcgaggcagagattcgagcagtactggcagaagaagtctgcaatcttaacatcttga

SEQ ID NO: 7540 - protein, 369 aa, Sorghum bicolor
  misc_feature: Ceres ANNOT ID no. 6079659
  misc_feature (89)..(292): Pfam Id: Choline_kinase Pfam Desc: Choline/ethanolamine kinase
  misc_feature (54)..(300): Pfam Id: APH Pfam Desc: Phosphotransferase enzyme family
  misc_feature (1)..(53): Pfam Id: Choline_kin_N Pfam Desc: Choline kinase N terminus
  misc_feature (1)..(369): NCBI GI: 94420695 NCBI Desc: choline kinase [oryza sativa (indica cultivar-group)]
  misc_feature (1)..(369): NCBI GI: 33149685 NCBI Desc: choline kinase [oryza sativa (indica cultivar-group)]
  misc_feature (21)..(367): NCBI GI: 1438883 NCBI Desc: gmck3p
  misc_feature (29)..(368): NCBI GI: 92872421 NCBI Desc: choline kinase, n-terminal; protein kinase-like [medicago truncatula]
  misc_feature (15)..(369): NCBI GI: 1438881 NCBI Desc: gmck2p
  misc_feature: Up-regulated in shoot tissues in response to methyl jasmonate treatment
  misc_feature: Up-regulated in root tissues in response to methyl jasmonate treatment
  misc_feature: Up-regulated in root tissues in response to salicylic acid treatment
MVAIENNQSQVQVAVAAEAVPVPVPGPRIPREARSLLHELAAAWADVADCRALEVVPLKGAMTNEVYQVRWLTGPAAAGEKEEPRREREVRKVLVRIYGDGVDLFFDREDEVRTFECMSRHGQGPRLLGRFPNGRVEEFIHARTLSAADLRDPEISALVASKLREFHNLDMPGPKSVLIWDRLRNWLRTAKNLCPSEEAKEFRLDSLENEITALENECSGDYQWIGFCHNDLQYGNIMIDEETNVLTIIDFEYASFNPVAYDIANHFCEMAADYHSSKPHILDYSRYPDVDEQKRFVKTYLNISGEEPDAEVVENLLQRIDKYMLASHLVWGLWGIISDHVNDIDFDYKEYARQRFEQYWQKKSAILTS

SEQ ID NO: 7541 - DNA, 909 bp, Sorghum bicolor
  misc_feature: Ceres ANNOT ID no. 6079674
  misc_feature: Encodes the peptide sequence at SEQ ID NO 7542
atgggcgccttggacctacaccttgagtttgcttctgctcaacatggacaagccaagctaaatgtggaggaatatgccaagggctctttgctgtctgatggaaactacaatacagagaagatcaatggttcaaatcctgatgagtatgagaaatttcagaaagggataatgcagtatgggtgtccacattatagaaggagatgccgcataagagctccttgctgcaatgaagtttttgattgccgacactgccacaatgaaactaagaattccattaaaattgataaaatgaagaggcatgaacttccacgccatgaagtgcagcaggttgtatgctcattgtgtggcactgaacaggaggtacaacaagtatgcatcaattgtggtgtttgcatggggaagtacttctgtggattgtgcaaactctttgacgatgatgtctctaaacagcagtatcactgcaacggatgtggaatatgcagaattggagggagggagaatttcttccactgttcaaaatgcggatgttgctattcaattgctctgaagaatagtcatgcatgtgttgaaggggcgatgcatcatgactgtccaatctgctttgagtacttgttcgagtcgacgaatgatgtttctgtcctgccttgtggtcataccattcatgtaaagtgcctcaaagaaatggaggagcactgccagtttgcatgccccctttgctccaagtcggtttgtgacatgtcgaaggcatgggagagactcgacatggagctggcaactctgtctgactcctgtgatgataaaatggtccgcatattatgcaacgactgcggggctatatcagatgtgcagttccatttgattgcgcacaagtgccagaattgcaagtcatacaacacccgccagatctga

SEQ ID NO: 7542 - protein, 302 aa, Sorghum bicolor
  misc_feature: Ceres ANNOT ID no. 6079674
  misc_feature (61)..(144): Pfam Id: zf-CHY Pfam Desc: CHY zinc finger
  misc_feature (197)..(239): Pfam Id: zf-C3HC4 Pfam Desc: Zinc finger, C3HC4 type (RING finger)
  misc_feature (1)..(302): NCBI GI: 57899891 NCBI Desc: zinc finger protein zfp-like [oryza sativa (japonica cultivar-group)]
  misc_feature (1)..(302): NCBI GI: 46310216 NCBI Desc: zinc finger protein [oryza sativa (japonica cultivar-group)]
  misc_feature (54)..(301): NCBI GI: 42568081 NCBI Desc: zinc finger (c3hc4-type ring finger) family protein [arabidopsis thaliana]
  misc_feature (53)..(301): NCBI GI: 140043244 NCBI Desc: zinc finger, ring-type; zinc finger, chy-type [medicago truncatula]
  misc_feature (55)..(301): NCBI GI: 4105798 NCBI Desc: pgpd14 [petunia x hybrida]
  misc_feature: The sequence is a functional homolog of SEQ ID NO. 350 in the 11/188,298 US application
  misc_feature: The sequence is a functional homolog of SEQ ID NO. 468 in the 11/188,298 US application
  misc_feature: The sequence is a functional homolog of SEQ ID NO. 271 in the 11/188,298 US application
  misc_feature: The sequence is a functional homolog of SEQ ID NO. 329 in the 11/188,298 US application
MGALDLHLEFASAQHGQAKLNVEEYAKGSLLSDGNYNTEKINGSNPDEYEKFQKGIMQYGCPHYRRRCRIRAPCCNEVFDCRHCHNETKNSIKIDKMKRHELPRHEVQQVVCSLCGTEQEVQQVCINCGVCMGKYFCGLCKLFDDDVSKQQYHCNGCGICRIGGRENFFHCSKCGCCYSIALKNSHACVEGAMHHDCPICFEYLFESTNDVSVLPCGHTIHVKCLKEMEEHCQFACPLCSKSVCDMSKAWERLDMELATLSDSCDDKMVRILCNDCGAISDVQFHLIAHKCQNCKSYNTRQI

SEQ ID NO: 7543 - DNA, 1044 bp, Sorghum bicolor
  misc_feature: Ceres ANNOT ID no. 6079681
  misc_feature: Encodes the peptide sequence at SEQ ID NO 7544
atgcggcgacgacaggtcaatctggcgacgtggctcctcgccgccgccgtcgtcgtcctagcccttttcgccacgccgggcgccgccgccgcgcaggtcaagacgaccgacacgcgctggagcttccacctccctttacccggcggcgtcagcggcgccgagagcctcgccttcgacggcaagggcgaggggccctacgccggcgtctcggacggccgcgtcctcaagtggggcggcagcgccgtcggctggaccacgttcgcgcacagcgccaactacaggaagatacccctgtgcacggccggagtggtgccgtcggccgagaccgagagcatgtgcggccggcccctgggcctccagttccacttcaagaccggcgacgtctacatcgccgacgcctacttggggctcatgaaggtcggcccgggcggcggcgaggccgaggtgctggcgaccggcgcgggcggcgtcccgttcaacttcgtcaacggcctcgacgtccaccaggccaccggcgacgtctacttcaccgactcgagcagcacgtacccgaggaggttcaacacggagatcatgatgaacgcggacgcgacggggcggctgctcaagtacgacgccaagacgaagagcgtcaccgtgctcaaggccggcctgccgtacccgaacggcgtggccgtcagccgcgacggcgcgcaggtcgtggtcgcgcacaccgtgccgtgccaggcgttcaggtacttcctccgtggcgccagggcgggacagtacgagctgctggcggacctgccggggtacccggacaacgtgaggcgggacggcaagggtgggtactgggtggcgctcaaccaggaaaagcagcggctggacgtgacgccggcgacggctcccgcgaagcacctggtcggcgtccgcctggacaaccaaggggtggaggtcgaggagcttacggcggccaagggtgtcacactgagcgacgtggcggagaggagggggaagctgtggctgggctccgtggaactcgagtacgtcggcctcgttgcttga

SEQ ID NO: 7544 - protein, 347 aa, Sorghum bicolor
  misc_feature: Ceres ANNOT ID no. 6079681
  misc_feature (163)..(251): Pfam Id: Str_synth Pfam Desc: Strictosidine synthase
  misc_feature (23)..(339): Pfam Id: SGL Pfam Desc: SMP-30/Gluconolaconase/LRE-like region
  misc_feature (3)..(346): NCBI GI: 115478879 NCBI Desc: os09g0374900 [oryza sativa (japonica cultivar-group)]
  misc_feature (49)..(285): NCBI GI: 30694556 NCBI Desc: strictosidine synthase family protein [arabidopsis thaliana]
  misc_feature (50)..(282): NCBI GI: 140040327 NCBI Desc: strictosidine synthase [medicago truncatula]
  misc_feature (44)..(282): NCBI GI: 14028757 NCBI Desc: male fertility protein [zea mays]
  misc_feature (48)..(282): NCBI GI: 115455371 NCBI Desc: os03g0750700 [oryza sativa (japonica cultivar-group)]
MRRRQVNLATWLLAAAVVVLALFATPGAAAAQVKTTDTRWSFHLPLPGGVSGAESLAFDGKGEGPYAGVSDGRVLKWGGSAVGWTTFAHSANYRKIPLCTAGVVPSAETESMCGRPLGLQFHFKTGDVYIADAYLGLMKVGPGGGEAEVLATGAGGVPFNFVNGLDVHQATGDVYFTDSSSTYPRRFNTEIMMNADATGRLLKYDAKTKSVTVLKAGLPYPNGVAVSRDGAQVVVAHTVPCQAFRYFLRGARAGQYELLADLPGYPDNVRRDGKGGYWVALNQEKQRLDVTPATAPAKHLVGVRLDNQGVEVEELTAAKGVTLSDVAERRGKLWLGSVELEYVGLVA

SEQ ID NO: 7545 - DNA, 1152 bp, Sorghum bicolor
  misc_feature: Ceres ANNOT ID no. 6079690
  misc_feature: Encodes the peptide sequence at SEQ ID NO 7546
atggccaccctcaacatgttcgaactcctcggcgccgacgacaacgacgacccctcgcagctgattgccgccgcggaggcggcggctcagaaagccgaggcgaagaagtccgccgcagcgcctgctgggaaggctgcccagcctgcggcggccgccaagttcccgaccaagcccgctcccccctcgcagactgtgagagatgcacgcggtggtggtgcatcagctcgtggaggctttggccgtggcgaacgcggccgtggtagaggtggacggggatatggccagaaccgcgacttcagtggtgacaatgccaatggcttccagggaggttatggtggcggaggctatggtggcggaggctatggagatggtgctgtaactggtggagctgaaggggaaagggagagaggccctcgccccccataccgtggtggaggcagacgtggtggttacaggaatggtgagtttggtgatgattctgagaggccaccacggagaaactatgagcgccacagtgggactggccgtggctatgagatgaagcgtgatggtgcaggacgtgggaactggggcactgccactgatgaggttcttgcccaggaaacagaggaagctctgaaggtggaggagggtgctcctgttgctgagaaacagggtgagcagaatgatgccccagcagcggatgagaacaaagataacaaggattctgctgcaaatgaggaggaagaaaaggaagaggacaaggagatgactttggaggaatatgaaaaaataaaagaggagaagaggaaagcactacttgcattgaaggctgaagagagaaaagttgaagttgataaggatctgcagtctctgcagccactttcaaacaagaaagaaaatgatgaagttttcattaagctgggttctgacaaggataaaaagaaggaaattgctgagcgtgatgagcgtgccaagaagtcggtgagcatcaatgagttcctgaaacctgctgaaggagaaaggtactatggtggccgtggtcgtggaaggggtggccgcggggagcgtggtggttttagaggtggatacggagggggatacaatcgtggccctgctgctgctccatccattgaagatcaagctcaattcccaagccttggtgggaagtga

SEQ ID NO: 7546 - protein, 383 aa, Sorghum bicolor
  misc_feature: Ceres ANNOT ID no. 6079690
  misc_feature (164)..(277): Pfam Id: HABP4_PAI-RBP1 Pfam Desc: Hyaluronan / mRNA binding family
  misc_feature (135)..(383): NCBI GI: 115465079 NCBI Desc: os05g0533100 [oryza sativa (japonica cultivar-group)]
  misc_feature (1)..(383): NCBI GI: 2104681 NCBI Desc: transcription factor [vicia faba]
  misc_feature (32)..(381): NCBI GI: 39725278 NCBI Desc: salt tolerance protein 2 [beta vulgaris]
  misc_feature (1)..(383): NCBI GI: 77416977 NCBI Desc: nuclear rna binding protein-like [solanum tuberosum]
  misc_feature (17)..(381): NCBI GI: 21553991 NCBI Desc: nuclear rna binding protein a-like protein [arabidopsis thaliana]
MATLNMFELLGADDNDDPSQLIAAAEAAAQKAEAKKSAAAPAGKAAQPAAAAKFPTKPAPPSQTVRDARGGGASARGGFGRGERGRGRGGRGYGQNRDFSGDNANGFQGGYGGGGYGGGGYGDGAVTGGAEGERERGPRPPYRGGGRRGGYRNGEFGDDSERPPRRNYERHSGTGRGYEMKRDGAGRGNWGTATDEVLAQETEEALKVEEGAPVAEKQGEQNDAPAADENKDNKDSAANEEEEKEEDKEMTLEEYEKIKEEKRKALLALKAEERKVEVDKDLQSLQPLSNKKENDEVFIKLGSDKDKKKEIAERDERAKKSVSINEFLKPAEGERYYGGRGRGRGGRGERGGFRGGYGGGYNRGPAAAPSIEDQAQFPSLGGK

SEQ ID NO: 7547 - DNA, 1515 bp, Sorghum bicolor
  misc_feature: Ceres ANNOT ID no. 6079698
  misc_feature: Encodes the peptide sequence at SEQ ID NO 7548
atgaggaagccggcggcgctggtggcgtctacggtggttttcgcagccgcagccgtagccgctgtgatggcgcgccagaggctgcgggaagcgaggcggtgggcacgcgcagccgccatgctgcgggacctgcaggagcggtgcgcggcgccggcggagcggctgcggcaggtggcagacgcgatggccgcggagatgcgcgcggggctggcctccaacgactccgagggagagagcgggagcaccgtcctcctcaagatgctcgtcacctacgttgactccctaccctccgggggcgagaaagggctattttatgctcttgaccttggaggaacaaactttcgtgttttacgaattcagtttgggggcaaggaacagcgaatagtcaagcaagaatctaaaggggtatccattcctcaacatttaatgtccaggggatcaaatgagctgttcgattttattgctgctgctttggcaaagttcgttgcttctgagggtgaggactttcatcttcctgagggtatgcagagacaacttggttttacattctcctttccagtgaatcaaaattcagttgcatctggcactcttatcaaatggacaaagggttttgcaattgatgaaatggtaggaaaggatgtagtggcagaattaaacaaggctatcgaacgccaaggaattgatatgaaaatcacagcactggtcaatgatacggtagggacattggctgctgggagatatgtggataatgatactgttgctgcagttatactgggtactggcactaatgcagcatacatagaacatatgaactcaattcctaaatggtgcggcccacctcctgagtctgatgacatggtgataaatatggaatggggaaactttaggtcctcccaccttccactgactgaatttgatgtagccttggatgcagaaagtttgaaccctggtgaacagatttatgagaagttgatctctggcatgtatatgggggaaatcgttcgaagagtcttgctaaaaatggctcaggatgcttctcttttcgcagacaatgtacctccgaaacttgagatcccatatatcctgagaacatatcatgtgctgatgatgcatcaagacacatcgcctgatctcaggacagttggcatcaacctgaaagaaatcttcgggatagaaaacacctgttgcaaaacaaggaaactggtagtggatgtttgtgaggctgttgccacccgcggtgcacgacttgctgctgctgggatacacggcatcctcaaaaagcttgggcgagacattgccaaccctgacaaacaaaagacggttattgctgtggatggcggagtttacaagtattacactttcttcgcccaatgcatggagagcactctaagagacttgcttggggaggaagtggcgtcctctgtcgtgataaagcttgccgaagatggctcaggcactggagcggccctcttggcagcctcctattctcaacgtttcggggccatggatgattaa

SEQ ID NO: 7548 - protein, 504 aa, Sorghum bicolor
  misc_feature: Ceres ANNOT ID no. 6079698
  misc_feature (251)..(498): Pfam Id: Hexokinase_2 Pfam Desc: Hexokinase
  misc_feature (38)..(249): Pfam Id: Hexokinase_1 Pfam Desc: Hexokinase
  misc_feature (1)..(497): NCBI GI: 110808552 NCBI Desc: hexokinase-2 (hexokinase-3)
  misc_feature (1)..(497): NCBI GI: 110808556 NCBI Desc: hexokinase-9 (hexokinase-5)
  misc_feature (8)..(497): NCBI GI: 11066213 NCBI Desc: hexokinase [citrus sinensis]
  misc_feature (8)..(496): NCBI GI: 21700789 NCBI Desc: at4g29130/f19b15_160 [arabidopsis thaliana]
  misc_feature (8)..(497): NCBI GI: 18141293 NCBI Desc: hexokinase [brassica oleracea]
  misc_feature (1)..(497): SWISSPROT Homolog: EC 2.7.1.1 Hexokinase-2
  misc_feature: The sequence is a functional homolog of SEQ ID NO. 321 in the 11/188,298 US application
MRKPAALVASTVVFAAAAVAAVMARQRLREARRWARAAAMLRDLQERCAAPAERLRQVADAMAAEMRAGLASNDSEGESGSTVLLKMLVTYVDSLPSGGEKGLFYALDLGGTNFRVLRIQFGGKEQRIVKQESKGVSIPQHLMSRGSNELFDFIAAALAKFVASEGEDFHLPEGMQRQLGFTFSFPVNQNSVASGTLIKWTKGFAIDEMVGKDVVAELNKAIERQGIDMKITALVNDTVGTLAAGRYVDNDTVAAVILGTGTNAAYIEHMNSIPKWCGPPPESDDMVINMEWGNFRSSHLPLTEFDVALDAESLNPGEQIYEKLISGMYMGEIVRRVLLKMAQDASLFADNVPPKLEIPYILRTYHVLMMHQDTSPDLRTVGINLKEIFGIENTCCKTRKLVVDVCEAVATRGARLAAAGIHGILKKLGRDIANPDKQKTVIAVDGGVYKYYTFFAQCMESTLRDLLGEEVASSVVIKLAEDGSGTGAALLAASYSQRFGAMDD

SEQ ID NO: 7549 - DNA, 1137 bp, Sorghum bicolor
  misc_feature: Ceres ANNOT ID no. 6079700
  misc_feature: Encodes the peptide sequence at SEQ ID NO 7550
atgggctgctgtggcgccatgtccgccaggccgcggggcatccacgaggagacgctgctgcgcgtcccgggcgcgtccgtgcacctcatggcgggctccgacggccccgtcgagctcgcgcgcggggacctcgccgtcgtcaggctcaccaaggacgacgtggccgtggccaccgcggtgcgcgtcggcaaggacctgggctggccgctcgcgcgggacgagcccgtcgtcaagctcgaccgcctgcactacctcttcacgctgcccgacaaggacgggacgttcctcaactacggcgtctccttcaacgccgacgccgccgacgactccgcgctggcgtcgctcgacggcttgctccgctccagcgcatgcttctccgcaccttcgtacccggtggttccgtccaagagctccaggcggccgccgccgccgccgcagcagcagcagcagccggttgcgtcggacgggtactggaacgagttcgcgccgaggatggaaggctacaacggcgtgcttgccaaggccatcgccgcgggcaccggccagctcgtcaagggcatcttcatgtgcagcgaggcctacgccagccaggttcagagaggagccgatctgtttcgtcctcaggctggcggcagcgcgcggagccgattcggcgacgctggtggcgccgacaggagcagccaggcgagcaccaagcgtggagcagtcaacaagagtctcaagagggtcaggaagctgtcggagatgaccgagaagatgagccagtcgctgctcgatacggtcatctcggtgaccggctccatggcggcaccgctgatccgctccaagcaagggagagcattcctcgccagcgtacccggcgaggtcgtcctggcatctcttgatgccatcaacaaagtaatggatgcggtagaggctgctgagaagaagtcgcttgctgcaacttcaaatgtcgtcgccggcgcagtttcaaggaggtacggcgagagcgcaggggaggcaaccgaagacgcgttcgcgacggccggccacgccgtgggaacggcgtggaacctcttcaagatccgcaaggccgtcacaccgtcgtcctccatgcccgggaacatggtcaagagcgccattaggaacaggaactga

SEQ ID NO: 7550 - protein, 378 aa, Sorghum bicolor
  misc_feature: Ceres ANNOT ID no. 6079700
  misc_feature (16)..(371): Pfam Id: Senescence Pfam Desc: Senescence-associated protein
  misc_feature (1)..(377): NCBI GI: 57899541 NCBI Desc: senescence/dehydration-associated protein-related (erd7)-like [oryza sativa (japonica cultivar-group)]
  misc_feature (14)..(319): NCBI GI: 30683270 NCBI Desc: senescence/dehydration-associated protein-related [arabidopsis thaliana]
  misc_feature (8)..(375): NCBI GI: 18419759 NCBI Desc: senescence/dehydration-associated protein-related [arabidopsis thaliana]
  misc_feature (92)..(375): NCBI GI: 92894544 NCBI Desc: imp dehydrogenase/gmp reductase [medicago truncatula]
  misc_feature (157)..(375): NCBI GI: 92886174 NCBI Desc: senescence-associated [medicago truncatula]
MGCCGAMSARPRGIHEETLLRVPGASVHLMAGSDGPVELARGDLAVVRLTKDDVAVATAVRVGKDLGWPLARDEPVVKLDRLHYLFTLPDKDGTFLNYGVSFNADAADDSALASLDGLLRSSACFSAPSYPVVPSKSSRRPPPPPQQQQQPVASDGYWNEFAPRMEGYNGVLAKAIAAGTGQLVKGIFMCSEAYASQVQRGADLFRPQAGGSARSRFGDAGGADRSSQASTKRGAVNKSLKRVRKLSEMTEKMSQSLLDTVISVTGSMAAPLIRSKQGRAFLASVPGEVVLASLDAINKVMDAVEAAEKKSLAATSNVVAGAVSRRYGESAGEATEDAFATAGHAVGTAWNLFKIRKAVTPSSSMPGNMVKSAIRNRN

SEQ ID NO: 7551 - DNA, 1782 bp, Sorghum bicolor
  misc_feature: Ceres ANNOT ID no. 6079703
  misc_feature: Encodes the peptide sequence at SEQ ID NO 7552
atggagagcacgctcaaggggatacgcggcagcgacgcgccgtgcgtgctggacatggacgacgcggccaccgtggcgggcggcgtcgaggacacctacggcgaggaccgcgccaccgaggagcagctcgtcacgccatggaccgtctccgtcgccagcggttacaatttgctgagggatccccgttacaacaagggacttgcgttcacagagagggagcgtgagacgcactacctccgtggccttctgccaccagctattgtatctcaggagctccaggagagaaagatcatgaataatatccgacaataccagttgcctttgcagcgctacatggccctcatggacctccaggaagggaatgagaggcttttctacaagctgcttattgacaatgtggaggagttacttcctatcgtctacacaccaactgtaggcgaggcctgccaaaagtatggatccatttttagtcgtcctcagggtctttatatcagtttgaaggagaagggaaagatccttgaggtgctgaagaactggccagagaggagcattcaagttattgttgttactgatggtgaacggattttggggcttggagatctcggatgccagggaatggggattcctgttggtaaactttccctttacactgccctgggaggagttcgtccatctgcttgcttgccaatcacattggatgttggtacaaataatgaggagctgcttaatgacgaattttacattggcttgagacaaagaagagccacgggccaggagtacactgattttctgcaagaatttatgagtgctgtgaaacaaaactatggggaaaaagtgctcattcagtttgaggattttgccaaccataatgcttttgatctccttgcaagatatggcaccactcaccttgtattcaatgatgatattcagggaacagcttctgtggttcttgctgggcttattgcagcccaaacactacttggtggttcattggcagatcacacttaccttttcctgggtgctggagaggctgggacaggtatcgctgaactaatagctcttgagatctcacgtcagacgaaagctcctatagaggagtgccgcaagaaaatctggcttgttgattcaaagggtttgattgtcagtacacgaaaggagtcccttcaacacttcaagaaaccatgggcccatgagcataaaccagtcaacaacctcttagatgctgttaacgctatcaaaccaacagtgttgattggcacatccgggaaggggcaaactttcacaaaagacgttattgaagcgatctcctcatttaacgagagaccaatcattcttgccctttcgaacccaacgtcgcaatctgaatgcacagctgagcaagcttacacatggagcaagggccaagcagtgtttgcaactgggagtccatttgatcctgtggagtacaatggcaagatacatgttcccggacaggcaaacaatgcctatatcttcccagggtttggccttggtgtggtgatgtctggggctatccgcgttcatgatgacatgcttctggcagcatcggaggctctggcccagcaggtcacagaagaaaattttgaaaaggggctcatttatcctcccttctcaaacatcaggaagatctctgcccacattgcagccaacgttgcagcgaaggcatatgaacttggtttggcaagtaggcgccctcggccaaaggacctggtgaaatttgcagagagctgcatgtacagccccatttaccgcaactaccgctga

SEQ ID NO: 7552 - protein, 593 aa, Sorghum bicolor
  misc_feature: Ceres ANNOT ID no. 6079703
  misc_feature (309)..(562): Pfam Id: Malic_M Pfam Desc: Malic enzyme, NAD binding domain
  misc_feature (118)..(307): Pfam Id: malic Pfam Desc: Malic enzyme, N-terminal domain
  misc_feature (1)..(593): NCBI GI: 54606800 NCBI Desc: nadp dependent malic enzyme [oryza sativa (japonica cultivar-group)]
  misc_feature (46)..(593): NCBI GI: 115439655 NCBI Desc: os01g0723400 [oryza sativa (japonica cultivar-group)]
  misc_feature (1)..(593): NCBI GI: 515759 NCBI Desc: malate dehydrogenase (nadp+)
  misc_feature (1)..(593): NCBI GI: 8118507 NCBI Desc: nadp-dependent malic protein [ricinus communis]
  misc_feature (1)..(593): NCBI GI: 2911148 NCBI Desc: nadp-malic enzyme [aloe arborescens]
  misc_feature (1)..(593): SWISSPROT Homolog: EC 1.1.1.40 NADP-dependent malic enzyme
  misc_feature: The sequence is a functional homolog of SEQ ID NO. 292 in the 11/188,298 US application
MESTLKGIRGSDAPCVLDMDDAATVAGGVEDTYGEDRATEEQLVTPWTVSVASGYNLLRDPRYNKGLAFTERERETHYLRGLLPPAIVSQELQERKIMNNIRQYQLPLQRYMALMDLQEGNERLFYKLLIDNVEELLPIVYTPTVGEACQKYGSIFSRPQGLYISLKEKGKILEVLKNWPERSIQVIVVTDGERILGLGDLGCQGMGIPVGKLSLYTALGGVRPSACLPITLDVGTNNEELLNDEFYIGLRQRRATGQEYTDFLQEFMSAVKQNYGEKVLIQFEDFANHNAFDLLARYGTTHLVFNDDIQGTASVVLAGLIAAQTLLGGSLADHTYLFLGAGEAGTGIAELIALEISRQTKAPIEECRKKIWLVDSKGLIVSTRKESLQHFKKPWAHEHKPVNNLLDAVNAIKPTVLIGTSGKGQTFTKDVIEAISSFNERPIILALSNPTSQSECTAEQAYTWSKGQAVFATGSPFDPVEYNGKIHVPGQANNAYIFPGFGLGVVMSGAIRVHDDMLLAASEALAQQVTEENFEKGLIYPPFSNIRKISAHIAANVAAKAYELGLASRRPRPKDLVKFAESCMYSPIYRNYR

SEQ ID NO: 7553 - DNA, 1224 bp, Sorghum bicolor
  misc_feature: Ceres ANNOT ID no. 6079708
  misc_feature: Encodes the peptide sequence at SEQ ID NO 7554
  misc_feature: Down-regulated in shoot tissues in response to salicylic acid treatment
atggcaacggccgcctccgccttccccggcgcgttcggcgtcaaaaccccagccccagcccgtgggctgagcgcgcacccggccctcaccccgagccccgcattcgcgaggcctttgccgcgcacccccgcctgcggcaggtcccgcgccagcctccacctcggcggcgtgggcgcggccagcagcagcgccgccgccgccggcaacggcaccgggctccacgtgccccccacgaccgcgccgctcgccgtgcccaagatggccggctccatgaagacgcacaagaacgtcctgctcttctactgcgaggagatgcgggacctcgcgcggcaggtggtcgcccggaacgatgacatcgagctgcgctccatctcatggaggaaatttcccgatggatacccgaatttgttcatctcgaacgcccacaacattcgtgggcagcatgttgcctttttggcctcgtttagctcgcccagtgtcatatttgagcaactatctgtcatatataatctgccaaagttgtttatttcttcatttactcttatactcccgttttttccaaccgggacttctgagcgcatggaagatgaaggagatgttgcaaccgcctttacacttgccagatttttgtcaaatataccaatatcacgaggtggaccttcgagtttagtaatttttgatatccatgctttgcaggagagattctactttggagactcagtcttaccatgttttgagagtggcatccccttgctaaaaagtaggcttcaggagctacctgattcccataatataaccatagcatttccagatgacggtgcatggaagcgcttctataagcaacttcaacattttcctatggttgtatgtaacaaagttagagaaggggagcaaagaattgtacggataaaagagggagatcctagaggacgtcatgttgttatagtggatgatttggttcagtctggtggtacattgattgagtgccagaaagtactggcagctcatggagcagcaaaggtcagtgcatacgtgacacatggcatttttcccaataactcatgggaaaaatttcagcatgataatggagagggtccggagcacggcctgagccacttttggcttactgattcatgcccccttactgtcaacgcggtgaagggcaggcggccatttgaaattctaagtctggccggacctatagcttctgctctccagatttag

SEQ ID NO: 7554 - protein, 407 aa, Sorghum bicolor
  misc_feature: Ceres ANNOT ID no. 6079708
  misc_feature (240)..(366): Pfam Id: Pribosyltran Pfam Desc: Phosphoribosyl transferase domain
  misc_feature (1)..(407): NCBI GI: 68571765 NCBI Desc: ribose-phosphate pyrophosphokinase 3 (phosphoribosyl pyrophosphate synthetase 3)
  misc_feature (90)..(407): NCBI GI: 4902877 NCBI Desc: phosphoribosyl pyrophosphate synthase isozyme 3 [spinacia oleracea]
  misc_feature (58)..(407): NCBI GI: 19699210 NCBI Desc: at1g10700/f20b24.13 [arabidopsis thaliana]
  misc_feature (90)..(407): NCBI GI: 140041706 NCBI Desc: ribose-phosphate pyrophosphokinase [medicago truncatula]
  misc_feature (83)..(407): NCBI GI: 4902470 NCBI Desc: phosphoribosyl diphosphate synthase [arabidopsis thaliana]
  misc_feature (1)..(407): SWISSPROT Homolog: EC 2.7.6.1 Ribose-phosphate pyrophosphokinase 3
  misc_feature: Down-regulated in shoot tissues in response to salicylic acid treatment
MATAASAFPGAFGVKTPAPARGLSAHPALTPSPAFARPLPRTPACGRSRASLHLGGVGAASSSAAAAGNGTGLHVPPTTAPLAVPKMAGSMKTHKNVLLFYCEEMRDLARQVVARNDDIELRSISWRKFPDGYPNLFISNAHNIRGQHVAFLASFSSPSVIFEQLSVIYNLPKLFISSFTLILPFFPTGTSERMEDEGDVATAFTLARFLSNIPISRGGPSSLVIFDIHALQERFYFGDSVLPCFESGIPLLKSRLQELPDSHNITIAFPDDGAWKRFYKQLQHFPMVVCNKVREGEQRIVRIKEGDPRGRHVVIVDDLVQSGGTLIECQKVLAAHGAAKVSAYVTHGIFPNNSWEKFQHDNGEGPEHGLSHFWLTDSCPLTVNAVKGRRPFEILSLAGPIASALQI

SEQ ID NO: 7555 - DNA, 3708 bp, Sorghum bicolor
  misc_feature: Ceres ANNOT ID no. 6079711
  misc_feature: Encodes the peptide sequence at SEQ ID NO 7556
atgagtggccgagccccagcgggcggcggcggcggcggcggcgagcggccgatgagcatccgcggcatgttccagttcgcggaccgggtggacgttctgctcatggccctgggaacgctgggggccatcggcgacgggtgctccaccaacctgctgctcatcttcgccagcgacgtgatgaacgcgctcgggtacggcggcgcccgggccagcggcggcggcgccaagagcgcgcagttcatgcacgaggtggagaagtcgtgcctgaatttcgtctacctggcgttcgtggtcctggctgtggcgttcatggaagggtactgctggagccggacgagcgagcggcaggtgctgcggatccggtacctgtacctgcaggccatcctgcggcaggaggcgggcttcttcgactcgcaggaggccaccacctcggagatcatcaacagcatctccaaggacgcctcccacatccaggaggtcctcagcgagaaggtccctctatttctaatgcactctacggtcttcgtctccggactagtcttcgccacttatttctgctggaggctggctctggtttcttttcctctggtcctgcttctcataatcccggggctcatctacggcaagtaccttctctacctgtcgcgccagtcacgccatgagtactccaaggcgaattccctcgtcgagcaagctctgggatctatcaagaccgtttactccttcacagccgagaaaaggatcatccaaaggtacacggcaatccttgacaagacgatcaagctggggatcaaacaaggcattgcaaagggtcttgctgttgggttcactggcctttctttcgccatttgggcctttctcgcatggtatggcgggagattggtgatgttccatcatgtaagtggtggaaggatatatgctgctgggatttcattcgtcttgggtggcctatcccttggaatggcactccctgagctgaaacatttcactgaggcatctgttgctgccacaagaatccttgatcggataaaccgtgttccccagatcaatgctgatgacccaaaaggccttattttggaccaaattcggggagagctcgaatttgaatctgtccatttcgtgtacccatcaagaccaaatatgccagtcctcaaaaacttcaacctccagattcctgctgggcaaactattgctttggttgggtccagtggcagcggcaagtcaacagcaatagctttagtgcagcgcttctatgacgccaatgaaggaactgtcaaaattgatggttttgacatcaaagaactccaactcaaatggatcaggagcaaaatggggctagtcagccaagatcatgcattgtttggtacttcaataaaagagaacatcttgtttggcaaaccagatgcaaccatggatgaggtttatgcagcagccatgacagcaaatgctcacaacttcataagggggcttccagaggaatatgagactaagattggtgagcgtggagcattgttatcaggtggccaaaagcaacgtattgccattgcaagggcgataattaagaaccctgctatactcttgctcgatgaagccacaagtgcacttgattcagaatcagaaaagctggtacagcatgcacttgatcaagcatctatgggacgaacaacactggtagttgctcataagctctcaacggtgaagaatgctgatcagattgcagtagttgatgggggtacaatagctgaaattggtacacatgatgaactgatcagcaggggtggcccgtactcgagacttgtgaaattgcaaaaaatggtaagctacatcgatcaagaaaatgaacaatttagggcttcctcagtggccaggacaagtaccagccgtcacagcatgtccagagcaagtccaatgccactaacaccagctatcttaaaggaaaataattctgatgttcctccacctgcaccatctttctccaggcttcttgcaatgaactcacctgagtggaggcaggcagtcgtaggcagtttgtctgcattggtatatggttccttgcagcccatctatgccataaccatcggaggaatgattgctgcattctttgttcaggaccaaaatgagatgaatgcaattatcagacgctatgccttgatcttctgttcactgtccttggtatctattgttgttaatctattgcaacactacaattttgcgtacatgggggagcatcttgttaggcgcatccgggttcaagtacttgagaagatcttaacctttgaggcagcatggtttgatgaagaaactaattcaagcggtgcattgtgctctcggctaagcaatgaggcttctcttgtcaaaacccttgttgcagacagaatatccttactgcttcaaacagcttccggaatcataattgcagtgacaatgggcctgatggtagcttggaaacttgctcttgtcatgatagctgtacagccatctacaatgatatgctattatgcaaaaaaaatggttctctcaaatgtgtcaagggacttggcaaaggctcagcaccaaagcacccagatagccatagaagctgtttacaaccacaggatggtaacctcctttggatgctcatcgaaggttcttcagctattcgagcatgcacaagaggaacccttgaaaaaagcaaggaagaaatcatgggtagcagggatcaccacaggattgtcaccttgcctctcattcttgtcatgggcactggacttctggtatggtgggaagctggcacagtctggggagatatcagcgggtgatgttttcaaaacctttttcgtgctggtgagcacaggaaagctgattgctgatgctggtagcatgacatctgacctggcaaagggagcaaatgcagttgcttcagtatttgaggtgctagataggaaatccatctctccaaaaaattcacaggtggagaaggaagatcagaagaagaaaatagaaggtagaatagaattcaagaaggtagattttgcatatccaacaagaccagaatgccttatcctacaggattttagcttggacgtgaaagcaggaacaagtgttggcctggttgggagaagcggttgtggtaaatcaactatcataggtttgatccagaggttctatgatgttgatagggggtccgtaagaattgatggtatggatgtgagggagatgaatattctttggttccgaggatttaccgctcttgttagtcaggagcctgcaatgttttcaggcagtgtcagggacaatattgcttttggtaaaccagaagctgatgaagatgagattgtggaagctgcaaaagctgcaaacgcacatgagttcatctcatctttgaaggatggatacgatactgattgtggagagcatggtatacagctctcaggggggcagaagcaaagaatcgcaattgcaagggcaataatccggaatccagcaatactactacttgatgaagcaacaagtgcccttgatgcacagtcagagcaagtggtgcaggaagctcttgatcgaataatgtcagggaggaccacaattgtggtggcacatagactaaacacaatcaagaatgttgactcgattgctttcctgggagaaggtaaagtggtggagcgtggctcttacccgcagctcatgaacaagaagggggcattctacaaccttgcaactcttcagaagtaa

SEQ ID NO: 7556 - protein, 1235 aa, Sorghum bicolor
  misc_feature: Ceres ANNOT ID no. 6079711
  misc_feature (394)..(578): Pfam Id: ABC_tran Pfam Desc: ABC transporter
  misc_feature (1025)..(1209): Pfam Id: ABC_tran Pfam Desc: ABC transporter
  misc_feature (47)..(319): Pfam Id: ABC_membrane Pfam Desc: ABC transporter transmembrane region
  misc_feature (669)..(949): Pfam Id: ABC_membrane Pfam Desc: ABC transporter transmembrane region
  misc_feature (11)..(1235): NCBI GI: 27368839 NCBI Desc: mdr-like abc transporter [oryza sativa (japonica cultivar-group)]
  misc_feature (7)..(1235): NCBI GI: 2292907 NCBI Desc: p-glycoprotein homologue [hordeum vulgare subsp. vulgare]
  misc_feature (19)..(1234): NCBI GI: 15229473 NCBI Desc: abc transporter family protein [arabidopsis thaliana]
  misc_feature (19)..(1235): NCBI GI: 9294571 NCBI Desc: multidrug resistance p-glycoprotein; abc transporter-like protein [arabidopsis thaliana]
  misc_feature (105)..(1230): NCBI GI: 124360622 NCBI Desc: cyclic peptide transporter [medicago truncatula]
MSGRAPAGGGGGGGERPMSIRGMFQFADRVDVLLMALGTLGAIGDGCSTNLLLIFASDVMNALGYGGARASGGGAKSAQFMHEVEKSCLNFVYLAFVVLAVAFMEGYCWSRTSERQVLRIRYLYLQAILRQEAGFFDSQEATTSEIINSISKDASHIQEVLSEKVPLFLMHSTVFVSGLVFATYFCWRLALVSFPLVLLLIIPGLIYGKYLLYLSRQSRHEYSKANSLVEQALGSIKTVYSFTAEKRIIQRYTAILDKTIKLGIKQGIAKGLAVGFTGLSFAIWAFLAWYGGRLVMFHHVSGGRIYAAGISFVLGGLSLGMALPELKHFTEASVAATRILDRINRVPQINADDPKGLILDQIRGELEFESVHFVYPSRPNMPVLKNFNLQIPAGQTIALVGSSGSGKSTAIALVQRFYDANEGTVKIDGFDIKELQLKWIRSKMGLVSQDHALFGTSIKENILFGKPDATMDEVYAAAMTANAHNFIRGLPEEYETKIGERGALLSGGQKQRIAIARAIIKNPAILLLDEATSALDSESEKLVQHALDQASMGRTTLVVAHKLSTVKNADQIAVVDGGTIAEIGTHDELISRGGPYSRLVKLQKMVSYIDQENEQFRASSVARTSTSRHSMSRASPMPLTPAILKENNSDVPPPAPSFSRLLAMNSPEWRQAVVGSLSALVYGSLQPIYAITIGGMIAAFFVQDQNEMNAIIRRYALIFCSLSLVSIVVNLLQHYNFAYMGEHLVRRIRVQVLEKILTFEAAWFDEETNSSGALCSRLSNEASLVKTLVADRISLLLQTASGIIIAVTMGLMVAWKLALVMIAVQPSTMICYYAKKMVLSNVSRDLAKAQHQSTQIAIEAVYNHRMVTSFGCSSKVLQLFEHAQEEPLKKARKKSWVAGITTGLSPCLSFLSWALDFWYGGKLAQSGEISAGDVFKTFFVLVSTGKLIADAGSMTSDLAKGANAVASVFEVLDRKSISPKNSQVEKEDQKKKIEGRIEFKKVDFAYPTRPECLILQDFSLDVKAGTSVGLVGRSGCGKSTIIGLIQRFYDVDRGSVRIDGMDVREMNILWFRGFTALVSQEPAMFSGSVRDNIAFGKPEADEDEIVEAAKAANAHEFISSLKDGYDTDCGEHGIQLSGGQKQRIAIARAIIRNPAILLLDEATSALDAQSEQVVQEALDRIMSGRTTIVVAHRLNTIKNVDSIAFLGEGKVVERGSYPQLMNKKGAFYNLATLQK

SEQ ID NO: 7557 - DNA, 1659 bp, Sorghum bicolor
  misc_feature: Ceres ANNOT ID no. 6079717
  misc_feature: Encodes the peptide sequence at SEQ ID NO 7558
atgccgcccaaggtggtcgccgtcgccgcgggcgaggcccacacactcgccctcacgggtgacgggcaggtgtactcctggggcagggggccgttcggtcgcctcgggaccggccgcgaggacgacgagctggtccccaccgcggtggcgcccgcggtctctgccggcgggacaccgcggcccaggttcgtcgccgtcgccgctggtgcctaccatagccttgcgctggacgatgaaggttcactctggtcatggggttacaatctctctaattccctttttccatgtttggttgagcaatttcaggatctaggttctcctgaaacactgaatgatgaagaccagaacacacgtgatcagacttgtttaaagctgtcttctgtcaaagctggtggcatgatgtcatttgccatagacagtttgggggggctttggatgtggggaagttgcccacagcagactgatgctggagagttatgtatttcgagtagctctatcccactacctgtgtgggatttccatggacacactgttgttaaggttgcctgtggtaatgagcatgtagtagctgcagttagtgttggcgagacctatactgaaggtgaccttgtttgttatgcttggggaaataacaaccatggtcagttgggtctaggtgacaaggaaagtagatctcgtcctgtgcttatctcagcatttagcgaaggatcttcttgggaggtgtatgaaattgcatgcggggcttcccacactgcagtcctcgcaaataagaagtcttctgaccagatagaatctcggtgctggacatttggccttggtgacaaggggcagcttggccatggaaccacagccaccatttgctcaccacaacctgtcgatggactaccaaccggatccttccttatttctcttgactgtggattgttccacacaaccatagtctcctctgatggagaggtgtggtgctggggaatggagagaggtcttggactgtgcccagatgctagcttttcgggagttgatgaaggggatgctttatatccaataagggttcagtctcctgagacaaatgggttcaggtttcttggtccagtgcagatctcctgtggagctgcacacactgttcttgttgctggtgatgggtataggatgtgggcatggggcagaggccgcagtggtgtacttgggagaggccagactgctgacagttacataccctgtgttgtgatgtggcctcctcttgatgagaacttccaagagatccatgaggaccaagcgggaggatcaacatcaagagtgaatgatcgcactagcaccgagttaactcagaagctatctgctgcctcagaggagttgcaattcctaagatcaaaactgacactgatggagagatatgccaatatacttcacatctcaatctttcgtaagccacttgatgaacgggcgctaccacgttcacttcaggaatcttctgtctttgatatcagaaaggaatttgagaacattttggatgcagcagacactgatgaacttaatcgtttggagatcttctaccgcagcatgctttctggcgtgaaagataagcttctgaagagaagagtccaagagatggtccaacaatgcataatttcactctcagcagggaggcaaaacccttaa

SEQ ID NO: 7558 - protein, 552 aa, Sorghum bicolor
  misc_feature: Ceres ANNOT ID no. 6079717
  misc_feature (21)..(76): Pfam Id: RCC1 Pfam Desc: Regulator of chromosome condensation (RCC1)
  misc_feature (200)..(254): Pfam Id: RCC1 Pfam Desc: Regulator of chromosome condensation (RCC1)
  misc_feature (1)..(552): NCBI GI: 20161135 NCBI Desc: p0042a10.5 [oryza sativa (japonica cultivar-group)]
  misc_feature (4)..(546): NCBI GI: 99646741 NCBI Desc: regulator of chromosome condensation family protein [beta vulgaris]
  misc_feature (4)..(441): NCBI GI: 18958034 NCBI Desc: at5g11580/f15n18_170 [arabidopsis thaliana]
  misc_feature (179)..(406): NCBI GI: 114321835 NCBI Desc: regulator of chromosome condensation, rcc1 [alkalilimnicola ehrlichei mlhe-1]
  misc_feature (172)..(413): NCBI GI: 118047428 NCBI Desc: regulator of chromosome condensation, rcc1 [chloroflexus aggregans dsm 9485]
MPPKVVAVAAGEAHTLALTGDGQVYSWGRGPFGRLGTGREDDELVPTAVAPAVSAGGTPRPRFVAVAAGAYHSLALDDEGSLWSWGYNLSNSLFPCLVEQFQDLGSPETLNDEDQNTRDQTCLKLSSVKAGGMMSFAIDSLGGLWMWGSCPQQTDAGELCISSSSIPLPVWDFHGHTVVKVACGNEHVVAAVSVGETYTEGDLVCYAWGNNNHGQLGLGDKESRSRPVLISAFSEGSSWEVYEIACGASHTAVLANKKSSDQIESRCWTFGLGDKGQLGHGTTATICSPQPVDGLPTGSFLISLDCGLFHTTIVSSDGEVWCWGMERGLGLCPDASFSGVDEGDALYPIRVQSPETNGFRFLGPVQISCGAAHTVLVAGDGYRMWAWGRGRSGVLGRGQTADSYIPCVVMWPPLDENFQEIHEDQAGGSTSRVNDRTSTELTQKLSAASEELQFLRSKLTLMERYANILHISIFRKPLDERALPRSLQESSVFDIRKEFENILDAADTDELNRLEIFYRSMLSGVKDKLLKRRVQEMVQQCIISLSAGRQNP

SEQ ID NO: 7559 - DNA, 654 bp, Sorghum bicolor
  misc_feature: Ceres ANNOT ID no. 6079723
  misc_feature: Encodes the peptide sequence at SEQ ID NO 7560
atgggtcggggccgcagcgagataaagcggatcgagaaccccacgcagcggcagtccaccttctacaagcgccgggacggcctcttcaagaaggcgagggagctctccgtcctgtgcgacgtcgacctgctgctgctcctcttctccacctccggcaagctctaccactacctctcccccaccgtcccctctgtgaaggacatggtcgagaggtacgaggccgcgacgcacaccaaggcctggaccgacattcgccaggagcggcgcgcggagctggagaaggtggagcagatgtgcgatctgatggagaaggagctgcggttcatgacggtggacgacggggagcagtacacggtgccgtcgctggagctgctggagcacaacctggaggcggccgtgcacaaggtgcgctccgagaaggaccgcaagatcggcggcgagatcagctacctcgagaacatcatcagaggacgccacgaggagcgctacgggttgtgcgaccagcttgctcattctcaggcctcgaacaacaacggggaaggagggtcggccccaccaagcagcggcctggaactcaaactgggtacaatgcaatccttatgccaccttctcaacttcgattcagatttcagaccaactattttcagtacctaa

SEQ ID NO: 7560 - protein, 217 aa, Sorghum bicolor
  misc_feature: Ceres ANNOT ID no. 6079723
  misc_feature (9)..(59): Pfam Id: SRF-TF Pfam Desc: SRF-type transcription factor (DNA-binding and dimerisationdomain)
  misc_feature (72)..(171): Pfam Id: K-box Pfam Desc: K-box region
  misc_feature (1)..(195): NCBI GI: 95982116 NCBI Desc: mads-box transcription factor taagl14 [triticum aestivum]
  misc_feature (1)..(195): NCBI GI: 75303318 NCBI Desc: mads-box transcription factor 32 (osmads32)
  misc_feature (1)..(195): NCBI GI: 95982142 NCBI Desc: mads-box transcription factor taagl15 [triticum aestivum]
  misc_feature (1)..(175): NCBI GI: 62122347 NCBI Desc: mads-box transcription factor gbmads4 [ginkgo biloba]
  misc_feature (1)..(191): NCBI GI: 51849651 NCBI Desc: pistillata-like protein [nuphar japonica]
  misc_feature: Abnormal phyllotaxy, leaf number higher than wild-type
  misc_feature: No seed is being produced by the plant
  misc_feature: The plant flowers significantly earllier than wild-type.
  misc_feature: The plant flowers significantly late compared to wild-type.
  misc_feature: The plant is abnormally small.
  misc_feature: The plant produces a reduced number of seeds.
  misc_feature: Useful for biocontainment applications
  misc_feature: Useful for making plants with altered Lignin content
  misc_feature: Useful for making plants with altered alkaloid content
  misc_feature: Useful for making plants with modulated biomass
  misc_feature: Useful for making plants with modulated flowering time
  misc_feature: Useful for making plants with modulated nitrogen use efficiency
  misc_feature: Functional homolog of the protein sequence given in SEQ ID NO 12958
  misc_feature: GREAT-hit functional homolog of the protein sequence given in SEQ ID NO 13046
  misc_feature: GREAT-hit functional homolog of the protein sequence given in SEQ ID NO 13191
  misc_feature: Functional homolog of the protein sequence given in SEQ ID NO 13528
  misc_feature: Useful for making plants with modulated nitrogen use efficiency
  misc_feature: Functional homolog of the protein sequence given in SEQ ID NO 13191
  misc_feature: Useful for making plants with altered alkaloid content
  misc_feature: Functional homolog of the protein sequence given in SEQ ID NO 13046
  misc_feature: The sequence is a functional homolog of SEQ ID NO. 359 in the 11/188,298 US application
  misc_feature: The sequence is a functional homolog of SEQ ID NO. 518 in the 11/188,298 US application
  misc_feature: The sequence is a functional homolog of SEQ ID NO. 361 in the 11/188,298 US application
  misc_feature: The sequence is a functional homolog of SEQ ID NO. 273 in the 11/188,298 US application
  misc_feature: The sequence is a functional homolog of SEQ ID NO. 420 in the 11/188,298 US application
  misc_feature: The sequence is a functional homolog of SEQ ID NO. 377 in the 11/188,298 US application
MGRGRSEIKRIENPTQRQSTFYKRRDGLFKKARELSVLCDVDLLLLLFSTSGKLYHYLSPTVPSVKDMVERYEAATHTKAWTDIRQERRAELEKVEQMCDLMEKELRFMTVDDGEQYTVPSLELLEHNLEAAVHKVRSEKDRKIGGEISYLENIIRGRHEERYGLCDQLAHSQASNNNGEGGSAPPSSGLELKLGTMQSLCHLLNFDSDFRPTIFST

SEQ ID NO: 7561 - DNA, 1929 bp, Sorghum bicolor
  misc_feature: Ceres ANNOT ID no. 6079726
  misc_feature: Encodes the peptide sequence at SEQ ID NO 7562
atggggaaggggaagaagtcgaaggagaaggagatggagaagaaaccggtggacatcctcgcggggtccgacgaggactccgacggcggggaggatctctccaaggtccagatcaacgaggagtacgcgcgccgcttcgagcacaacaagcggcgggaggcgctgcagcgcctcgaggagcgcaggaagcagggcctcgtccccgcctctgacgacggcgagtcggattccgagtccgagtcgtctgaggaggacgaggaggccgccattgcctcgcgcctcgtcgaccgccgcgtgttcgaggtgatccgccgcatccgcagcggtgaccctcgcatcctagacaaggacgccaaggtctactcggagtcggaggaggaagagggcagcgaagaaggtgagggcgccgagaaggaagaagagttcaagcaggggaagaaaaaggccaagaaggagaagcctctgtacctcaaggacgtcaatgcccgccacctgctcgaggagggcccggagttcgcagcgcaggccagccggagcagcagcaagttcgagaggatctcctatgatgagcagcagaagaagggtttggaggctttccttgaggcacagaaagaagtattacgcggcgacgacgacgacgacgatttgttccaggtgaagcccaaggctagagcaggggctgatgatgaagtggaggaggatgaggaggagaagcagaccaaggaacttgctggtaaggtctttgggaacgatgaggagctggatgagaacgagaagttcttgaaggaatttttccttaagaggccctaccttgaggcagagaagaggaagtcctatctggatgatatccaggaattatcagatgatgaagaggagctcgagattcaggaagaaaatgagcatggttataattaccggcatgaggaggccatggcatcaggggcagtggtggcggaccgggtaatgggacattcaagggttgttgaggggtcagtgaggaagaaggagagcagcaggaagcagcagcgcaagagcaaagaggagcggatggcccgtgttaagcaagagcaggcagaggagctgaagcatctcaagaatttgaagaagaaagagattgcagagaagcttgagaggatcctaatgattgctgggattgaaggtgatgctgcgtgtaagcttggtgctgatgacttggaggaggattttgatccagaggattatgacaagaaaatgcaggagatgtttgatgacagttactatgaggctgatgatgttgatcctgagtttggaagtggtgaggagatggatttgaagaagccatattttgacaaggaagatgaattgcttgggcttcctaagggctgggctagtgaacattcaaaagaagagtctactgccaccgatgcaaaaggtgcaaaagggaagatctctctcaaagacaaggtggagcttgagaaagagatggaagagtactacaagttagactatgaggacactattggagatatcaagactcggttcaagtataaacaggttaagcccaacagttttggtctgagtgcctgtgatatattggaagcagatgacaaggatttgaaccagtatgtatccattaagaagctatctccttatagagaggatgaatggaaggttacacatcataagaggcagagcaaggatttcatccttggaggccagaagaaagggaagaaggacaaatctgtcaagaaatctaggtctgaggaaggcggccctagttcttcaaaaacagagaaagacaggctgacaaatgggcaagagtcaacggatgacaagaaaaagactacccgaagtgagcgaaggaagcgtcgtaaggctgacctaaagatatccgatgatcgattagtggcatttggaaagacaaattcgaagcgtcacaagagccattga

SEQ ID NO: 7562 - protein, 642 aa, Sorghum bicolor
  misc_feature: Ceres ANNOT ID no. 6079726
  misc_feature (393)..(573): Pfam Id: Krr1 Pfam Desc: Krr1 family
  misc_feature (15)..(421): NCBI GI: 66361516 NCBI Desc: zz domain protein [cryptosporidium parvum]
  misc_feature (15)..(421): NCBI GI: 46228862 NCBI Desc: zz domain protein [cryptosporidium parvum]
  misc_feature (74)..(504): NCBI GI: 30687340 NCBI Desc: krr1 family protein [arabidopsis thaliana]
  misc_feature (18)..(438): NCBI GI: 21357951 NCBI Desc: cg5645-pa [drosophila melanogaster]
  misc_feature (24)..(438): NCBI GI: 125978631 NCBI Desc: ga19028-pa [drosophila pseudoobscura]
MGKGKKSKEKEMEKKPVDILAGSDEDSDGGEDLSKVQINEEYARRFEHNKRREALQRLEERRKQGLVPASDDGESDSESESSEEDEEAAIASRLVDRRVFEVIRRIRSGDPRILDKDAKVYSESEEEEGSEEGEGAEKEEEFKQGKKKAKKEKPLYLKDVNARHLLEEGPEFAAQASRSSSKFERISYDEQQKKGLEAFLEAQKEVLRGDDDDDDLFQVKPKARAGADDEVEEDEEEKQTKELAGKVFGNDEELDENEKFLKEFFLKRPYLEAEKRKSYLDDIQELSDDEEELEIQEENEHGYNYRHEEAMASGAVVADRVMGHSRVVEGSVRKKESSRKQQRKSKEERMARVKQEQAEELKHLKNLKKKEIAEKLERILMIAGIEGDAACKLGADDLEEDFDPEDYDKKMQEMFDDSYYEADDVDPEFGSGEEMDLKKPYFDKEDELLGLPKGWASEHSKEESTATDAKGAKGKISLKDKVELEKEMEEYYKLDYEDTIGDIKTRFKYKQVKPNSFGLSACDILEADDKDLNQYVSIKKLSPYREDEWKVTHHKRQSKDFILGGQKKGKKDKSVKKSRSEEGGPSSSKTEKDRLTNGQESTDDKKKTTRSERRKRRKADLKISDDRLVAFGKTNSKRHKSH

SEQ ID NO: 7563 - DNA, 456 bp, Sorghum bicolor
  misc_feature: Ceres ANNOT ID no. 6079754
  misc_feature: Encodes the peptide sequence at SEQ ID NO 7564
atgagcaaagcaggcggcggccccagctcggccacgggcccgacggccgcggcggccgcggccgcggtgcagaagcagaagtcgctgctgcagaaggcggacgccgacgtctccagcctcgtcgacaatttctcctccctcatcaacatcgcccgagtcaacgatccgccagtgcgcaactcgcaggaggccttccagatggagatgcgtgccgcccgcatggtacattcagcagactcgctgttgaaattagtgtcggaacttaagaggacagccatattttctgggcttgcttcattgaacgagaatgtggataggaggatagaagtgttgggtcagcaagctgaggtaactgagagaatgctggagaggattgggcaggaggcagcagcgagcctcaaggagctagaggcacactactactcatctgttgtgcggtcaccatcctatgattga

SEQ ID NO: 7564 - protein, 151 aa, Sorghum bicolor
  misc_feature: Ceres ANNOT ID no. 6079754
  misc_feature (17)..(143): Pfam Id: SURF5 Pfam Desc: Surfeit locus protein 5
  misc_feature (1)..(148): NCBI GI: 115434352 NCBI Desc: os01g0132700 [oryza sativa (japonica cultivar-group)]
  misc_feature (4)..(146): NCBI GI: 8778847 NCBI Desc: t6d22.4 [arabidopsis thaliana]
  misc_feature (17)..(143): NCBI GI: 76781479 NCBI Desc: surfeit gene 5 isoform 2 [mus musculus]
  misc_feature (17)..(143): NCBI GI: 60822577 NCBI Desc: surfeit 5 [synthetic construct]
  misc_feature (17)..(143): NCBI GI: 119608462 NCBI Desc: surfeit 5, isoform cra_a [homo sapiens]
MSKAGGGPSSATGPTAAAAAAAVQKQKSLLQKADADVSSLVDNFSSLINIARVNDPPVRNSQEAFQMEMRAARMVHSADSLLKLVSELKRTAIFSGLASLNENVDRRIEVLGQQAEVTERMLERIGQEAAASLKELEAHYYSSVVRSPSYD

SEQ ID NO: 7565 - DNA, 1026 bp, Sorghum bicolor
  misc_feature: Ceres ANNOT ID no. 6079758
  misc_feature: Encodes the peptide sequence at SEQ ID NO 7566
atggctcctctcctttccccaccgctgctcgcggacaccggcaccaagttccatgcggcctcagcgccagtctcgtgctccggtagcccacagcgatatgccatcgcagggttggctggggccggaagaagagaccgggactgccgccggaggacgcggggaagaacgagcttgagggtgaaagcggtggcggcggagtcccgcagctcggaggggggaatcgctgaagattactacgctgttcttggcgttatgccagatgcaacgccgaagcagatcaagaaagcatactacaattgcatgaaatcatgtcatcctgatctcagtgggaatgaccctgatatgacaaatttctgcatgttcatcaatgaagtttacacggttcttacagatcccatccagcgagcagtgtatgatgagatacatgggtatgccgcgactgcaaccaatcctttcttggatgacagtgcaccccgggatcacgtgtttgttgatgagtttagctgcataggatgcaagaactgtgctaacgtgtgttctaaggtctttcaaattgaggaagatttcggacgggcaagagtttatgaccaatcaggcagcacagaactgattcaagaagctattgacagttgcccagttgactgcattcattggacttcagctgcgcaactttcgctccttgaggacgaaatgcgcagagtagagagagtaaatgttggattaatgcttgctgggatgggaggctcagttgacgtgtttcggatggcaagctcacgctgggagaaaagacaagccaaagtcctggagaaggtcagaaggcggatgagccaagatgattccagtaagggtggctcatggagtgatatctggggagcaccaacaagatacgagaagaacgaagaggaggcaaaggagagagcaaagcgagcagcggctgcagcgaggaggtggcgagagtactcaaggaaaggcgccgacaagcctcctacattcaaacttccagaggcagtgcccaacaaggagtga

SEQ ID NO: 7566 - protein, 341 aa, Sorghum bicolor
  misc_feature: Ceres ANNOT ID no. 6079758
  misc_feature (77)..(139): Pfam Id: DnaJ Pfam Desc: DnaJ domain
  misc_feature (1)..(336): NCBI GI: 144923250 NCBI Desc: 4fe-4s ferredoxin, iron-sulfur binding; heat shock protein dnaj [medicago truncatula]
  misc_feature (80)..(309): NCBI GI: 92871859 NCBI Desc: 4fe-4s ferredoxin, iron-sulfur binding; heat shock protein dnaj [medicago truncatula]
  misc_feature (44)..(281): NCBI GI: 38344928 NCBI Desc: osjnba0018m05.19 [oryza sativa (japonica cultivar-group)]
  misc_feature (116)..(170): NCBI GI: 90308255 NCBI Desc: chloroplast heat shock protein-binding protein [coffea canephora]
  misc_feature (116)..(170): NCBI GI: 90308249 NCBI Desc: chloroplast heat shock protein-binding protein [lycopersicon esculentum]
MAPLLSPPLLADTGTKFHAASAPVSCSGSPQRYAIAGLAGAGRRDRDCRRRTRGRTSLRVKAVAAESRSSEGGIAEDYYAVLGVMPDATPKQIKKAYYNCMKSCHPDLSGNDPDMTNFCMFINEVYTVLTDPIQRAVYDEIHGYAATATNPFLDDSAPRDHVFVDEFSCIGCKNCANVCSKVFQIEEDFGRARVYDQSGSTELIQEAIDSCPVDCIHWTSAAQLSLLEDEMRRVERVNVGLMLAGMGGSVDVFRMASSRWEKRQAKVLEKVRRRMSQDDSSKGGSWSDIWGAPTRYEKNEEEAKERAKRAAAAARRWREYSRKGADKPPTFKLPEAVPNKE

SEQ ID NO: 7567 - DNA, 1374 bp, Sorghum bicolor
  misc_feature: Ceres ANNOT ID no. 6079761
  misc_feature: Encodes the peptide sequence at SEQ ID NO 7568
atggatctgggaccgtcgctgccggacgacgtgctcgcgggcgtcctccgtcgcctcgcgccacgcggcctcgccgcgtcccgctgcgtctgcaaggcgtggcgacgtgtcgtcgacgaccactgcctgctgcgcgcggatctcctgccgctctcgctgggcggcatcttcctcaacttgcatgacctacgtttcacgcagttcctctctcgccccacgacgggcgccgtagtctccggccggcttgactacacggtgcccggtgagcacggcttcatgccccccgtctacgtcagggatcactgcaatggcctcctcttgctcgaccactgcgtggtgaaccccgccacacagcagtgggcgcccttgcccccgctcccgccattgcccgaccccctccacacggagcagtaccttctgtttgaccccaccctgtcactcaattatgacttgttgatagtgcctgatattccttccgagctgaacgatgaatgtgaggaatctgaatggccgccgtccaccttgatactacatgtcttttcatcagaggctggttcttgggaggagaggacattcggacgggaaggggaggctgcggggatgttagctgacatggttgggtcaagacgacatttcttcgaccgccaatgtggtttcttcgtgcgtcaatgtggctactggcggggagaactctatatatgctgcgagaactgttttgttatgagaatatcactttcaaacaatacgtatcaagcaattaggatgcccacagaagatgtattttatctgggaaaatcaatcaatgggatatactgtgcatccatatttcaggggtcacaacttcaggtttggttccttaacgaccaatgtgttcatggtcagacagagtgggtgttgaagcatggcagagacatcttccccttcctgccaaatctgaactatgacgaacagtgtgatggtccttggatcttacaagatttttactattgccgacaagaagaacataattcttatggtgaagcttatgatgtggtgtacaaaaacgaagcaatacttgaagagaaatttgtgtgggactctgacaatgataatgttctggaaccaggaagtaggtgcaaggattcttatatctattttcttggatttcatccgtacaaagaggttgtcttcttgagtgataaattcgaccgggtgttagcctataattggagtagctcaagggttcaagatttgggcaaggttttcccaaaattctatatagactggaatctccatttccaccatacactggtagcagcgtctttcccatacactccctgctggttgggagagctccctgagaaactgaatttagaagctcagctggaagattag

SEQ ID NO: 7568 - protein, 457 aa, Sorghum bicolor
  misc_feature: Ceres ANNOT ID no. 6079761
  misc_feature (2)..(49): Pfam Id: F-box Pfam Desc: F-box domain
  misc_feature (7)..(447): NCBI GI: 115456876 NCBI Desc: os04g0113000 [oryza sativa (japonica cultivar-group)]
  misc_feature (7)..(447): NCBI GI: 116308824 NCBI Desc: osigba0112g01.1 [oryza sativa (indica cultivar-group)]
  misc_feature (6)..(411): NCBI GI: 53370641 NCBI Desc: f-box domain containing protein [oryza sativa (japonica cultivar-group)]
  misc_feature (7)..(326): NCBI GI: 57900269 NCBI Desc: f-box domain containing protein-like [oryza sativa (japonica cultivar-group)]
  misc_feature (7)..(326): NCBI GI: 115440773 NCBI Desc: os01g0824700 [oryza sativa (japonica cultivar-group)]
  misc_feature: The sequence is a functional homolog of SEQ ID NO. 456 in the 11/188,298 US application
MDLGPSLPDDVLAGVLRRLAPRGLAASRCVCKAWRRVVDDHCLLRADLLPLSLGGIFLNLHDLRFTQFLSRPTTGAVVSGRLDYTVPGEHGFMPPVYVRDHCNGLLLLDHCVVNPATQQWAPLPPLPPLPDPLHTEQYLLFDPTLSLNYDLLIVPDIPSELNDECEESEWPPSTLILHVFSSEAGSWEERTFGREGEAAGMLADMVGSRRHFFDRQCGFFVRQCGYWRGELYICCENCFVMRISLSNNTYQAIRMPTEDVFYLGKSINGIYCASIFQGSQLQVWFLNDQCVHGQTEWVLKHGRDIFPFLPNLNYDEQCDGPWILQDFYYCRQEEHNSYGEAYDVVYKNEAILEEKFVWDSDNDNVLEPGSRCKDSYIYFLGFHPYKEVVFLSDKFDRVLAYNWSSSRVQDLGKVFPKFYIDWNLHFHHTLVAASFPYTPCWLGELPEKLNLEAQLED

SEQ ID NO: 7569 - DNA, 501 bp, Sorghum bicolor
  misc_feature: Ceres ANNOT ID no. 6079775
  misc_feature: Encodes the peptide sequence at SEQ ID NO 7570
atgcggcgagacgccgtcgccgccgcgcccacggcggccggcgcctcgccgccgatccccctcccgatggatgctctggtcatcgatatcgagggggcgccgcctttacctgcggaggcggcccccgggctggggtgccggatctgccacctcggccccgaggacgacgagtcggcggtgccaggttccgaggtgatacgtctaggctgcggctgcaaggacgagctcggcgccgcgcaccggcaatgtgccgaggcgtggtttaggatcaagggcgataggcgctgtgaaatatgtggttcagatgccaaaaacattattgggttagaagtgaaaaaattcatggagcagtggcatggccgaagagtggcacacacccaaactactgaggagagagaaagtaattgttgttggagacagcagcccttatgtaatttcttgttagcaagcttactgattgttttcatgctgccctggtttctccgtgtaaatttgttttga

SEQ ID NO: 7570 - protein, 166 aa, Sorghum bicolor
  misc_feature: Ceres ANNOT ID no. 6079775
  misc_feature (46)..(99): Pfam Id: zf-C3HC4 Pfam Desc: Zinc finger, C3HC4 type (RING finger)
  misc_feature (46)..(166): NCBI GI: 92875384 NCBI Desc: zinc finger, ring-type; ringv [medicago truncatula]
  misc_feature (23)..(165): NCBI GI: 20805170 NCBI Desc: p0529h11.12 [oryza sativa (japonica cultivar-group)]
  misc_feature (54)..(159): NCBI GI: 15237796 NCBI Desc: zinc finger (c3hc4-type ring finger) family protein [arabidopsis thaliana]
  misc_feature (28)..(165): NCBI GI: 117667936 NCBI Desc: zinc finger protein [brassica rapa]
  misc_feature (14)..(106): NCBI GI: 54291081 NCBI Desc: zinc finger (c3hc4-type ring finger)-like [oryza sativa (japonica cultivar-group)]
  misc_feature: Useful for making plants with altered Lignin content
  misc_feature: Useful for making plants with altered terpenoid content
  misc_feature: GREAT-hit functional homolog of the protein sequence given in SEQ ID NO 12916
  misc_feature: Functional homolog of the protein sequence given in SEQ ID NO 13300
MRRDAVAAAPTAAGASPPIPLPMDALVIDIEGAPPLPAEAAPGLGCRICHLGPEDDESAVPGSEVIRLGCGCKDELGAAHRQCAEAWFRIKGDRRCEICGSDAKNIIGLEVKKFMEQWHGRRVAHTQTTEERESNCCWRQQPLCNFLLASLLIVFMLPWFLRVNLF

SEQ ID NO: 7571 - DNA, 939 bp, Sorghum bicolor
  misc_feature: Ceres ANNOT ID no. 6079778
  misc_feature: Encodes the peptide sequence at SEQ ID NO 7572
atgctcctccaccaccgcctcctccctcgcctactcgttccttccacccacacatccacactcctccgcccctcccgtttgccgctccgtctctctctctcgccgcgcttctccgcgctgtcccacctcgcggcaccgcagaccgtcgaccagtccgacgacgaaggggcgccccaggggaaggtgcaggtccagctcccgctcgaccgcctcttcgtgccgcccggggcaaccgtggatgcgggggaccaggacgccgtgagcgcacgggtccttaagggctccaacatcgtgctgggcccatacgcgcgcggtgacgcacaggtggtcaacgcagattttgtgaagagcagcgtgcgtcccgatgactgccctcgggacggcctaccggagttcgcactcgttggccggtcgaacgtcggcaaatcgtcgctgctcaactcgcttgtccgccgcaagcgccttgcactcacctccaagaagcctgggaagacccaatgtatcaatcatttcaaagtaaatgacagctggtatcttgtcgacttgcctggttatggatatgcttctgcaccacaggaagctcgtaccaattgggatgaatttactagaaattactttctcagtagggagaatttggtatctgtttttctccttatagatgcaagtatacctgccaagaagattgatcttgactatgctagttggcttggtcaaaacaaggttcccatgacccttgtgttcacaaaatgtgacaaacgcaagaagaagaagaatggcggcaggagacccgaagaaaacgtggaaactttccagagcctaatccgtgaatacttcgaggctgcgcctccttggatcatgacaagcagcgtgaccaaccagggccgcgatgagatactcctgcacatgtctcagcttaggaattattggctcaagcattga

SEQ ID NO: 7572 - protein, 312 aa, Sorghum bicolor
  misc_feature: Ceres ANNOT ID no. 6079778
  misc_feature (130)..(251): Pfam Id: MMR_HSR1 Pfam Desc: GTPase of unknown function
  misc_feature (91)..(309): NCBI GI: 25306612 NCBI Desc: probable nucleotide-binding protein [imported] - arabidopsis thaliana
  misc_feature (108)..(299): NCBI GI: 124005837 NCBI Desc: gtp-binding protein [microscilla marina atcc 23134]
  misc_feature (108)..(305): NCBI GI: 126663224 NCBI Desc: gtpase engb [flavobacteria bacterium bal38]
  misc_feature (108)..(305): NCBI GI: 81382646 NCBI Desc: probable gtp-binding protein engb
  misc_feature (108)..(299): NCBI GI: 86134337 NCBI Desc: gtp-binding protein [tenacibaculum sp. med152]
  misc_feature: Useful for making plants with modulated heat sensitivity
  misc_feature: Functional homolog of the protein sequence given in SEQ ID NO 13099
MLLHHRLLPRLLVPSTHTSTLLRPSRLPLRLSLSPRFSALSHLAAPQTVDQSDDEGAPQGKVQVQLPLDRLFVPPGATVDAGDQDAVSARVLKGSNIVLGPYARGDAQVVNADFVKSSVRPDDCPRDGLPEFALVGRSNVGKSSLLNSLVRRKRLALTSKKPGKTQCINHFKVNDSWYLVDLPGYGYASAPQEARTNWDEFTRNYFLSRENLVSVFLLIDASIPAKKIDLDYASWLGQNKVPMTLVFTKCDKRKKKKNGGRRPEENVETFQSLIREYFEAAPPWIMTSSVTNQGRDEILLHMSQLRNYWLKH

SEQ ID NO: 7573 - DNA, 1908 bp, Sorghum bicolor
  misc_feature: Ceres ANNOT ID no. 6079792
  misc_feature: Encodes the peptide sequence at SEQ ID NO 7574
atggcgccctcgtccgcagaggctgactcgccggcgtccgccagcggccgcctcctcgtgctctacgcgtcacaaactgggaacgccatggacgccgcagagcgtgtcggccgcgaggcggaacgtggtggctgcccggccgtcgacgtgctgtccatggatagcttcgatcccagtcgcttgccgagcgagcggttcgtggtctttgtggtgtccaccacggggcagggcgatcccccggattccatgaaggggttttggagatacctgcttcggaaggatctggacagacaatggcttaaggggatccatcatgcagtgtttggactcggggattcaggctaccagaagtacaattttgctgcaaagaagcttgatagaaggcttttacatcttggtgcagaaccggttctagagataggcctgggagatgaccaacacccttcaggatacgaaggggctttagatccttggttgctctctttgtggaaatctctgaatgaaattaatccatcattgttacctagagtgtctgatatcaatgattctaatttgagtattttgggggatccaaaagttcatgtcatttattactcttccaatgaagttccacaagattctgtactttcagaccccagtaaaataataagtagcgcaagatcaatgtcccctgcactacggttccatgctgatgcagagccagcttacatgctccaaatggtaaaaaacaagtgtttgactaaggagggttctgatagagatgttcgccactttgaattggaagatccatcttctgccatcagctataaaattggtgatactcttgaaattctacctagtcaaaatccatcagctgtcgatgccttcattgaacgctgtaacttggatccagattgttacataacggttcaagtgagaagtggggataaagtttccaatgattcagttgtgaatagccagatggaccgtatcaaattaaggacctttgttgctttgacaatggatgttgcgtcagcttcccctcggcgatatttctttgaggtcatgagcttttttgcaacaagcgaacgtgaaaaggagaggcttcagtattttgcttctcctgaaggaagagatgatctttaccagtacaatcagaaggagagtaggactgttctagaggtgttggaggattttccttcagtgcaaatgccttttgaatggctggtgcaactaacacctccactgaagaaaagagccttttccatctcatcatccccactggcacacccaaatcaaattcatttgaccgttagcattgtagcatgggttactccattcaagagaacccgacgtggactctgctctacatggctggccgggctcaatccaaataaagacaatcttatcccgtgttggatacaccaaggatccctgcctcctccacgtccattggttcctctcgtgttgattggaccaggaacagggtgtgcaccattccgtgcatttgtggaggaaagggctgcacaggctgcagcagagccaacagccgcggttatgttcttctttggctgtagaaaccaagataacgattttctatacaaggatttctggttaactcatgcccaggatgagggggtgttgtcctcgaaaaagggtggtggtttatttgttgctttttcccgggatcagcctcaaaaggtctatgtgcaacataagataaaggaacatagttcaagagtgtggaacttattactgtccgatgcagttatttacattgcgggctcttcgacgaaaatgcccgctgatgttacagctgcactggaggaggttatttgtaaagaaggtggtgtcaaacaagaggatgcttcaaaatggctcagggatcttgaaagagctggtagacttaacatcgagacttggtcatag

SEQ ID NO: 7574 - protein, 635 aa, Sorghum bicolor
  misc_feature: Ceres ANNOT ID no. 6079792
  misc_feature (228)..(451): Pfam Id: FAD_binding_1 Pfam Desc: FAD binding domain
  misc_feature (20)..(158): Pfam Id: Flavodoxin_1 Pfam Desc: Flavodoxin
  misc_feature (482)..(599): Pfam Id: NAD_binding_1 Pfam Desc: Oxidoreductase NAD-binding domain
  misc_feature (324)..(635): NCBI GI: 124359423 NCBI Desc: flavoprotein pyridine nucleotide cytochrome reductase [medicago truncatula]
  misc_feature (220)..(605): NCBI GI: 116132693 NCBI Desc: ensangp00000003321 [anopheles gambiae str. pest]
  misc_feature (14)..(634): NCBI GI: 89289352 NCBI Desc: flavodoxin family protein [tetrahymena thermophila sb210]
  misc_feature (174)..(635): NCBI GI: 60677855 NCBI Desc: re34180p [drosophila melanogaster]
  misc_feature (18)..(531): NCBI GI: 47125224 NCBI Desc: mgc83826 protein [xenopus laevis]
MAPSSAEADSPASASGRLLVLYASQTGNAMDAAERVGREAERGGCPAVDVLSMDSFDPSRLPSERFVVFVVSTTGQGDPPDSMKGFWRYLLRKDLDRQWLKGIHHAVFGLGDSGYQKYNFAAKKLDRRLLHLGAEPVLEIGLGDDQHPSGYEGALDPWLLSLWKSLNEINPSLLPRVSDINDSNLSILGDPKVHVIYYSSNEVPQDSVLSDPSKIISSARSMSPALRFHADAEPAYMLQMVKNKCLTKEGSDRDVRHFELEDPSSAISYKIGDTLEILPSQNPSAVDAFIERCNLDPDCYITVQVRSGDKVSNDSVVNSQMDRIKLRTFVALTMDVASASPRRYFFEVMSFFATSEREKERLQYFASPEGRDDLYQYNQKESRTVLEVLEDFPSVQMPFEWLVQLTPPLKKRAFSISSSPLAHPNQIHLTVSIVAWVTPFKRTRRGLCSTWLAGLNPNKDNLIPCWIHQGSLPPPRPLVPLVLIGPGTGCAPFRAFVEERAAQAAAEPTAAVMFFFGCRNQDNDFLYKDFWLTHAQDEGVLSSKKGGGLFVAFSRDQPQKVYVQHKIKEHSSRVWNLLLSDAVIYIAGSSTKMPADVTAALEEVICKEGGVKQEDASKWLRDLERAGRLNIETWS

SEQ ID NO: 7575 - DNA, 2784 bp, Sorghum bicolor
  misc_feature: Ceres ANNOT ID no. 6079796
  misc_feature: Encodes the peptide sequence at SEQ ID NO 7576
atgaggggcggcgccgccccgggccaccagcgatggagcggctcggcggggacaacgccgcggtcgctcagcacgggctcctcgccgcggggctccgagcgcagctccgacgacggggaggagctggtcgaggttacgctcgacctgcaggaggacgacaccatcattctgcggagcgtcgagccggccgcggcgggggccgccaacgggctgccgctgggcgcgcgcggggaccatgcgggcggcgcgtcgtcgtcgtcgcggtcacggtcgccgtcgatcaggcggacctcgtcgcaccggctgctgcagttctcgcaggagctcaaggcggaggccatgtccatcgcgcgccagttctcgcaggacctcaccaagcgcttcggccgcacccagagccgcgcggaagggcaggggcagcagcagcagcagccgtcgtcaggcatcgagtcggccctcgctgcccgcgccgcgcggcggcagcgcgcgcagctcgaccgcacgcgctccggcgcgcacaaggcgctccgcggtctccgcttcatcagcagcaacaaggccaacaacgcctggatggaggtgcaggccaacttcgaccgcctcgcctgcgacggcttcctctcccgctccgacttcgcggaatgcattgggatgacggaatcgaaagagttcgcgctcgagctgtttgacacattgagccgccgccgtcagatgcaggtcgacaaaatcaacaaggaggagctgcgcgagatctggcaggtggataagaacgcggacggccggattggggaggaggaggtgaaagagattatcatgttaagtgcatctgccaacaagctgtccaggcttaaggagcaagctgaagagtatgccgccctgatcatggaggagcttgatcctgaaggacttggctacattgagttgtggcagttggagacccttctgttgcagaaggatacctacatgaactacagtcaggcgctaagttatacaagccaagcactaagtcagaacctagcaggcttaaggaaaaagagtccaattcgcaagataagtaccacattgagttactacttggaggataattggaaacgcctatgggtgcttgcattatggattggaataatggctggactgttcacttggaagttcatgcagtatcgcaacaggtatgtctttaatgtgatgggctactgcgtgaccactgcaaaaggcgctgctgaaaccctgaagctgaacatggcaattatcctcctcccagtatgccgtaacaccattacttggttgagaaatacaagggctgcacgggcattaccatttgatgataatataaacttccacaagactattgcagcagcaatcgttgttggtataatcctccatgcagggaatcaccttgtgtgtgattttccacgacttataaattcatcaaatgagaagtatgctcctctgggccagtacttcggtgaaacaaagccaacatactttagattggtcaaaggagtggaaggcatcactggtgtaattatggttatatgtatgattattgctttcactttagcaacacggtggttccgccgtagcctggtgaagcttccaaaaccatttgacaaactgactggcttcaatgccttctggtactctcatcacttattcataattgtgtatttggctctcgttgttcatggccagttcctgtacctcattcatgactggtaccgaaaaacgacatggatgtatctggcagtgcctgtttgcttgtatgcaggggagagggtgctgaggttcttcaggtctggcagttattctgtcaggctattgaaggtggccatatatcctggtaatgtgttgacactgcaaatgtccaagcctcctgctttccgatacaagagtgggcaatatatgtttgttcaatgtccagcagtgtcaccctttgaatggcatccgttctcaattacttcagcgcctggggatgattatctcagcattcatgttcgacaacttggtgactggacacgagagctgaagagggtttttgcagcagcttgtgaacccccagtgggtggtaaaagtggccttcttagagcagatgagacaaccaagaaagccttaccaaaacttctgattgatggaccttatggttctcctgctcaggattacagcaagtatgatgttcttctacttgttggattaggaattggtgcaactccttttatcagcatactgaaagatcttcttaataatatcataaggatggaggaagaggaggatgcttccactgatctttatcctccagttggtccgaataagccgcacattgatctgagcacacttatgacggtaacatcaagaccaaagagggttctaaggaccacaaacgcttacttttattgggttacacgtgagcaaggttcttttgattggttcaagggagtcatgaatgagattgctgaactggaccaaaggaatatcattgagatgcataactacctcacgagtgtttatgaggaaggggatgctcggtcagcgctcatcaccatgcttcaagctttgaaccatgcaaagaatggtgttgacattgtctctggaactaaagtccggacacactttgcaagaccaaattggaaaaaagtcctatctaaaattgcctccaagcatccacatgccaagataggtgtattctactgtggagctccagttcttgcacaagaactaaacaaactgtgccacgaattcaatgggaaaagcacaacgaaatttgagttccacaaggagcatttctga

SEQ ID NO: 7576 - protein, 927 aa, Sorghum bicolor
  misc_feature: Ceres ANNOT ID no. 6079796
  misc_feature (723)..(910): Pfam Id: NAD_binding_6 Pfam Desc: Ferric reductase NAD binding domain
  misc_feature (601)..(717): Pfam Id: FAD_binding_8 Pfam Desc: FAD-binding domain
  misc_feature (164)..(260): Pfam Id: NADPH_Ox Pfam Desc: Respiratory burst NADPH oxidase
  misc_feature (404)..(560): Pfam Id: Ferric_reduct Pfam Desc: Ferric reductase like transmembrane component
  misc_feature (1)..(927): NCBI GI: 114432120 NCBI Desc: respiratory burst oxidase protein b [zea mays]
  misc_feature (199)..(927): NCBI GI: 2654870 NCBI Desc: rbohaosp [oryza sativa]
  misc_feature (199)..(927): NCBI GI: 115439771 NCBI Desc: os01g0734200 [oryza sativa (japonica cultivar-group)]
  misc_feature (3)..(927): NCBI GI: 116805085 NCBI Desc: respiratory burst oxidase-like protein c [zea mays]
  misc_feature (195)..(927): NCBI GI: 125859103 NCBI Desc: respiratory burst oxidase homologue a [hordeum vulgare subsp. vulgare]
MRGGAAPGHQRWSGSAGTTPRSLSTGSSPRGSERSSDDGEELVEVTLDLQEDDTIILRSVEPAAAGAANGLPLGARGDHAGGASSSSRSRSPSIRRTSSHRLLQFSQELKAEAMSIARQFSQDLTKRFGRTQSRAEGQGQQQQQPSSGIESALAARAARRQRAQLDRTRSGAHKALRGLRFISSNKANNAWMEVQANFDRLACDGFLSRSDFAECIGMTESKEFALELFDTLSRRRQMQVDKINKEELREIWQVDKNADGRIGEEEVKEIIMLSASANKLSRLKEQAEEYAALIMEELDPEGLGYIELWQLETLLLQKDTYMNYSQALSYTSQALSQNLAGLRKKSPIRKISTTLSYYLEDNWKRLWVLALWIGIMAGLFTWKFMQYRNRYVFNVMGYCVTTAKGAAETLKLNMAIILLPVCRNTITWLRNTRAARALPFDDNINFHKTIAAAIVVGIILHAGNHLVCDFPRLINSSNEKYAPLGQYFGETKPTYFRLVKGVEGITGVIMVICMIIAFTLATRWFRRSLVKLPKPFDKLTGFNAFWYSHHLFIIVYLALVVHGQFLYLIHDWYRKTTWMYLAVPVCLYAGERVLRFFRSGSYSVRLLKVAIYPGNVLTLQMSKPPAFRYKSGQYMFVQCPAVSPFEWHPFSITSAPGDDYLSIHVRQLGDWTRELKRVFAAACEPPVGGKSGLLRADETTKKALPKLLIDGPYGSPAQDYSKYDVLLLVGLGIGATPFISILKDLLNNIIRMEEEEDASTDLYPPVGPNKPHIDLSTLMTVTSRPKRVLRTTNAYFYWVTREQGSFDWFKGVMNEIAELDQRNIIEMHNYLTSVYEEGDARSALITMLQALNHAKNGVDIVSGTKVRTHFARPNWKKVLSKIASKHPHAKIGVFYCGAPVLAQELNKLCHEFNGKSTTKFEFHKEHF

SEQ ID NO: 7577 - DNA, 1347 bp, Sorghum bicolor
  misc_feature: Ceres ANNOT ID no. 6079804
  misc_feature: Encodes the peptide sequence at SEQ ID NO 7578
atgcgcccgcttatccgaaccgctcgctgctggctcctccgcgcgcgtgttcgcgccatggccacgcttcccatggcgccccccgccgccgccatctcctccttcaccacccgctccctctactccccttcttcgcgttctcaccgcctcctcctcgcccgcttcttctccgccgcgccggcgcctgccggggcgagagcgctccgagcggcagcctccgccgttgaggtgggcggcgtcaagatcgcgcgcgaggatgttgtgaaggagaatgacccgacaaacaacgtgccagacactatcttttcaaagattggcttgcagctgcacaggagggataaccatccccttgggatcctgaagaacacggtttatgattactttgacaagaacttcactggacagtttgacaagtttgatgacctttgcccccttgtttccgtcaagcagaattttgatgatgtcttggtcccatctgaccatgtaagtcggagttacaatgacacatattatgttgatggtcaaacagtcttaaggtgtcatactagcgctcatcaagctgagctgctaagggatggacatacacactttcttgtaactggagatgtttaccgtagggattccattgattcaactcactatcctgtcttccatcagatggaaggcttccgtgtcttctctcctgatgaatggtcaggttctggcatggatgggacagcatatgcagctgcggaactcaagaaaatgctggaaggcttggcaagacatctatttggtgctgtagagatgcgatgggttgacacttacttcccatttaccaacccatccttcgagcttgaaatatattttcaggatgattggttggaggttttggggtgtggagtcaccgagcaggaaattttgaaaagaaatggcaggagtgaccatgtggcatgggcctttggattgggactggagcgccttgcaatggtcctttttgacattccagatattcgactcttctggtcgaatgataaacggttcacgtcccagttctcagaaggcaagcttggtgtcaagttcaagccattttcaaagtttcctccttgttacaaggatatgagtttctggatcaatgatgcatttacagagaacaatttatgtgaggttgtcagaggaattgctggcgatcttgttgaggaggtaaaacttattgataatttcaccaacaagaaaggcatgacaagtcattgctacagaatagcctataggtcaatggaacggtcgctcacagacgaggagattaacaatcttcagttgaatgtcagggaagctgtgaaagataaattgaaagtagagttgagatag

SEQ ID NO: 7578 - protein, 448 aa, Sorghum bicolor
  misc_feature: Ceres ANNOT ID no. 6079804
  misc_feature (94)..(345): Pfam Id: tRNA-synt_2d Pfam Desc: tRNA synthetases class II core domain (F)
  misc_feature (358)..(448): Pfam Id: FDX-ACB Pfam Desc: Ferredoxin-fold anticodon binding domain
  misc_feature (1)..(448): NCBI GI: 77556017 NCBI Desc: phenylalanyl-trna synthetase [oryza sativa (japonica cultivar-group)]
  misc_feature (25)..(448): NCBI GI: 115488878 NCBI Desc: os12g0533700 [oryza sativa (japonica cultivar-group)]
  misc_feature (57)..(448): NCBI GI: 6735326 NCBI Desc: phenylalanine-trna synthetase-like protein [arabidopsis thaliana]
  misc_feature (78)..(448): NCBI GI: 145342464 NCBI Desc: phenylalanine-trna synthetase, probable [ostreococcus lucimarinus cce9901]
  misc_feature (82)..(448): NCBI GI: 119358855 NCBI Desc: phes phenylalanine-trna synthetase, probable (ic) [ostreococcus tauri]
MRPLIRTARCWLLRARVRAMATLPMAPPAAAISSFTTRSLYSPSSRSHRLLLARFFSAAPAPAGARALRAAASAVEVGGVKIAREDVVKENDPTNNVPDTIFSKIGLQLHRRDNHPLGILKNTVYDYFDKNFTGQFDKFDDLCPLVSVKQNFDDVLVPSDHVSRSYNDTYYVDGQTVLRCHTSAHQAELLRDGHTHFLVTGDVYRRDSIDSTHYPVFHQMEGFRVFSPDEWSGSGMDGTAYAAAELKKMLEGLARHLFGAVEMRWVDTYFPFTNPSFELEIYFQDDWLEVLGCGVTEQEILKRNGRSDHVAWAFGLGLERLAMVLFDIPDIRLFWSNDKRFTSQFSEGKLGVKFKPFSKFPPCYKDMSFWINDAFTENNLCEVVRGIAGDLVEEVKLIDNFTNKKGMTSHCYRIAYRSMERSLTDEEINNLQLNVREAVKDKLKVELR

SEQ ID NO: 7579 - DNA, 633 bp, Sorghum bicolor
  misc_feature: Ceres ANNOT ID no. 6079823
  misc_feature: Encodes the peptide sequence at SEQ ID NO 7580
atggcgaccgagatccaaggatactgctccgacgacgacacctacgtggtgtctttcgacgaggactgcttcgaggcaacgctcaccaaatccggcggcgaggtggagtcgtggctggaggagacctaccgcatccaccgccgctgccgccatatgctcatcgtcggcctcgacgtggagtggcgccccgccgcgcccgtgccgggccccgtcgccgtgctgcagatctgcgtcgaccgccgctgcctcgtcttccagatcctccgcgccgactacgtacccgacgcgctgtccgacttcctggctgatcgccggttcaccttcgtcggggtcgggatccgcgacgacgcggccaagctgcgggacgggtacgggctggaggtgccgcgcacggtggacctgcgccgccttgccgcgcgcacgctcgggaagcccgacctccgccgcgccgggctgcagaggctggtgtgggaggtgctgggcgtgcagatggagaagccgcaccacgtccgcgtcagcgcctgggacaagcgcaagctgtcgaaggcccagttcaagtacgcctgcgccgacgcgttcgcgtccatggaggtcggccaggagctctacacctgccactgcggcgacgagtga

SEQ ID NO: 7580 - protein, 210 aa, Sorghum bicolor
  misc_feature: Ceres ANNOT ID no. 6079823
  misc_feature (15)..(205): Pfam Id: 3_5_exonuc Pfam Desc: 3'-5' exonuclease
  misc_feature (1)..(207): NCBI GI: 38344132 NCBI Desc: osjnbb0072n21.11 [oryza sativa (japonica cultivar-group)]
  misc_feature (1)..(207): NCBI GI: 116309147 NCBI Desc: osigba0101a01.4 [oryza sativa (indica cultivar-group)]
  misc_feature (12)..(203): NCBI GI: 115439805 NCBI Desc: os01g0737700 [oryza sativa (japonica cultivar-group)]
  misc_feature (1)..(200): NCBI GI: 115439803 NCBI Desc: os01g0737600 [oryza sativa (japonica cultivar-group)]
  misc_feature (12)..(190): NCBI GI: 115436114 NCBI Desc: os01g0299700 [oryza sativa (japonica cultivar-group)]
MATEIQGYCSDDDTYVVSFDEDCFEATLTKSGGEVESWLEETYRIHRRCRHMLIVGLDVEWRPAAPVPGPVAVLQICVDRRCLVFQILRADYVPDALSDFLADRRFTFVGVGIRDDAAKLRDGYGLEVPRTVDLRRLAARTLGKPDLRRAGLQRLVWEVLGVQMEKPHHVRVSAWDKRKLSKAQFKYACADAFASMEVGQELYTCHCGDE

SEQ ID NO: 7581 - DNA, 627 bp, Sorghum bicolor
  misc_feature: Ceres ANNOT ID no. 6079824
  misc_feature: Encodes the peptide sequence at SEQ ID NO 7582
atggcgaccagtatctaccgcaccgaagacggccacttcgtggtgtggttcgacgaggacgccatccacacgacgctcacggactccggcgccgcggtggactcgtggctggacgagatccgccgcgtccaccgccgccgcctcaaccgcctcatcgtcggcatcgacgtcgagtggcgcccgtccaggaccaccaccaaccacgtgccaccggtcgccctgctgcagatctgcgtcggccgccgctgcctcgtcttcaagatcctccacgccgactacgtcccgcagtcgctgtccgacttcctcgccgaccagcgcttcgccttcgtgggcgtcggcgtccgcgacgacgcggccaagctgcggtccgggtacgggctcaaggtcgggcgcatggtcgacctgcgcaccctcgccgccaccaagctccggaagcccgcgctgcgcggcgccgggctgcaggcgctggtgtcggaggtgatgggcgtcgagatggagaagccgcaccatgtccgtgtcagcgcgtgggacgcgcccaagctcacgtatgaccagctcaagtacgcctgcgccgacgccttcgcgtcgttcgaggttggccggaggctcttcgacggagactactag

SEQ ID NO: 7582 - protein, 208 aa, Sorghum bicolor
  misc_feature: Ceres ANNOT ID no. 6079824
  misc_feature (31)..(207): Pfam Id: 3_5_exonuc Pfam Desc: 3'-5' exonuclease
  misc_feature (1)..(201): NCBI GI: 115439803 NCBI Desc: os01g0737600 [oryza sativa (japonica cultivar-group)]
  misc_feature (1)..(208): NCBI GI: 115439805 NCBI Desc: os01g0737700 [oryza sativa (japonica cultivar-group)]
  misc_feature (1)..(204): NCBI GI: 38344132 NCBI Desc: osjnbb0072n21.11 [oryza sativa (japonica cultivar-group)]
  misc_feature (1)..(204): NCBI GI: 116309147 NCBI Desc: osigba0101a01.4 [oryza sativa (indica cultivar-group)]
  misc_feature (10)..(191): NCBI GI: 115436114 NCBI Desc: os01g0299700 [oryza sativa (japonica cultivar-group)]
MATSIYRTEDGHFVVWFDEDAIHTTLTDSGAAVDSWLDEIRRVHRRRLNRLIVGIDVEWRPSRTTTNHVPPVALLQICVGRRCLVFKILHADYVPQSLSDFLADQRFAFVGVGVRDDAAKLRSGYGLKVGRMVDLRTLAATKLRKPALRGAGLQALVSEVMGVEMEKPHHVRVSAWDAPKLTYDQLKYACADAFASFEVGRRLFDGDY

SEQ ID NO: 7583 - DNA, 612 bp, Sorghum bicolor
  misc_feature: Ceres ANNOT ID no. 6079826
  misc_feature: Encodes the peptide sequence at SEQ ID NO 7584
atggcgaccaggatcgcgatcgcccacaccaacgacggccgctacatggtgtttttcgacgatgactctatcctcacgacgcttacagactccggcgacgtggtggactcgtggctggacgagatctaccgcatccaccgccgccgcctcaaacgcctcgtcgttggcctggacgtggagtggcgcccgtcctactcccgctacgacgcacccccagtagccgtgctgcaaatgtgcgtcgaccaccgctgcctcgtctttcagatcctccacgccgactacctgcctgacgcgctcttcgacttcctcgccgacgaccgcctcaccttcgtcggcgtcgggatccacggcgacgtggccaagctgcgagccgggtacgggctggagcctggaggtggggaatgcggtggaccttcgccatctcgccgcgcacgagctcgggaacttcgggctgcgccgggccggatggagaagccgtaccatgtccgtaggagcccctgggactcgcgccagctgtcgtacgaccagctgaagtacgcctgcgccgatgcgttcgcgtcgttcgaggtaggccggaggcacattggagatcacatcatcagatatatctga

SEQ ID NO: 7584 - protein, 203 aa, Sorghum bicolor
  misc_feature: Ceres ANNOT ID no. 6079826
  misc_feature (1)..(194): NCBI GI: 115439803 NCBI Desc: os01g0737600 [oryza sativa (japonica cultivar-group)]
  misc_feature (12)..(198): NCBI GI: 115439805 NCBI Desc: os01g0737700 [oryza sativa (japonica cultivar-group)]
  misc_feature (1)..(193): NCBI GI: 38344132 NCBI Desc: osjnbb0072n21.11 [oryza sativa (japonica cultivar-group)]
  misc_feature (1)..(193): NCBI GI: 116309147 NCBI Desc: osigba0101a01.4 [oryza sativa (indica cultivar-group)]
  misc_feature (27)..(188): NCBI GI: 92889199 NCBI Desc: 3-5 exonuclease [medicago truncatula]
MATRIAIAHTNDGRYMVFFDDDSILTTLTDSGDVVDSWLDEIYRIHRRRLKRLVVGLDVEWRPSYSRYDAPPVAVLQMCVDHRCLVFQILHADYLPDALFDFLADDRLTFVGVGIHGDVAKLRAGYGLEPGGGECGGPSPSRRARARELRAAPGRMEKPYHVRRSPWDSRQLSYDQLKYACADAFASFEVGRRHIGDHIIRYI

SEQ ID NO: 7585 - DNA, 1686 bp, Sorghum bicolor
  misc_feature: Ceres ANNOT ID no. 6079835
  misc_feature: Encodes the peptide sequence at SEQ ID NO 7586
  misc_feature: Up-regulated in root tissues in response to salicylic acid treatment
atggcgtcgtcccacatcatcctgcccaaggaggaggaggaggaggagaaggaggcggcggcggtggcggaggccgggttgggcgtgggggtggaggcggaccacgactccccggcgcagcggccgtaccaggagcaggcgccagggaaggcggcgttgccgttctcggcaacgtgcgtccggatctcccgcgactcgtacccgaacctccgcgcgctgcggaacgcgtccaccatggcactccacgatgatgacgccgccttcgtcaaaatcgaggagggtgacttcggatacgtgctcgacgacgtcccgcacctcaccgactacctcccggacctccccacttttcctaatcctttgcaagatcatccggcgtattcaactgtcaagcaatattttgtcaatgcagatgatacagtccctgaaaaggtggttgttcagaagaacagtccgcgaggagttcacttccgtcgtgctggacctcgtcagagggtgtattttgagtcagaagaagtgaaagcttgcattgtaacctgtggaggcctttgccctgggctcaatactgtcatcagagagttggtgtgtggcttgtcccacatgtacaacgttagcaatgtctttggaatacagaatgggtacaaggggttctattcgagcaattatcttcccatgacaccaaagagtgtgaatgatatccacaaacgaggtggtacggttcttggaacatcacgaggtggccatgataccaaaaagatcgttgacaacattcaagatcgtggaattaatcaggtgtacattataggaggagatggaactcagaagggtgcatatgagatttacaaggaaattcggagacgtggtctacatgtagctgttgctggtattcccaagactattgataatgatatagcggttatagacaagtcatttggttttgatactgctgtagaagaagcccagcgtgccatcaatgcagctcatgtggaagcttcaagtgctgaaaatgggatagggttagtgaagcttatgggtcgctatagtgggtttattgccatgtatgctactcttgcaagcagagatgtggactgctgcttgattcctgagtcacccttttatttggaaggggagggtggactatttgagtatatagataggaggttgaaggagaacaaccacatggttattgttgtggcggagggagctggacaggatcttattgctcaaagtatacctgctgcagatcagcaagatgcatctggaaataagctgcttcttgatgttggtctctggttgactcacaagattaaggattattgcaagagcaagaagatggagatgactattaaatacatagatccaacctacatgatccgtgctattccaagcaatgcatcagacaatgtctattgcacactgctcgcacatagtgccattcatggtgcaatggcaggatacagctttacagtcggaatggttaatggcaggcatgcatatataccatttcatagggtgacatctacaaggaacaaggtgaggataactgacaggatgtgggcgaggctgctgtcttcaaccaaccagccgagtttcctgagccagaaggacatcgacgcggcaagagaagccgataaggcggccaatgcgaagaaccaatctgcaccagcgttggcaaatggtgagaaataa

SEQ ID NO: 7586 - protein, 561 aa, Sorghum bicolor
  misc_feature: Ceres ANNOT ID no. 6079835
  misc_feature (173)..(426): Pfam Id: PFK Pfam Desc: Phosphofructokinase
  misc_feature (90)..(551): NCBI GI: 92877935 NCBI Desc: phosphofructokinase [medicago truncatula]
  misc_feature (90)..(550): NCBI GI: 92893972 NCBI Desc: phosphofructokinase [medicago truncatula]
  misc_feature (90)..(546): NCBI GI: 19699124 NCBI Desc: at4g26270/t25k17_80 [arabidopsis thaliana]
  misc_feature (90)..(535): NCBI GI: 10176767 NCBI Desc: pyrophosphate-dependent phosphofructo-1-kinase-like protein [arabidopsis thaliana]
  misc_feature (90)..(532): NCBI GI: 22136390 NCBI Desc: pyrophosphate-dependent phosphofructo-1-kinase-like protein [arabidopsis thaliana]
  misc_feature: Up-regulated in root tissues in response to salicylic acid treatment
MASSHIILPKEEEEEEKEAAAVAEAGLGVGVEADHDSPAQRPYQEQAPGKAALPFSATCVRISRDSYPNLRALRNASTMALHDDDAAFVKIEEGDFGYVLDDVPHLTDYLPDLPTFPNPLQDHPAYSTVKQYFVNADDTVPEKVVVQKNSPRGVHFRRAGPRQRVYFESEEVKACIVTCGGLCPGLNTVIRELVCGLSHMYNVSNVFGIQNGYKGFYSSNYLPMTPKSVNDIHKRGGTVLGTSRGGHDTKKIVDNIQDRGINQVYIIGGDGTQKGAYEIYKEIRRRGLHVAVAGIPKTIDNDIAVIDKSFGFDTAVEEAQRAINAAHVEASSAENGIGLVKLMGRYSGFIAMYATLASRDVDCCLIPESPFYLEGEGGLFEYIDRRLKENNHMVIVVAEGAGQDLIAQSIPAADQQDASGNKLLLDVGLWLTHKIKDYCKSKKMEMTIKYIDPTYMIRAIPSNASDNVYCTLLAHSAIHGAMAGYSFTVGMVNGRHAYIPFHRVTSTRNKVRITDRMWARLLSSTNQPSFLSQKDIDAAREADKAANAKNQSAPALANGEK

SEQ ID NO: 7587 - DNA, 1017 bp, Sorghum bicolor
  misc_feature: Ceres ANNOT ID no. 6079842
  misc_feature: Encodes the peptide sequence at SEQ ID NO 7588
atgaggatctgcgaattgggagacggtgacggggggctggtgcttcagcaggagcagcaggaggaggctgttcaggcgagcggtggcggcgagctcgtacggcttaaggcgaagcgcgcgctcgtcggcgccggcgcgagggtgctgttctacccgacgctgctctacaacgtcttgcgcaaccggtacgaggccgacttccggtggtgggatcgcgtcgaccagtttattttgcttggcgctgttccttttccaagtgatgttccacgattgaagcagcttggagttcaaggggttgtaacgttgaatgaaccttatgaaactcttgtcccaacatctttataccaggcgaatgagattgagcacctggtaattccaacaagagattatctctttgcaccttcactcgaggatatttctcaagccatagatttcatccaccggaatgcattacaaggcggtactacgtatgttcattgtaaagctggaagaggacgaagcaccactattgtattgtgctacttgattaaatacaggaacatgacccctgaagcagctttggatcatgtccgatccattaggcctagagtgcttttggcaccatcgcagtggcatgctgttaggtcatttggaagtctcaccactggacaacttccagttcggagtacgaacctgggctgcttcttagaagccattgaagctcgttgtatgaacacggaaaatgatgattaccacgtgatggagtttgactgcgaagatagtggcttaccactttctcaaattatgctatctaagccagccagccccactgggtgcaccgatgcagtcctcataacagaagcagatcttgagggctatgatacttatattggtactaggaaagatgccgtgtcattggtagtagccactcgcaggcccatcatgaggagattgtcctgcctctttggctccctgaaacttaacagcagcagttgtgaaccagcttcaagccggttcactgaggttcgtgcctgctag

SEQ ID NO: 7588 - protein, 338 aa, Sorghum bicolor
  misc_feature: Ceres ANNOT ID no. 6079842
  misc_feature (72)..(213): Pfam Id: DSPc Pfam Desc: Dual specificity phosphatase, catalytic domain
  misc_feature (1)..(288): NCBI GI: 115464977 NCBI Desc: os05g0524200 [oryza sativa (japonica cultivar-group)]
  misc_feature (1)..(254): NCBI GI: 74318858 NCBI Desc: dual-specificity protein-like phosphatase 4 [zea mays]
  misc_feature (9)..(338): NCBI GI: 102139981 NCBI Desc: dual specificity protein phosphatase family protein [musa acuminata]
  misc_feature (17)..(210): NCBI GI: 144924691 NCBI Desc: tyrosine specific protein phosphatase and dual specificity protein phosphatase [medicago truncatula]
  misc_feature (7)..(214): NCBI GI: 74318850 NCBI Desc: dual-specificity protein-like phosphatase 1 [zea mays]
MRICELGDGDGGLVLQQEQQEEAVQASGGGELVRLKAKRALVGAGARVLFYPTLLYNVLRNRYEADFRWWDRVDQFILLGAVPFPSDVPRLKQLGVQGVVTLNEPYETLVPTSLYQANEIEHLVIPTRDYLFAPSLEDISQAIDFIHRNALQGGTTYVHCKAGRGRSTTIVLCYLIKYRNMTPEAALDHVRSIRPRVLLAPSQWHAVRSFGSLTTGQLPVRSTNLGCFLEAIEARCMNTENDDYHVMEFDCEDSGLPLSQIMLSKPASPTGCTDAVLITEADLEGYDTYIGTRKDAVSLVVATRRPIMRRLSCLFGSLKLNSSSCEPASSRFTEVRAC

SEQ ID NO: 7589 - DNA, 396 bp, Sorghum bicolor
  misc_feature: Ceres ANNOT ID no. 6079847
  misc_feature: Encodes the peptide sequence at SEQ ID NO 7590
atgtcgtggcagacgtacgtcgacgagcacctcatgtgcgagatcgagggccaccacctcacctccgccgccatcatcggccacgacggcaccgtctgggcccagagcaccgcgttcccgcagttcaagcctgaggagatgaccaacatcatgaaggacttcgacgagcccgggttcctggccccgaccggcctcttcctcggccccaccaagtacatggtcatccaaggcgagcccggcgccgtcatccgcgggaagaagggatctggaggcataaccgtgaagaagaccggacaggcgctggtgatcggcatctacgacgagcccatgacccccgggcagtgcaacatggtggtcgagaggctcggcgactacctcgtagagcaaggcctgtaa

SEQ ID NO: 7590 - protein, 131 aa, Sorghum bicolor
  misc_feature: Ceres ANNOT ID no. 6079847
  misc_feature (2)..(126): Pfam Id: Profilin Pfam Desc: Profilin
  misc_feature (1)..(131): NCBI GI: 11141757 NCBI Desc: profilin a [oryza sativa]
  misc_feature (1)..(131): NCBI GI: 313142 NCBI Desc: profilin 3 [zea mays]
  misc_feature (1)..(131): NCBI GI: 110644960 NCBI Desc: pollen profilin variant 5 [zea mays]
  misc_feature (1)..(131): NCBI GI: 146386311 NCBI Desc: pollen-specific profilin3 [zea mays]
  misc_feature (1)..(131): NCBI GI: 110644958 NCBI Desc: pollen profilin variant 4 [zea mays]
  misc_feature: The plant is abnormally small.
  misc_feature: The plant produces a reduced number of seeds.
  misc_feature: Useful for biocontainment applications
  misc_feature: Useful for making plants with modulated biomass
  misc_feature: Functional homolog of the protein sequence given in SEQ ID NO 13035
  misc_feature: Useful for biocontainment applications
  misc_feature: Useful for making plants with modulated biomass
  misc_feature: Functional homolog of the protein sequence given in SEQ ID NO 13035
MSWQTYVDEHLMCEIEGHHLTSAAIIGHDGTVWAQSTAFPQFKPEEMTNIMKDFDEPGFLAPTGLFLGPTKYMVIQGEPGAVIRGKKGSGGITVKKTGQALVIGIYDEPMTPGQCNMVVERLGDYLVEQGL

SEQ ID NO: 7591 - DNA, 1020 bp, Sorghum bicolor
  misc_feature: Ceres ANNOT ID no. 6079860
  misc_feature: Encodes the peptide sequence at SEQ ID NO 7592
atgggagactccaaagaaagagaacctcttccacggctgcttgatcttatcccggatgggaaacaatgtaaggggagggaagcacaaggcgcaggaagatcatcaaggaacacaggctttgggagcgaggaggacaagcacctagagctcaaactcggtcctccgggtctcgtcgaacaaggggcgacagcagcagcgtcaagagggatacagcgagagattccggctctctcgcttggttgcttcccacataaaccctcctccaagcctgcaataaacactactgcgactgggacaaagagggggttcttagacaccattgaggccaaaacagaaggtcgtgatgagcagaagcagcaggctggagctggatgtgggaaggaactagcactggaccagaagataacagccgcgagcgagagaaagaaaggattctgcccgccaacatcacagcatgcccctcctcctgctgctgcaactgtgcacgacagatcacacgcccagggaagaaggtcttcagctccggttgtcggttggcctccagtgagatccttcaggagaaatcttgctcatggcagttcatccaaacaatccattgagccacaaaatactgaagctagcatgaaggagaagcttgcctgcaagaagaatcctcttgtaaaaatcaacatggatggaatccccattggaaggaaagtagaccttggagcctatgacagctacgagaggctatcattgggcgtcaaagagcttttccatggttttcttgaagctcaaaaggatctatctagtgctggaagtacacagccaggggccactgaaaaaatattttctcaattattggatggatctggtgaatatactctagtttaccaagacaatgaaggagacaggatgctggtaggggatgtgccgtggaatgtatttgtgtcaactgctaaaaggctgagggttttgaggagctcagagctttcccatggtttgattgcagtagctcctagaagaggaccagattgctga

SEQ ID NO: 7592 - protein, 339 aa, Sorghum bicolor
  misc_feature: Ceres ANNOT ID no. 6079860
  misc_feature (92)..(332): Pfam Id: AUX_IAA Pfam Desc: AUX/IAA family
  misc_feature (4)..(334): NCBI GI: 75246515 NCBI Desc: auxin-responsive protein iaa6 (indoleacetic acid-induced protein 6)
  misc_feature (5)..(333): NCBI GI: 75252102 NCBI Desc: auxin-responsive protein iaa18 (indoleacetic acid-induced protein 18)
  misc_feature (139)..(339): NCBI GI: 75258740 NCBI Desc: auxin-responsive protein iaa7 (indoleacetic acid-induced protein 7)
  misc_feature (170)..(328): NCBI GI: 2618725 NCBI Desc: iaa18 [arabidopsis thaliana]
  misc_feature (113)..(328): NCBI GI: 21593333 NCBI Desc: phytochrome-associated protein 1 (pap1) [arabidopsis thaliana]
  misc_feature: The sequence is a functional homolog of SEQ ID NO 1149 in the 10/412,699US patent application
  misc_feature: The sequence is a functional homolog of SEQ ID NO 736 in the 10/374,780US patent application
  misc_feature: The sequence is a functional homolog of SEQ ID NO 737 in the 10/374,780US patent application
  misc_feature: The sequence is a functional homolog of SEQ ID NO 738 in the 10/374,780US patent application
  misc_feature: The sequence is a functional homolog of SEQ ID NO 739 in the 10/374,780US patent application
  misc_feature: The sequence is a functional homolog of SEQ ID NO 742 in the 10/374,780US patent application
  misc_feature: Useful for making plants with altered alkaloid content
  misc_feature: Useful for making plants with modulated growth and phenotype characteristics
  misc_feature: Functional homolog of the protein sequence given in SEQ ID NO 13232
  misc_feature: The sequence is a functional homolog of SEQ ID NO 1149 in the 20040045049 US patent application
  misc_feature: The sequence is a functional homolog of SEQ ID NO 736 in the 20060162006 US patent application
  misc_feature: The sequence is a functional homolog of SEQ ID NO 737 in the 20060162006 US patent application
  misc_feature: The sequence is a functional homolog of SEQ ID NO 738 in the 20060162006 US patent application
  misc_feature: The sequence is a functional homolog of SEQ ID NO 739 in the 20060162006 US patent application
  misc_feature: Useful for making plants with altered lignin content
  misc_feature: Useful for making plants with modulated nitrogen use efficiency
  misc_feature: Functional homolog of the protein sequence given in SEQ ID NO 13704
MGDSKEREPLPRLLDLIPDGKQCKGREAQGAGRSSRNTGFGSEEDKHLELKLGPPGLVEQGATAAASRGIQREIPALSLGCFPHKPSSKPAINTTATGTKRGFLDTIEAKTEGRDEQKQQAGAGCGKELALDQKITAASERKKGFCPPTSQHAPPPAAATVHDRSHAQGRRSSAPVVGWPPVRSFRRNLAHGSSSKQSIEPQNTEASMKEKLACKKNPLVKINMDGIPIGRKVDLGAYDSYERLSLGVKELFHGFLEAQKDLSSAGSTQPGATEKIFSQLLDGSGEYTLVYQDNEGDRMLVGDVPWNVFVSTAKRLRVLRSSELSHGLIAVAPRRGPDC

SEQ ID NO: 7593 - DNA, 1521 bp, Sorghum bicolor
  misc_feature: Ceres ANNOT ID no. 6079866
  misc_feature: Encodes the peptide sequence at SEQ ID NO 7594
atggggaagggcgcggtcgtggggacggctgtggtggtgggcgccgcggctgccgcggcggtgggggtggcggtggtgtcgctgtcgcgcaggaggcgtcggcggcgggaggcggaggacgagaggaagaggaaggcggccgcggtgatcgaggaggtggagcagcggttctcgacgcccaccgcgctgctccgcggcatcgcggacgccatggtggaggagatggagcgcggcctccgcgccgagccccacgcgccgctcaagatgctcatcagctacgtcgacaacctcccaaccggtgatgaacaaggactgttttatgcactggaccttggcgggaccaactttcgtgtcatacgggttcaacttggaggaagggataaacgtgtcgtgaagcaacaatatgaagaggtctccattccgcctcatcttatggttggaacttctacggaactgtttgatttcattgctgctgagctggaaaaattcgtgcggactgaaggagaagatttccacctaccaaatggcaagcagagagaactgggtttcactttttctttcccagtgcaccaaacatctatatcatcagggactctaattaagtggaccaaaggcttttccatcaatggcacggttggagaagatgttgtggctgaattgagtagagccatggaaaggcagggtcttgatatgaaagttgcagctctggttaatgataccgtaggcacattggctggtgggagatatgctgataatgatgttgttactgctgtaatattgggcactggcacaaatgcagcttatgtggaacatgcaaatgcgattcctaaatggaccggactactgcctagatcagggaatatggtaatcaacatggaatggggaaacttcaggtcagataaacttccaatgtcagagtatgataaatccttggactttgaaagtttgaaccctggtgagcagatatatgaaaagatgatttctggaatgtatcttggagaaattgtgcggaggatcctgctgaaactggctcatgatgcttcattgtttggggatgttgttcctccgaaattggaacagctatttatactgaggacgccagatatgtcagccatgcatcatgacacctcacatgatctcaagcacctgggagctaagctgaaggatattctgggggttcctgatacttctctcgaagcaagatacattactcttcatgtgtgcgacctcgtcgcagagagaggtgcacgcttggctgctgctggtatatatggtattctgaagaagcttggcaaagacaaattgcttagtgacttcagtcaacaaaggactgtagttgctattgatggtggcttatacgagcattacaagaagttcagtgcctgcctagaagcgacgcttacagacctgctcggcgaggaggttgcctcatcggttgttgtcaagttggccaacgacggctcaggaatcggagctgcacttcttgcagcctcacactcccagtatgctgaagttgcatag

SEQ ID NO: 7594 - protein, 506 aa, Sorghum bicolor
  misc_feature: Ceres ANNOT ID no. 6079866
  misc_feature (44)..(251): Pfam Id: Hexokinase_1 Pfam Desc: Hexokinase
  misc_feature (258)..(501): Pfam Id: Hexokinase_2 Pfam Desc: Hexokinase
  misc_feature (1)..(505): NCBI GI: 75157445 NCBI Desc: hexokinase-6 (hexokinase-2)
  misc_feature (1)..(505): NCBI GI: 13991925 NCBI Desc: hexokinase i [oryza sativa]
  misc_feature (10)..(502): NCBI GI: 21954124 NCBI Desc: hexokinase [zea mays]
  misc_feature (10)..(504): NCBI GI: 110808552 NCBI Desc: hexokinase-2 (hexokinase-3)
  misc_feature (1)..(505): NCBI GI: 11066213 NCBI Desc: hexokinase [citrus sinensis]
  misc_feature (1)..(505): SWISSPROT Homolog: EC 2.7.1.1 Hexokinase-6
  misc_feature: The sequence is a functional homolog of SEQ ID NO. 321 in the 11/188,298 US application
MGKGAVVGTAVVVGAAAAAAVGVAVVSLSRRRRRRREAEDERKRKAAAVIEEVEQRFSTPTALLRGIADAMVEEMERGLRAEPHAPLKMLISYVDNLPTGDEQGLFYALDLGGTNFRVIRVQLGGRDKRVVKQQYEEVSIPPHLMVGTSTELFDFIAAELEKFVRTEGEDFHLPNGKQRELGFTFSFPVHQTSISSGTLIKWTKGFSINGTVGEDVVAELSRAMERQGLDMKVAALVNDTVGTLAGGRYADNDVVTAVILGTGTNAAYVEHANAIPKWTGLLPRSGNMVINMEWGNFRSDKLPMSEYDKSLDFESLNPGEQIYEKMISGMYLGEIVRRILLKLAHDASLFGDVVPPKLEQLFILRTPDMSAMHHDTSHDLKHLGAKLKDILGVPDTSLEARYITLHVCDLVAERGARLAAAGIYGILKKLGKDKLLSDFSQQRTVVAIDGGLYEHYKKFSACLEATLTDLLGEEVASSVVVKLANDGSGIGAALLAASHSQYAEVA

SEQ ID NO: 7595 - DNA, 456 bp, Sorghum bicolor
  misc_feature: Ceres ANNOT ID no. 6079880
  misc_feature: Encodes the peptide sequence at SEQ ID NO 7596
atggattattctaatttgcgtcgccaggctgcatccatgaaaaagagtctctttgatcaggggtacctagatgagcaattttgccaggtggaagacttgcaggacgaagctagtcctaattttgccgaagaggttgtcactttgtttttcaaggattcagccaggctaatatcaaatgttgaacaagctctggaaaaataccccaaagatttcaatagatgggatgcatacatgcagcagctaaaaggcagctgttccagcattggtgcttcaaggatgaagagtgagtgcatgtcattcagggattactgtgcacagggaaatgttgaaggttgcatgagatcgttccagaaagtgaagagggagcacggtgccctgaggcagaaactagaggcctatttccagctgctacgacaagctggtcctgctggagctgccaccaggcctgggatgtaa

SEQ ID NO: 7596 - protein, 151 aa, Sorghum bicolor
  misc_feature: Ceres ANNOT ID no. 6079880
  misc_feature (44)..(129): Pfam Id: Hpt Pfam Desc: Hpt domain
  misc_feature (17)..(149): NCBI GI: 115439883 NCBI Desc: os01g0743800 [oryza sativa (japonica cultivar-group)]
  misc_feature (6)..(135): NCBI GI: 9279718 NCBI Desc: histidine-containing phosphotransfer protein-like [arabidopsis thaliana]
  misc_feature (21)..(135): NCBI GI: 115462463 NCBI Desc: os05g0186100 [oryza sativa (japonica cultivar-group)]
  misc_feature (1)..(146): NCBI GI: 13774348 NCBI Desc: histidine-containing phosphotransfer protein [catharanthus roseus]
  misc_feature (6)..(136): NCBI GI: 140071469 NCBI Desc: hpt [medicago truncatula]
  misc_feature: The sequence is a functional homolog of SEQ ID NO. 465 in the 11/188,298 US application
MDYSNLRRQAASMKKSLFDQGYLDEQFCQVEDLQDEASPNFAEEVVTLFFKDSARLISNVEQALEKYPKDFNRWDAYMQQLKGSCSSIGASRMKSECMSFRDYCAQGNVEGCMRSFQKVKREHGALRQKLEAYFQLLRQAGPAGAATRPGM

SEQ ID NO: 7597 - DNA, 2169 bp, Sorghum bicolor
  misc_feature: Ceres ANNOT ID no. 6079891
  misc_feature: Encodes the peptide sequence at SEQ ID NO 7598
atgcctggtatgccgacggacggtgtcggcgcaatcgtaccttttacaggggagcctggccaaggggcgccacccgtgcggccaatccgccacggcgtgccgccgcccatcttccgcatctacgtctcctggtccagcggcaaccttctgcaggtcgcgtgcctccgcccgccgaattcggaaggtggcggcggcacagaggaggtcgttgggagtgtggtggaggtgaatctcggcgacggtggctcggaggccgaggagaaaattgacgaggcggagatgcggcggatcgagtacgggtcggtgccggccttcgcgctgctgcagagcaggaagaacaccctcgcagatgctgctactatgtcgcacttgccctcagtccccgatcatgcagaatggtggcaatatgtgcttgaatacagcaaaaccattggcaatctccttgggaacccagaccctcctgttttcatgattgaagaccccaagacaattcttaaggttagggaaaaaccgacaagtttaagggctgcttgggagttgttggagatattctatgttgataaacatttgcaaggctggcttcctgagcgtcttgttgattggttagccgattttgacagcctgttgtcaacgatggcgagcacggtgtactctaagctcagcaatttccagaaaaaactcattaacttgcagattgttgaagatgatcctgattactggaatggtttgtcagcagcactttcagttggatggcttgatattgtggtgaatatgctacggtttcatggatcgtaccaattagatcagatggataaccgtgagacagaaaatggattggtcgaggctgttgctgttcttgtatcaacgatgccccgcttgagaccaaatttgccatctggtaaattaggtcagtgctgcaaaacaagacctgattttatcaaggcatgggaaaagtggcgaggtcaagtaactaaactggagtgcagtgcattttggatccagtgtggccaccaaaaaacccgtgatggtttgaagaatttgcttcatattatgatggggaacataaacgaactcactgatgctacttaccattggctggagctgtttgcttctcattttctttatataaaaccatttacagtgggttttgaagggatgcaccatttagcacagaaatgcatacagcttaagccatcctctagcactaatggattaacaggcctcattcttggtgtcctttcagaaaatacagaggttgtcttggcagaatgcacaaaaaattttggcccttggctggtcacacatgctatggaacttctgacagctgataatgactatgcggatgttatgttgcatgaagagagacctaacttaggtggtataagcatagaggaactgcaccggctagtctatgctcaagttttgtgttctcattctttaacttggcagattgcgcctacttatctgtcctcatgtctaaaccaaggcctaggactcttggagattctacttctcaagcaacccatacaagataattgcctagtactcaagactttggaaatttgccgattgtacgaactggagaatgttagtacaatcatcatgaagattgctggcatttatcattggaagcatggacgaaaaggaactggtgtatactggttccagcaagctcatgataaaatttgccttgacagaattgctcaacagttgttcgaacacattgggaagtcagtgacagatgatagttttaagcaatgggaaggactgctcgagctccttggttctgacattggtagtgcaggcggtcttgagttccttcacaggtaccgggatttcaagaggtctctgcaacaagctctagacagaaggtgtggtgaggctgctcgacaaactgtggattttttaatacagcttatgaaaaacccatccacaccgcaacgtttctggctacctcttctacatgactcggtggagctacttaatagcaaactctgccctcttatgaatgttgctgagacgacattgttgctcaacaagctacaagagctatcaatggccaagctgcgccctgatttttccagtaatcacctaccaagccatgcgataagctctgtgagattggctttggcatcaaatctggcacgtgccattcttggagacccgtaa

SEQ ID NO: 7598 - protein, 722 aa, Sorghum bicolor
  misc_feature: Ceres ANNOT ID no. 6079891
  misc_feature (86)..(682): Pfam Id: Nucleopor_Nup85 Pfam Desc: Nup85 Nucleoporin
  misc_feature (1)..(722): NCBI GI: 21902047 NCBI Desc: osjnba0014k08.23 [oryza sativa (japonica cultivar-group)]
  misc_feature (4)..(721): NCBI GI: 123720792 NCBI Desc: nucleoporin [lotus japonicus]
  misc_feature (8)..(719): NCBI GI: 13605599 NCBI Desc: at4g32910/f26p21_30 [arabidopsis thaliana]
  misc_feature (278)..(719): NCBI GI: 51260235 NCBI Desc: pericentrin 1 [mus musculus]
  misc_feature (307)..(719): NCBI GI: 49522801 NCBI Desc: mgc69530 protein [xenopus tropicalis]
MPGMPTDGVGAIVPFTGEPGQGAPPVRPIRHGVPPPIFRIYVSWSSGNLLQVACLRPPNSEGGGGTEEVVGSVVEVNLGDGGSEAEEKIDEAEMRRIEYGSVPAFALLQSRKNTLADAATMSHLPSVPDHAEWWQYVLEYSKTIGNLLGNPDPPVFMIEDPKTILKVREKPTSLRAAWELLEIFYVDKHLQGWLPERLVDWLADFDSLLSTMASTVYSKLSNFQKKLINLQIVEDDPDYWNGLSAALSVGWLDIVVNMLRFHGSYQLDQMDNRETENGLVEAVAVLVSTMPRLRPNLPSGKLGQCCKTRPDFIKAWEKWRGQVTKLECSAFWIQCGHQKTRDGLKNLLHIMMGNINELTDATYHWLELFASHFLYIKPFTVGFEGMHHLAQKCIQLKPSSSTNGLTGLILGVLSENTEVVLAECTKNFGPWLVTHAMELLTADNDYADVMLHEERPNLGGISIEELHRLVYAQVLCSHSLTWQIAPTYLSSCLNQGLGLLEILLLKQPIQDNCLVLKTLEICRLYELENVSTIIMKIAGIYHWKHGRKGTGVYWFQQAHDKICLDRIAQQLFEHIGKSVTDDSFKQWEGLLELLGSDIGSAGGLEFLHRYRDFKRSLQQALDRRCGEAARQTVDFLIQLMKNPSTPQRFWLPLLHDSVELLNSKLCPLMNVAETTLLLNKLQELSMAKLRPDFSSNHLPSHAISSVRLALASNLARAILGDP

SEQ ID NO: 7599 - DNA, 1209 bp, Sorghum bicolor
  misc_feature: Ceres ANNOT ID no. 6079903
  misc_feature: Encodes the peptide sequence at SEQ ID NO 7600
atgcaggtcgccgtcaacaccagcactgtcggcgctcaccagcacccaacaaagtcctccttcctccggccatcccctccttgccgcgtctacttccacgcttctccacgtccgaagaacctgagggcgattgccatggccaccaagtcgcagcttcaggagcaactggtcatcactcggcccgacgattggcatctccatcttcgtgaaggcggtgtcctcgaggctgtagtgccacacagcgcgaggcattttgggagggccatcatcatgcccaacttgaagcccccggtgaccacaacggcgcgggcggtggaatacagggaggagataatgagggcgctgccgccagggagtagcttcgagccgctcatgacactgtacctgacagacaacacaagtccagaggagatcaagctcgcaagaaagagtggtataatctttgctgtgaagctatatcctgctggagcaactaccaattcccaagatggcgtcactgatatatttgggaagtgcttgccagtcctcgaggagatggtcaggcaggaaatgccattgcttgttcatggagaagtcacagatccacatgttgacacctttgaccgtgagaaggttttcattgacaaaatattggcaccacttgtacaaaaacttccacagctgaaaattgtcatggaacatatcacaaccatggatgcagtgaacttcatagaatcatgtgaagaaggtcatgttgctgcaacagtgactccccagcatctcctcctcaataggaatgctttatttcagggtggcttgcagccacacaattattgtttgcccgtactgaaaagagagactcataggcaagctattgtatctgctgtaacaaatgggagtagacggtactttcttggtactgacagcgctccccatgataaacagaacaaagaatgttcctgtggatgtgcaggaatatatagtgctcctgttgccttgtctctttatgcgaaggtatttgaagaggctggtgccctagataagctagaaacatttacaagcttcaatggccccgatttttatggcctcccaaggaacacttcaaagattgtcttgagaaagaatgcctggaaagttcctggaacttataaacacagttcaggggagattgtgcctatgtttagtggcagcacccttgagtggcttccatctgatcagcctaaagagtaa

SEQ ID NO: 7600 - protein, 402 aa, Sorghum bicolor
  misc_feature: Ceres ANNOT ID no. 6079903
  misc_feature (63)..(398): Pfam Id: Amidohydro_1 Pfam Desc: Amidohydrolase family
  misc_feature (1)..(402): NCBI GI: 115439907 NCBI Desc: os01g0747500 [oryza sativa (japonica cultivar-group)]
  misc_feature (55)..(396): NCBI GI: 7269140 NCBI Desc: dihydroorotase [arabidopsis thaliana]
  misc_feature (55)..(396): NCBI GI: 110736546 NCBI Desc: dihydroorotase [arabidopsis thaliana]
  misc_feature (55)..(397): NCBI GI: 17977977 NCBI Desc: dihydroorotase [beta vulgaris]
  misc_feature (56)..(398): NCBI GI: 91776632 NCBI Desc: dihydroorotase, homodimeric type [methylobacillus flagellatus kt]
  misc_feature (55)..(396): SWISSPROT Homolog: EC 3.5.2.3 Dihydroorotase, mitochondrial precursor
MQVAVNTSTVGAHQHPTKSSFLRPSPPCRVYFHASPRPKNLRAIAMATKSQLQEQLVITRPDDWHLHLREGGVLEAVVPHSARHFGRAIIMPNLKPPVTTTARAVEYREEIMRALPPGSSFEPLMTLYLTDNTSPEEIKLARKSGIIFAVKLYPAGATTNSQDGVTDIFGKCLPVLEEMVRQEMPLLVHGEVTDPHVDTFDREKVFIDKILAPLVQKLPQLKIVMEHITTMDAVNFIESCEEGHVAATVTPQHLLLNRNALFQGGLQPHNYCLPVLKRETHRQAIVSAVTNGSRRYFLGTDSAPHDKQNKECSCGCAGIYSAPVALSLYAKVFEEAGALDKLETFTSFNGPDFYGLPRNTSKIVLRKNAWKVPGTYKHSSGEIVPMFSGSTLEWLPSDQPKE

SEQ ID NO: 7601 - DNA, 2478 bp, Sorghum bicolor
  misc_feature: Ceres ANNOT ID no. 6079911
  misc_feature: Encodes the peptide sequence at SEQ ID NO 7602
atggcggccagctccctctcgtccccggcggccagccgaacgccgaacctgaaatcagcgccggcgccgtcaccatccccatccacccgccggatggcagcagatgcggcgtcggcggcggctgcggtggccgcggcggactcgaaggcacggttcgaggcttacaaccggctgcaggcagcggcggtggcgttcggcgagaagctccccatcccagagatagtggcgataggaggccagtctgatgggaagagctctctcctcgaggcgctccttggctttcgcttcaacgtccgcgaggtcgagatgggcacccgccgtcctctcgttctccagatggtccacgaccccaccgccctcgagcccagatgccgattccaggaggaggactccgaggaatacgggagcccgatggtaatggctacggccatcgccgacctcatcaagcagcggactgaatcacacctccggaagatccaggccgctgtctcatccaagcccatcgttatgagggctgagtacgcccactgccccaacctcacaatcatcgacaccccaggtttcgtgcttaaggctaagagaggcgagccagagagcacaccggatgagatacggtcgatggtgaagtccctcgcgacccctccccaccgcctcgttctgttcctccagcaaagcagcgtcgagtggtgctcgtcgatctggctcgacacgcttaaagagattgatcctactttcaggcgcaccatgatagtcatctccaagtttgacaaccgcctcaaggaattcacggagaggtgggaggtcgataccttcttgagtgcaagtggctaccttggggataatatccacccgttcttcgtggctcttccaaaggaccgtggaacaatttccaatgaggagttccggaggcagatctgtcaggttgatattgatgtgctacgtcacttgcgagataatgtaaaagggggtttcaatgaagagaaatatggatcgtacattgggttcagctgcctcaggaagtacctcgagtctgaacttcagaagaggtacaaagaagcaactccagctacactggcattgttagagcagaggtgcactgatgtctcaatggacctaacaagactagattccaaactacaagcaacgtctgatgtctctcagctccggagatcggcaatgcttcatgcagcttctatttgcacacacttgcatgcattacttgatggagctgctgatccagctccagaaatatgggggaaaactactgaggaggaacagatgcatagtggtattggcagctggcctggcattaatatgcctgtaaaacctgccaactccagccttaagttgtatggcggtgcagcttttgagagagtaatgcatgaatttcgctgtgcaacatattcaatggaatgcccacaagtgtcaagggagaaggttgcgaacatactacttgcccatgctggaagaggtggaagcagtaggttgactgaggcagcagctgagatagctcgggcggctgcaagatcatggcttgctcctcttattgatactgcatgtgaccggcttgcatttgtcctacaaagtctatttgatctcgctatggagcgcaaccgcaataaggacgcacaatatcatcaaaatgttgaagatatggatagttatgttggctttcttgctgctctccggtgctcatattataagtttgtcaaagaattgtccaagcaatgcaagcagatagtgcgtcatcaccttgattcagttacgagcccctactcccatatttgctatgacaacgactttttgagtggtgttggatctgtagcaaactccatgagtaggtttaatcactttactggagttacatcctttgatctagcggacagtggatcagctttagaggaagctcaggagaacttgcctccaagagatcagcagcatatgacaccacctaataaagggaatgagtcaaaggaggttctcagagaaagccaactaacagtacctgagacgccttctcctgatcttccatctgatgtacatggtggtaagaagaaagataatgggatcccaaatgacggtggcccaaggaaaagacaagcaaggatggcagcatatacaaacagaaatcaccataacagtatgattgctgctgatgacatgggctcgaagtcagggtcatcatactccaccatatgcgcaatatctgctcaatattttgccaaaatgcgagaagtcctgattgaaagaaatgttccctctgcattgaactctggattcttaacaccatgccgtgaaaggttatttctggcacttggctttgagctattcgctgtgagtgatgacaagttcatggacatgtttgtcgcccctggggcagttgatgctatccagaatgagcgccaatctcttctcaaacgtcagaagattttgctgtcctgtttgaacgagtttaagaacatatcccgggctctgtag

SEQ ID NO: 7602 - protein, 825 aa, Sorghum bicolor
  misc_feature: Ceres ANNOT ID no. 6079911
  misc_feature (74)..(255): Pfam Id: Dynamin_N Pfam Desc: Dynamin family
  misc_feature (1)..(825): NCBI GI: 57899504 NCBI Desc: dynamin-like [oryza sativa (japonica cultivar-group)]
  misc_feature (1)..(766): NCBI GI: 115439915 NCBI Desc: os01g0748000 [oryza sativa (japonica cultivar-group)]
  misc_feature (1)..(825): NCBI GI: 102139994 NCBI Desc: dynamin family protein [musa acuminata]
  misc_feature (23)..(825): NCBI GI: 15219207 NCBI Desc: dynamin family protein [arabidopsis thaliana]
  misc_feature (128)..(589): NCBI GI: 28829020 NCBI Desc: similar to arabidopsis thaliana (mouse-ear cress). f8l10.1 protein [dictyostelium discoideum]
MAASSLSSPAASRTPNLKSAPAPSPSPSTRRMAADAASAAAAVAAADSKARFEAYNRLQAAAVAFGEKLPIPEIVAIGGQSDGKSSLLEALLGFRFNVREVEMGTRRPLVLQMVHDPTALEPRCRFQEEDSEEYGSPMVMATAIADLIKQRTESHLRKIQAAVSSKPIVMRAEYAHCPNLTIIDTPGFVLKAKRGEPESTPDEIRSMVKSLATPPHRLVLFLQQSSVEWCSSIWLDTLKEIDPTFRRTMIVISKFDNRLKEFTERWEVDTFLSASGYLGDNIHPFFVALPKDRGTISNEEFRRQICQVDIDVLRHLRDNVKGGFNEEKYGSYIGFSCLRKYLESELQKRYKEATPATLALLEQRCTDVSMDLTRLDSKLQATSDVSQLRRSAMLHAASICTHLHALLDGAADPAPEIWGKTTEEEQMHSGIGSWPGINMPVKPANSSLKLYGGAAFERVMHEFRCATYSMECPQVSREKVANILLAHAGRGGSSRLTEAAAEIARAAARSWLAPLIDTACDRLAFVLQSLFDLAMERNRNKDAQYHQNVEDMDSYVGFLAALRCSYYKFVKELSKQCKQIVRHHLDSVTSPYSHICYDNDFLSGVGSVANSMSRFNHFTGVTSFDLADSGSALEEAQENLPPRDQQHMTPPNKGNESKEVLRESQLTVPETPSPDLPSDVHGGKKKDNGIPNDGGPRKRQARMAAYTNRNHHNSMIAADDMGSKSGSSYSTICAISAQYFAKMREVLIERNVPSALNSGFLTPCRERLFLALGFELFAVSDDKFMDMFVAPGAVDAIQNERQSLLKRQKILLSCLNEFKNISRAL

SEQ ID NO: 7603 - DNA, 534 bp, Sorghum bicolor
  misc_feature: Ceres ANNOT ID no. 6079921
  misc_feature: Encodes the peptide sequence at SEQ ID NO 7604
atgactgatgtggaaccgttggttctggctcatgtgatacgtgatgtgttggattcttttacaccaactatccccctcagaatagcctacaacaataggctacttctagctggtgttgagttgaagccatccgcagttgtgaataatccaagagttgatgttgggggcaccgacctcagggtgttctatacactggtattagttgatccagatgccccaagcccaagcaatccatcactgagggagtatttgcattggatggtgatagatattccaggaacaactggagccaactttggccaggagctcatgttttacgaaaggccagaaccgagatctggtatacaccgcatggtatttgtgctgttccggcaacttggtagggggacagtttttgcaccagacatgcgacataacttcaactgcaagaactttgcacgtcaataccacctagacattgtggctgccacatatttcaactgtcaaagggaagcaggatctggagggagaaggttcaggcccgaaagttcgtaa

SEQ ID NO: 7604 - protein, 177 aa, Sorghum bicolor
  misc_feature: Ceres ANNOT ID no. 6079921
  misc_feature (18)..(162): Pfam Id: PBP Pfam Desc: Phosphatidylethanolamine-binding protein
  misc_feature (1)..(177): NCBI GI: 89514801 NCBI Desc: ft-like protein 3 [hordeum vulgare subsp. vulgare]
  misc_feature (3)..(171): NCBI GI: 38347694 NCBI Desc: flowering locus t [populus nigra]
  misc_feature (3)..(171): NCBI GI: 38256990 NCBI Desc: flowering locus t [populus nigra]
  misc_feature (3)..(171): NCBI GI: 41323980 NCBI Desc: floweing locus t-like protein ft1 [populus deltoides]
  misc_feature (3)..(171): NCBI GI: 38524448 NCBI Desc: flowering locus t [populus nigra]
  misc_feature: Useful for making plants with modulated flowering time
  misc_feature: Functional homolog of the protein sequence given in SEQ ID NO 13388
  misc_feature: Functional homolog of the protein sequence given in SEQ ID NO 13391
  misc_feature: The sequence is a functional homolog of SEQ ID NO 2 in US patent 7196246
  misc_feature: Useful for making plants with modulated flowering time
  misc_feature: Functional homolog of the protein sequence given in SEQ ID NO 13388
  misc_feature: The sequence is a functional homolog of SEQ ID NO 2 in US patent 7208653
MTDVEPLVLAHVIRDVLDSFTPTIPLRIAYNNRLLLAGVELKPSAVVNNPRVDVGGTDLRVFYTLVLVDPDAPSPSNPSLREYLHWMVIDIPGTTGANFGQELMFYERPEPRSGIHRMVFVLFRQLGRGTVFAPDMRHNFNCKNFARQYHLDIVAATYFNCQREAGSGGRRFRPESS

SEQ ID NO: 7605 - DNA, 1674 bp, Sorghum bicolor
  misc_feature: Ceres ANNOT ID no. 6079924
  misc_feature: Encodes the peptide sequence at SEQ ID NO 7606
atgagcctcgcgggctccgccctggaggcggcgctacaggcggtggggcgcggcctcgacgcagctggagaccaccggctgctctactgcaagggagccggaaggctcgtggcgctcgaggaggaccgtgcgcgggacctccgtctccccgacggcggcgtcctcccgagcgtgccccccgacgtcgaggtcgagcagtgccgcagagacccccagcgcatccgcccgttcccctccggcccaggctccgccgtagcggacgcgcccttcgtctgcagcttcgataagatggctgagtatttcaacttgaagtcatgcttgtccgagacagtaccgctgggttccttcaactctctgttcagcttcaccggttcatggaagaatgatgcggcggccacgaaggcccttgcgatcgatggctattctctgcctctgtttcgagtgaaaattaggagttctgaactgacactgcttgagagcgttaagcgcgcgatcccaaatgtttgggatccatcagcattggctagctttattgagaactatggtacccatattattatctctgttacggttggtggtaaggatgaggtatacattaagcagcattcatcgtcccaattgtcagagctggagttcaaaaattatgtgagggaaattgggagggaaagattctcagatgtggaaaataagtcaaatgcaactcctatcaattacagcgagaaggatatgacagtaatattcagaaggaggggtggttgcgatcttgttcaaagttttagtgattggaaaggaactgttgcctcagcaccagatgtcataggcatgacctttctctcaattgtctctcttgttgacgatataccaggaaagaagcaccttgctcgtgcagttgagctatacttgacctacaaacctccaattgaagaattacagtacttcttagattttcaagtcccactagtttgggctccagccccaccgggtattgctggtcaccacaggaaggaacctgtctgtccatcacttcagtttagcttaatgggcccaaagctcttcattagcacagaacagatctctgttgggcgtcgaccagttgttggcctcaaactgctcttggaaggagccaaacagaatcgtctggctattcatttgcagcaccttggatcattaccaaagatattcctacctcattgggactcccatattaccattggacctccaaaatggcaaggtcctgaagaacaggacagcagatggttcgagccaatcaaatggaagaactttgctcatgttagcacagcacccatagagtacactgaaacaaatattacggacctatctggtgtttatattgttacaggagcacagttgggagtgtgggattttggtgcaaagagtgttctccatcttaaacttttgttctccagggttcctgggtgcacaattagaagatcagtgtgggaccacagcccatcaagttcttcgattcataaaacagacgaatcttcatcatcctcaagtgataatgccaaacttctgaagatcgttgacatgacagaaacattgaagggcccacaagatgcgcctggccactggctgatcacaggtgctaagttgggtgttgagaaaggcaggattgttgtgcgtgcaaagtactccttattgaattattaa

SEQ ID NO: 7606 - protein, 557 aa, Sorghum bicolor
  misc_feature: Ceres ANNOT ID no. 6079924
  misc_feature (133)..(302): Pfam Id: MACPF Pfam Desc: MAC/Perforin domain
  misc_feature (1)..(557): NCBI GI: 14209545 NCBI Desc: p0481e12.26 [oryza sativa (japonica cultivar-group)]
  misc_feature (11)..(557): NCBI GI: 140053390 NCBI Desc: aldehyde oxidase and xanthine dehydrogenase, a/b hammerhead; membrane attack complex component/perforin/complement c9 [medicago truncatula]
  misc_feature (231)..(491): NCBI GI: 92870237 NCBI Desc: membrane attack complex component/perforin/complement c9 [medicago truncatula]
  misc_feature (199)..(494): NCBI GI: 92895124 NCBI Desc: membrane attack complex component/perforin/complement c9 [medicago truncatula]
  misc_feature (6)..(383): NCBI GI: 15809820 NCBI Desc: at1g29690/f15d2_24 [arabidopsis thaliana]
MSLAGSALEAALQAVGRGLDAAGDHRLLYCKGAGRLVALEEDRARDLRLPDGGVLPSVPPDVEVEQCRRDPQRIRPFPSGPGSAVADAPFVCSFDKMAEYFNLKSCLSETVPLGSFNSLFSFTGSWKNDAAATKALAIDGYSLPLFRVKIRSSELTLLESVKRAIPNVWDPSALASFIENYGTHIIISVTVGGKDEVYIKQHSSSQLSELEFKNYVREIGRERFSDVENKSNATPINYSEKDMTVIFRRRGGCDLVQSFSDWKGTVASAPDVIGMTFLSIVSLVDDIPGKKHLARAVELYLTYKPPIEELQYFLDFQVPLVWAPAPPGIAGHHRKEPVCPSLQFSLMGPKLFISTEQISVGRRPVVGLKLLLEGAKQNRLAIHLQHLGSLPKIFLPHWDSHITIGPPKWQGPEEQDSRWFEPIKWKNFAHVSTAPIEYTETNITDLSGVYIVTGAQLGVWDFGAKSVLHLKLLFSRVPGCTIRRSVWDHSPSSSSIHKTDESSSSSSDNAKLLKIVDMTETLKGPQDAPGHWLITGAKLGVEKGRIVVRAKYSLLNY

SEQ ID NO: 7607 - DNA, 690 bp, Sorghum bicolor
  misc_feature: Ceres ANNOT ID no. 6079928
  misc_feature: Encodes the peptide sequence at SEQ ID NO 7608
atggctacggccgtcgcctcccctacgttcctctcctccgccttcgccccgcggcagcaccgccgcctgacccggctcgcgggcccgcgccgggccgccccggtgggactggccgtgcgatgcgagaagagcgacaagcagaagaggcagccgctctccgcgctcgtgccccgcgagcagcgcttcatgttcgagggagacgagctctgcggccccgacatatggaatacaacctggtatcctaaggctgcagatcatgtaaccacagagaagacatggtatgttgttgatgcaacagacaagattctaggcaggctagcatccaccattgcagtacatatcaggggaaaaaacgaacccacttacactcccagtgtggacatgggagcttttgttattgtggtcaatgcagagaaggttgctgtttctggtaaaaagcggtcacaaaagctctataggaggcactctggacggcctggagggatgaaagaagaaacttttgaccaacttcagaaaagaattccagagagaatcgtcgagcatgcggttcgtgggatgctccccaagggcaggctgggaagaaggttatttacccacctcaaggtatacaaaggggcagaacatccgcacgaggctcaaaaacctgtcccactcccaatcagggataaaagaatacaaaaaactggctag

SEQ ID NO: 7608 - protein, 229 aa, Sorghum bicolor
  misc_feature: Ceres ANNOT ID no. 6079928
  misc_feature (93)..(220): Pfam Id: Ribosomal_L13 Pfam Desc: Ribosomal protein L13
  misc_feature (56)..(226): NCBI GI: 132659 NCBI Desc: 50s ribosomal protein l13, chloroplast precursor (cl13)
  misc_feature (93)..(220): NCBI GI: 22297652 NCBI Desc: 50s ribosomal protein l13 [thermosynechococcus elongatus bp-1]
  misc_feature (93)..(220): NCBI GI: 81743999 NCBI Desc: 50s ribosomal protein l13
  misc_feature (90)..(220): NCBI GI: 75906941 NCBI Desc: ribosomal protein l13 [anabaena variabilis atcc 29413]
  misc_feature (90)..(220): NCBI GI: 81770186 NCBI Desc: 50s ribosomal protein l13
MATAVASPTFLSSAFAPRQHRRLTRLAGPRRAAPVGLAVRCEKSDKQKRQPLSALVPREQRFMFEGDELCGPDIWNTTWYPKAADHVTTEKTWYVVDATDKILGRLASTIAVHIRGKNEPTYTPSVDMGAFVIVVNAEKVAVSGKKRSQKLYRRHSGRPGGMKEETFDQLQKRIPERIVEHAVRGMLPKGRLGRRLFTHLKVYKGAEHPHEAQKPVPLPIRDKRIQKTG

SEQ ID NO: 7609 - DNA, 2733 bp, Sorghum bicolor
  misc_feature: Ceres ANNOT ID no. 6079930
  misc_feature: Encodes the peptide sequence at SEQ ID NO 7610
  misc_feature: Down-regulated in shoot tissues in response to aminocyclopropane carboxylic treatment
  misc_feature: Down-regulated in shoot tissues in response to salicylic acid treatment
atgatgtcgcggtcgtataccaacctgctcgacctcgcggagggcaacttcgcggcgctgggcccggccggcggcagcgggcggcagaggcagggatcgttcgggatgaggcggatgtcccgggtgatgacggtgccggggacgctgtcggagctcgacggcgaggacgagtcggagccggcggcgaccaacagcgttgcctccgacgcgccctcgtcgctggcagcggaccgcgtcatagtggtctcgaaccagttgcccatcgtcgcgcgtcgaaggcccgacggccgaggatggtccttctcatgggacgacgactcgcttctgctccagctccgcgacggcattcccgacgagatggaagtgctgttcgtcggttccctccgagccgatgtccccgtagcggagcaggacgaggtgtcgcaggcgctgctcgaccgattccgctgcgcaccggtgttcctacctgaccacctcaacgaccggttctaccacggcttctgcaagcgccaactctggcctctgtttcactacatgctccccttctcatcatccgcgtctgccgccaccacctcttcctccgtcgccccttcgtcaccaggcaacggtcgcttcgaccgcagcgcttgggaggcgtatgttctcgccaacaagttcttcttcgagaaggtcgtggaggtaatcaacccggaggaggactacgtctgggttcatgactaccatctcatggcgctgcctaccttcctccgccgccgcttcaaccgcctccgcatcggattcttcctccacagcccctttccctcgtccgagatctaccgcaccctccctgttcgcgaggagatattgaaggctctgctcaattgcgacctcattgggttccacactttcgattacgccaggcacttcctctcgtgctgcagtaggatgctgggaattgaataccagtccaagcgtgggtacattggattggattactttggccgcactgttgggatcaaaatcatgccagtgggaattcatatgggtcaattagagtcaggtctgcgcttgcctgatagagaatggagactttctgagcttcaacagcagttcgaggggagaactgtcttgcttggtgtggatgatatggatatctttaaggggatcaatttgaagcttcttgcctttgagaacatgttgaggacacatcccaagtggcaagggcgagcagtgttagtgcagattgctaacccggcccgtggaaggggtaaggatctggaagccatccaggctgagattgaggagagctgccgaaggatcaatggagactttggccagtcagggtatagcccggttgttttcatcgatcgtgatgtgtcaagtgttgagaagattgcctattatacgatagcggaatgtgtggtggtgactgctgtgagggatgggatgaacttgacaccatatgagtacattgtcagtaggcagggtgcaccaggatctgagtcagtatcagaggtgagtgggccaaagaagagcatgctggttgtgtcagagtttattggctgctcaccgtcactgagtggtgctattagggttaacccatggaatatagaggcaactgcagaggcgatgaatgaggccatttcaatgccagaacaggaaaaacagttgaggcatgagaagcattaccgttatgtcagcagccatgatgttgctttttggtcaaggagcttcatcctagacttgcaaagggcttgtcaggaccactttaagaggacttgttggggcatagggttgggttttggtttcagggtggtggccttggaccctcatttcacaaagctcaacatggatttgattgttaatgcttatgagatttcagagagcagggctatattgcttgattatgatggaactctggttcctcaaacttccatcaacaaggaacctagtccagaggttttgagcatcatcaataccctttgctctgatagtagaaacaccgtttttcttgtcagtggtcgagacaaagatacgttgggaaagtggttctcctcatgtccaaaattgggtattgcagctgaacatggttacttcttgaggtggtctagagaagaagagtggcaaacatgcactcaggccttggacttcggatggatgcaaatggcaaggcctgtgatgaatttgtatacagaagcaactgatggatcctacattgagacgaaggaaagtgccttggtgtggcaccatcaggatgctgacccaggctttggatcctcacaggcaaaggagatgcttgatcacctggaaagtgtattagcaaatgaaccagtctctgtcaagagtggccagttcattgtcgaagtcaaaccacagggagtaaccaagggaatagttgccgagaggatacttgcatcagtgaaggagagaggaaagcaggctgatttcgtattgtgcatcggcgatgataggtccgatgaggacatgtttgaaaatattgctgatatcattaataggaatgtggttgatccaagaacatcgctgtttgcgtgcactgtgggacaaaaaccaagcaaagccaaattctacctggacgatacattcgaagtggtcactatgctgagcgcacttgcagatgccacaggacctgaactggagactgattcggctgatgaattggccgcatctatctcttcacttgatattggtgacgaacaatcagaatccagtgatagaccaattggagggtcttag

SEQ ID NO: 7610 - protein, 910 aa, Sorghum bicolor
  misc_feature: Ceres ANNOT ID no. 6079930
  misc_feature (77)..(577): Pfam Id: Glyco_transf_20 Pfam Desc: Glycosyltransferase family 20
  misc_feature (626)..(861): Pfam Id: Trehalose_PPase Pfam Desc: Trehalose-phosphatase
  misc_feature (32)..(884): NCBI GI: 140048870 NCBI Desc: glycosyl transferase, family 20; trehalose-phosphatase [medicago truncatula]
  misc_feature (63)..(892): NCBI GI: 60265773 NCBI Desc: trehalose-6-phosphate synthase [ginkgo biloba]
  misc_feature (198)..(874): NCBI GI: 8927678 NCBI Desc: contains similarity to a trehalose-6-phosphate synthase mrna from arabidopsis thaliana gby08568 and contains a trehalose-6-phosphate synthase pf00982 domain. ests gbt76758,
  misc_feature (198)..(874): NCBI GI: 8927678 (continued) gbt21695, gbr30506, gbt42298, gbt42288 come from this gene
  misc_feature (33)..(874): NCBI GI: 42572029 NCBI Desc: glycosyl transferase family 20 protein / trehalose-phosphatase family protein [arabidopsis thaliana]
  misc_feature (57)..(874): NCBI GI: 55792824 NCBI Desc: trehalose 6-phosphate synthase [gossypium hirsutum]
  misc_feature: Useful for making plants with altered carbohydrate content
  misc_feature: Functional homolog of the protein sequence given in SEQ ID NO 13884
  misc_feature: Down-regulated in shoot tissues in response to aminocyclopropane carboxylic treatment
  misc_feature: Down-regulated in shoot tissues in response to salicylic acid treatment
MMSRSYTNLLDLAEGNFAALGPAGGSGRQRQGSFGMRRMSRVMTVPGTLSELDGEDESEPAATNSVASDAPSSLAADRVIVVSNQLPIVARRRPDGRGWSFSWDDDSLLLQLRDGIPDEMEVLFVGSLRADVPVAEQDEVSQALLDRFRCAPVFLPDHLNDRFYHGFCKRQLWPLFHYMLPFSSSASAATTSSSVAPSSPGNGRFDRSAWEAYVLANKFFFEKVVEVINPEEDYVWVHDYHLMALPTFLRRRFNRLRIGFFLHSPFPSSEIYRTLPVREEILKALLNCDLIGFHTFDYARHFLSCCSRMLGIEYQSKRGYIGLDYFGRTVGIKIMPVGIHMGQLESGLRLPDREWRLSELQQQFEGRTVLLGVDDMDIFKGINLKLLAFENMLRTHPKWQGRAVLVQIANPARGRGKDLEAIQAEIEESCRRINGDFGQSGYSPVVFIDRDVSSVEKIAYYTIAECVVVTAVRDGMNLTPYEYIVSRQGAPGSESVSEVSGPKKSMLVVSEFIGCSPSLSGAIRVNPWNIEATAEAMNEAISMPEQEKQLRHEKHYRYVSSHDVAFWSRSFILDLQRACQDHFKRTCWGIGLGFGFRVVALDPHFTKLNMDLIVNAYEISESRAILLDYDGTLVPQTSINKEPSPEVLSIINTLCSDSRNTVFLVSGRDKDTLGKWFSSCPKLGIAAEHGYFLRWSREEEWQTCTQALDFGWMQMARPVMNLYTEATDGSYIETKESALVWHHQDADPGFGSSQAKEMLDHLESVLANEPVSVKSGQFIVEVKPQGVTKGIVAERILASVKERGKQADFVLCIGDDRSDEDMFENIADIINRNVVDPRTSLFACTVGQKPSKAKFYLDDTFEVVTMLSALADATGPELETDSADELAASISSLDIGDEQSESSDRPIGGS

SEQ ID NO: 7611 - DNA, 1404 bp, Sorghum bicolor
  misc_feature: Ceres ANNOT ID no. 6079934
  misc_feature: Encodes the peptide sequence at SEQ ID NO 7612
atgggggactgcgttgtcgaggacggccacgggcaccaccaatcggaggcggtggagggcgcggttccgttgacggtagccgtggagctcgatgagcggtcgggagagtcgcgggaggagggtggcgggcagcggaagaaggttggtgggatccgaagggagccgtcgttctcgcggtggtgcagggacccctctgacgccgccgcctccaataccgccgctgctgcggcgaccagcgacagcgacgactcagaggagttcgagctgccgctcctgccatcctcctcgggcggcggcagctcaccgatggacattgaggcgggggcgacggcgagatctgatgatctgccgatctcgccgaggttgcttgcgaaggtcatcgggttgatagcgtgttggtacacgcttagcacatgcttgacgctgtacaacaaggagatgctggggaagcacatgtggaagttcccggcgccattcctgatgaacacagtgcatttcacgttgcaggctgtggcgtccagggccatcgtgtggttccagcaacgcggcctggagggagggccaagtaaaatgtcgtggaaggattactgtttacgagttgtcccaacagctttggctactgctcttgatataaatctgagcaacatttcacttgttttcattactgtgacatttgctacaatgtgcaaatcggcttctccaattttcattcttctgtttgcttttatgttcaggcttgagaaaccgagctttagccttcttggaatcatgctggttgtttcatttggagttctactaacagttgctaaagagacggaatttaatctgcggggatctatatttattatgcttgctgctgtaatgtctggtttccgctggtccatgactcagattcttctccaggttgattatcgattaaagaatccttttaccttgatgagccatgttaccccagtaatggcaatagtgacagcaattatttccattgtgatggatccatggcacgacttcagagcaagccacttttttgatagttctgctcacataataagaagcagcttgttgctgcttctaggtggcgctttggcctttttcatggttttgacagaatatgtccttgtttctgtgactagtgctgtaacagttactgtagcaggaattgtgaaggaagctgtcactattctggttgctgtgctattctttcatgatccatttacatggttaaaggcgcttgggctggcaataataatatttggtgtcagtctattcaatatttacaagtataaaaggttcaaaaaaggacatcacaatgaagatactgggacaaatatccaatcttccaatgggacttcaaagtacgttatccttgacgatgatactgaagcccaagatgatacaggctga

SEQ ID NO: 7612 - protein, 467 aa, Sorghum bicolor
  misc_feature: Ceres ANNOT ID no. 6079934
  misc_feature (278)..(425): Pfam Id: TPT Pfam Desc: Triose-phosphate Transporter family
  misc_feature (128)..(431): Pfam Id: UAA Pfam Desc: UAA transporter family
  misc_feature (1)..(467): NCBI GI: 115439939 NCBI Desc: os01g0749900 [oryza sativa (japonica cultivar-group)]
  misc_feature (1)..(301): NCBI GI: 57899516 NCBI Desc: phosphate translocator-related-like [oryza sativa (japonica cultivar-group)]
  misc_feature (201)..(465): NCBI GI: 115466482 NCBI Desc: os06g0153200 [oryza sativa (japonica cultivar-group)]
  misc_feature (364)..(461): NCBI GI: 6692687 NCBI Desc: f12k11.18 [arabidopsis thaliana]
  misc_feature (124)..(430): NCBI GI: 40217971 NCBI Desc: cas42p [cryptococcus neoformans var. neoformans]
  misc_feature: The sequence is a functional homolog of SEQ ID NO. 360 in the 11/188,298 US application
  misc_feature: The sequence is a functional homolog of SEQ ID NO. 484 in the 11/188,298 US application
MGDCVVEDGHGHHQSEAVEGAVPLTVAVELDERSGESREEGGGQRKKVGGIRREPSFSRWCRDPSDAAASNTAAAAATSDSDDSEEFELPLLPSSSGGGSSPMDIEAGATARSDDLPISPRLLAKVIGLIACWYTLSTCLTLYNKEMLGKHMWKFPAPFLMNTVHFTLQAVASRAIVWFQQRGLEGGPSKMSWKDYCLRVVPTALATALDINLSNISLVFITVTFATMCKSASPIFILLFAFMFRLEKPSFSLLGIMLVVSFGVLLTVAKETEFNLRGSIFIMLAAVMSGFRWSMTQILLQVDYRLKNPFTLMSHVTPVMAIVTAIISIVMDPWHDFRASHFFDSSAHIIRSSLLLLLGGALAFFMVLTEYVLVSVTSAVTVTVAGIVKEAVTILVAVLFFHDPFTWLKALGLAIIIFGVSLFNIYKYKRFKKGHHNEDTGTNIQSSNGTSKYVILDDDTEAQDDTG

SEQ ID NO: 7613 - DNA, 1152 bp, Sorghum bicolor
  misc_feature: Ceres ANNOT ID no. 6079951
  misc_feature: Encodes the peptide sequence at SEQ ID NO 7614
atggctcagcagcaaacaaatcctgaggaggtggtcctcggacaggaggccgggggcgcgagggtgatcactctcaaccgcccgcgccagctcaatggcatctccgacagagtggtgtacctccttgcgcagttcctggagaaatgggagaaggatgagaacgccaaattagtcatctttaagggcgctggacgtgcattttctgctggtggggacctaaagatgttttatgaagggaaatcaaatgattcctgcctcgaggttgtgtatagaatgtattggctttgctaccacattcatacgtacaagaaaaccacggttgctcttgttaatgggcttgtcatgggtggtggtgctgctatggttgcgccactaaagtttgcagttgtcacagagaaaacaatctttgctactcctgaggctagtgttggattgcacacagattgtagcttttcctacatccattctcggctccctggatatttaggcgagtacctggctttaactggtgctagactgaatgcgaaggaaatgatttctgctggtcttgctactcattttgtcagttccgaaaaattggaagaacttgaaaaacgtctactggatttggacactggtgaggagtctgcagtcagagctgttattgaagaattttcaacagatgttcaacctgatgaagatagtattttaaacaagctttcaattatcaacaaatgcttctctgcagagactgttgaggacatcataaaagcatttgaatcagaagcgagcatagatggaaaccaatggatagctccagtcctgaagggtctgagaagatcatctccaactgcactgaagatcaccctgagatcgatcagagaaggtcggagacagagtttgcctgaatgtttgactaaggaatttaggcttacaatgaatatactacggtctgttgttaatggggatgtttatgagggcattagagctctcagcattgataaagacaatgcccctaagtggaatccgacaacgcttgaggaggtgaagaacgaggacattgaccgtgtgttccagccgttcagttcggagcgggagcttcaggtcccatccgatgattccaacaggtggagcggcaaatacgagaacacagtctatggcagagcttcctag

SEQ ID NO: 7614 - protein, 383 aa, Sorghum bicolor
  misc_feature: Ceres ANNOT ID no. 6079951
  misc_feature (21)..(189): Pfam Id: ECH Pfam Desc: Enoyl-CoA hydratase/isomerase family
  misc_feature (1)..(379): NCBI GI: 30679729 NCBI Desc: enoyl-coa hydratase/isomerase family protein [arabidopsis thaliana]
  misc_feature (62)..(379): NCBI GI: 6692680 NCBI Desc: f12k11.12 [arabidopsis thaliana]
  misc_feature (12)..(351): NCBI GI: 115488084 NCBI Desc: os12g0264500 [oryza sativa (japonica cultivar-group)]
  misc_feature (9)..(365): NCBI GI: 115483330 NCBI Desc: os10g0552900 [oryza sativa (japonica cultivar-group)]
  misc_feature (12)..(363): NCBI GI: 55167904 NCBI Desc: at3g60510 [arabidopsis thaliana]
MAQQQTNPEEVVLGQEAGGARVITLNRPRQLNGISDRVVYLLAQFLEKWEKDENAKLVIFKGAGRAFSAGGDLKMFYEGKSNDSCLEVVYRMYWLCYHIHTYKKTTVALVNGLVMGGGAAMVAPLKFAVVTEKTIFATPEASVGLHTDCSFSYIHSRLPGYLGEYLALTGARLNAKEMISAGLATHFVSSEKLEELEKRLLDLDTGEESAVRAVIEEFSTDVQPDEDSILNKLSIINKCFSAETVEDIIKAFESEASIDGNQWIAPVLKGLRRSSPTALKITLRSIREGRRQSLPECLTKEFRLTMNILRSVVNGDVYEGIRALSIDKDNAPKWNPTTLEEVKNEDIDRVFQPFSSERELQVPSDDSNRWSGKYENTVYGRAS

SEQ ID NO: 7615 - DNA, 678 bp, Sorghum bicolor
  misc_feature: Ceres ANNOT ID no. 6079953
  misc_feature: Encodes the peptide sequence at SEQ ID NO 7616
atgaacacgtacatgtctctctccttggagagcagcagcagcaccaccaccagcagcgtggtccgcgacgtcgccacgcccgcgcctctgtccagcggtgccagtgcctcgtcgtatccacgggcgggcgcgggcatgggcatgggcacgtcgctctccctggccagcgccgcggcggcggcgcacgggcacggacagtacctccccctcaacgaggatgactccctggagatggtcctcttcgacgtgctccgcgaggcatccggctccgctgcggcgcccaccacctaccagccgccggcctcgtcgttgcctacgctgaagaaggcgctcgcttccggcgccgccgcgcgcaagggcggcggcggcggcgtcggttgcagcagcagggcagcgcacgcgccgaaggcggccacaacggggcggcactaccgcggggtgaggcggcggccgtggggcaagtacgccgcggagatccgtgaccccgcgcggcacggggcgcggctctggctcggcaccttcgccacggccgaggaggccgccgcggcgtacgaccgcgccgcgttccgcatgcggggcgccaaggcgctgctcaacttcccgccggcggtcgcgggctgcgggaacgccgcaaccgccacggcggagcaggctgctggggtgacggaagccaagtga

SEQ ID NO: 7616 - protein, 225 aa, Sorghum bicolor
  misc_feature: Ceres ANNOT ID no. 6079953
  misc_feature (142)..(194): Pfam Id: AP2 Pfam Desc: AP2 domain
  misc_feature (5)..(223): NCBI GI: 115439973 NCBI Desc: os01g0752500 [oryza sativa (japonica cultivar-group)]
  misc_feature (103)..(220): NCBI GI: 70663974 NCBI Desc: osjnba0079a21.16 [oryza sativa (japonica cultivar-group)]
  misc_feature (103)..(220): NCBI GI: 116310255 NCBI Desc: osigba0101c23.15 [oryza sativa (indica cultivar-group)]
  misc_feature (141)..(204): NCBI GI: 2213783 NCBI Desc: pti5 [lycopersicon esculentum]
  misc_feature (68)..(201): NCBI GI: 32401273 NCBI Desc: ethylene responsive protein [mesembryanthemum crystallinum]
  misc_feature: The plant flowers significantly late compared to wild-type.
  misc_feature: The plant is abnormally large.
  misc_feature: The sequence is a functional homolog of SEQ ID NO 10 in the 10/412,699US patent application
  misc_feature: The sequence is a functional homolog of SEQ ID NO 100 in the 10/412,699US patent application
  misc_feature: The sequence is a functional homolog of SEQ ID NO 1000 in the 10/412,699US patent application
  misc_feature: The sequence is a functional homolog of SEQ ID NO 1001 in the 10/412,699US patent application
  misc_feature: The sequence is a functional homolog of SEQ ID NO 124 in the 11/479,226US patent application
  misc_feature: The sequence is a functional homolog of SEQ ID NO 166 in the 10/714,887US patent application
  misc_feature: The sequence is a functional homolog of SEQ ID NO 166 in the 11/435,388US patent application
  misc_feature: The sequence is a functional homolog of SEQ ID NO 243 in the 11/479,226US patent application
  misc_feature: The sequence is a functional homolog of SEQ ID NO 34 in the 10/903,236US patent application
  misc_feature: The sequence is a functional homolog of SEQ ID NO 501 in the 10/374,780US patent application
  misc_feature: The sequence is a functional homolog of SEQ ID NO 502 in the 10/374,780US patent application
  misc_feature: The sequence is a functional homolog of SEQ ID NO 503 in the 10/374,780US patent application
  misc_feature: Useful for making plants with altered Lignin content
  misc_feature: Useful for making plants with altered alkaloid content
  misc_feature: Useful for making plants with altered cell wall content and/or composition
  misc_feature: Useful for making plants with modulated biomass
  misc_feature: Useful for making plants with modulated flowering time
  misc_feature: Useful for making plants with modulated growth and phenotype characteristics
  misc_feature: Useful for making plants with modulated drought sensitivity
  misc_feature: Functional homolog of the protein sequence given in SEQ ID NO 13225
  misc_feature: Functional homolog of the protein sequence given in SEQ ID NO 13265
  misc_feature: Functional homolog of the protein sequence given in SEQ ID NO 13268
  misc_feature: The sequence is a functional homolog of SEQ ID NO 10 in the 20040045049 US patent application
  misc_feature: The sequence is a functional homolog of SEQ ID NO 10 in the 20040045049 US patent application
  misc_feature: The sequence is a functional homolog of SEQ ID NO 100 in the 20040045049 US patent application
  misc_feature: The sequence is a functional homolog of SEQ ID NO 100 in the 20040045049 US patent application
  misc_feature: The sequence is a functional homolog of SEQ ID NO 1000 in the 20040045049 US patent application
  misc_feature: The sequence is a functional homolog of SEQ ID NO 1001 in the 20040045049 US patent application
  misc_feature: The sequence is a functional homolog of SEQ ID NO 34 in the 20050155117 US patent application
  misc_feature: The sequence is a functional homolog of SEQ ID NO 503 in the 20060162006 US patent application
  misc_feature: The sequence is a functional homolog of SEQ ID NO 1001 in the 10/412,699 US patent application
  misc_feature: The sequence is a functional homolog of SEQ ID NO 502 in the 10/374,780 US patent application
  misc_feature: The sequence is a functional homolog of SEQ ID NO 20 in the 10/903,236 US patent application
  misc_feature: The sequence is a functional homolog of SEQ ID NO 2213 in the 10/666,642 US patent application
  misc_feature: The sequence is a functional homolog of SEQ ID NO 80 in the 10/714,887 US patent application
  misc_feature: The sequence is a functional homolog of SEQ ID NO 80 in the 11/435,388 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
  misc_feature: The sequence is a functional homolog of SEQ ID NO 164 in the 10/714,887 US patent application
  misc_feature: The sequence is a functional homolog of SEQ ID NO 164 in the 11/435,388 US patent application
  misc_feature: The sequence is a functional homolog of SEQ ID NO 32 in the 10/903,236 US patent application
MNTYMSLSLESSSSTTTSSVVRDVATPAPLSSGASASSYPRAGAGMGMGTSLSLASAAAAAHGHGQYLPLNEDDSLEMVLFDVLREASGSAAAPTTYQPPASSLPTLKKALASGAAARKGGGGGVGCSSRAAHAPKAATTGRHYRGVRRRPWGKYAAEIRDPARHGARLWLGTFATAEEAAAAYDRAAFRMRGAKALLNFPPAVAGCGNAATATAEQAAGVTEAK

SEQ ID NO: 7617 - DNA, 2022 bp, Sorghum bicolor
  misc_feature: Ceres ANNOT ID no. 6079956
  misc_feature: Encodes the peptide sequence at SEQ ID NO 7618
atggcggcagcccttttgcttcgcggtctccgctcatcggcgagccgggcacatatccactctctttcccacgcctcctccccgtcggctctggggtcttcccttctacgccgcctctactcctctgcggcggcgtcaaccgccgcctcgcctgctttcacgcccgccggcgtcatggacccgtcccgcatccgcaacgtggcagtgatagcccacgtcgaccatgggaagacgacgctcatggatcggcttctgcgacagtgcggggccgatatcccccacgagcgcgccatggattccatcagccttgagcgcgagcgcggcatcaccattgcctccaaggttacttctgtctcttggaaggaaaatgaactcaacatggtcgatacacctggccacgctgattttggtggtgaggttgaacgagttgttggaatggtggaaggagctgtcttggttgttgatgctggagagggacctttagcacaaactaaatttgtgctttcaaaggctttgaagtatggcttgcgcccaattcttctcctcaacaaggttgataggccttcagtttctgaagaaacctgcaatgaagtagagagcttggtttttgatctttttgcaaaccttggtgctacagaagaacagttagatttcccggttctttatgcgtccgctaaagaggggtgggcttccttaactttcactaagagcccccctgataatgcaaagaatatgtcttcgttgctggattccattgtacagcatgttccttcaccaaaagctgatcttgaggctccattccaaatgttggtttccatgatggaacgtgatttttatctaggacgaatactcactgggagagtaagatctggagttgtccgtgttggtgacaaagtccatggtcttcgcagtacagatgatggagttcagaagattgaagatggaaaggttgtcaaactcatgaaaaagaaaggcacaagtatggtaacagtagagactgcaggggctggtgatataatttcaatggcaggattggctgctccagcaattggacatactgtggcaaattcagaggtattgactgctctgcctacaattgagttggatcctcccacaatatccatgacatttggtgtgaatgattcaccgttggctggccgggatggcactcatctaactggagcaaaaattggtaaccgcctgatggcagaggcagaaacgaatttggctattaatgttctccctggaccattatcagaatcttatgaagttcaaggaagaggagagcttcagttaggaatattaatcgaaaacatgcggcgtgagggatttgagctttcggtttcacctccaaaagtgatgtataaaacagagtgtggtcaaaggttggagcctattgaagaagtgactgttgaggtggatgaagagcatgtgggattcgtcttggaaaccattacacacaggaagggtgaagtagttgacatgggcccagttcctgggacaactggaagaactcgaatcttcatgacctgtccatctaggggtttggtgggtgtcaaaggaattttcagcagttttacacgtggaactggatttatgcaccgtgctttccaggcatatgctaaatacagaggtccactaggcagtgtcagaaagggagttctgatatctgttggtaagggacttatcacttcacatgcccttatgagtttagaagctcgtgggattctctttgtatctcctggaatggaggcatatgaaggcatgatagttggtgagcactcacgtgacagtgatcttgaggtgaatcctgtgagaactaaagaacttacaaacatccgtgcccctggaaaggatgaaaatgttcgtttgtctccacctcgattgatgagtttggaagaggcaattggatatgttgctgcagatgagcttattgaggttactcccaaggttatacgtcttcggaagaagtacttggattccactaaacgtaagatgatgaaaaacaagcccatggattaa

SEQ ID NO: 7618 - protein, 673 aa, Sorghum bicolor
  misc_feature: Ceres ANNOT ID no. 6079956
  misc_feature (62)..(258): Pfam Id: GTP_EFTU Pfam Desc: Elongation factor Tu GTP binding domain
  misc_feature (461)..(551): Pfam Id: EFG_C Pfam Desc: Elongation factor G C-terminus
  misc_feature (281)..(355): Pfam Id: GTP_EFTU_D2 Pfam Desc: Elongation factor Tu domain 2
  misc_feature (65)..(186): Pfam Id: MMR_HSR1 Pfam Desc: GTPase of unknown function
  misc_feature (1)..(673): NCBI GI: 140053144 NCBI Desc: elongation factor tu, domain 2 [medicago truncatula]
  misc_feature (3)..(673): NCBI GI: 79323586 NCBI Desc: gtp binding / translation elongation factor [arabidopsis thaliana]
  misc_feature (146)..(673): NCBI GI: 42569499 NCBI Desc: elongation factor family protein [arabidopsis thaliana]
  misc_feature (64)..(665): NCBI GI: 77464017 NCBI Desc: ef-tu; elongation factor tu [rhodobacter sphaeroides 2.4.1]
  misc_feature (64)..(665): NCBI GI: 126462862 NCBI Desc: gtp-binding protein typa [rhodobacter sphaeroides atcc 17029]
MAAALLLRGLRSSASRAHIHSLSHASSPSALGSSLLRRLYSSAAASTAASPAFTPAGVMDPSRIRNVAVIAHVDHGKTTLMDRLLRQCGADIPHERAMDSISLERERGITIASKVTSVSWKENELNMVDTPGHADFGGEVERVVGMVEGAVLVVDAGEGPLAQTKFVLSKALKYGLRPILLLNKVDRPSVSEETCNEVESLVFDLFANLGATEEQLDFPVLYASAKEGWASLTFTKSPPDNAKNMSSLLDSIVQHVPSPKADLEAPFQMLVSMMERDFYLGRILTGRVRSGVVRVGDKVHGLRSTDDGVQKIEDGKVVKLMKKKGTSMVTVETAGAGDIISMAGLAAPAIGHTVANSEVLTALPTIELDPPTISMTFGVNDSPLAGRDGTHLTGAKIGNRLMAEAETNLAINVLPGPLSESYEVQGRGELQLGILIENMRREGFELSVSPPKVMYKTECGQRLEPIEEVTVEVDEEHVGFVLETITHRKGEVVDMGPVPGTTGRTRIFMTCPSRGLVGVKGIFSSFTRGTGFMHRAFQAYAKYRGPLGSVRKGVLISVGKGLITSHALMSLEARGILFVSPGMEAYEGMIVGEHSRDSDLEVNPVRTKELTNIRAPGKDENVRLSPPRLMSLEEAIGYVAADELIEVTPKVIRLRKKYLDSTKRKMMKNKPMD

SEQ ID NO: 7619 - DNA, 522 bp, Sorghum bicolor
  misc_feature: Ceres ANNOT ID no. 6079958
  misc_feature: Encodes the peptide sequence at SEQ ID NO 7620
atgatgctcccgctggtgaagctcggctcgctcgcgttccggacgctgagcaagcccatcgcggcccgcctcaagtacaacgccggcatccaccccaagttccgcggtctcatcatcggactcgcgcaggcaaaccatcgtttcactacaaatatgcagaggcgagtgtatggacgtgcgactgacattcacattcggcccctgaatgaggagaaagctattcaagctgccgcagatcttcttggcgaactatttgttttctcggttgctggtgctgcaattatctatgaggtgcaaagaagtgctaggtcagaagccagaaaagaggaagtccgtagtcaggaaattgaggcgataaagaaaagggatgaacaactggccctggaagtacagctcatgaaacagaagattagcgagatggagcggcagtactcgaagtggactcttccggggtttcgcggcctcggcactgctcaggcggcggcacagcctactggtactcagcagccaacagctgcgtag

SEQ ID NO: 7620 - protein, 173 aa, Sorghum bicolor
  misc_feature: Ceres ANNOT ID no. 6079958
  misc_feature (4)..(136): Pfam Id: OPA3 Pfam Desc: Optic atrophy 3 protein (OPA3)
  misc_feature (1)..(164): NCBI GI: 115435592 NCBI Desc: os01g0242300 [oryza sativa (japonica cultivar-group)]
  misc_feature (1)..(146): NCBI GI: 37202086 NCBI Desc: at3g58150 [arabidopsis thaliana]
  misc_feature (64)..(150): NCBI GI: 119404885 NCBI Desc: opa3 domain protein [aspergillus clavatus nrrl 1]
  misc_feature (64)..(139): NCBI GI: 119484936 NCBI Desc: opa3 domain protein [neosartorya fischeri nrrl 181]
  misc_feature (7)..(126): NCBI GI: 44981425 NCBI Desc: acl018wp [eremothecium gossypii]
MMLPLVKLGSLAFRTLSKPIAARLKYNAGIHPKFRGLIIGLAQANHRFTTNMQRRVYGRATDIHIRPLNEEKAIQAAADLLGELFVFSVAGAAIIYEVQRSARSEARKEEVRSQEIEAIKKRDEQLALEVQLMKQKISEMERQYSKWTLPGFRGLGTAQAAAQPTGTQQPTAA

SEQ ID NO: 7621 - DNA, 1242 bp, Sorghum bicolor
  misc_feature: Ceres ANNOT ID no. 6079978
  misc_feature: Encodes the peptide sequence at SEQ ID NO 7622
atggacggccaggctccacatctcgacggcgtcgcgcgggatccccttaccgtgtccgacgagccgcagcccacggtcgaggtggcggaggagcacgccatacccgtcgcgcacgacatcgccaagggcgaggtggtggaggaggacgccctaccagtcgcgtccgacatcgtcaagggcgaggtggtggaggaggacgccctacccgtcgcgaccgacatcatcaacgacgcctcttcggaggttcccgaggctggcagtggtggcgtcgtgctcacggacgagctccgcgaccgcatcgtcaagcaggtcgagtactatttcagcgatgagaatcttcctacagacgagttcatgttgaaatatgtgaagaagaacaagaagggctttgttcctattgagactatcgcatcatttagaagaatgaagaaacttgttcaagacctgtcagtaattgaagctgcactcaggacatcaccaaagctggttgtaagttcagatgggaaacgggtcaggaggttacatccgctgccacacaatgaattgaaagattcaaagaaaagcactgttttggttgaaaatctacctccagatttctccatggagagtattcaggaaaaattcagtacagtgggcaaagttgtgaaagtaacaattaatgatccagaattagtgaaagaatcttcaactgctaagaagcctgacttcaatttaagtagtaaggttcatgtacttgttgagtatgaagcagtggaggctgctgagaaggctgttactgtcctaagtgatgagagcaactggagaactgggatgaaagtcaggcttctgtctaaacaaagcgtaatgggatcaggaaagtataacaaaccttcaaaagaaaatcaggatgcagtttccaaaaagattgatcagaatcaacattcaaaagaagaccagcgtataacctcagaaaagatctccaatgctgatgcagtggggagtgccaaggacaaagagaatttgaaatctgtttttaccactgagactgagcaccatgaccagaagccaaattctagaggacgaaaaggacggtacaaaggtcaaggtcagatgcagcaaaatacaaacaaacaaggaagttctggttctgagtcattaaacaagcctattcctggaccaagaatgccagatggaacaaggggctttacactgggacgtggtaaatctctaccactacagaagtctgataaggctgaagagtag

SEQ ID NO: 7622 - protein, 413 aa, Sorghum bicolor
  misc_feature: Ceres ANNOT ID no. 6079978
  misc_feature (100)..(159): Pfam Id: La Pfam Desc: La domain
  misc_feature (81)..(404): NCBI GI: 23308375 NCBI Desc: at5g46250/mpl12_3 [arabidopsis thaliana]
  misc_feature (81)..(323): NCBI GI: 145334751 NCBI Desc: rna recognition motif (rrm)-containing protein [arabidopsis thaliana]
  misc_feature (100)..(380): NCBI GI: 62734646 NCBI Desc: at2g43970/f6e13.10 [oryza sativa (japonica cultivar-group)]
  misc_feature (81)..(323): NCBI GI: 145358920 NCBI Desc: rna recognition motif (rrm)-containing protein [arabidopsis thaliana]
  misc_feature (107)..(380): NCBI GI: 115484947 NCBI Desc: os11g0248200 [oryza sativa (japonica cultivar-group)]
MDGQAPHLDGVARDPLTVSDEPQPTVEVAEEHAIPVAHDIAKGEVVEEDALPVASDIVKGEVVEEDALPVATDIINDASSEVPEAGSGGVVLTDELRDRIVKQVEYYFSDENLPTDEFMLKYVKKNKKGFVPIETIASFRRMKKLVQDLSVIEAALRTSPKLVVSSDGKRVRRLHPLPHNELKDSKKSTVLVENLPPDFSMESIQEKFSTVGKVVKVTINDPELVKESSTAKKPDFNLSSKVHVLVEYEAVEAAEKAVTVLSDESNWRTGMKVRLLSKQSVMGSGKYNKPSKENQDAVSKKIDQNQHSKEDQRITSEKISNADAVGSAKDKENLKSVFTTETEHHDQKPNSRGRKGRYKGQGQMQQNTNKQGSSGSESLNKPIPGPRMPDGTRGFTLGRGKSLPLQKSDKAEE

SEQ ID NO: 7623 - DNA, 579 bp, Sorghum bicolor
  misc_feature: Ceres ANNOT ID no. 6080129
  misc_feature: Encodes the peptide sequence at SEQ ID NO 7624
atgccgggttactatgacatcgatgacatcctcatggaggatgagcctatttcagttgttttccaagtaactgcaaatggcgttggcctgctagatcccggtgctgaaagtaactgtgtagagaagggtgccaaggtggacctcccattttggcttgcgcatgggctgctgtctctggaacaagctgtgtcaataaacccacctccatgcttcacacagaaaactcggaaggagatccaagctgatgcagcctgtgtggatttgagggttcgttgcccgtacttttatgagctaggatgcaagattgttcctttggtgagtgacaagagcattggcctgttcttgcgatatgcattcaccagtaggtacaaagaggttctaagcaagtcccacagttcttccatgatgacagttcccaagtttgttccacggcttacaaaagaagaaactcgagtgtttgaatctgctagagaatcgatggctggtttcaagaaatggagagcaggtggggtgagactgcaaaaggcttccattcttggccggaagaggaagacaaagctgcctgatggaccgccttga

SEQ ID NO: 7624 - protein, 192 aa, Sorghum bicolor
  misc_feature: Ceres ANNOT ID no. 6080129
  misc_feature (4)..(167): Pfam Id: Psf3 Pfam Desc: Partner of SLD five, PSF3
  misc_feature (1)..(184): NCBI GI: 92893214 NCBI Desc: gins complex, psf3 component [medicago truncatula]
  misc_feature (1)..(184): NCBI GI: 8778281 NCBI Desc: f14d16.22 [arabidopsis thaliana]
  misc_feature (1)..(166): NCBI GI: 121920552 NCBI Desc: dna replication complex gins protein psf3
  misc_feature (4)..(186): NCBI GI: 27694899 NCBI Desc: flj13912-prov protein [xenopus laevis]
  misc_feature (4)..(189): NCBI GI: 146387467 NCBI Desc: chain c, the crystal structure of human gins core complex
MPGYYDIDDILMEDEPISVVFQVTANGVGLLDPGAESNCVEKGAKVDLPFWLAHGLLSLEQAVSINPPPCFTQKTRKEIQADAACVDLRVRCPYFYELGCKIVPLVSDKSIGLFLRYAFTSRYKEVLSKSHSSSMMTVPKFVPRLTKEETRVFESARESMAGFKKWRAGGVRLQKASILGRKRKTKLPDGPP

SEQ ID NO: 7625 - DNA, 372 bp, Sorghum bicolor
  misc_feature: Ceres ANNOT ID no. 6080445
  misc_feature: Encodes the peptide sequence at SEQ ID NO 7626
atgggcactgttgctccacatgtactcatagttgatgacacctttgttgatcgccttgtggcatctcgagtcttaaagagttgtaacattcaagtgacaattgtggagggcccaaagcaagccttggattttctagatgtggagaatgatgtaaagctgattctaaccgactattgtatgcctggcatgactgggtatgatcttctaatggaggtgaaggaatcaccaaagttgaaccatatccctgtggtgatcatgtctagtgacaacatccctgaaaggattcaaaagtgcttggctgcacgggcaaaggagtatatcataaagcctatcaaagttgctgacgtgcaccgtatttttagctacatttga

SEQ ID NO: 7626 - protein, 123 aa, Sorghum bicolor
  misc_feature: Ceres ANNOT ID no. 6080445
  misc_feature (6)..(121): Pfam Id: Response_reg Pfam Desc: Response regulator receiver domain
  misc_feature (5)..(123): NCBI GI: 87116398 NCBI Desc: typea response regulator 12 [oryza sativa (japonica cultivar-group)]
  misc_feature (5)..(123): NCBI GI: 87116400 NCBI Desc: typea response regulator 13 [oryza sativa (japonica cultivar-group)]
  misc_feature (5)..(123): NCBI GI: 71273489 NCBI Desc: type a response regulator 8 [oryza sativa (indica cultivar-group)]
  misc_feature (1)..(123): NCBI GI: 94966174 NCBI Desc: response regulator [zea mays]
  misc_feature (1)..(123): NCBI GI: 94966176 NCBI Desc: response regulator [zea mays]
  misc_feature: The sequence is a functional homolog of SEQ ID NO 932 in the 10/666,642US patent application
  misc_feature: Useful for making plants with altered Lignin content
  misc_feature: Useful for making plants with altered carotene content
  misc_feature: Useful for making plants with altered terpenoid content
  misc_feature: Useful for making plants with modulated growth and phenotype characteristics
  misc_feature: Functional homolog of the protein sequence given in SEQ ID NO 13463
  misc_feature: The sequence is a functional homolog of SEQ ID NO 932 in the 20070033671 US patent application
  misc_feature: The sequence is a functional homolog of SEQ ID NO 932 in the 10/666,642 US patent application
  misc_feature: The sequence is a functional homolog of SEQ ID NO. 378 in the 11/188,298 US application
MGTVAPHVLIVDDTFVDRLVASRVLKSCNIQVTIVEGPKQALDFLDVENDVKLILTDYCMPGMTGYDLLMEVKESPKLNHIPVVIMSSDNIPERIQKCLAARAKEYIIKPIKVADVHRIFSYI

SEQ ID NO: 7627 - DNA, 933 bp, Sorghum bicolor
  misc_feature: Ceres ANNOT ID no. 6080447
  misc_feature: Encodes the peptide sequence at SEQ ID NO 7628
atgcctgatatccagctaggatgccacactatacagtcccatggcaccaaagtggcaagattacacatgtatgactggattatacttttatgtcttgctgtatttgatggactgttaaacttaatcgagccctttcaccgctttgttggacgcgacatgatgaccgacttgagttatcccctcaagggcaacacaatcccattttgggctgttcctctgattgccatagtgctaccttggttcatctttggtgtcatttacttcaaaaagaaaaatgtctatgatttacaccatggcatactagggatcttatactcagtgcttataactgctgtgatcactgatgcaattaaggatggtgttggccgccctcgcccagatttcttttggcgttgttttcctgatggcaaacctaattatgataatatcaccaccgatgtgatttgccatggagaaaagagtgtcatcaaggaaggtcataagagcttcccaagtgggcattcttcatggtcttttgccggtctaggttttcttgcgtggtacttggctggaaaacttaaagcttttgatcgcaaaggtcacattgcaaaactatgcttagtttttctgcctctacttgtcgcgtcacttgtggcggtttctcgagttgatgattactggcatcactggcaagatgtttttgcaggcggcatcttaggtcttacagttgcttcattctgttacctgcagttcttcccgtttccctttgacaatgatgctctatggccacacgcatacttccaacagctagctgagacacacagcaatggtaatgcaaactcaatcaacataagacctacagagtctgaagatgaacaagaagaccatggtggcattgcccttagggataccagccctatcttggagtcaatggagtctggccggagactatga

SEQ ID NO: 7628 - protein, 310 aa, Sorghum bicolor
  misc_feature: Ceres ANNOT ID no. 6080447
  misc_feature (99)..(249): Pfam Id: PAP2 Pfam Desc: PAP2 superfamily
  misc_feature (4)..(309): NCBI GI: 56784972 NCBI Desc: phosphatidic acid phosphatase beta-like [oryza sativa (japonica cultivar-group)]
  misc_feature (4)..(309): NCBI GI: 126165538 NCBI Desc: acid phosphatase acp2 [oryza sativa (japonica cultivar-group)]
  misc_feature (1)..(286): NCBI GI: 10673973 NCBI Desc: phosphatidic acid phosphatase beta [vigna unguiculata]
  misc_feature (3)..(308): NCBI GI: 9621903 NCBI Desc: phosphatidic acid phosphatase alpha [vigna unguiculata]
  misc_feature (10)..(291): NCBI GI: 56202159 NCBI Desc: phosphatidic acid phosphatase beta-like [oryza sativa (japonica cultivar-group)]
MPDIQLGCHTIQSHGTKVARLHMYDWIILLCLAVFDGLLNLIEPFHRFVGRDMMTDLSYPLKGNTIPFWAVPLIAIVLPWFIFGVIYFKKKNVYDLHHGILGILYSVLITAVITDAIKDGVGRPRPDFFWRCFPDGKPNYDNITTDVICHGEKSVIKEGHKSFPSGHSSWSFAGLGFLAWYLAGKLKAFDRKGHIAKLCLVFLPLLVASLVAVSRVDDYWHHWQDVFAGGILGLTVASFCYLQFFPFPFDNDALWPHAYFQQLAETHSNGNANSINIRPTESEDEQEDHGGIALRDTSPILESMESGRRL

SEQ ID NO: 7629 - DNA, 2187 bp, Sorghum bicolor
  misc_feature: Ceres ANNOT ID no. 6080472
  misc_feature: Encodes the peptide sequence at SEQ ID NO 7630
atggcgccaccgccgctacccctcttctccccgtccccaaaggccccgcctccgccgccatggctccacgggtcctccacccaaagccgcgactccgcacccccggtgcctccaccccccgccgacgcaactcctcccaagccccgcacccacagccccaaatcggcaccggcaaagaaaaacaccaaaacaacagccaagcccctcactgccggagtcccggggggccgcacacaccgagctgtcctcggcatcatccggcgcgtccgctccctcgagctctcagatgctccgagtgcgagttccgtccacgacagcaacgccggtgccgccgccgcattccaccttccaatcgagccgtccccgccgcgggaaccaggccaagaagtggtggagaaggcgaagccgcgggcggttccgtgggcggctgctagggacgagggcctcaaggtcgcgctgcggcgggagaagaagccgcggaagccgacgcgcgccgagaccgagctggagaccgacgagctggaccggctgcggcggttggcgcgcgggatgggcaggtgggcgcgggccaagaaggccggagtcaccgacgaggtggtcgaggagatgcgaagggaatgggccagtggtgaagagctcgccgcagtgcgtatcgtcgagccactccgccggtccatggaccgcgccagggagattcttgagataaaaacaggaggattagttgtgtggacaaaaggagacatacattttgtctataaaggaagcaaatatcagcaaaacgcaaagcatagtcacacttttgtaactaatgttcataaaggttctctcgtaaaacaaaatgttcgtggtgaagcagatgatgcttttcaagaaaatgatcagagcatttgtggccagaaggatgaagaacctgtcaagggaacactatacgagagggaagtcaatagactattggacactttgggccctcgatttgttgattggtggtgggacacaccattacctgtggatgctgatctcctcccagagttcattccaggctttaagactccatttaggcagtgccctcctggtgtgagaccaacactagctgatgaggagctgacatacttgcgcaagcttgcgcgccctttgccaacacattttgcccttggtagaaatacaagattgcagggtttggctgctgctatactgaagctttgggagaaaagccttatagcaaaaattgcagtgaaagtaggtatccagaatacgaacaatgaacaaatggcatggaacctgaagcatcttacgggaggcactgtgatattgagaaacaaggattttgttattctatatagaggcaaggattttctgcctggtggagttgctcaaactgttattcaacgagaagctcaggtagatgatgaacaggtgaaggaagaggaagctcgactgaaagcagttgactctcttcagatggttggtgaattatcatctgatgaagaaagttctgtaggaactttcagggagtataaggatttccatgctgactttgtgcatgcaaacactgaaaagtccaacaccatgattgaattagaggccgagaagtatagattggaaaaggaactgaaagatcatgaatggaagctttccattctcaacaagaagattgaaagatctaaccaggcactggcaaagcttcgcagttcttggagcccttcagagcagtctgctgatagagaactattgacagaagaggaaaagataatgttccgccggattggccgcaaaatggatgggcttgttctcctaggaaggcgtggtatctttgatggtgtaattgaagagattcatcagcattggaaacataaagaggttgtgaaagtaattacaaagcagaatcaagcccgacagatcatgtacacagcgaatttgcttgaggttgagacaggtggaatattaatagcagtagaaaagctcacaaccagccatgccataatactttaccgtgggaaaaactatcgccgcccagcaaaatcatcatttagtaatctcctaacgaaaagagaagctctccgaagatcacttgaggtccagcggcgagggtcaatgaaatactttgtccgggagagacagaagtccatttcggaattgaaaaggagactgagatatgtgacaaggcaaatcaggtatcgaaccccatga

SEQ ID NO: 7630 - protein, 728 aa, Sorghum bicolor
  misc_feature: Ceres ANNOT ID no. 6080472
  misc_feature (169)..(253): Pfam Id: CRS1_YhbY Pfam Desc: CRS1 / YhbY domain
  misc_feature (363)..(447): Pfam Id: CRS1_YhbY Pfam Desc: CRS1 / YhbY domain
  misc_feature (577)..(664): Pfam Id: CRS1_YhbY Pfam Desc: CRS1 / YhbY domain
  misc_feature (1)..(728): NCBI GI: 9837550 NCBI Desc: crs1 [zea mays]
  misc_feature (200)..(428): NCBI GI: 9837552 NCBI Desc: crs1 [zea mays]
  misc_feature (1)..(234): NCBI GI: 9837554 NCBI Desc: crs1 [zea mays]
  misc_feature (313)..(728): NCBI GI: 116310121 NCBI Desc: osigba0130p02.2 [oryza sativa (indica cultivar-group)]
  misc_feature (18)..(569): NCBI GI: 115486097 NCBI Desc: os11g0592400 [oryza sativa (japonica cultivar-group)]
MAPPPLPLFSPSPKAPPPPPWLHGSSTQSRDSAPPVPPPPADATPPKPRTHSPKSAPAKKNTKTTAKPLTAGVPGGRTHRAVLGIIRRVRSLELSDAPSASSVHDSNAGAAAAFHLPIEPSPPREPGQEVVEKAKPRAVPWAAARDEGLKVALRREKKPRKPTRAETELETDELDRLRRLARGMGRWARAKKAGVTDEVVEEMRREWASGEELAAVRIVEPLRRSMDRAREILEIKTGGLVVWTKGDIHFVYKGSKYQQNAKHSHTFVTNVHKGSLVKQNVRGEADDAFQENDQSICGQKDEEPVKGTLYEREVNRLLDTLGPRFVDWWWDTPLPVDADLLPEFIPGFKTPFRQCPPGVRPTLADEELTYLRKLARPLPTHFALGRNTRLQGLAAAILKLWEKSLIAKIAVKVGIQNTNNEQMAWNLKHLTGGTVILRNKDFVILYRGKDFLPGGVAQTVIQREAQVDDEQVKEEEARLKAVDSLQMVGELSSDEESSVGTFREYKDFHADFVHANTEKSNTMIELEAEKYRLEKELKDHEWKLSILNKKIERSNQALAKLRSSWSPSEQSADRELLTEEEKIMFRRIGRKMDGLVLLGRRGIFDGVIEEIHQHWKHKEVVKVITKQNQARQIMYTANLLEVETGGILIAVEKLTTSHAIILYRGKNYRRPAKSSFSNLLTKREALRRSLEVQRRGSMKYFVRERQKSISELKRRLRYVTRQIRYRTP

SEQ ID NO: 7631 - DNA, 1476 bp, Sorghum bicolor
  misc_feature: Ceres ANNOT ID no. 6080478
  misc_feature: Encodes the peptide sequence at SEQ ID NO 7632
atggcagcacggaggccgcgcgatgacgaggaggaggaggacgatgaggacgggggcggagccgatgatcatccgcacaggcgtggccctaggcggatccggccggcgccgcttgcttttaccgctgtggtaagaagagttgtggcccaagaaactatacaacaaatagtccacaatctggaaccacttattcgtagagtggtgcgtgaggaaatccagaacatgttttcacatcatcaagatcacatgccactaagatctctttctctacgcatccaagaggcagatgtcctgcctccactgaagttagtcttcgctaagcagctcaagctaccaatcttcacaaacaacaaacttgttgatattatggacaacccaattgaaatccagctcatggacacaagaaccaactctatgatcgcactaccagatactcatcttggatcttcatcagtaaaactagaagtgctggttctggatggtgattttcagtgtgaggaccgggatgggtggactgctgaccagttcaatgcagcgattgtgaaggctagagaagggaagagaccattgctcgtgggctcactcagtgttcctatgaacaaccatggagtagctgtgattgatgatgtatccttcactgacaattcgagctggataaggtgccgtaagtttcgaattggcgtgcgcatcatgcctgggggccatcttggatcaagagtcaaagaggctgtgagtggcagcttcaccgtcaaagatcatcgaggtgaattgtacaaaaaacactatcctcctttgctgactgacaacatatggaggctgaagaacattggaaaagatggaccaattgacaagaggttggaatccgaggggattaggaacgtccaggacttcttgaagcttaacaccatagatcctgaaaagctcaaagctctcgtcggcatgtcagataggccatggaacgcaacgctgaatcatgcgaaaacgtgtgacatgggacggaaatgctatgttttcaggactgtagggtgtgaaattacctttaaccctataggagaggtcttaggagcaagaattgaagaccagacatttgctctgcaagaactgcaaccacatcaactgttccatgtgaagcagttggccgctcaggcataccagatgtggggtcaactagaggaagtagctaatgaaatgccacttgctgcaaataagagctttgttcccacaatgaattctggtcgggagccgagtgagagtcaagggagcatgatcagttcaggatctcagaacgctaagtatctcgactgcacgggaaccgctacctccagtgccgcagcaatgtcgacgaacagcagcagcacctcagattctacagcagctgttccagctaatgatgccatgttctggagcccgagcatagaaccggaatgtgacttcagctggcaggactcggcaggttgttgggatcaagtggattaa

SEQ ID NO: 7632 - protein, 491 aa, Sorghum bicolor
  misc_feature: Ceres ANNOT ID no. 6080478
  misc_feature (98)..(402): Pfam Id: Calmodulin_bind Pfam Desc: Calmodulin binding protein-like
  misc_feature (1)..(330): NCBI GI: 115478472 NCBI Desc: os09g0309200 [oryza sativa (japonica cultivar-group)]
  misc_feature (1)..(475): NCBI GI: 140045800 NCBI Desc: calmodulin binding protein-like [medicago truncatula]
  misc_feature (16)..(404): NCBI GI: 115453677 NCBI Desc: os03g0436300 [oryza sativa (japonica cultivar-group)]
  misc_feature (15)..(479): NCBI GI: 32482927 NCBI Desc: osjnba0058g03.4 [oryza sativa (japonica cultivar-group)]
  misc_feature (10)..(457): NCBI GI: 42569137 NCBI Desc: calmodulin-binding protein [arabidopsis thaliana]
MAARRPRDDEEEEDDEDGGGADDHPHRRGPRRIRPAPLAFTAVVRRVVAQETIQQIVHNLEPLIRRVVREEIQNMFSHHQDHMPLRSLSLRIQEADVLPPLKLVFAKQLKLPIFTNNKLVDIMDNPIEIQLMDTRTNSMIALPDTHLGSSSVKLEVLVLDGDFQCEDRDGWTADQFNAAIVKAREGKRPLLVGSLSVPMNNHGVAVIDDVSFTDNSSWIRCRKFRIGVRIMPGGHLGSRVKEAVSGSFTVKDHRGELYKKHYPPLLTDNIWRLKNIGKDGPIDKRLESEGIRNVQDFLKLNTIDPEKLKALVGMSDRPWNATLNHAKTCDMGRKCYVFRTVGCEITFNPIGEVLGARIEDQTFALQELQPHQLFHVKQLAAQAYQMWGQLEEVANEMPLAANKSFVPTMNSGREPSESQGSMISSGSQNAKYLDCTGTATSSAAAMSTNSSSTSDSTAAVPANDAMFWSPSIEPECDFSWQDSAGCWDQVD

SEQ ID NO: 7633 - DNA, 1023 bp, Sorghum bicolor
  misc_feature: Ceres ANNOT ID no. 6080484
  misc_feature: Encodes the peptide sequence at SEQ ID NO 7634
atgacgcgatgtcgccttctcttttacgaggaaatccagcaggattggattggaggtatggaagttcggaggaggaggaggatccggatctccttctccgatcctgacgcaaccgattcagactccggcgaggatgcgacttccgcccagggttttctttttcggcgaaatttcaccgaaatttccgaaatttcgcatttttcagtgaggtgccgaaaaaattttcctaccgaaaaagaaaaccttgcttccgcctcctgtggtggccgcaagacaaatattgtaatctttcattgcagtagtactagtagcagcagcagcagcgccaagaagaaccctggtggctgtgctggttcgcaacaaaggcaagcaatccgatcgtcgccggcgagctgctgggaccgcgccgccgtcggttcggtacccgtgatgaagcggtgccgcggcgtctacgagcggcagcctggtcggtgggcggcggagtttcggagccatagactcaaggcccggcattggatcggcacgttcgccaccgaggacgaggccaaggccgcgtacgacgacttcgagaggcagttcttcccggcgcggcgctgtggcctgccggtgccgctgccggcgttggagcgcggtggtggccgcgctgctggcggcgttcagagagcatcaaatcctcatcgacaacgacatccacatccacctgacaagcgacagattgtactggctttggcggcgactgggataatgctgccgccgcttccgtctgcgcctgcgagcgcgccatgcatctcgaacccgacgtcggcgacgccgcagcggccgctggtgccgccgccgccgttcgagaataatgcggaaccgcatggtgatgcggtgccgagtgttcattctttctgggcggacgagcccgccgacgaggatcttatagggctagctgatcttggacacctgccattgccgttctcggatggcagcatggactttgatccggatgatttgtcgctgtttgatgggttcttgtga

SEQ ID NO: 7634 - protein, 340 aa, Sorghum bicolor
  misc_feature: Ceres ANNOT ID no. 6080484
  misc_feature (145)..(196): Pfam Id: AP2 Pfam Desc: AP2 domain
  misc_feature (148)..(193): NCBI GI: 115478480 NCBI Desc: os09g0309700 [oryza sativa (japonica cultivar-group)]
  misc_feature (88)..(293): NCBI GI: 115471237 NCBI Desc: os07g0227600 [oryza sativa (japonica cultivar-group)]
  misc_feature (88)..(293): NCBI GI: 50510280 NCBI Desc: pathogenesis-related genes transcriptional activator pti6-like protein [oryza sativa (japonica cultivar-group)]
  misc_feature (124)..(309): NCBI GI: 60100209 NCBI Desc: dreb2 [triticum aestivum]
  misc_feature (114)..(235): NCBI GI: 68611258 NCBI Desc: osjnba0042l16.9 [oryza sativa (japonica cultivar-group)]
MTRCRLLFYEEIQQDWIGGMEVRRRRRIRISFSDPDATDSDSGEDATSAQGFLFRRNFTEISEISHFSVRCRKNFPTEKENLASASCGGRKTNIVIFHCSSTSSSSSSAKKNPGGCAGSQQRQAIRSSPASCWDRAAVGSVPVMKRCRGVYERQPGRWAAEFRSHRLKARHWIGTFATEDEAKAAYDDFERQFFPARRCGLPVPLPALERGGGRAAGGVQRASNPHRQRHPHPPDKRQIVLALAATGIMLPPLPSAPASAPCISNPTSATPQRPLVPPPPFENNAEPHGDAVPSVHSFWADEPADEDLIGLADLGHLPLPFSDGSMDFDPDDLSLFDGFL

SEQ ID NO: 7635 - DNA, 2895 bp, Sorghum bicolor
  misc_feature: Ceres ANNOT ID no. 6080618
  misc_feature: Encodes the peptide sequence at SEQ ID NO 7636
atggccgggaagttggagaagatggcgtcgatcgacgcgcagctgcggatgctggcgccggcgaagctgtcggaggacgacaagctggtggagtacgacgccctcctcctcgaccgcttcctcgacatcctccaggacctccacggcgaggatctccgtgagctggtacaagagtgctatgagatagctgctgagtatgaaaggaagcatgactcagaaaagcttgatgaacttggcaacatgttgaccagcttggatcctggtgattcgattgtaactgcgaaagcattctcacatatgcttaacttggccaacttggctgaggaagtccagattgcttatcggaggagaatcaagctcaagaagggggactttgctgatgagaactcagcactgactgaatctgatattgaggaaacttttaagcggcttgtagttgaccttaagaagtcaccagctgaagtttttgatgctctgaagagtcagactgttgacctggttttgactgcacatccaacacagtcagtaaggagatcactgctacagaagcactcacggataaggaattgtttagttcaactgtgctctaaggacatcacaccagatgacaaacaggagcttgatgaggctctccagagggagatccaggcagccttcagaactgatgagatcagaagaacacagcctactccacaagatgaaatgcgggctggtatgagttacttccatgaaacaatatggaaaggtgttccaaagtttttacgccgcgtggatactgccttgaagaacattggaattgatgagcgtgtgccgtataatgcccctctcattcagttctcttcttggatgggaggagatcgtgatggaaatccaagagtgacaccagaggttacaagggatgtctgtttgcttgccagaatgatggctgcaaatttgtattgctcacagattgagaatctcatgttcgagttgtctatgtggcgatgcaatgatgagcttcgggcacaagcagatgagttacatcgctcatcaaagaaagatgcaaagcactatatagagttctggaaaaaggttcctccgagtgagccatatcgggttatacttggcgatttgagagacaagctttacaatacacgtgagcgggcacgccagttgttatccagtggatattctgacattcccgaagaatctactgtcacaaacgttgagcagttcttagagcctttggagctatgctacaggtctctctgtgcttgtggtgaccgtgtaattgctgatggaagccttcttgatttcttgcgccaagtttctacctttggactgtgccttgtgaggcttgacataaggcaggaatctgataggcacactgatgtccttgatgctattaccacctacttaggaataggttcataccgtgagtggtctgaggaacgccgtcaggagtggctcttgtctgaactcaatgggaagcgtccattgtttggtccagaccttcccactactgatgagattgctgatgtcctagacacattccgtgtgatagctgaacttcctgcggacaactttggagcatacattatttctatggcaacagctccatctgatgttcttgctgttgagcttctccagcgtgaatgtcatgtgaagacaccacttagagttgtcccactatttgagaagttggctgatcttgaaggtgccccagctgcactggccagactcttctcagtggattggtatagagaaaggattaatggcaaacaggaggtcatgattggctactcagactcaggtaaggatgctggtcgcctctcagcagcttggcagctgtacaaggctcaggaggagcttatcaaagtcgctaagaaatttggggtgaaattgacgatgttccatgggcgaggtggtactgttggaagaggtggaggccccactcatcttgccattttgtctcagccaccggatacaatccatggatccctcagggtcactgttcagggggaagtcattgaacagtcctttggtgaggagcacctgtgtttcaggacactgcagcgtttcacggctgctactcttgagcatggcatgcatccaccaatttccccaaaacctgaatggcgtgctctgcttgatgagatggctgtagtggcaacaaaggaatatcggtccattgtcttccaagaaccacgctttgtggagtatttccgccttgcaacacctgaaatggagtatggaaggatgaacatagggagcagaccatccaagagaaaaccaagtggtgggattgagtctctacgtgccattccatggatctttgcatggacacagacacgcttccacctccctgtctggctgggttttggggctgcctttaagcacatcctggaaaaggacattaggaacctccacatgcttcaggagatgtacaatgagtggccattcttcagggtgacaattgatctagttgagatggtgttcgccaagggtgacccaggcatcgctgccttgtacgataaactccttgtttcttcagagctctggcctcttggggagaagctgagggcaaattatgaagagaccaaacgtcttctccttcaggttgctggacacaaggatcttcttgaaggggatttatacctgaagcagcgtctccgcctccgtgatgcgtacatcaccacactgaatgtctgccaagcctacacgatgaagcgcatccgtgacccagattaccatgtcacactgcggccccacctgtccaaggaaatcatggactggaacaagcctgctgcagagctcgtcaagctgaacccgaccagtgagtatgctccggggctggaggacaccctcatcctgaccatgaagggcattgctgctgggatgcagaacactggttag

SEQ ID NO: 7636 - protein, 964 aa, Sorghum bicolor
  misc_feature: Ceres ANNOT ID no. 6080618
  misc_feature (10)..(964): Pfam Id: PEPcase Pfam Desc: Phosphoenolpyruvate carboxylase
  misc_feature (1)..(964): NCBI GI: 27948554 NCBI Desc: phosphoenolpyruvate carboxylase [oryza sativa (indica cultivar-group)]
  misc_feature (3)..(964): NCBI GI: 115478504 NCBI Desc: os09g0315700 [oryza sativa (japonica cultivar-group)]
  misc_feature (5)..(964): NCBI GI: 115583 NCBI Desc: phosphoenolpyruvate carboxylase 2 (pepcase 2) (cp28)
  misc_feature (4)..(964): NCBI GI: 1705585 NCBI Desc: phosphoenolpyruvate carboxylase 2 (pepcase 2)
  misc_feature (2)..(964): NCBI GI: 3341490 NCBI Desc: phospoenolpyruvate carboxylase [triticum aestivum]
  misc_feature (5)..(964): SWISSPROT Homolog: EC 4.1.1.31 Phosphoenolpyruvate carboxylase 2
MAGKLEKMASIDAQLRMLAPAKLSEDDKLVEYDALLLDRFLDILQDLHGEDLRELVQECYEIAAEYERKHDSEKLDELGNMLTSLDPGDSIVTAKAFSHMLNLANLAEEVQIAYRRRIKLKKGDFADENSALTESDIEETFKRLVVDLKKSPAEVFDALKSQTVDLVLTAHPTQSVRRSLLQKHSRIRNCLVQLCSKDITPDDKQELDEALQREIQAAFRTDEIRRTQPTPQDEMRAGMSYFHETIWKGVPKFLRRVDTALKNIGIDERVPYNAPLIQFSSWMGGDRDGNPRVTPEVTRDVCLLARMMAANLYCSQIENLMFELSMWRCNDELRAQADELHRSSKKDAKHYIEFWKKVPPSEPYRVILGDLRDKLYNTRERARQLLSSGYSDIPEESTVTNVEQFLEPLELCYRSLCACGDRVIADGSLLDFLRQVSTFGLCLVRLDIRQESDRHTDVLDAITTYLGIGSYREWSEERRQEWLLSELNGKRPLFGPDLPTTDEIADVLDTFRVIAELPADNFGAYIISMATAPSDVLAVELLQRECHVKTPLRVVPLFEKLADLEGAPAALARLFSVDWYRERINGKQEVMIGYSDSGKDAGRLSAAWQLYKAQEELIKVAKKFGVKLTMFHGRGGTVGRGGGPTHLAILSQPPDTIHGSLRVTVQGEVIEQSFGEEHLCFRTLQRFTAATLEHGMHPPISPKPEWRALLDEMAVVATKEYRSIVFQEPRFVEYFRLATPEMEYGRMNIGSRPSKRKPSGGIESLRAIPWIFAWTQTRFHLPVWLGFGAAFKHILEKDIRNLHMLQEMYNEWPFFRVTIDLVEMVFAKGDPGIAALYDKLLVSSELWPLGEKLRANYEETKRLLLQVAGHKDLLEGDLYLKQRLRLRDAYITTLNVCQAYTMKRIRDPDYHVTLRPHLSKEIMDWNKPAAELVKLNPTSEYAPGLEDTLILTMKGIAAGMQNTG

SEQ ID NO: 7637 - DNA, 1575 bp, Sorghum bicolor
  misc_feature: Ceres ANNOT ID no. 6080643
  misc_feature: Encodes the peptide sequence at SEQ ID NO 7638
atgactgacatgaaaccggaggagatgagccaccctcccatggaccagctgctgggaatggagtactgcatagactcaaacccatcctggggaggggctgttttgctgggcttccagcatttcatcctttgtttggggacggcagtgatgatccccaccttgctggttcccctcatgggaggaaatgcccatgacaaggcaaaggtggtacagacaatgctgcttgtgactgggataaatacaatgctccaaactctgtttggaactcgtctgcccaccgtcatcggtgggtcttatgcattcctaatcccggtcatatcaataatcagtgacccctcactgatacaaattactgatggtcatacaaggttcaaaatgaccatgagagccatacagggggccctgataatatcgtcctgcattcagataatacttggctacagccaattgtggggggtatgctccaggttcttcagcccacttgggatggttccagttattgcattggcggggcttggtcttttcgagagaggattcccagtgattggaacatgtgtggagattggtcttccaatgcttctcctgtttgtggcactttcccaatatctgaagcacgtacaagtgtgccattttccgatattggagaggttctcagtgctcatctccatcgcacttgtctggttatatgcccacatcctcactgtgagtggggcatacagacatagttcgcaggtcacccagctcaactgccgaactgaccttgccaacctcatcacaaccatgccatggtttggtgttccatacccactgcaatggggtcccccgacattcagcgcagatcattcatttggcatgatggctgctgtggtggtgtccttggtagagtctaccggagcatttaaggctgctgcccggttggcaagtgcgacgcccccaccaccatttgtcctgagcaggggaattggatggcagggaatcgggctgctattagatgggctatttggtactgccagcggatctactgtctctgtggagaacgtcggtctcctaggatcaaccaggattggtagcagaagagtcattcagatctccgctggtttcatgatcttcttctctatcctagggaaatttggagcgctgttcgcctcaattccattcacactgtttgctgctatatactgtgtattgtttggctatgtcggtgctgtggggctctcctttatgcagttcatcaacatgaactcgatgcgcagcctcttcattatcggcatgtcactgttccttggcatctccatcccggagtacttcttccggtttacaatgggcaatcagcacggaccgtcacacaccagagctggatggttcaacgacctcatcaacaccatcttctcctcacccccgactaccggattcatcatttcggtggtcctagacaacacactggatgtgaggaacagagcgaaggaccgtgggatgccttggtgggctaggttcaggacatttcgcggggacagccggaacgaggagttctacaacctgccgttcaacctcaaccggttcttcccaccatcgtaa

SEQ ID NO: 7638 - protein, 524 aa, Sorghum bicolor
  misc_feature: Ceres ANNOT ID no. 6080643
  misc_feature (31)..(438): Pfam Id: Xan_ur_permease Pfam Desc: Permease family
  misc_feature (266)..(524): NCBI GI: 115478518 NCBI Desc: os09g0320400 [oryza sativa (japonica cultivar-group)]
  misc_feature (77)..(524): NCBI GI: 115440067 NCBI Desc: os01g0759900 [oryza sativa (japonica cultivar-group)]
  misc_feature (5)..(522): NCBI GI: 89330191 NCBI Desc: leaf permease 1 [oryza sativa (japonica cultivar-group)]
  misc_feature (182)..(524): NCBI GI: 115476114 NCBI Desc: os08g0369000 [oryza sativa (japonica cultivar-group)]
  misc_feature (11)..(522): NCBI GI: 30696385 NCBI Desc: xanthine/uracil permease family protein [arabidopsis thaliana]
MTDMKPEEMSHPPMDQLLGMEYCIDSNPSWGGAVLLGFQHFILCLGTAVMIPTLLVPLMGGNAHDKAKVVQTMLLVTGINTMLQTLFGTRLPTVIGGSYAFLIPVISIISDPSLIQITDGHTRFKMTMRAIQGALIISSCIQIILGYSQLWGVCSRFFSPLGMVPVIALAGLGLFERGFPVIGTCVEIGLPMLLLFVALSQYLKHVQVCHFPILERFSVLISIALVWLYAHILTVSGAYRHSSQVTQLNCRTDLANLITTMPWFGVPYPLQWGPPTFSADHSFGMMAAVVVSLVESTGAFKAAARLASATPPPPFVLSRGIGWQGIGLLLDGLFGTASGSTVSVENVGLLGSTRIGSRRVIQISAGFMIFFSILGKFGALFASIPFTLFAAIYCVLFGYVGAVGLSFMQFINMNSMRSLFIIGMSLFLGISIPEYFFRFTMGNQHGPSHTRAGWFNDLINTIFSSPPTTGFIISVVLDNTLDVRNRAKDRGMPWWARFRTFRGDSRNEEFYNLPFNLNRFFPPS

SEQ ID NO: 7639 - DNA, 1947 bp, Sorghum bicolor
  misc_feature: Ceres ANNOT ID no. 6080669
  misc_feature: Encodes the peptide sequence at SEQ ID NO 7640
atggcgagggcgaggggcaggttggtgctgctgctcctcctcgccctcacggtgctttccccgctcgcgctctacactagccgcctccccgcggcgcttagccccatccaaacgcaggattttcctggagaaatcacgaatcagggccgtggcggcaaggcagacaagctgaatgcactccctctggaaaccgtgagctctttgaaagaacctgtcggcattgtcttctcagaggagctgactgaatctaagagccaagatttgccgttgacgaaagtaggggagcacaagagccgcatgctctctgaagtcacggttgctgctgatggcaccacattgaaagctgatgaagtgatcgagcaagtgacgacgctggaaccacaggatggtagcttggtgaagggagcaggcatatcagatgagcaggagaaaaatattggatcacagcagcaatcttcttctgaggaaagttcacaggacactatgcttaaacagacacctgaaaaggttattgtggagaactcccaatcagctaaaacagatggtaaaactaaaatcactgttttacctgatgtgcggatccgaaatatcaaggatcagttgatcaaggcaaaggtctaccttggtcttggatccattagagcgaattcccagtatcttaaagacctacggcagaggatacgagaagttcaaaaggtgcttggtgatgcatccaaggactctgatctactgaagaatgcaaatgagaaggttaaagcactggagcagatgctgattaagggaaaacagatgcaggatgattgttctattgttgtcaaaaagcttcgagctatgcttcattcagcagaggagcagctgcatgcacacaaaaaacagactgtttttctgacacaacttgcagctaaaacccttcctaaaggtcttcactgcctccccctgagactagctaacgaatacttttcattggatcctgttcggcagcagttcccaaaccaacaaaaactcattaacccaaaactgtatcattatgccttgttctcggataatatactagcaacagcggtggttgttaattcgacagtgttaaatgctaagcatccttctgatcatgttttccacatagtaaccgacaaactgaattatgctccaatgagaatgtggttcctctctaatcctccggggaaagcaacaattgaagtacagcatattggggagttcacatggctaaatgacagctacagtccagtactcaaacaacttgggtccccgtccatgattgattactactttggaacgaatcgtgcaaactcagattcaaacttgaaatatcgaaacccgaagtacctgtcaatccttaatcatctgcgtttttacctacctgagatttatccgaagcttgacaagatggtctttcttgatgatgacatagtagtaaagaaggatctgactggcctttggtcaatcaatatgaaggggaaggtaaatggtgctgttgagacatgtggagagagtttccatcgctatgatcgatacctgaatttttcaaatcctattattgccaagagttttgacccgcatgcttgtggttgggcttttggaatgaatgtgtttgatctggctgaatggaggcggcagaacataacacaaatctatcactcgtggcagaagcttaatgaagatagatcactctggaaacttggtactctccctccgggtttgatcacattctggaacaagacatttcccctcagccgatcatggcatgttcttggtctaggttacaatcctcatgtaaacagcagggacattgagcgtgccgcggtcatacattacaatggcaacatgaagccctggctagagattggcctgcccaagtaccggagctactggtccaagtatctggattatgaccaatctttcctgcgggaatgcaacattaatccatga

SEQ ID NO: 7640 - protein, 648 aa, Sorghum bicolor
  misc_feature: Ceres ANNOT ID no. 6080669
  misc_feature (310)..(622): Pfam Id: Glyco_transf_8 Pfam Desc: Glycosyl transferase family 8
  misc_feature (88)..(648): NCBI GI: 124360882 NCBI Desc: glycosyl transferase, family 8 [medicago truncatula]
  misc_feature (110)..(648): NCBI GI: 86438644 NCBI Desc: glycosyl transferase-like protein [brachypodium sylvaticum]
  misc_feature (109)..(648): NCBI GI: 86439693 NCBI Desc: glycosyl transferase-like protein [triticum aestivum]
  misc_feature (114)..(648): NCBI GI: 52077295 NCBI Desc: glycosyltransferase family-like [oryza sativa (japonica cultivar-group)]
  misc_feature (176)..(647): NCBI GI: 92885182 NCBI Desc: nudix hydrolase; glycosyl transferase, family 8 [medicago truncatula]
  misc_feature: Useful for making plants with altered cell wall content and/or composition
  misc_feature: GREAT-hit functional homolog of the protein sequence encoded by LOCUS at5g47780
  misc_feature: Useful for making plants with altered carbohydrate content
  misc_feature: Functional homolog of the protein sequence given in SEQ ID NO 13900
  misc_feature: Useful for making plants with altered cell wall content and/or composition
  misc_feature: Functional homolog of the protein sequence given in SEQ ID NO 13899
MARARGRLVLLLLLALTVLSPLALYTSRLPAALSPIQTQDFPGEITNQGRGGKADKLNALPLETVSSLKEPVGIVFSEELTESKSQDLPLTKVGEHKSRMLSEVTVAADGTTLKADEVIEQVTTLEPQDGSLVKGAGISDEQEKNIGSQQQSSSEESSQDTMLKQTPEKVIVENSQSAKTDGKTKITVLPDVRIRNIKDQLIKAKVYLGLGSIRANSQYLKDLRQRIREVQKVLGDASKDSDLLKNANEKVKALEQMLIKGKQMQDDCSIVVKKLRAMLHSAEEQLHAHKKQTVFLTQLAAKTLPKGLHCLPLRLANEYFSLDPVRQQFPNQQKLINPKLYHYALFSDNILATAVVVNSTVLNAKHPSDHVFHIVTDKLNYAPMRMWFLSNPPGKATIEVQHIGEFTWLNDSYSPVLKQLGSPSMIDYYFGTNRANSDSNLKYRNPKYLSILNHLRFYLPEIYPKLDKMVFLDDDIVVKKDLTGLWSINMKGKVNGAVETCGESFHRYDRYLNFSNPIIAKSFDPHACGWAFGMNVFDLAEWRRQNITQIYHSWQKLNEDRSLWKLGTLPPGLITFWNKTFPLSRSWHVLGLGYNPHVNSRDIERAAVIHYNGNMKPWLEIGLPKYRSYWSKYLDYDQSFLRECNINP

SEQ ID NO: 7641 - DNA, 1086 bp, Sorghum bicolor
  misc_feature: Ceres ANNOT ID no. 6080949
  misc_feature: Encodes the peptide sequence at SEQ ID NO 7642
atgagcagccatgtttccatctcagtggttgtcatcgtccttgtccctgttgtcctcctgctcaattcccatgtagggttgtgcagctgctacaagcgcatcttcagttttggcgatgatagtatggatactggcaattttgtgcatttgattgggaagaatgcatctaagtacaaggaagccccctatggcaatacattttttaggcacccaactggccgcatgtccgatggccgtgtcctcattgatttctatgcgcaagcactgaagctgccattgataccaccaattttacctaagaaggactctggacattttccacacggtgccaactttgctgtgtttggtgccacggcacgtgagcaactcttctactcaggcagcccctggtgtctaggcacacaaatgggatggttccataatatggtggatcgtatagctcctagagacgctgccaagaagcaatttctaagtgattctcttgtcgtgatgggtggaattggtggcaatgactactactcatatttcatcgccggtaaacctagcaaggatggaaatatcattccagatgtcatcgcatacatagaacatttcatcgaggagcttatttgcagtacaggtgcgaaagcgttcctgatccccaataacttccccattggttgcttcgcatcatacctaagtaggttccatagtgacaaccctgaggactatgatgagcatgggtgccttaggtggttcaacgagttctcgcagacgcacaatgaacaactttattctgccatcggacggatcaacatcacttaccctgatgtgaagctaatatatgctgactactacaatgccaccatggaattcatcaagaaccccggcagatttggtattggtaatcctctagtcgcatgttgtggcggtgatggaccataccacaccagcatggagtgcaatggcacggcaaaactttggggtgacccacaccactttgccaattgggatggcatgcacatgacagagaaggcatacaacatcatcgtggaaggggtgctaaatggaccatttgctgatcctccatttccacggagttgctag

SEQ ID NO: 7642 - protein, 361 aa, Sorghum bicolor
  misc_feature: Ceres ANNOT ID no. 6080949
  misc_feature (34)..(347): Pfam Id: Lipase_GDSL Pfam Desc: GDSL-like Lipase/Acylhydrolase
  misc_feature (3)..(361): NCBI GI: 20146423 NCBI Desc: lipase-like [oryza sativa (japonica cultivar-group)]
  misc_feature (8)..(361): NCBI GI: 10764858 NCBI Desc: f1k23.17 [arabidopsis thaliana]
  misc_feature (1)..(361): NCBI GI: 62004690 NCBI Desc: lipase 1 [brassica napus]
  misc_feature (26)..(346): NCBI GI: 54290849 NCBI Desc: lanatoside 15'-o-acetylesterase-like [oryza sativa (japonica cultivar-group)]
  misc_feature (28)..(361): NCBI GI: 62084739 NCBI Desc: lipase 2 [brassica napus]
MSSHVSISVVVIVLVPVVLLLNSHVGLCSCYKRIFSFGDDSMDTGNFVHLIGKNASKYKEAPYGNTFFRHPTGRMSDGRVLIDFYAQALKLPLIPPILPKKDSGHFPHGANFAVFGATAREQLFYSGSPWCLGTQMGWFHNMVDRIAPRDAAKKQFLSDSLVVMGGIGGNDYYSYFIAGKPSKDGNIIPDVIAYIEHFIEELICSTGAKAFLIPNNFPIGCFASYLSRFHSDNPEDYDEHGCLRWFNEFSQTHNEQLYSAIGRINITYPDVKLIYADYYNATMEFIKNPGRFGIGNPLVACCGGDGPYHTSMECNGTAKLWGDPHHFANWDGMHMTEKAYNIIVEGVLNGPFADPPFPRSC

SEQ ID NO: 7643 - DNA, 735 bp, Sorghum bicolor
  misc_feature: Ceres ANNOT ID no. 6080954
  misc_feature: Encodes the peptide sequence at SEQ ID NO 7644
atggctgctggcagcacggccaagaccctgctcctcggcttcctccttgctctcacggcgacctcgacgccggcggcggccaccacgctgacgctccacaacctgtgcccgtaccccgtgtggccgctggtgaccccgaacacggggttcccggccatctccgagaacacgggccgcctcgacggcggcgggcgcgggctcgtctccttccgcttcccggacagcttctgggcgggccgcgtggtggcgcgcacgggctgcagcagcagatccggttcgccgccgtcctcgtcctcgtccggctgcgagacggggagcacgccgccggcgacggtggtgcagctggtggtgcacgcggaagggcaggacctggcggcgtacagcgtgagcctggtggacgggttcaacgtgcccgccgtggtgagcccgcaggcagtgggcggcgggcagtgcccggccctggggtgcgcggcggacctcaacggcgggtgcccgcgctcgcagcgcgtggtcggggcaggcggcggcgtggtggcgtgcaagggccccgcggcgtacttcaaggagcggtgcccgctgacgcgcaccacggccaccgacgtcgagcccgtgccgcagcggtgcttcgcgcccggcgagctcaaggtcgtcttctgccagtccgccatggtgaacaacaacgacgccgccggcgagcccgggcgcatccgcaccgtcgtcgtcgcggacaactag

SEQ ID NO: 7644 - protein, 244 aa, Sorghum bicolor
  misc_feature: Ceres ANNOT ID no. 6080954
  misc_feature (34)..(220): Pfam Id: Thaumatin Pfam Desc: Thaumatin family
  misc_feature (7)..(240): NCBI GI: 77556850 NCBI Desc: thaumatin/pr5-like protein [oryza sativa (japonica cultivar-group)]
  misc_feature (16)..(219): NCBI GI: 62733228 NCBI Desc: osmotin protein homolog - rice (fragment) [oryza sativa (japonica cultivar-group)]
  misc_feature (6)..(191): NCBI GI: 27373045 NCBI Desc: thaumatin-like cytokinin-binding protein [brassica oleracea]
  misc_feature (11)..(191): NCBI GI: 144924329 NCBI Desc: thaumatin, pathogenesis-related [medicago truncatula]
  misc_feature (3)..(188): NCBI GI: 2501182 NCBI Desc: osmotin-like protein precursor
MAAGSTAKTLLLGFLLALTATSTPAAATTLTLHNLCPYPVWPLVTPNTGFPAISENTGRLDGGGRGLVSFRFPDSFWAGRVVARTGCSSRSGSPPSSSSSGCETGSTPPATVVQLVVHAEGQDLAAYSVSLVDGFNVPAVVSPQAVGGGQCPALGCAADLNGGCPRSQRVVGAGGGVVACKGPAAYFKERCPLTRTTATDVEPVPQRCFAPGELKVVFCQSAMVNNNDAAGEPGRIRTVVVADN

SEQ ID NO: 7645 - DNA, 684 bp, Sorghum bicolor
  misc_feature: Ceres ANNOT ID no. 6080960
  misc_feature: Encodes the peptide sequence at SEQ ID NO 7646
atggccagagccctggtcctcgtcgctgtcctcctcgccgccagcgccgccggctccacgacggcgaccacgctgaccatccacaacctctgcccccacccagtctggccgctggtgaccccgaactcaggcctcccctccatctccgacaacacggcgcgcctcgaccccaacgcgctgctctccctctccttcccgcccaccttctgggccgggcgcgtggccgcgcgcacgggctgcgacgccgcggcgtcgggctgctggacgggcgccgcgccgcccgccaccgtcgtgcaggtcaccgtccacgacggcggggacctggaccaggccgcgtacagcgtcagcctcgtcgacggcttcaacgtgcccgtggtcgtcagcccgcaggcgatcgccggcggcgggcagtgccccgcgctgggttgccccgtcgacctcaactgcgactgccctcctgcgcagcgcgccgccgagggcgtggcctgccgcggcccgccggagtacttcaagaaccggtgcccgctcacccggaccacgcccaccgacgtcgagcccgtcccgcagagctgccgcgggcccggcgagctcaaggtcgtcttctgccaggcgaccatcgtcacaggcgccgccggagccggcgaagccgagatggtcatccgctccgtcgtcgccgacagctag

SEQ ID NO: 7646 - protein, 227 aa, Sorghum bicolor
  misc_feature: Ceres ANNOT ID no. 6080960
  misc_feature (29)..(203): Pfam Id: Thaumatin Pfam Desc: Thaumatin family
  misc_feature (4)..(226): NCBI GI: 77556850 NCBI Desc: thaumatin/pr5-like protein [oryza sativa (japonica cultivar-group)]
  misc_feature (6)..(202): NCBI GI: 62733228 NCBI Desc: osmotin protein homolog - rice (fragment) [oryza sativa (japonica cultivar-group)]
  misc_feature (4)..(192): NCBI GI: 27373045 NCBI Desc: thaumatin-like cytokinin-binding protein [brassica oleracea]
  misc_feature (5)..(152): NCBI GI: 92872887 NCBI Desc: thaumatin, pathogenesis-related [medicago truncatula]
  misc_feature (72)..(201): NCBI GI: 90265110 NCBI Desc: h0806h05.5 [oryza sativa (indica cultivar-group)]
MARALVLVAVLLAASAAGSTTATTLTIHNLCPHPVWPLVTPNSGLPSISDNTARLDPNALLSLSFPPTFWAGRVAARTGCDAAASGCWTGAAPPATVVQVTVHDGGDLDQAAYSVSLVDGFNVPVVVSPQAIAGGGQCPALGCPVDLNCDCPPAQRAAEGVACRGPPEYFKNRCPLTRTTPTDVEPVPQSCRGPGELKVVFCQATIVTGAAGAGEAEMVIRSVVADS

SEQ ID NO: 7647 - DNA, 1185 bp, Sorghum bicolor
  misc_feature: Ceres ANNOT ID no. 6080990
  misc_feature: Encodes the peptide sequence at SEQ ID NO 7648
atggcggcgccaccggagctcgtcgacgacgccatggaggagatcttcctccgcctgcccccagccgagcccgcgcacctcgtccgcgccgccctcgtctgcaggcggtggcggcgcatcctcaccggcggggccttcgtccgccggtaccgcgcgttccacggggcggcccctctgctcggcttcctcgacaacacgatcgatctccacggcgccagggcccctcgcttctccccaacctcatccgcctccccgtttcacaggggtccgttcgactgcatctgctgggatgtcctcgactgccgccacggccgcgtcctcctcggcctcttcgccgggagggtcaacctcgtcgtgtgggaccccgtcaccggccaccaccaggcgctgccggaccccggtttgctcccggggtactacagcgcggcagtgctctgcggcaccgcgcgcggcggctgcggctgcgacaacctccactgctgccgcgacggcggtggcccgttccgcgtcgtgctggcagggatggagtcgatggactacttcgcacggggggaggacgccggcgtgcgggcgcgcctctactgctcggaggccgctgcctgggtcgcctcggcacatctaccctccaattcccatgtcatgcggaagcccagcgccgtcgtcggggacgacgtctacttccagctgatgtcggcctacgtgattctgaggtacgacacggccaggaaccgcctgtccaccttcgaccctccgccggcgcacgccgacgaagggggcatcgtgctcatgcccatggacggagaggacggtgacggttcgtcgcagctggggctcgccggcgtcaggggttcgaggctgtgcctgcggtcgacgagtgtcggcgcagagggagaggggattgcaggatgggtgcggcgcggggacattgagctcatgacacggatcccgtttttgccctatagcgaagcccaggtgattgcttctgcagagggattgggtaccatcttcttcttcgtctcaactgaggttggcctcttcgcgatcgacttcaagtcagggcaggagcgcaaggtgagcgagcctggcaactacaacaacttcactgtcttcccgttcatgagcttctacactccaggtttaggagaagctggagaacagaaacaactaagtgtcgtgtgctcgtga

SEQ ID NO: 7648 - protein, 394 aa, Sorghum bicolor
  misc_feature: Ceres ANNOT ID no. 6080990
  misc_feature (2)..(52): Pfam Id: F-box Pfam Desc: F-box domain
  misc_feature (4)..(336): NCBI GI: 115437584 NCBI Desc: os01g0557400 [oryza sativa (japonica cultivar-group)]
  misc_feature (3)..(284): NCBI GI: 115470391 NCBI Desc: os07g0122900 [oryza sativa (japonica cultivar-group)]
  misc_feature (1)..(378): NCBI GI: 115475786 NCBI Desc: os08g0299900 [oryza sativa (japonica cultivar-group)]
  misc_feature (20)..(378): NCBI GI: 115481210 NCBI Desc: os10g0158700 [oryza sativa (japonica cultivar-group)]
  misc_feature (6)..(201): NCBI GI: 38567955 NCBI Desc: osjnbb0115i21.11 [oryza sativa (japonica cultivar-group)]
  misc_feature: The sequence is a functional homolog of SEQ ID NO. 456 in the 11/188,298 US application
MAAPPELVDDAMEEIFLRLPPAEPAHLVRAALVCRRWRRILTGGAFVRRYRAFHGAAPLLGFLDNTIDLHGARAPRFSPTSSASPFHRGPFDCICWDVLDCRHGRVLLGLFAGRVNLVVWDPVTGHHQALPDPGLLPGYYSAAVLCGTARGGCGCDNLHCCRDGGGPFRVVLAGMESMDYFARGEDAGVRARLYCSEAAAWVASAHLPSNSHVMRKPSAVVGDDVYFQLMSAYVILRYDTARNRLSTFDPPPAHADEGGIVLMPMDGEDGDGSSQLGLAGVRGSRLCLRSTSVGAEGEGIAGWVRRGDIELMTRIPFLPYSEAQVIASAEGLGTIFFFVSTEVGLFAIDFKSGQERKVSEPGNYNNFTVFPFMSFYTPGLGEAGEQKQLSVVCS

SEQ ID NO: 7649 - DNA, 1065 bp, Sorghum bicolor
  misc_feature: Ceres ANNOT ID no. 6081008
  misc_feature: Encodes the peptide sequence at SEQ ID NO 7650
atgtcgcccgccgccgccaccaccacagccttcgccgcggtctccgtcgccatccccaaccctactgctccatcccgcggccgcgtgcgccttccgctacgcggggtccccgccgccgcacgccgcgccgtcgcctcgatggccgtgtccgcccccaggtccggcgccgccgcctcgttcctcgagcgccgcgagtccgagcgcgctctccacttcgtcaagtaccagggcctcggcaacgacttcatcatggtggacaacagggattcgtcggtgccgaaggtgacgccggaggaggccgcgaagctgtgcgaccgaaactttggcattggcgctgacggcgtcatcttcgtcatgccgggggtgaatggtgccgactacaccatgaggatcttcaactctgatggcagcgagccagagatgtgtggtaatggagtccgttgctttgctcggtttatagctgagattgaaaatctgcaggggacaaatagcttcactattcatactggtgctggaaagatcattcctgaaatacaaagtgatgggcaggtaaaggttgatatgggtgagcccatcctttccggaccagacatccccacaaaactgctacctaccaagaacaaagctgttgtccaagctgaattggcagttgagggcttaacatggcatgccacatgtgttagcatgggcaaccctcactgtgtcacatttggtgccaaggagttaaaggtgttgcaggttgacgatttaaaacttagcgaaattgggcctaaatttgagcatcatgaaatgtttcctgctcgcacaaacacagaattcgtacaggttttgtctcgctcacacctcaaaatgcgagtctgggagcgtggtgctggagcaactcttgcctgtggtaccggtgcttgtgcagtggttgttgcagctgttcttgagggtcgagctgagcggaaatgtgtagttgatttgcctggcgggccattggaaattgagtggagggaggatgacaatcatgtttacatgaccggtcctgcagaggccgtcttttatggatctgttgttccctag

SEQ ID NO: 7650 - protein, 354 aa, Sorghum bicolor
  misc_feature: Ceres ANNOT ID no. 6081008
  misc_feature (72)..(194): Pfam Id: DAP_epimerase Pfam Desc: Diaminopimelate epimerase
  misc_feature (225)..(347): Pfam Id: DAP_epimerase Pfam Desc: Diaminopimelate epimerase
  misc_feature (37)..(353): NCBI GI: 23505901 NCBI Desc: at3g53580/f4p12_280 [arabidopsis thaliana]
  misc_feature (69)..(350): NCBI GI: 16332245 NCBI Desc: diaminopimelate epimerase [synechocystis sp. pcc 6803]
  misc_feature (69)..(352): NCBI GI: 75909296 NCBI Desc: diaminopimelate epimerase [anabaena variabilis atcc 29413]
  misc_feature (69)..(352): NCBI GI: 22256738 NCBI Desc: diaminopimelate epimerase 2 (dap epimerase 2)
  misc_feature (69)..(352): NCBI GI: 23130251 NCBI Desc: cog0253: diaminopimelate epimerase [nostoc punctiforme pcc 73102]
  misc_feature (69)..(350): SWISSPROT Homolog: EC 5.1.1.7 Diaminopimelate epimerase
MSPAAATTTAFAAVSVAIPNPTAPSRGRVRLPLRGVPAAARRAVASMAVSAPRSGAAASFLERRESERALHFVKYQGLGNDFIMVDNRDSSVPKVTPEEAAKLCDRNFGIGADGVIFVMPGVNGADYTMRIFNSDGSEPEMCGNGVRCFARFIAEIENLQGTNSFTIHTGAGKIIPEIQSDGQVKVDMGEPILSGPDIPTKLLPTKNKAVVQAELAVEGLTWHATCVSMGNPHCVTFGAKELKVLQVDDLKLSEIGPKFEHHEMFPARTNTEFVQVLSRSHLKMRVWERGAGATLACGTGACAVVVAAVLEGRAERKCVVDLPGGPLEIEWREDDNHVYMTGPAEAVFYGSVVP

SEQ ID NO: 7651 - DNA, 1269 bp, Sorghum bicolor
  misc_feature: Ceres ANNOT ID no. 6081037
  misc_feature: Encodes the peptide sequence at SEQ ID NO 7652
atggcgcggaagaagatccgggagtacgactccaagcgcctcctccgggagcacctcaagcgcctcgccggcatcgacctccagatcctctccgcgcaggtcacacagtcaacggatttcaccgagcttgcaaaccaggagccatggctctcatctatgaagttggttgtgaaacctgacatgctcttcgggaaacgtgggaagagtggacttgtggccctcaacctagatcttgcccaagttcgccaatttgtcaaggagcggttgggtgttgaggtcgagatgggtggctgcaaagctccaattacaaccttcatagttgagccatttgtgccgcatgaccaagagtattacctttcgattgtatcagaaaggcttggcagcaccattagtttctcagagtgtggaggtattgagatcgaggagaactgggacaaggttaagactatctttcttccgacagagaagcaaatgacacctgacgcatgtgctcctttgatcgccaccttgccattggaggtccgcacaaaaataggtggtttcattagaggtgtattttctgttttccaagacttggatttctcatttcttgagatgaacccattcaccttggtaaatggtgaaccgtatcctctggatatgagaggagaactagatgacacagctgctttcaagaactttaataagtggggtgacattgagttccctctaccttttggaagagttctcagtccctcagaaagctttatccacgaactggatgagaagacaagtgcttctctgaaattcacagtactgaacccaaaaggacgcatttggacaatggttgcaggtggtggtgctagcgtcatatacgcggatactgttggtgatttgggatatgcttcagagctaggaaattatgcagagtacagtggagctcctaaggaggaggaggttctgcagtatgctagagtacttctggattgcgctactgctgatcctgatggccgtaagagagcccttcttatcggaggaggtatcgctaacttcaccgatgttgctgcaacatttaatggcatcattcgggctttaagagagaaggaatccaaattgaaggctgcaaggatgaatatttatgtccggagaggtggtccaaactaccaaactggactcgctaaaatgcgcaccctaggcacggaacttggcgttccaattgaggtctatggaccagaggccaccatgactgggatctgcaaagaagccattgattgcatcatggccgcataa

SEQ ID NO: 7652 - protein, 422 aa, Sorghum bicolor
  misc_feature: Ceres ANNOT ID no. 6081037
  misc_feature (5)..(204): Pfam Id: ATP-grasp_2 Pfam Desc: ATP-grasp domain
  misc_feature (1)..(422): NCBI GI: 15919089 NCBI Desc: atp citrate lyase b-subunit [lupinus albus]
  misc_feature (1)..(422): NCBI GI: 2462746 NCBI Desc: similar to atp-citrate-lyase [arabidopsis thaliana]
  misc_feature (1)..(422): NCBI GI: 22136126 NCBI Desc: similar to atp-citrate-lyase [arabidopsis thaliana]
  misc_feature (1)..(233): NCBI GI: 115486715 NCBI Desc: os11g0693800 [oryza sativa (japonica cultivar-group)]
  misc_feature (1)..(416): NCBI GI: 114054990 NCBI Desc: atp citrate lyase beta subunit [desulfurobacterium crinifex]
  misc_feature: Useful for making plants with modulated root development
  misc_feature: Functional homolog of the protein sequence given in SEQ ID NO 13780
MARKKIREYDSKRLLREHLKRLAGIDLQILSAQVTQSTDFTELANQEPWLSSMKLVVKPDMLFGKRGKSGLVALNLDLAQVRQFVKERLGVEVEMGGCKAPITTFIVEPFVPHDQEYYLSIVSERLGSTISFSECGGIEIEENWDKVKTIFLPTEKQMTPDACAPLIATLPLEVRTKIGGFIRGVFSVFQDLDFSFLEMNPFTLVNGEPYPLDMRGELDDTAAFKNFNKWGDIEFPLPFGRVLSPSESFIHELDEKTSASLKFTVLNPKGRIWTMVAGGGASVIYADTVGDLGYASELGNYAEYSGAPKEEEVLQYARVLLDCATADPDGRKRALLIGGGIANFTDVAATFNGIIRALREKESKLKAARMNIYVRRGGPNYQTGLAKMRTLGTELGVPIEVYGPEATMTGICKEAIDCIMAA

SEQ ID NO: 7653 - DNA, 2130 bp, Sorghum bicolor
  misc_feature: Ceres ANNOT ID no. 6081043
  misc_feature: Encodes the peptide sequence at SEQ ID NO 7654
  misc_feature: Down-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
atggaggagagcttcgtgcccctgcggggcatcaaggacgacctccacgggaggctcgcctgctacaagcaggattggaccggagggttccgtgccggtatcaggatcctggcgccgaccacctacatattcttcgcgtccgcgataccggtgatatcgttcggggagcaattggagaggaacactgatggagtgctcacagcagtgcagacgttggcatccactgccgtgtgcggcataatccactccattgtgggagggcagcccctgctgatcctgggagttgccgaacccacggtgctcatgtacacattcatgttcaacttcgccaaggacaggcccgacctcggacggaatctgttcttggcctggaccggttgggtttgtgtgtggactgccatcctactgttcttgctggccatactaggcgcatgctccatcatcaaccggttcacccgcatcgctggcgagctgtttgggcttctgattgctatgctcttcatgcagcaggctatcaagggacttgtcgacgagttccgcattcctgagagggaaaaccgaaaggcactggagtttgtcccatcatggcggtttgccaatggaatgtttgcaattgtgctgtcgtttggccttttactcactgctctgaggagcaggaaggcacggtcatggcgctacggaacaggttggctgcgcggcttcatcgctgactatggtgttccactgatggtgctagtttggactggagtgtcttacataccttatggaaatgtaccaaaaggaattccacgacgccttttcagccctaatccatggtcccctggtgcatatgacaattggacagtcatcaaggatatgacacaagttccactcctctatatccttggtgccttcataccagcaacgatgattgctgttctctactacttcgatcatagtgttgcatctcagcttgcgcagcagaaagagttcaatttgaggaaacctccatccttccactacgatttgcttctcttaggcttcctgacattaatgtgtggccttattggtatccctccatcaaatggtgtcattccacaatcacccatgcatacgaagagtttggctactctcaagcaccagctgcttcgtaaccggctagtagccaccgcacgaaagagcatgagccagaatgcgagcttgagccaactgtatggcagcatgcaggatgcttatcagcagatgcagacaccactggtttatcagcagcagtctgtcagaagaggcttaaatgagctcaaggactcaacagtccagctagcttcgagtatgggtaacattgatgcaccagttgatgagacagtctttgacatagagaaagaaattgatgatctgctgcccatcgaggtcaaggagcagcgcttgagcaacttgctacaggcttccatggtggggggttgtgttgctgctatgccgctactcaagaagatccctacatctgtcctctggggctattttgccttcatggccattgagagcttgcctggtaaccaattttgggagaggatcttgttgctcttcactgctcccagcagaagatacaaggtgcttgaagagtaccacaccacgttcgtcgagacagtgccattcaagacaatagccatgttcacattgttccagacaatgtaccttttggtctgctttggaatcacatggattccaatagctggagttcttttccccctcatgatcatgctcctggttccagtcaggcagtacatcctccccaagctcttcaaaggtgcacatctaactgacctagatgcagctgaatacgaggaatcaccggctataccattcagccttgctgcgcaagacattgatgtcgcattgggacgcacccagagtgcagaaatcctagacgacatggtcacgagaagccggggtgagatcaaacgcctcaacagcccgaagatcaccagctcaggtggcacacctgtggcagaactgaaaggcatccgcagcccatccatttctgagaaagcatacagccctcgtctcaccgagctccggcatgagcgcagccctctgggagggagaaacagccctaggacgccatccaagttgggtgaaggctcaacaccgaagtga

SEQ ID NO: 7654 - protein, 709 aa, Sorghum bicolor
  misc_feature: Ceres ANNOT ID no. 6081043
  misc_feature (7)..(552): Pfam Id: HCO3_cotransp Pfam Desc: HCO3- transporter family
  misc_feature (1)..(709): NCBI GI: 33304494 NCBI Desc: boron transporter [oryza sativa (japonica cultivar-group)]
  misc_feature (63)..(703): NCBI GI: 145331425 NCBI Desc: bor1 (requires high boron 1) [arabidopsis thaliana]
  misc_feature (1)..(616): NCBI GI: 140043818 NCBI Desc: hco3-transporter [medicago truncatula]
  misc_feature (3)..(698): NCBI GI: 23308463 NCBI Desc: at3g06450/f24p17_6 [arabidopsis thaliana]
  misc_feature (9)..(645): NCBI GI: 17978949 NCBI Desc: at1g15460/t16n11_24 [arabidopsis thaliana]
  misc_feature: Down-regulated in root tissues in response to methyl jasmonate treatment
  misc_feature: Up-regulated in shoot tissues in response to methyl jasmonate treatment
  misc_feature: Down-regulated in shoot tissues in response to salicylic acid treatment
MEESFVPLRGIKDDLHGRLACYKQDWTGGFRAGIRILAPTTYIFFASAIPVISFGEQLERNTDGVLTAVQTLASTAVCGIIHSIVGGQPLLILGVAEPTVLMYTFMFNFAKDRPDLGRNLFLAWTGWVCVWTAILLFLLAILGACSIINRFTRIAGELFGLLIAMLFMQQAIKGLVDEFRIPERENRKALEFVPSWRFANGMFAIVLSFGLLLTALRSRKARSWRYGTGWLRGFIADYGVPLMVLVWTGVSYIPYGNVPKGIPRRLFSPNPWSPGAYDNWTVIKDMTQVPLLYILGAFIPATMIAVLYYFDHSVASQLAQQKEFNLRKPPSFHYDLLLLGFLTLMCGLIGIPPSNGVIPQSPMHTKSLATLKHQLLRNRLVATARKSMSQNASLSQLYGSMQDAYQQMQTPLVYQQQSVRRGLNELKDSTVQLASSMGNIDAPVDETVFDIEKEIDDLLPIEVKEQRLSNLLQASMVGGCVAAMPLLKKIPTSVLWGYFAFMAIESLPGNQFWERILLLFTAPSRRYKVLEEYHTTFVETVPFKTIAMFTLFQTMYLLVCFGITWIPIAGVLFPLMIMLLVPVRQYILPKLFKGAHLTDLDAAEYEESPAIPFSLAAQDIDVALGRTQSAEILDDMVTRSRGEIKRLNSPKITSSGGTPVAELKGIRSPSISEKAYSPRLTELRHERSPLGGRNSPRTPSKLGEGSTPK

SEQ ID NO: 7655 - DNA, 2148 bp, Sorghum bicolor
  misc_feature: Ceres ANNOT ID no. 6081049
  misc_feature: Encodes the peptide sequence at SEQ ID NO 7656
atggcggcggcggagtgggacagccggagcgaggcgagccccaccggggactggccaccggcggccgccgcgtccccggtaaaggggaaggcggcggcgctgcaggagtcggatgcgggcgcgtcggcgtcgggctcgtcggaggccaaggtcgacgacggcaacatccaggaggcggagtcgtcgctccgcgagggcctctccctcaactacgaggaagctagagctctccttgggagactggaatatcagagaggcaacgtggaagcagctctgcgagtatttgatggaatagaccttcaagctgctattcagcgcttccaaccatctctttctgaaaaaccactctcgaagcgaagtaataaattacggtcagattcatcaaattcaggatcacagcatgctgctagccttgttcttgaagccatttacttgaaatcaatgtctcttcaaaagttgggcaaggcaatggaggctgctaaacagtgtaaaagtgtcctagatgctgttgaaagtatcttccaatgtggcatacctggtgttatggttgaaccaaaactgcaagaaactgtcagtaagtctgttgagcttctcccagaactttggaagcaagctggggcctatcaagaagcacttgcttcataccgccgtgctcttctaagtcaatggaatctcgatgatgaatgctgcacaaggattcagaagagatttgctgttttcttgttgtacggtggtgtagaggtgacccccccgagcttggcttcacaaactgaaggttcttttgttcctaggaataatgtggaagaggcaatcctattgctcatgatactattgaagaagtggttccttgggaagacacactgggatccgtctgttatggagcatttaacctttgcattgtcactgtgtggccagacatctattcttgccaagcaccttgaagaggttttacctggaatataccctcgaactgagagatggtatagtctagcgttgtgctattttgcagcttctcataatgaagctgcattaaatttgttgaggaaatcattgaataagaacgagagtccaaatgacataatggcccttctgttagctgctaagatatgcggttccaattatcttctttcttctgagggtgtagagtatgcaaagagagcagtcaaagattccgaatcatcagatgggcatctaaagagtgtggccctccatgttctggggagttgcctgtccaagaagtctaaggttgcttcatctgatcaccaaagatctctcttgcagactgaggctttgaagtcacttaatgaggcaatttctcttgaccgtcagaacccagagttaatatttgacatggggattgagtacgctgagcagcggaacatgcatgctgccttgaaatgtgcaaaggagttcattgatgcaactggtggatctgtctcgaaaggctggaggttgctatcattggttctttctgcacaacaaaggtattcagaagctgaagttgtgactgatgcggcattagatgagaccgcaaagtgggaacaagggccattgcttagaataagggctaaattgaaggttgctcaatcattgcccatggaagcagttgaagcatatcgcacccttcttgctcttgttcaggcacaacgaaaggcttatggatctgccaaaaatggcacagaggatgatgaggataaagtgagcgaatttgaagtttggcaaggtcttgccaacttgtactctagtctttcctattggagagatgcagagatttgcttacagaaggctaaagccctcaaaacatactctgcgacaacccttcatgcagaaggtaacatacatgaggtgcacgagaagatacaggatgctcttgctgcatacttcaatgccctctccatggaggtagagcatgtcccatccaaggtctctatcggtgccctcctctctaaacaagggcccaagttcctacctgtggcgaggtgtttcctatcggatgccctaaggctccaacccactaaccgaatggcttggttctacctgggggaggttcacaagcaggatggcaggctagctgatgccgccgattgcttccaggcggcctcaatgctggaggactcggaccctgtagaaagtttcagatcaccctga

SEQ ID NO: 7656 - protein, 715 aa, Sorghum bicolor
  misc_feature: Ceres ANNOT ID no. 6081049
  misc_feature (674)..(707): Pfam Id: TPR_2 Pfam Desc: Tetratricopeptide repeat
  misc_feature (2)..(714): NCBI GI: 77556181 NCBI Desc: calmodulin-binding protein mpcbp [oryza sativa (japonica cultivar-group)]
  misc_feature (73)..(714): NCBI GI: 10086260 NCBI Desc: calmodulin-binding protein mpcbp [zea mays]
  misc_feature (10)..(714): NCBI GI: 32492890 NCBI Desc: calmodulin-binding protein [oryza sativa (indica cultivar-group)]
  misc_feature (48)..(712): NCBI GI: 27450574 NCBI Desc: pollen-specific calmodulin-binding protein [arabidopsis thaliana]
  misc_feature (22)..(713): NCBI GI: 78708807 NCBI Desc: new cdna-based gene [oryza sativa (japonica cultivar-group)]
MAAAEWDSRSEASPTGDWPPAAAASPVKGKAAALQESDAGASASGSSEAKVDDGNIQEAESSLREGLSLNYEEARALLGRLEYQRGNVEAALRVFDGIDLQAAIQRFQPSLSEKPLSKRSNKLRSDSSNSGSQHAASLVLEAIYLKSMSLQKLGKAMEAAKQCKSVLDAVESIFQCGIPGVMVEPKLQETVSKSVELLPELWKQAGAYQEALASYRRALLSQWNLDDECCTRIQKRFAVFLLYGGVEVTPPSLASQTEGSFVPRNNVEEAILLLMILLKKWFLGKTHWDPSVMEHLTFALSLCGQTSILAKHLEEVLPGIYPRTERWYSLALCYFAASHNEAALNLLRKSLNKNESPNDIMALLLAAKICGSNYLLSSEGVEYAKRAVKDSESSDGHLKSVALHVLGSCLSKKSKVASSDHQRSLLQTEALKSLNEAISLDRQNPELIFDMGIEYAEQRNMHAALKCAKEFIDATGGSVSKGWRLLSLVLSAQQRYSEAEVVTDAALDETAKWEQGPLLRIRAKLKVAQSLPMEAVEAYRTLLALVQAQRKAYGSAKNGTEDDEDKVSEFEVWQGLANLYSSLSYWRDAEICLQKAKALKTYSATTLHAEGNIHEVHEKIQDALAAYFNALSMEVEHVPSKVSIGALLSKQGPKFLPVARCFLSDALRLQPTNRMAWFYLGEVHKQDGRLADAADCFQAASMLEDSDPVESFRSP

SEQ ID NO: 7657 - DNA, 1848 bp, Sorghum bicolor
  misc_feature: Ceres ANNOT ID no. 6081082
  misc_feature: Encodes the peptide sequence at SEQ ID NO 7658
atggacgcgacggggcagcaggagcagcatgcaggagatggaggcggagatcgctacggtgtgcttctctactacaagtacgccgaggtgcccgacgccgccgcgctcgccgcgttctacgaggcgcactgccgcggcctcgcgctcgtcggccgcgtccgggtcggccccgacggcgtcaacgccacgctcggagggcggatgaccacgctggagaagcatatcaaggagatgagctccaacgccttgttcgagggcacggatttcaagctggcgtcctgcgacgaccctgtcgacgagagggtcgccagggagtgcggcttcacctcactctccgtccgggtcgtcaaggagctagttaccctgtgctccaaccccacgtcagcaccgccagaggtttcgagtgctgggaaacacttgtcggcggctgagttccattcggtgctccagaatgttgctgggactagtttggatgctgtggcatctgcagagaagaaggaagtggttgtcttggatgcaaggaatgtatacgagactcggattggcaagttcaatgtgccaaatgcgaagaccttagatccggaaattaggcaatacagtgacctgccttcttggatagacgagcatgctgagcagctgcatgggaaatctattcttatgtactgcacaggaggtatacgctgcgagatggcatcagcttatattcgctcaaaaggtgaaggatttgagaacgtttttcagctatatggtggcattcagcggtatctggagcaatttccagatggtggctactttgaaggaaagaattttgtatttgaccacagaatctcagtgggaagctttaaagaaaacatactcggagcgtgtttgatgtgtggttcttcttttgatgactattcatcacgctgtcggtgcagccattgcagaatgttggtcctagtgtgccctacatgtcaggattccaccaaggaatatgcatgcgagttatgtcaaaaaaatggaaaagagccctgccaaatatcaacaagacaagactgcaaaattcagataggactatctgaaagctttgaaaaaccacccataagctatcacaatgcgatttccaaagttccctggagtgatggtagtgagcagctgaaaaggttgaggatcctctgcttgcatggtttccgccagaacgcgtccaattttaagggaaggacgtcagcacttgctaagaagctgaagcacattgctgagcttgtctttgtagatgcaccacatgaactttcctttgtatatcaaccaattcagggccactgcttggacaaaccctcacctctatctgtgacaccaaaacggaagtttgcatggctcattgctccaaactccaactacaaccctgagcaatactggagggctgcagatgtgccatttgaccctcttcagtaccagcaacaaactgaaggctttgaggaatcatacatctaccttgaaaatgcaatctctcaaatgggcagcttcgatggaatcctgggcttctctcagggcgctgccatggctgccttattctgcaggcagcagcagaagatctgtggctctccgaagttcaggtttgggatgttctgctccggatatccagcacctgtgggtgattttggcaacgaaccaatcaagctctcctcgctccattgttttggtaatggggatggtcatgataggcagatagcaaacagggcgagcgctgaacttgctggtctgtttgagcaggattgctgctccgttgttgagcatgacatgggccacataatccccacccggtcaccctacatcgatcgaataaaggattttctttccaatttccaatga

SEQ ID NO: 7658 - protein, 615 aa, Sorghum bicolor
  misc_feature: Ceres ANNOT ID no. 6081082
  misc_feature (380)..(613): Pfam Id: FSH1 Pfam Desc: Serine hydrolase (FSH1)
  misc_feature (421)..(615): Pfam Id: Abhydrolase_2 Pfam Desc: Phospholipase/Carboxylesterase
  misc_feature (17)..(276): NCBI GI: 3249095 NCBI Desc: contains similarity to dihydrofolate reductase (dfr1) gbl13703 from schizosaccharomyces pombe. ests gbn37567 and gbt43002 come from this gene. [arabidopsis thaliana]
  misc_feature (14)..(347): NCBI GI: 23272598 NCBI Desc: chromosome 9 open reading frame 97 [homo sapiens]
  misc_feature (14)..(347): NCBI GI: 119579252 NCBI Desc: chromosome 9 open reading frame 97, isoform cra_a [homo sapiens]
  misc_feature (21)..(344): NCBI GI: 62858017 NCBI Desc: loc549302 [xenopus tropicalis]
  misc_feature (14)..(316): NCBI GI: 119579253 NCBI Desc: chromosome 9 open reading frame 97, isoform cra_b [homo sapiens]
MDATGQQEQHAGDGGGDRYGVLLYYKYAEVPDAAALAAFYEAHCRGLALVGRVRVGPDGVNATLGGRMTTLEKHIKEMSSNALFEGTDFKLASCDDPVDERVARECGFTSLSVRVVKELVTLCSNPTSAPPEVSSAGKHLSAAEFHSVLQNVAGTSLDAVASAEKKEVVVLDARNVYETRIGKFNVPNAKTLDPEIRQYSDLPSWIDEHAEQLHGKSILMYCTGGIRCEMASAYIRSKGEGFENVFQLYGGIQRYLEQFPDGGYFEGKNFVFDHRISVGSFKENILGACLMCGSSFDDYSSRCRCSHCRMLVLVCPTCQDSTKEYACELCQKNGKEPCQISTRQDCKIQIGLSESFEKPPISYHNAISKVPWSDGSEQLKRLRILCLHGFRQNASNFKGRTSALAKKLKHIAELVFVDAPHELSFVYQPIQGHCLDKPSPLSVTPKRKFAWLIAPNSNYNPEQYWRAADVPFDPLQYQQQTEGFEESYIYLENAISQMGSFDGILGFSQGAAMAALFCRQQQKICGSPKFRFGMFCSGYPAPVGDFGNEPIKLSSLHCFGNGDGHDRQIANRASAELAGLFEQDCCSVVEHDMGHIIPTRSPYIDRIKDFLSNFQ

SEQ ID NO: 7659 - DNA, 885 bp, Sorghum bicolor
  misc_feature: Ceres ANNOT ID no. 6081101
  misc_feature: Encodes the peptide sequence at SEQ ID NO 7660
atgggcttcgccggccgggtatccgcgctgctcttcctcctggtcgctggtgctgtagcaaatgaccaggtcttcaccacttcaggtgtgacatttgggcggagttcgcgtgagccaaggtaccgcgtcgaattccatcctgttgattcgccgttccatccagagaatggtcaggaatccgtaccaatggctaatcatgaggggaaacgttacaagtgctttctaccagttgaagaaactaaaaccatgaagtcaatgctcccacaaaatgcaactaatgttatagtagaaagtgaaaggagaattaagccaaaggagccagatgagttacttgaggttctcaaggatcagtgtttctacaggcacgaaggttggtggtcgtatgagttctgttatcatgggaaaatcagacaggtccatgtagacgatgaaaaggttatccaagaatttgttctaggtgaatacgatgatgacgcgactgctgcataccacgaaaatagcacctctgagttagctaatgatgacaatcatgtgaaagatatatctaagaggtatcatgttcacttgtataaaaatgggactgtatgtgatctcacagatattccccgggagacagaggttagatttgtctgctcggagcctactgtactgattagttcaatcaaggagatctcttcctgcaaatatgttgtaacaattcaaagtcccatgctttgcaaaaacccgttgttccagcaagagaaacgaaccctctccatccactgcaatgagttgcctgctaaagcagaatccaatgtggtggatgactcgcttccaaaagaagcgcagatatccatcatccctgatcaggatgggctacatgattttccagcttatgctacttga

SEQ ID NO: 7660 - protein, 294 aa, Sorghum bicolor
  misc_feature: Ceres ANNOT ID no. 6081101
  misc_feature (116)..(193): Pfam Id: PRKCSH Pfam Desc: Glucosidase II beta subunit-like protein
  misc_feature (145)..(294): NCBI GI: 115469182 NCBI Desc: os06g0644800 [oryza sativa (japonica cultivar-group)]
  misc_feature (7)..(245): NCBI GI: 110665582 NCBI Desc: amplified in osteosarcoma precursor [bos taurus]
  misc_feature (7)..(245): NCBI GI: 48145699 NCBI Desc: os-9 [homo sapiens]
  misc_feature (7)..(245): NCBI GI: 63252868 NCBI Desc: amplified in osteosarcoma isoform 3 precursor [homo sapiens]
  misc_feature (7)..(245): NCBI GI: 63252866 NCBI Desc: amplified in osteosarcoma isoform 2 precursor [homo sapiens]
MGFAGRVSALLFLLVAGAVANDQVFTTSGVTFGRSSREPRYRVEFHPVDSPFHPENGQESVPMANHEGKRYKCFLPVEETKTMKSMLPQNATNVIVESERRIKPKEPDELLEVLKDQCFYRHEGWWSYEFCYHGKIRQVHVDDEKVIQEFVLGEYDDDATAAYHENSTSELANDDNHVKDISKRYHVHLYKNGTVCDLTDIPRETEVRFVCSEPTVLISSIKEISSCKYVVTIQSPMLCKNPLFQQEKRTLSIHCNELPAKAESNVVDDSLPKEAQISIIPDQDGLHDFPAYAT

SEQ ID NO: 7661 - DNA, 2136 bp, Sorghum bicolor
  misc_feature: Ceres ANNOT ID no. 6081104
  misc_feature: Encodes the peptide sequence at SEQ ID NO 7662
atgaagaaccccgacttcgccgcagacaaagcgctcgccaaggacttcctgtccaacttcgccggccctcacggcgagcccaagtacctgaacatcctgcaagatgtcgccaataggaagatacgcgcggtccagatcgagctggacgacatgttccattataaggatatcgacgaggagttcttgcagcgtgtcactgagaacacgcggcgctacatcggcgtcttcgcggaggccatggacgagatcatgccggagcccacggaggcgtacaccgtcgacgaggaccgggacatcctcatgacgcagcgtgtggatgagggtgccgacggcggcgccgacggcacagacccgctacagaggatgccaccagagatcaaacggttctttgaggtttacatcaagacattctcaaaggcgactccgctcaccattaggcaagtaaaggcatccaacattgggcagcttgtgaaaatatctgggattgttacccgctgctcggatgtgaagcccttgatgcaggttgctgtttatacatgtgaagaatgtggctttgagatataccaggaagtgacggctagagtgtttatgcctctcattgagtgtccatctcaacgatgcaagctgaacaaagcaaaggggaatctaatccttcaactgcgtgcatcaaagtttttgaaatttcaggaggtgaagcttcaagagttagcagagcatgtaccaaagggccacattcctcgttctctgactgttcatctaagaggagagctgactagaaaggttgcacctggagatgtggttgagatgtcgggcatttttctccctatgccatactatgggtttagagcgatgcgcgcaggattagttgctgatacttacttggaagcaatgtctgtcacccatttcaagaaaaaatatgaggagtatgaactaaagggtgatgaacaagaacaaattgaccgattgttggcaaggtcattggcaccagaaatatttggccatgaagatgtcaaaaaagcactgctgttactacttgttggtgcaccccatcggaagcttgcagatggcatgaagatcagaggagacctgcatatatgcatgatgggagatcctggtgttgcaaagagtcaacttctgaagcatattatcaatgttgcaccaagaggagtgtacaccactggacgtgggagcagtggtgttggtcttactgctgctgtccagaaagatccagtaacaaatgagtttgtccttgagggtggagcactggtgctggcagatatgggcatttgtgctatagatgagtttgataagatggaagagtcagacaggaccgcaattcatgaggtaatggagcagcaaacagttagcattgccaaggctggcatcaccacctctctcaatgcgagaaccgcaattctggctgctgcaaatccagcatggggaaggtacgatatgaggaggaccccagcagaaaatataaatctacctccagcacttttgtctcgtttcgacctcctttggttgatcctggatcgtgcagacatggaaactgatcttgaaatggcaagacacgttgttcatgtgcatcaaaatcttgaatcaccagcactggggttcacaccacttgagccatctgtactcagagcatacatatctgctgctagaagagtcattccttctgttcctagagagcttgaggaatacattgcaactgcatattccagcatccgccaagaggaggcaaagtcaaatgcaccaacctcctacacaactatcagaacacttttgagcatactccgtatttctattgccttggcaagacttaggttttcagaaactgtggctcagagtgatgttgacgaagcactgcgactgatgcaaatgtccaaatactcgttatactcagatgaccgccagcggtctggccttgatgcaatatctgacatatattccatcctgagagacgaagctgctaggacgagcagcatggatgtgagatatgctcatgctcttaacttgatctccagaaagggatacagtgaggctcaattgaaggagtgcttggaggaatacgcttccctgaacgtgtggcaaatccatccaagcacctttgacatccacttcatcgatgcttga

SEQ ID NO: 7662 - protein, 711 aa, Sorghum bicolor
  misc_feature: Ceres ANNOT ID no. 6081104
  misc_feature (307)..(631): Pfam Id: MCM Pfam Desc: MCM2/3/5 family
  misc_feature (330)..(515): Pfam Id: Mg_chelatase Pfam Desc: Magnesium chelatase, subunit ChlI
  misc_feature (1)..(710): NCBI GI: 15027268 NCBI Desc: replication licensing factor mcm7 homologue [zea mays]
  misc_feature (2)..(711): NCBI GI: 77556136 NCBI Desc: replication licensing factor mcm7 homologue [oryza sativa (japonica cultivar-group)]
  misc_feature (2)..(711): NCBI GI: 34452231 NCBI Desc: mini-chromosome maintenance 7 [pisum sativum]
  misc_feature (1)..(709): NCBI GI: 675491 NCBI Desc: contains mcm2/3/5 family signature; prosite; ps00847; disruption leads to early lethal phenotype; similar to mcm2/3/5 family, most similar to ybr1441
  misc_feature (1)..(709): NCBI GI: 7268590 NCBI Desc: prolifera [arabidopsis thaliana]
MKNPDFAADKALAKDFLSNFAGPHGEPKYLNILQDVANRKIRAVQIELDDMFHYKDIDEEFLQRVTENTRRYIGVFAEAMDEIMPEPTEAYTVDEDRDILMTQRVDEGADGGADGTDPLQRMPPEIKRFFEVYIKTFSKATPLTIRQVKASNIGQLVKISGIVTRCSDVKPLMQVAVYTCEECGFEIYQEVTARVFMPLIECPSQRCKLNKAKGNLILQLRASKFLKFQEVKLQELAEHVPKGHIPRSLTVHLRGELTRKVAPGDVVEMSGIFLPMPYYGFRAMRAGLVADTYLEAMSVTHFKKKYEEYELKGDEQEQIDRLLARSLAPEIFGHEDVKKALLLLLVGAPHRKLADGMKIRGDLHICMMGDPGVAKSQLLKHIINVAPRGVYTTGRGSSGVGLTAAVQKDPVTNEFVLEGGALVLADMGICAIDEFDKMEESDRTAIHEVMEQQTVSIAKAGITTSLNARTAILAAANPAWGRYDMRRTPAENINLPPALLSRFDLLWLILDRADMETDLEMARHVVHVHQNLESPALGFTPLEPSVLRAYISAARRVIPSVPRELEEYIATAYSSIRQEEAKSNAPTSYTTIRTLLSILRISIALARLRFSETVAQSDVDEALRLMQMSKYSLYSDDRQRSGLDAISDIYSILRDEAARTSSMDVRYAHALNLISRKGYSEAQLKECLEEYASLNVWQIHPSTFDIHFIDA

SEQ ID NO: 7663 - DNA, 1032 bp, Sorghum bicolor
  misc_feature: Ceres ANNOT ID no. 6081110
  misc_feature: Encodes the peptide sequence at SEQ ID NO 7664
atgacgaaactacccctgccccttctccttctccagcctcctgccggcgccgcctccccgctccgctccctgctcctcctgctgccaccggcgcgccgccccacggtgatgtcagcggctacgtcgacggcgccgtcgagtggagagtatccttccccggtgtccccgccctacccggccgcctccaaggacgtggagctccggcgcgccatgaccgcctccgcgcgctccgcggccttcgcctctgcggacgtcgtgttcgaggacgagtggctcgccgtcgtcgacaagcccgccggtgtctactgcgacgccttcctcacctccctcccttcctctgtcgtctcagaggatccagcaactaaacctaatcttcaccttgcaaacaggctggatcgtgataccagtgggctcatggttatcaccaaatgcaacaaagttgctgggaagctagtgaaggcattcacagatcataaagtcaagaaaacatatctagctctttgcataggttgcccaccgacatgggaaaagattaagatatgttctggtcatggacgatcaaaacatggtgcttggcgtgtatatgctatgtctgatgttggccgttcactcccaggtggttctgttgtaagggacatgagcacgcagtttgaagttttaggggtcaatggtaaatgtcagtttagagaaccctacaactttgacaccgatgatattgagtcaattactgtacaagaaaaggcagctgaccagacttgtagtggtgatgtgaacaacagtgccattttggttagagcctatccccaaagtggacggacacatcagattcgtctacactgccagtatcttggtttcccgatcagaggtgatgtgaaatacggcggggtgattgagtggaacggcgtagagtgtgatggccatgcattgcatgcggagagcttgtcatttgtacaccctatcactggattgcccatcactttccggtcacctctcccttcatgggcaaaagaatgtatatcaacaatggaataa

SEQ ID NO: 7664 - protein, 343 aa, Sorghum bicolor
  misc_feature: Ceres ANNOT ID no. 6081110
  misc_feature (91)..(282): Pfam Id: PseudoU_synth_2 Pfam Desc: RNA pseudouridylate synthase
  misc_feature (34)..(339): NCBI GI: 92886361 NCBI Desc: pseudouridine synthase, rlu [medicago truncatula]
  misc_feature (85)..(220): NCBI GI: 106891130 NCBI Desc: pseudouridine synthase [roseiflexus sp. rs-1]
  misc_feature (65)..(220): NCBI GI: 118064040 NCBI Desc: pseudouridine synthase [roseiflexus castenholzii dsm 13941]
  misc_feature (54)..(219): NCBI GI: 118046027 NCBI Desc: pseudouridine synthase [chloroflexus aggregans dsm 9485]
  misc_feature (61)..(217): NCBI GI: 76260969 NCBI Desc: pseudouridine synthase [chloroflexus aurantiacus j-10-fl]
MTKLPLPLLLLQPPAGAASPLRSLLLLLPPARRPTVMSAATSTAPSSGEYPSPVSPPYPAASKDVELRRAMTASARSAAFASADVVFEDEWLAVVDKPAGVYCDAFLTSLPSSVVSEDPATKPNLHLANRLDRDTSGLMVITKCNKVAGKLVKAFTDHKVKKTYLALCIGCPPTWEKIKICSGHGRSKHGAWRVYAMSDVGRSLPGGSVVRDMSTQFEVLGVNGKCQFREPYNFDTDDIESITVQEKAADQTCSGDVNNSAILVRAYPQSGRTHQIRLHCQYLGFPIRGDVKYGGVIEWNGVECDGHALHAESLSFVHPITGLPITFRSPLPSWAKECISTME

SEQ ID NO: 7665 - DNA, 1740 bp, Sorghum bicolor
  misc_feature: Ceres ANNOT ID no. 6081159
  misc_feature: Encodes the peptide sequence at SEQ ID NO 7666
  misc_feature: Up-regulated in shoot tissues in response to methyl jasmonate treatment
atgtcttcgccggcgccggcggaagaggacggccgtgcgccgaccaagtacgtgctgatcacgggcggcgtcgtcagcggcctcggcaagggcgtcaccgccagcagcatcggcgtcgtcctcaaggcctgtgggctccgcgtcacctgcatcaagatcgatccatacttgaacacagatgctggtacaatgtccccctttgagcatggtgaggtgtttgttcttgatgatggtggagaggttgatttggatttggggaattatgagcgtttcatagatgtaactctgacgagggataacaacattaccactggaaagatataccagtctgtcattgagaaggagagaaggggtgattatcttggaaagactgtacaggttgttcctcatgtcactgatgaaataaaacagtggatacagtccgtgtcttcagttcctgtggatgggcagactcgtccagctgatgtttgtgttattgaattgggaggcactgtaggtgatattgagtcaatgccattcattgaagctttgcgccaattatccttttctcttggcaaggagaatttctgcctcatacacgttagccttgttccagtattgggtgtagttggtgagcagaaaactaaaccaacacaacacagtgtacgagaactgagagcgttgggtctgactcctgatcttctagcatgccggtcagcacagccactaataggatctgttaaggagaagctgtcacaattttgccatgtcccggttgagaacatactcaacatccatgatgttccaaatttatggcatgtcccacttattcttagaaaccaaaaggctcatgaagctataatcaaacaactgaaccttgctaggtccgctggaccacctgagttacgagattggacagatatggctgagtcgtatgataacctcaagaactctgttaaagttgctttggttgggaagtatactaatctgacagattcttacctatcagtggtgaaggctctcctacatgccagtgttgcctgttcgttaaagccatctatccagtggattgcagcttcggatcttgaagatgcaactgcaatatctgcaccagatgcccatgctgaagcctgggaaactcttaaaggttcatcatgcattttgatacctggaggattcggggatcgtggaatctcagggatgatattggctgcaaaatatgctcgtgagaataaagttccatatcttggtatttgcttgggcatgcagatatcagtgattgagatgtccagacatgtcctgggcctgggagatgcagacagtgaagagtttaacaaggatacaccaaatcatattgttatgtacatgcctgaggtttcaaaaacacatatgggaaacacaatgaggttgggctgcaggagaacattcttcaggaaacctgattgccttacatcaaaactgtatggaagtcctccacatgtagatgagcgtcatcgtcatagatacgaggtcaatccctcttttgttcccatgcttgaaagtgctggtcttcattttgttggttgtgacgaaagtcgaaagcggatggagattgtggagctacaagatcatccattctatgtaggtgttcagttccatccagagttcaaatcaaggccccgaagaccttcacctccttttacaggtctaataatggcagccactaaacaactgggaacaatttcgaatagctcgaatggctatgttggagcttctggctaa

SEQ ID NO: 7666 - protein, 579 aa, Sorghum bicolor
  misc_feature: Ceres ANNOT ID no. 6081159
  misc_feature (15)..(298): Pfam Id: CTP_synth_N Pfam Desc: CTP synthase N-terminus
  misc_feature (322)..(559): Pfam Id: GATase Pfam Desc: Glutamine amidotransferase class-I
  misc_feature (35)..(578): NCBI GI: 115489036 NCBI Desc: os12g0556600 [oryza sativa (japonica cultivar-group)]
  misc_feature (36)..(578): NCBI GI: 77556764 NCBI Desc: ctp synthase [oryza sativa (japonica cultivar-group)]
  misc_feature (16)..(564): NCBI GI: 92877256 NCBI Desc: ctp synthase [medicago truncatula]
  misc_feature (16)..(555): NCBI GI: 7268596 NCBI Desc: ctp synthase-like protein [arabidopsis thaliana]
  misc_feature (16)..(575): NCBI GI: 115438602 NCBI Desc: os01g0616900 [oryza sativa (japonica cultivar-group)]
  misc_feature (16)..(564): SWISSPROT Homolog: EC 6.3.4.2 CTP synthase 1
  misc_feature: Up-regulated in shoot tissues in response to methyl jasmonate treatment
MSSPAPAEEDGRAPTKYVLITGGVVSGLGKGVTASSIGVVLKACGLRVTCIKIDPYLNTDAGTMSPFEHGEVFVLDDGGEVDLDLGNYERFIDVTLTRDNNITTGKIYQSVIEKERRGDYLGKTVQVVPHVTDEIKQWIQSVSSVPVDGQTRPADVCVIELGGTVGDIESMPFIEALRQLSFSLGKENFCLIHVSLVPVLGVVGEQKTKPTQHSVRELRALGLTPDLLACRSAQPLIGSVKEKLSQFCHVPVENILNIHDVPNLWHVPLILRNQKAHEAIIKQLNLARSAGPPELRDWTDMAESYDNLKNSVKVALVGKYTNLTDSYLSVVKALLHASVACSLKPSIQWIAASDLEDATAISAPDAHAEAWETLKGSSCILIPGGFGDRGISGMILAAKYARENKVPYLGICLGMQISVIEMSRHVLGLGDADSEEFNKDTPNHIVMYMPEVSKTHMGNTMRLGCRRTFFRKPDCLTSKLYGSPPHVDERHRHRYEVNPSFVPMLESAGLHFVGCDESRKRMEIVELQDHPFYVGVQFHPEFKSRPRRPSPPFTGLIMAATKQLGTISNSSNGYVGASG

SEQ ID NO: 7667 - DNA, 2847 bp, Sorghum bicolor
  misc_feature: Ceres ANNOT ID no. 6081201
  misc_feature: Encodes the peptide sequence at SEQ ID NO 7668
atggcctccacgccggcggcgcccgccgtggcgccgtcgctggtggacacgctcttccagcgctccctaaacgacctcatcaagtccctccgcgccgacgcgtcggccgccggcgaggcggcggccgtggcccgcgcgctctccgagatccaccgcgagatccgcgccccggacgccgccaccaagtccgtcgcgctgcagaagctcacctacctctcctcgctccacttcgcccccgtcgcctcccacccgctcgccttccccgccatcgagctcctcgcctcgccgcacctgccccacaagcgcctggcctacctcgccgcgtcgctctcgctccacccggcctcgctctcgctgctcccgctcgccacgcaccagctccacaaggacctctccccctccccctccccctccgctggcgccgcccaccagcggcacgtctccgcgctcgcgctccagctcctcgcctcgcccgccgcggccgccgcgcccgacctccccgtccacctcgcgcacgacctcgtgccgcacctcgcccgcggcagcccacgcgccatcgccgccgccgcgcgcgtcatagccgcctcgccgtccgcggccgtgcccgtcctcttcaaaccgctggcggcgtgtctcgcctctcccgatcctcgggcgtccacggcggctgcggcagccttctgtgacctgtcggcgccccctgctgacgccacccctttcctgccgctcgcgcccgacctctacaacctgctcaccacctcccgatccaactgggctctcatcaaggtgctcaaggtgtttgcacgactggctcctctcgagccccgcctcgcagctagaattgtcgacccggtctgccagctcctcacccgatccggggccatgtcgctgaccttcgagtgcatccgtacggtgctcactgcgctgccagcacatgatgccgcggtccgccttgccattgggaaagccaaggagttcattgccgctgatgatgatcccaacctgaggtaccttggacttctggctgttggtatgcttggcccagcatatgcatccacggtgcatgattgtcaggatgctattgcgaagtcactgggtgatgccgacacaaacattcgccaggaggcgttgcatctcattatggggatggttaatgaaaacaacgtcatggacattgctggtatgctgatcggacatgttgctaagtcagacccagagttcgcaaatgacattcttggggctgttctagcagcttgtgggcataatgtgtatgagatggtggtggactttgattggtatgtttcgctccttgcggatatggcaaggaccctgcattgtgcccaaggggatgagattggtcggcagcttgttgatgtaggactgagagtgcaggatacccggccagagcttgtccgttcagctcgaactctcctgattgatcctgctttgcttggaaatcacttcctcttccctgttctttcagcggctgcatgggtttctggtgagtatgtggacttaacgaaggatcctgttgagcttgttgaagcactcttgcaaccaaggaccgggcttctgccaatttcagtgagagctgtctacatccatgcagtatttaaagtgattacatggtgtttcagtgtatatgttgggagattgggtgattcaggcatggcaatggatgtcacgttcgacaggtcagctgctgatcaaactgttagtttggacagcaatgttgcacttgggtctggcgaagagcaaggtattggggcgagcacagtgcgaaaggaccccttttcacatgaatctatactttacatgattgacctgattcaaacaacagttggtccattgattaactgcaatgaagtagaagtacaagatagagcacacaacctgattggttttgtccatttagtaagagagattcaagagctgaacaaaacgaaggttgctgatggtgacaagccaagcaggttagaagagcttgttaagactatgcggacagtgttctgtcaagaactaggtcctgtttctgtgaatgcacaaatgaaagtggcccttccagatggccttatcctgaatgaaaatcttgttgaacttgctggcatggtgagtgaagatgattctactccctcaacttcaatctttttctatccttgcagtcgtcattctgtagataccagagatgagcctgcagtgtcaattggttcgtcttctctttctgagcatcgcaagaggcatgggctcttttatctccaaacagggaaaactgaggacgagccaaatgattaccctcaagctaacgattctctaccatcttctagcaataattctgttaatgatgacaagttgaagactgctgaacttgtatttggtaggaaaaagtcgacggccacgaagtccagaccaaaagtagttaagttggatactgaggatttcctcagttctatgatgcctagtgcaaatgttccaaaagaagacccgttgtctggtgctctacgtgatgtgctcttgggtagtgatgctaaagcattgtcttcacaaaggacttcagatataaacttggaaggaatgctaaacaaaacaagcagtaatgaatctagcactccacggatagagaatttaggaagccatcctgcttcacattctagtagaacaagtaagcaacaaaaccatgataaagagaaaggtgcaaatcctgctgaaagtgatggcaaagaacaaagaaagcacagaagctctggtagaagtgggcatcgtcagggaaaacataagcatagagaaaagtctagtactcagcctgatactgtacctcaggctccagtcattcaagatttccttctatag

SEQ ID NO: 7668 - protein, 948 aa, Sorghum bicolor
  misc_feature: Ceres ANNOT ID no. 6081201
  misc_feature (39)..(640): Pfam Id: Adaptin_N Pfam Desc: Adaptin N terminal region
  misc_feature (1)..(948): NCBI GI: 115436956 NCBI Desc: os01g0512200 [oryza sativa (japonica cultivar-group)]
  misc_feature (295)..(643): NCBI GI: 56201815 NCBI Desc: ap-3 complex delta subunit-like protein [oryza sativa (japonica cultivar-group)]
  misc_feature (39)..(556): NCBI GI: 92873552 NCBI Desc: adaptin, n-terminal [medicago truncatula]
  misc_feature (39)..(540): NCBI GI: 33869469 NCBI Desc: ap3d1 protein [homo sapiens]
  misc_feature (39)..(562): NCBI GI: 51703373 NCBI Desc: ap3d1 protein [xenopus tropicalis]
MASTPAAPAVAPSLVDTLFQRSLNDLIKSLRADASAAGEAAAVARALSEIHREIRAPDAATKSVALQKLTYLSSLHFAPVASHPLAFPAIELLASPHLPHKRLAYLAASLSLHPASLSLLPLATHQLHKDLSPSPSPSAGAAHQRHVSALALQLLASPAAAAAPDLPVHLAHDLVPHLARGSPRAIAAAARVIAASPSAAVPVLFKPLAACLASPDPRASTAAAAAFCDLSAPPADATPFLPLAPDLYNLLTTSRSNWALIKVLKVFARLAPLEPRLAARIVDPVCQLLTRSGAMSLTFECIRTVLTALPAHDAAVRLAIGKAKEFIAADDDPNLRYLGLLAVGMLGPAYASTVHDCQDAIAKSLGDADTNIRQEALHLIMGMVNENNVMDIAGMLIGHVAKSDPEFANDILGAVLAACGHNVYEMVVDFDWYVSLLADMARTLHCAQGDEIGRQLVDVGLRVQDTRPELVRSARTLLIDPALLGNHFLFPVLSAAAWVSGEYVDLTKDPVELVEALLQPRTGLLPISVRAVYIHAVFKVITWCFSVYVGRLGDSGMAMDVTFDRSAADQTVSLDSNVALGSGEEQGIGASTVRKDPFSHESILYMIDLIQTTVGPLINCNEVEVQDRAHNLIGFVHLVREIQELNKTKVADGDKPSRLEELVKTMRTVFCQELGPVSVNAQMKVALPDGLILNENLVELAGMVSEDDSTPSTSIFFYPCSRHSVDTRDEPAVSIGSSSLSEHRKRHGLFYLQTGKTEDEPNDYPQANDSLPSSSNNSVNDDKLKTAELVFGRKKSTATKSRPKVVKLDTEDFLSSMMPSANVPKEDPLSGALRDVLLGSDAKALSSQRTSDINLEGMLNKTSSNESSTPRIENLGSHPASHSSRTSKQQNHDKEKGANPAESDGKEQRKHRSSGRSGHRQGKHKHREKSSTQPDTVPQAPVIQDFLL

SEQ ID NO: 7669 - DNA, 1470 bp, Sorghum bicolor
  misc_feature: Ceres ANNOT ID no. 6081211
  misc_feature: Encodes the peptide sequence at SEQ ID NO 7670
atggggctcgccaaggtggctgttgggtgccccaggctggagaagctcagcctcaagtggtgccgtgagatctctgacatcggaattgatctgctggccaagaagtgccccgagctccgcagcctcaacatatcctacctcaaggtgggtaatggatcccttagatcaatttcctcactcgagaggcttgaggaattggcaatggtttgttgttcatgtatagacgatgaaggcctggaattgctgagcaaggggagcgattcgctgcagagtgttgatgtgtcaagatgtgatcatgtgacttccgaggggttagcttcactgatagatggtcgcaattttgtccagaagttatatgctgcagattgtttgcatgagataggacaacgttttctatccaagttggcaacactgaaggaaaccttgacaatgctgaaactcgatggtcttgaggtctcggactctcttcttcaagccattggtgaaagctgtaacaaattggttgagattggacttagcaaatgcagtggtgttacagatgacggaatctcatctcttgtagctcagtgtagtgacctaagaacaattgatctcacatgctgcaatctcattaccaataatgcgcttgattcaatagctgacaactgtaagatgcttgaatgcttgcggttggaatcatgctctttgataaatgagaagggactaaagcgaattgcaacttgttgccccaatcttaaggagatagacctcactgactgcggagtggatgatgcagcattggagcacttggctaaatgctctgaattgagaatattgaaattaggcttatgctcaagtatttctgacaaaggcattgcgtttattagttcaaattgtggaaaacttgtggagcttgatctctaccggtgcaactctattactgatgatgggttggcagctttagtaaatggatgcaagaggattaagttactgaacttgtgttactgcaacaaaatcactgatactggtttgggtcacttaggctccctggaggagctcacaaaccttgaattgaggtgcttggtccgcataacaggcattgggatctcctcagttgcaattggatgcaagagcctgatagaactggacttgaaacgatgctattcagttgatgatgctgggctttgggcccttgctcgttatgctttgaaccttagacagcttacgatatcgtactgccaagtcacggggttgggcctgtgccacctgctgagctccctgcggtgcctccaggacattaagatggtgcacctctcatgggtctccatagaagggtttgagatggcactgcgagcagcctgtgggaggctgaagaagctgaagatgctctgtgggctgaagaccgtgctgtcccccgagctcctccagatgctgcaggcatgcggctgccgaataagatgggtcaacaaacctcttgtctacaaggactaa

SEQ ID NO: 7670 - protein, 489 aa, Sorghum bicolor
  misc_feature: Ceres ANNOT ID no. 6081211
  misc_feature (129)..(489): NCBI GI: 115488994 NCBI Desc: os12g0552700 [oryza sativa (japonica cultivar-group)]
  misc_feature (1)..(480): NCBI GI: 92879669 NCBI Desc: leucine-rich repeat; leucine-rich repeat, cysteine-containing subtype [medicago truncatula]
  misc_feature (68)..(480): NCBI GI: 144923780 NCBI Desc: leucine-rich repeat; leucine-rich repeat, cysteine-containing [medicago truncatula]
  misc_feature (2)..(453): NCBI GI: 21536497 NCBI Desc: f-box protein family, atfbl4 [arabidopsis thaliana]
  misc_feature (1)..(453): NCBI GI: 77552216 NCBI Desc: f-box protein family, atfbl4 [oryza sativa (japonica cultivar-group)]
  misc_feature: Useful for making plants with altered carbohydrate content
  misc_feature: Functional homolog of the protein sequence given in SEQ ID NO 13998
MGLAKVAVGCPRLEKLSLKWCREISDIGIDLLAKKCPELRSLNISYLKVGNGSLRSISSLERLEELAMVCCSCIDDEGLELLSKGSDSLQSVDVSRCDHVTSEGLASLIDGRNFVQKLYAADCLHEIGQRFLSKLATLKETLTMLKLDGLEVSDSLLQAIGESCNKLVEIGLSKCSGVTDDGISSLVAQCSDLRTIDLTCCNLITNNALDSIADNCKMLECLRLESCSLINEKGLKRIATCCPNLKEIDLTDCGVDDAALEHLAKCSELRILKLGLCSSISDKGIAFISSNCGKLVELDLYRCNSITDDGLAALVNGCKRIKLLNLCYCNKITDTGLGHLGSLEELTNLELRCLVRITGIGISSVAIGCKSLIELDLKRCYSVDDAGLWALARYALNLRQLTISYCQVTGLGLCHLLSSLRCLQDIKMVHLSWVSIEGFEMALRAACGRLKKLKMLCGLKTVLSPELLQMLQACGCRIRWVNKPLVYKD

SEQ ID NO: 7671 - DNA, 465 bp, Sorghum bicolor
  misc_feature: Ceres ANNOT ID no. 6081214
  misc_feature: Encodes the peptide sequence at SEQ ID NO 7672
atggccggaggaggctgcagcggcggcgacgacagcgagcacagctattacgggctggagtggacgctgcagcacttcttcgcggcggggcagccgcagcagtaccacctggtggtgctcacctccaagccccccgcggcctccgtcatcggcatcgccggcgtgggctccgtcgagctgctgcccaaggtcgaggccgacctcaagcgcaccgtcgccagggtcatggacaaggccaagaagctctgcacccaggtgatcgacgtcagctacgaagccatcgagggtgacgccaggagcgtcatctgcgacgcggttgatcggcaccacgccgagatcctggtcgtcggctgccatggctacagcaagtggaagagggctgtgcttgggagcgtgagcgactactgcacgcaccacgcgcactgcaccgtcatgatcgtcaagaagccaaagcacaagcactga

SEQ ID NO: 7672 - protein, 154 aa, Sorghum bicolor
  misc_feature: Ceres ANNOT ID no. 6081214
  misc_feature (9)..(148): Pfam Id: Usp Pfam Desc: Universal stress protein family
  misc_feature (8)..(154): NCBI GI: 77556730 NCBI Desc: universal stress protein family [oryza sativa (japonica cultivar-group)]
  misc_feature (8)..(154): NCBI GI: 38016525 NCBI Desc: fiber protein fb19 [gossypium barbadense]
  misc_feature (10)..(154): NCBI GI: 92878438 NCBI Desc: universal stress protein (usp) [medicago truncatula]
  misc_feature (10)..(154): NCBI GI: 55792398 NCBI Desc: universal stress protein [hordeum vulgare subsp. vulgare]
  misc_feature (86)..(154): NCBI GI: 92878441 NCBI Desc: universal stress protein (usp) [medicago truncatula]
MAGGGCSGGDDSEHSYYGLEWTLQHFFAAGQPQQYHLVVLTSKPPAASVIGIAGVGSVELLPKVEADLKRTVARVMDKAKKLCTQVIDVSYEAIEGDARSVICDAVDRHHAEILVVGCHGYSKWKRAVLGSVSDYCTHHAHCTVMIVKKPKHKH

SEQ ID NO: 7673 - DNA, 828 bp, Sorghum bicolor
  misc_feature: Ceres ANNOT ID no. 6081717
  misc_feature: Encodes the peptide sequence at SEQ ID NO 7674
atgtcgtcgtcgtggaactccgtggggctggcggtcctgtaccaggtgctgggctgggtcgccttcgtcgcgtggtccttcagcttctacccgcaggtcctcctcaactacaagcgcaagagtgtcgtgggcttgaattttgattttctggtgttgaacttgacaaagcattcatcctacctcatatacaatgcagctctattcttcagcccgttcatccagcaacagtatcatgacaaatatggtgacaaagagatgattcctgttgctgcaaatgatgttgctttttcactacatgctgtagcattgacagcctttaccgtttttcaagtattcatatatgagcgaggaacacagaaagtctccaaagtttgcatatcaatttctgctatcgtctggactgccgctcttgtttgcctcattattgcttggccaaaaagtgactggctttggcttattgatgtactcaattcaatacaagttggcatgacagcaatcaagtacattcctcaggccatcatgaatttcaggcggaagagtacaattggttggagcgttggcaatattttacttgatctcacaggaggcgtgctgaacttttgtcagatgggtgttcaatctatagatcaacatacgttagtaaatttctatgggaacattgggaaaacccttctttcattggagacggttttctttgatgtcgtgttcattatccaacactatgtgctgtaccctgtcacaaaggacgatcatggtaaggcaatcatttctgaaagggtagcccctcttatcaggccttcggacaagcctgaagaagatactgtatga

SEQ ID NO: 7674 - protein, 275 aa, Sorghum bicolor
  misc_feature: Ceres ANNOT ID no. 6081717
  misc_feature (10)..(75): Pfam Id: PQ-loop Pfam Desc: PQ loop repeat
  misc_feature (163)..(215): Pfam Id: PQ-loop Pfam Desc: PQ loop repeat
  misc_feature (6)..(244): NCBI GI: 47123179 NCBI Desc: mgc83915 protein [xenopus laevis]
  misc_feature (6)..(244): NCBI GI: 116128870 NCBI Desc: ensangp00000020402 [anopheles gambiae str. pest]
  misc_feature (6)..(244): NCBI GI: 108878113 NCBI Desc: cystinosin [aedes aegypti]
  misc_feature (6)..(244): NCBI GI: 108878114 NCBI Desc: cystinosin [aedes aegypti]
  misc_feature (7)..(275): NCBI GI: 119943118 NCBI Desc: cystinosis, nephropathic isoform 1 [homo sapiens]
MSSSWNSVGLAVLYQVLGWVAFVAWSFSFYPQVLLNYKRKSVVGLNFDFLVLNLTKHSSYLIYNAALFFSPFIQQQYHDKYGDKEMIPVAANDVAFSLHAVALTAFTVFQVFIYERGTQKVSKVCISISAIVWTAALVCLIIAWPKSDWLWLIDVLNSIQVGMTAIKYIPQAIMNFRRKSTIGWSVGNILLDLTGGVLNFCQMGVQSIDQHTLVNFYGNIGKTLLSLETVFFDVVFIIQHYVLYPVTKDDHGKAIISERVAPLIRPSDKPEEDTV

SEQ ID NO: 7675 - DNA, 339 bp, Sorghum bicolor
  misc_feature: Ceres ANNOT ID no. 6081769
  misc_feature: Encodes the peptide sequence at SEQ ID NO 7676
atggcgtcgctcaccatgatggcgtccttcgccgccgtggcggtggccgcgccctcgcgccgcggcagcttcgccgtggtcagggccgccaacaaggccgaccaccgctgccaccagcaggaggagcccgccagcgccaggctggcggcggcggcggcggccgaggagcccgccgagggacgccgcgccgtcatgctcgcggcggccgcggcggccgtggcggccatcggcggcgccggcgccgccatggcggaccccaagaaagggagccccgaggcgaagaagaagtacgcgcccatctgcgtcaccatgcccaccgccaagatctgccacaactga

SEQ ID NO: 7676 - protein, 112 aa, Sorghum bicolor
  misc_feature: Ceres ANNOT ID no. 6081769
  misc_feature (1)..(112): NCBI GI: 115446925 NCBI Desc: os02g0581100 [oryza sativa (japonica cultivar-group)]
  misc_feature (1)..(112): NCBI GI: 21537121 NCBI Desc: photosystem ii [arabidopsis thaliana]
  misc_feature (1)..(110): NCBI GI: 1465366 NCBI Desc: photosystem ii [arabidopsis thaliana]
  misc_feature (1)..(110): NCBI GI: 2129671 NCBI Desc: photosystem ii protein psbt - arabidopsis thaliana
  misc_feature (85)..(109): NCBI GI: 81475 NCBI Desc: photosystem ii 5k protein - spinach (fragment)
  misc_feature: Useful for making plants with modulated nitrogen use efficiency
  misc_feature: Functional homolog of the protein sequence given in SEQ ID NO 13144
MASLTMMASFAAVAVAAPSRRGSFAVVRAANKADHRCHQQEEPASARLAAAAAAEEPAEGRRAVMLAAAAAAVAAIGGAGAAMADPKKGSPEAKKKYAPICVTMPTAKICHN

SEQ ID NO: 7677 - DNA, 996 bp, Sorghum bicolor
  misc_feature: Ceres ANNOT ID no. 6081771
  misc_feature: Encodes the peptide sequence at SEQ ID NO 7678
atggggctcggggaggcggcgcggcggctcctggcggccgtggactgggagcgcgaggcctacccggcgtacggcgacttcctcgctctccccgccttcgttctcttcttccctaccgtccgcttcctcctcgaccgcttcgtcttcgagtgggttgcgaggaggcttatacatgggaatggacatcagagagctaataacgaaacagaagaagcaaggaagaagataagaaaattcaaggaatcagcttggaaatgtgtttatttcctgtctggagaacttttatctttgtcagtcacatataacgagccttggttcaccaataccagatatttttgggtaggaccaggagaacaggtctggcctgatcaaaagataaaattgaaacttaaggctgtatatatgtatgctgctggattctacacatattccatatttgcacttatgttttgggaaacaaggcgttcagactttggagtgtcaatgtcacatcatgttgctactgttgttctgattgttctatcttatgtgttcagatttgctagagttggttctatagtattggcaattcatgatgcaagcgatgttttcctggaagtagggaagatgtccaagtacagccattgtgattggcttgccaatgtttcgtttctgttttttgtgatttcatgggttcttctccgcctcacatattttccgttctggattctgagaagtacaagctatgaggtcttgttgactttggacaaaaagaagcacaattttgatggtcctatatactattatgtgttcaattcccttctattttcactacttgttctccacatatattggtgggttttaatatatcggatgcttgtgagacaaatcatgacaagaaatgttggagatgatgtgcgatctgattatgagaggacgagcattgttcctcacgagattcatcagagccgtgcctatggtttcttctgtgtcgactgccaatttgtgctgtactaa

SEQ ID NO: 7678 - protein, 331 aa, Sorghum bicolor
  misc_feature: Ceres ANNOT ID no. 6081771
  misc_feature (97)..(308): Pfam Id: LAG1 Pfam Desc: Longevity-assurance protein (LAG1)
  misc_feature (1)..(304): NCBI GI: 62899852 NCBI Desc: asc1-like protein 1 (alternaria stem canker resistance-like protein 1)
  misc_feature (14)..(310): NCBI GI: 62899859 NCBI Desc: asc1-like protein 2 (alternaria stem canker resistance-like protein 2)
  misc_feature (10)..(304): NCBI GI: 7688742 NCBI Desc: asc1 [lycopersicon esculentum]
  misc_feature (1)..(242): NCBI GI: 34365553 NCBI Desc: at1g13580/f13b4_25 [arabidopsis thaliana]
  misc_feature (32)..(303): NCBI GI: 7658241 NCBI Desc: lag1 homolog 2 [arabidopsis thaliana]
MGLGEAARRLLAAVDWEREAYPAYGDFLALPAFVLFFPTVRFLLDRFVFEWVARRLIHGNGHQRANNETEEARKKIRKFKESAWKCVYFLSGELLSLSVTYNEPWFTNTRYFWVGPGEQVWPDQKIKLKLKAVYMYAAGFYTYSIFALMFWETRRSDFGVSMSHHVATVVLIVLSYVFRFARVGSIVLAIHDASDVFLEVGKMSKYSHCDWLANVSFLFFVISWVLLRLTYFPFWILRSTSYEVLLTLDKKKHNFDGPIYYYVFNSLLFSLLVLHIYWWVLIYRMLVRQIMTRNVGDDVRSDYERTSIVPHEIHQSRAYGFFCVDCQFVLY

SEQ ID NO: 7679 - DNA, 591 bp, Sorghum bicolor
  misc_feature: Ceres ANNOT ID no. 6081801
  misc_feature: Encodes the peptide sequence at SEQ ID NO 7680
atgaggcagtctagccgccccggggacgtcgatcctgccgctggcggtcatcaggataagaagttgaagctttgcggtgaacggtcccatggtttggacgttttgcaggggacggcgaaccgggatgaggaggacgcccccgccacgggcgcagcagtcaccattcccggccaggctctgcgagcggcggcgctgtccccggccggagacaggccggtggaccacgccgacgcgacggtggtgcaggccgcggtgcagagggcagcggggcagggcggggtcgtggtccccggcggcgtcgcggccgtagcacagcgggccgcggagacgaacaagcgaccaccggatcaggaagcgcgcggcggcgaggaggcgaagccggtggctctgagggacgtgctatgcgacccctcggccgtggtgccgggcgacagggcggccacgtggctggacgcggagaaggtcgcggctgcctactcagcgggggaaggcggcggcatgggcgaggtcgccgacgccatggcggcggccgcgctgatgaacgagggccatcgatatgatgctgcaacgctgcgatgcaaaggggactag

SEQ ID NO: 7680 - protein, 196 aa, Sorghum bicolor
  misc_feature: Ceres ANNOT ID no. 6081801
  misc_feature (52)..(116): Pfam Id: SMP Pfam Desc: Seed maturation protein
  misc_feature (3)..(183): NCBI GI: 115489678 NCBI Desc: os12g0626500 [oryza sativa (japonica cultivar-group)]
  misc_feature (36)..(182): NCBI GI: 4587565 NCBI Desc: similar to rab28 protein gbx59138 from zea mays. est gbaa042774 comes from this gene. [arabidopsis thaliana]
  misc_feature (52)..(182): NCBI GI: 226556 NCBI Desc: lea d-34 gene
  misc_feature (52)..(182): NCBI GI: 18501 NCBI Desc: d-34 lea protein [gossypium hirsutum]
  misc_feature (46)..(182): NCBI GI: 57506542 NCBI Desc: ecp31 protein [daucus carota]
MRQSSRPGDVDPAAGGHQDKKLKLCGERSHGLDVLQGTANRDEEDAPATGAAVTIPGQALRAAALSPAGDRPVDHADATVVQAAVQRAAGQGGVVVPGGVAAVAQRAAETNKRPPDQEARGGEEAKPVALRDVLCDPSAVVPGDRAATWLDAEKVAAAYSAGEGGGMGEVADAMAAAALMNEGHRYDAATLRCKGD

SEQ ID NO: 7681 - DNA, 933 bp, Sorghum bicolor
  misc_feature: Ceres ANNOT ID no. 6081815
  misc_feature: Encodes the peptide sequence at SEQ ID NO 7682
atgcaggcggcaggcggctgccgcgccgccaacctttgctccccgtcgctctcacgctttcggtgtggcttccgtctccccggccgggcccgcctcttctctgaaggcgtggcggcggcgccacttcgcgtcggctacctgccccagccgcggacacatggcagcggccgtttcgcgcacctcgaagccatggatgcggaggcgccgcggctgccgcacgccctccggggaatgcttatcgatcatcagaagatggcatgtcccaaccttctgaaagctgctgtactttcaaccatgacattacttgctgtacctcttgaggcatcagcggagatgtgccaaccacctaattctttcgccaatatgccaattttcattgctgtagctctaataggagctgctgttggcggattgttagcacgccaaagaaaggcagaattgaagcggctcaataatcaacttcgccagatcaatgcagcacttagaaggcaggcacagattgaatcatttgcgcctggccttacttatgcgccagttaggagaacaaatgaaactgatgttattgttgacccaaggaagcagcagttggtcacaaatctgagaaatgggaagaattacatgaggaatcaagatcttcataaggctatagtggagttcagaacagctttggagcttgcagagagcataggagatcgttttgaagaaaagaaagctgcacgaggactaggtgcatcgctgcaaaggctcggaaaataccgagaagcaatgagacagtacaccaaggttctggagctgtctaaggagacaggtgaagattctggctgcaccgaggcctacggtgccatagctgactgctacaccgagctgggcgacctggagcgagcggcgaagatatatgacaagtacatatcgaggctgcagcccggcgaatag

SEQ ID NO: 7682 - protein, 310 aa, Sorghum bicolor
  misc_feature: Ceres ANNOT ID no. 6081815
  misc_feature (73)..(307): NCBI GI: 20804493 NCBI Desc: tetratricopeptide repeat(tpr)-containing protein-like [oryza sativa (japonica cultivar-group)]
  misc_feature (70)..(307): NCBI GI: 112735174 NCBI Desc: chloroplast flu-like protein [gymnadenia conopsea]
  misc_feature (94)..(307): NCBI GI: 42572429 NCBI Desc: tetratricopeptide repeat (tpr)-containing protein [arabidopsis thaliana]
  misc_feature (200)..(306): NCBI GI: 51950311 NCBI Desc: chloroplast flu-like protein short form [chlamydomonas reinhardtii]
  misc_feature (200)..(306): NCBI GI: 51950309 NCBI Desc: chloroplast flu-like protein long form [chlamydomonas reinhardtii]
  misc_feature: The plant is abnormally small.
  misc_feature: The plant produces a reduced number of seeds.
  misc_feature: Useful for biocontainment applications
  misc_feature: Useful for making plants with altered Lignin content
  misc_feature: Useful for making plants with altered alkaloid content
  misc_feature: Useful for making plants with modulated biomass
  misc_feature: Functional homolog of the protein sequence given in SEQ ID NO 13174
  misc_feature: Useful for biocontainment applications
  misc_feature: Useful for making plants with altered alkaloid content
  misc_feature: Useful for making plants with altered lignin content
  misc_feature: Useful for making plants with modulated biomass
  misc_feature: Functional homolog of the protein sequence given in SEQ ID NO 13174
MQAAGGCRAANLCSPSLSRFRCGFRLPGRARLFSEGVAAAPLRVGYLPQPRTHGSGRFAHLEAMDAEAPRLPHALRGMLIDHQKMACPNLLKAAVLSTMTLLAVPLEASAEMCQPPNSFANMPIFIAVALIGAAVGGLLARQRKAELKRLNNQLRQINAALRRQAQIESFAPGLTYAPVRRTNETDVIVDPRKQQLVTNLRNGKNYMRNQDLHKAIVEFRTALELAESIGDRFEEKKAARGLGASLQRLGKYREAMRQYTKVLELSKETGEDSGCTEAYGAIADCYTELGDLERAAKIYDKYISRLQPGE

SEQ ID NO: 7683 - DNA, 315 bp, Sorghum bicolor
  misc_feature: Ceres ANNOT ID no. 6081817
  misc_feature: Encodes the peptide sequence at SEQ ID NO 7684
atggcgtccaactccaaggcgctcctcgtgttagcgctcctgctcgccgccactttcctcgtcgcctccgctaacgagcaagcccgtgagcaggccaaagaggagaagaaggcggaggtccaggactggcacggcggcggcggctacccgggtcgcggcggcggctggcacggcggcggcggcggctaccctggcggacactgccggtggggttgctgcgaccgcgggcactatggcggctgccggtgctgctcgcaccccgaccagataccggagcccatgtaccgccctgagctcgtcgaggtccacaactga

SEQ ID NO: 7684 - protein, 104 aa, Sorghum bicolor
  misc_feature: Ceres ANNOT ID no. 6081817
  misc_feature (1)..(81): Pfam Id: GRP Pfam Desc: Glycine rich protein family
  misc_feature (45)..(98): NCBI GI: 27461096 NCBI Desc: glycine-rich protein [lilium hybrid cv. 'star gazer']
  misc_feature (45)..(99): NCBI GI: 728596 NCBI Desc: glycine rich protein [hordeum vulgare subsp. vulgare]
  misc_feature (45)..(92): NCBI GI: 295808 NCBI Desc: glycine-rich protein [hordeum vulgare subsp. vulgare]
  misc_feature (45)..(92): NCBI GI: 121644 NCBI Desc: glycine-rich cell wall structural protein precursor
  misc_feature (45)..(98): NCBI GI: 7024449 NCBI Desc: glycine-rich protein [citrus unshiu]
MASNSKALLVLALLLAATFLVASANEQAREQAKEEKKAEVQDWHGGGGYPGRGGGWHGGGGGYPGGHCRWGCCDRGHYGGCRCCSHPDQIPEPMYRPELVEVHN

SEQ ID NO: 7685 - DNA, 1272 bp, Sorghum bicolor
  misc_feature: Ceres ANNOT ID no. 6081869
  misc_feature: Encodes the peptide sequence at SEQ ID NO 7686
atggcggtggagaagacgctgcccggcgcgaatgccgggaggaccgtgctcgtcacgggcggggcgggctacatcggcagccacgccgtgctgcagctcctcctcgcgggattccgcgccgtcgtcgtcgacaacctcaacaactcctctgagctcgccgtccgacgcgtcgccgcgctcgcgggggaccactcgcgcaacctctccttccacaagattgatctccgtgacaagggaacgctggaaatggtttttgcttctacaagatttgatgctgttgtccactttgctggattgaaagctgtgggtgaaagtgtacagaagccattactttattatgacaacaacgtcattggcacgataaatcttctagaagttatgtctgctcatggttgcaagaagttggtgttctcatcatcagctgcagtttatggatctcccagaaactcaccttgcacagaagagtttcctctgactccaaacaatccatatggcaaaacaaagcttgttgttgaggatatttgccgtgatatctaccgttcagatcctgaatggaagatcattttacttaggtacttcaatccagttggtgctcatcctagtggatatcttggtgaggacccacgaggaattcccaacaatcttatgccctatgttcagcaagttgcggttggtaggaggccagctctgacagttttaggaaatgactatgcgacaagagatggaactggggtccgagattacatccatgttgttgaccttgctgatggacatattgctgcattacagaagctttttgagaactctagcatagggtgtgaagcatacaaccttggaaccggaagaggtacatctgtgctggagattgttaaagcgttcgagaaggcttctgggaagaaaatccctctgatttttggtgaaagacgccctggtgatgcagagattctcttttcagagactactaaagcagagagggagcttaactggaaagcaaaatatggtattgaagagatgtgtcgcgaccaatggaactgggccagcaagaacccttatggctatggatcgcttgactctaccaagcagaatggccaccaaacaaatggatctgctgactcctccaagcagaatggccaccacacaaatggttcaactgactcacccaagcggaatgaccactatgcctatgggtccgccgactcacccaagcggaatgggcactatgtttatggatcatcagacttcaagcagaatggtaatggtcacctgcgctga

SEQ ID NO: 7686 - protein, 423 aa, Sorghum bicolor
  misc_feature: Ceres ANNOT ID no. 6081869
  misc_feature (16)..(279): Pfam Id: Epimerase Pfam Desc: NAD dependent epimerase/dehydratase family
  misc_feature (17)..(303): Pfam Id: 3Beta_HSD Pfam Desc: 3-beta hydroxysteroid dehydrogenase/isomerase family
  misc_feature (18)..(242): Pfam Id: NAD_binding_4 Pfam Desc: Male sterility protein
  misc_feature (14)..(156): Pfam Id: adh_short Pfam Desc: short chain dehydrogenase
  misc_feature (9)..(364): NCBI GI: 71063878 NCBI Desc: udp-d-glucose epimerase 2 [hordeum vulgare]
  misc_feature (12)..(359): NCBI GI: 3021357 NCBI Desc: udp-galactose 4-epimerase [cyamopsis tetragonoloba]
  misc_feature (14)..(359): NCBI GI: 92898077 NCBI Desc: udp-glucose 4-epimerase [medicago truncatula]
  misc_feature (14)..(359): NCBI GI: 92898076 NCBI Desc: udp-glucose 4-epimerase [medicago truncatula]
  misc_feature (14)..(360): NCBI GI: 32130594 NCBI Desc: udp-glucose-4-epimerase [zea mays]
  misc_feature (12)..(359): SWISSPROT Homolog: EC 5.1.3.2 UDP-glucose 4-epimerase GEPI48
  misc_feature: Useful for making plants with altered cell wall content and/or composition
  misc_feature: Functional homolog of the protein sequence encoded by LOCUS at1g64440
  misc_feature: Functional homolog of the protein sequence encoded by LOCUS at4g10960
  misc_feature: Functional homolog of the protein sequence encoded by LOCUS at4g23920
  misc_feature: Useful for making plants with altered carbohydrate content
  misc_feature: Functional homolog of the protein sequence given in SEQ ID NO 13976
  misc_feature: Useful for making plants with altered cell wall content and/or composition
  misc_feature: Functional homolog of the protein sequence given in SEQ ID NO 13977
MAVEKTLPGANAGRTVLVTGGAGYIGSHAVLQLLLAGFRAVVVDNLNNSSELAVRRVAALAGDHSRNLSFHKIDLRDKGTLEMVFASTRFDAVVHFAGLKAVGESVQKPLLYYDNNVIGTINLLEVMSAHGCKKLVFSSSAAVYGSPRNSPCTEEFPLTPNNPYGKTKLVVEDICRDIYRSDPEWKIILLRYFNPVGAHPSGYLGEDPRGIPNNLMPYVQQVAVGRRPALTVLGNDYATRDGTGVRDYIHVVDLADGHIAALQKLFENSSIGCEAYNLGTGRGTSVLEIVKAFEKASGKKIPLIFGERRPGDAEILFSETTKAERELNWKAKYGIEEMCRDQWNWASKNPYGYGSLDSTKQNGHQTNGSADSSKQNGHHTNGSTDSPKRNDHYAYGSADSPKRNGHYVYGSSDFKQNGNGHLR

SEQ ID NO: 7687 - DNA, 831 bp, Sorghum bicolor
  misc_feature: Ceres ANNOT ID no. 6081971
  misc_feature: Encodes the peptide sequence at SEQ ID NO 7688
atggcggctccgatgccgtcttccacgccgccgccggcagccgcaaaccccagccacaatccgaggcggaagcggaagcccaggccgaaaacactccagtcgaagctcccccaccgccccgcggcaacccacctgggcaagcgcaagcacgacgatgaccctccggcgcccgcggagccgtctccaccacccgcagtgcaggatatcaaactcgacccaacctctgacgacaccagcttgactaaggcggtggcgattgactgcgagatggtcggggtaggatctgatggcagcaaaagcgctctcggtagggttaccttggttaattcctttggcaatgttgtatatgatgaatatgttcgtactgtggagcgaattgtggactaccgtacccggattagtgggattagacctaagcacatgaacaaagccaaagaattctgggccgtgcagaaggaagtagctgagctgattaaaggaagagttcttgttggtcatgcactgcacaatgatctcaaggtcttgctactaagccaaccaaagaaggacatcagggatacatctgaatatgaggttttccgaagggagagaaagaggcgatccttgaaggatcttgctgctgaagtacttggtgctaaaatacaacagaatgaacactgccccattgaggacgcacgagctgcaatgttcatttacaacaagcacaagaaagcatgggagaagaacatgaaggaacaattcagattcaaaaagaagctcaagaagcgaggcaagaagaaaactaccgagtccaatgggaatgaccccaatgtccccactgttcttctatag

SEQ ID NO: 7688 - protein, 276 aa, Sorghum bicolor
  misc_feature: Ceres ANNOT ID no. 6081971
  misc_feature (83)..(232): Pfam Id: Exonuc_X-T Pfam Desc: Exonuclease
  misc_feature (8)..(276): NCBI GI: 40253326 NCBI Desc: exonuclease-like protein [oryza sativa (japonica cultivar-group)]
  misc_feature (46)..(267): NCBI GI: 8777491 NCBI Desc: exonuclease-like protein [arabidopsis thaliana]
  misc_feature (80)..(246): NCBI GI: 9931304 NCBI Desc: xpmc2h [homo sapiens]
  misc_feature (59)..(260): NCBI GI: 49899970 NCBI Desc: xpmc2 prevents mitotic catastrophe 2 homolog [xenopus tropicalis]
  misc_feature (59)..(260): NCBI GI: 89267425 NCBI Desc: prevents mitotic catastrophe 2 homolog [xenopus tropicalis]
MAAPMPSSTPPPAAANPSHNPRRKRKPRPKTLQSKLPHRPAATHLGKRKHDDDPPAPAEPSPPPAVQDIKLDPTSDDTSLTKAVAIDCEMVGVGSDGSKSALGRVTLVNSFGNVVYDEYVRTVERIVDYRTRISGIRPKHMNKAKEFWAVQKEVAELIKGRVLVGHALHNDLKVLLLSQPKKDIRDTSEYEVFRRERKRRSLKDLAAEVLGAKIQQNEHCPIEDARAAMFIYNKHKKAWEKNMKEQFRFKKKLKKRGKKKTTESNGNDPNVPTVLL

SEQ ID NO: 7689 - DNA, 3486 bp, Sorghum bicolor
  misc_feature: Ceres ANNOT ID no. 6082024
  misc_feature: Encodes the peptide sequence at SEQ ID NO 7690
atgcccatggacacagacgagcgccccctcgtcgagctcgcctccgcctccgccggcgccgctgcggccgccactactcccaccgcctcgacctccgcctccgctcccttcccggcccctgccacaccggggttctcccgcgcggtccgctgcaacgcgcccgcttcctcgctcccgggcaccgatggcggcgcgcagcagccggcgtacccggggaacgcgatctcgacgaccaagtacacgcccgcgagcttcgtgcccaagtcgctcttcgagcagttccgccgcgccgccaactgcttcttcctcgtcgtcgcctgcgtctccttcagcccgctcgcgccctaccgcgccgtctccgtcctgctcccgctcgtcgtcgtcgtcagcgccgccatggccaaggaggccgtcgaggactggcgccggaagcagcaggacatagaagtgaacaataggaaggttgaggtgtttgatgggatccaatcatttcatgagacggaatggaagaagcttcgagttggcgatatagttaaagttaaaaaggatgagttcttccctgctgatcttcttttcctttcgtctagctctgatgatggattatgctatgtggagacaatgaatcttgatggtgagacaaacttgaagcggaaacaggcattagaggtgactatgggcttgaatgatgaccaggttttccatagtttcaaggctttcattcgatgtgaggatccgaatgagaaactgtattctttcttaggaactctgtactacaatgggcaacaatattctctgtctccggaacagatcctgctaagggactcaaaacttcgtaatacaatgtgtatatatggcactgtaatatttacgggacatgatacaaaggtgatgcaaaatgcaatggagccaccgtcaaagaggagttcagttgaacgaaggatggataaaataatatatctcctttttgtgattctctttgctattgcaacgttcgggtcagttgtgtttggaatgaaaacaaagcatgaggtaagtccaggaaactatgcatggtacctcagaccagatcaagcaaatatattctttgatccaaacaatgcatcatttgcagccttctgccattttctcacaagcctgatgctgtatgtgtgcttggtgcctatttcattgtatatatcgatagaaattgtcaaggtgttacagagcacattcataaatcaagaccagaatatgtattgtgcagagtctgataaacctgcaagagctcgcacttcaaatttgaatgaagaacttggtcaagttcacactatactgtctgacaaaacagggacattaacatgcaattcaatggagttcttgaaatgttctattgctggtgttgcttatggaaatatggctacagaagtggtgacatgttatggagaaatagctgaaactactggcagttttgggcacaaggacactgctgaattcaagagatcagtcaaggggtttaatttcactgatagtcgtttgatgaatggaagatgggccaaagaatgttcaagggatgctatagaaatgtttttccgagtgttagctgtttgccatactgcaattcctgtggcagatagaaattctgctggtatgccttatgaagctgagtctcctgatgaaggagctcttgttacagctgcaagagagtttggttttgaattttatcataggacacaaacgacaatatcagtgcatgagtatgatcctgttgttggtggaaaggtggatagaacatataaactactcaacatcttagagttcagcagtgctcgtaagcgtatgtctgtcattgtgaggacagaagagggtcgactatttctcttctgcaaaggagcggacagtgtaatatttgaaaggctctccaaggataatggaacagcttgtctgaccaaaacgaagtgtcacattgatgagtattctgaggcaggtctccggaccctggcacttgcatattgtgaacttactgaagaacaatatgttgtatggaatcagaagtactcgtctgccaagaattctgtacatactgatcacgatgcagctgttgagaaggcatcagaagacattgagaaggatttggttctcttgggtgctactgctgtagaggatagattgcaaaatggggtccctgaatgtatttacaaacttgcacaagctggaattaagatctggattttaactggagacaagttggagacagctgtgaacataggttacgcttgtaacctactgaggaaagagatggaggaaatttttatcacactggagaactcaggtacaaatgcttcagagggttccagtggagaaggaaacaaaatggccgcgtttgaagaaattgataggaaattacaagatgctagaggaaagatttcccaaaaaggaacttcaacttcatttgctcttatcattgatggcaatgctctgacacatgctctcacgggccgccttaagaactcatttctagatctagcagtcaactgtgcatcagttttatgttgtcgggtttcaccaaaacaaaaggcactggtcaccaggttgattaaaattaggacaagtaaaactactttagctattggcgatggagcaaatgatgttggtatgctacaagaggctgacattggggttggaataagtggtgctgaaggaatgcaggctgttatggcaagtgactttgcaattgcacagtttcgtttcttagagcgattacttcttgtgcatggtcattggtgttatcgtcggattgcagctatgatatgctattttttcttcaagaacatcacatttggctttacgcttttctggtttgaggctcatgctatgttctcagcacaacctgcgtacaatgattggttcatttctttctataacgttgccttcacatctcttcctgtcatcgccctcggtgtttttgacaaggatgtctcttcccgtgtttgtcttgaggtcccttcattacatcaagatggtgttaataatgtattcttcagttggtcccgaatactcagttggatgttaaatgggatgtgctgttcaataattatttactttggttccctcaacgctattctggttcaggctgtccgacaggatggtcgtgttgctgggtttgacatccttggggtgaccatgtacagttgtgtagtgtggactgtgaactgccagcttgctctctacatcagctacttcacctggatacagcattttgtcatctggggcagcatactgatctggtacactttcctggtcatctatggactattttccccagcaatatcgaccactgcatatcatgtttttgtggaagcttgtgcgcctagccctttgtactggttatctattctaatgattgtggtgaccgccttgatcccattctttgtctacaaaatatcgagaacactgtattacccacagtatcatgatcaagttcaaagggctaactcaaagaattggtag

SEQ ID NO: 7690 - protein, 1161 aa, Sorghum bicolor
  misc_feature: Ceres ANNOT ID no. 6082024
  misc_feature (434)..(892): Pfam Id: Hydrolase Pfam Desc: haloacid dehalogenase-like hydrolase
  misc_feature (44)..(1151): NCBI GI: 11994492 NCBI Desc: p-type transporting atpase-like protein [arabidopsis thaliana]
  misc_feature (44)..(1151): NCBI GI: 15232278 NCBI Desc: haloacid dehalogenase-like hydrolase family protein [arabidopsis thaliana]
  misc_feature (43)..(1154): NCBI GI: 5734708 NCBI Desc: similar to gbaf067820 atpase ii from homo sapiens and is a member of pf00122 e1-e2 atpases family. [arabidopsis thaliana]
  misc_feature (43)..(1154): NCBI GI: 11994751 NCBI Desc: p-type transporting atpase [arabidopsis thaliana]
  misc_feature (43)..(1154): NCBI GI: 92878535 NCBI Desc: atpase, e1-e2 type [medicago truncatula]
MPMDTDERPLVELASASAGAAAAATTPTASTSASAPFPAPATPGFSRAVRCNAPASSLPGTDGGAQQPAYPGNAISTTKYTPASFVPKSLFEQFRRAANCFFLVVACVSFSPLAPYRAVSVLLPLVVVVSAAMAKEAVEDWRRKQQDIEVNNRKVEVFDGIQSFHETEWKKLRVGDIVKVKKDEFFPADLLFLSSSSDDGLCYVETMNLDGETNLKRKQALEVTMGLNDDQVFHSFKAFIRCEDPNEKLYSFLGTLYYNGQQYSLSPEQILLRDSKLRNTMCIYGTVIFTGHDTKVMQNAMEPPSKRSSVERRMDKIIYLLFVILFAIATFGSVVFGMKTKHEVSPGNYAWYLRPDQANIFFDPNNASFAAFCHFLTSLMLYVCLVPISLYISIEIVKVLQSTFINQDQNMYCAESDKPARARTSNLNEELGQVHTILSDKTGTLTCNSMEFLKCSIAGVAYGNMATEVVTCYGEIAETTGSFGHKDTAEFKRSVKGFNFTDSRLMNGRWAKECSRDAIEMFFRVLAVCHTAIPVADRNSAGMPYEAESPDEGALVTAAREFGFEFYHRTQTTISVHEYDPVVGGKVDRTYKLLNILEFSSARKRMSVIVRTEEGRLFLFCKGADSVIFERLSKDNGTACLTKTKCHIDEYSEAGLRTLALAYCELTEEQYVVWNQKYSSAKNSVHTDHDAAVEKASEDIEKDLVLLGATAVEDRLQNGVPECIYKLAQAGIKIWILTGDKLETAVNIGYACNLLRKEMEEIFITLENSGTNASEGSSGEGNKMAAFEEIDRKLQDARGKISQKGTSTSFALIIDGNALTHALTGRLKNSFLDLAVNCASVLCCRVSPKQKALVTRLIKIRTSKTTLAIGDGANDVGMLQEADIGVGISGAEGMQAVMASDFAIAQFRFLERLLLVHGHWCYRRIAAMICYFFFKNITFGFTLFWFEAHAMFSAQPAYNDWFISFYNVAFTSLPVIALGVFDKDVSSRVCLEVPSLHQDGVNNVFFSWSRILSWMLNGMCCSIIIYFGSLNAILVQAVRQDGRVAGFDILGVTMYSCVVWTVNCQLALYISYFTWIQHFVIWGSILIWYTFLVIYGLFSPAISTTAYHVFVEACAPSPLYWLSILMIVVTALIPFFVYKISRTLYYPQYHDQVQRANSKNW

SEQ ID NO: 7691 - DNA, 1809 bp, Sorghum bicolor
  misc_feature: Ceres ANNOT ID no. 6082026
  misc_feature: Encodes the peptide sequence at SEQ ID NO 7692
atggcgccccacctactcaccccaccggccctcgccattacgggcgccgccgccccaggccgcctcggcggcgccgcatcgaaggcggacccgcgggcgcccaggccacgcgcgccgtcgcgcaccttcttctgctcctcccccggcacagggcggcgcgggatgatgatgatgaggaggaagggcttgagcgtcgcggcggcggcggcggcgcaaggagcggaaccgggtgggcccgcgggaccgatgcggctcaacgagtacatggtcgctgtcgaccggcccctcggcgtccgcttcgcactaggtgtcgacggacgcgtcttcgtccactccctcaggaaaggggggaacgccgagaagtccaggatcatcatggtcggcgatacgctcaagaaggcgggcggtgacggcgaaggcctcgtcaccatcaaagacctaggtgacacggagtctgcgctaagggataagtctggaccgtgcagccttgtccttgagagaccatttgctccttttccaatccatcagttgcatcaaaatgaagattaccacattctatttaacaaagggcgggctgctgttgcctcctggaatagtgctgttttgtccacaaagctgaatggatcttctactggggatggaaaatctggttttgctgtattctccccaaggttgctaagttctcaaggatgggctcttctgtctaacgagaagggtggactcaatcagagtagcactaaccttgccaatcgcataagcgagattgttggtttgtattctgatgaagacgatgccaatgctgagtgggcacatggtagctttcctttggaggagtacatcaaagcactagaccgtgctaaaggtgaactgtactataatcattcactgggtatgcagtacagcaagataacagaacaaatatttgttgggtcatgtattcaaacagagaaagatgtgaagatgttatcagaaactatgggtattactgctgttctgaatttccaaagtgaaagtgagcgcattaactggggaatcaattctgagacaatcaacagttcttgtcgtgagaataacatcttgatggttaactatcctatacgagaggttgattccgtggacctaagaaagaaacttcctttctgtgttggacttctgttgcgtcttatcaggaagaactaccgtatatatgtgacttgtaccactggatatgatagatcacctgcatgcgtgatatcatacttacactgggttcaagatacacctctccatattgctcacaagttcatcactggtttgcactcttgtagacctgacagagctgcaattgtttgggcaacttgggatcttattgctttagttgaaaatggaaggcatgatggtagtcccacacattcagtatgtttcgtttggaatagtggtagggagggagaggatgtagagttggttggagattttacaagtaactggaaagacaaaataaggtgcaaccacaagggtgggtcaagatatgaggctgaagttcgacttcgacatggaaagtactattacaagtttatagttggagggcagtggaggcattcgacttcactgcctacagaaacagatgaacatgggaatgtcaacaatgtgatcagagtaggtgacattgcttggattcgtcctgctccaagccagctacatataaaagacccaactgttgttaaggtcatagaaagggcgctaactgaggacgagcggttttcattggcgtttgcagcacgccgcatggcatttgcaatctgcccaatcagattatcacctaagcagtag

SEQ ID NO: 7692 - protein, 602 aa, Sorghum bicolor
  misc_feature: Ceres ANNOT ID no. 6082026
  misc_feature (299)..(455): Pfam Id: DSPc Pfam Desc: Dual specificity phosphatase, catalytic domain
  misc_feature (59)..(601): NCBI GI: 18395843 NCBI Desc: 5'-amp-activated protein kinase beta-1 subunit-related [arabidopsis thaliana]
  misc_feature (277)..(548): NCBI GI: 11544663 NCBI Desc: ptpkis1 [arabidopsis thaliana]
  misc_feature (277)..(548): NCBI GI: 23505915 NCBI Desc: at3g52180/f4f15_290 [arabidopsis thaliana]
  misc_feature (277)..(548): NCBI GI: 82623389 NCBI Desc: protein tyrosine phosphatase-like [solanum tuberosum]
  misc_feature (277)..(548): NCBI GI: 14970762 NCBI Desc: protein tyrosine phosphatase [lycopersicon esculentum]
  misc_feature: The sequence is a functional homolog of SEQ ID NO. 473 in the 11/188,298 US application
MAPHLLTPPALAITGAAAPGRLGGAASKADPRAPRPRAPSRTFFCSSPGTGRRGMMMMRRKGLSVAAAAAAQGAEPGGPAGPMRLNEYMVAVDRPLGVRFALGVDGRVFVHSLRKGGNAEKSRIIMVGDTLKKAGGDGEGLVTIKDLGDTESALRDKSGPCSLVLERPFAPFPIHQLHQNEDYHILFNKGRAAVASWNSAVLSTKLNGSSTGDGKSGFAVFSPRLLSSQGWALLSNEKGGLNQSSTNLANRISEIVGLYSDEDDANAEWAHGSFPLEEYIKALDRAKGELYYNHSLGMQYSKITEQIFVGSCIQTEKDVKMLSETMGITAVLNFQSESERINWGINSETINSSCRENNILMVNYPIREVDSVDLRKKLPFCVGLLLRLIRKNYRIYVTCTTGYDRSPACVISYLHWVQDTPLHIAHKFITGLHSCRPDRAAIVWATWDLIALVENGRHDGSPTHSVCFVWNSGREGEDVELVGDFTSNWKDKIRCNHKGGSRYEAEVRLRHGKYYYKFIVGGQWRHSTSLPTETDEHGNVNNVIRVGDIAWIRPAPSQLHIKDPTVVKVIERALTEDERFSLAFAARRMAFAICPIRLSPKQ

SEQ ID NO: 7693 - DNA, 1203 bp, Sorghum bicolor
  misc_feature: Ceres ANNOT ID no. 6082027
  misc_feature: Encodes the peptide sequence at SEQ ID NO 7694
atgcaggcgttcctctcttcgtcgatcccggccacttcctactcgaggtcgtccttattcctgccgcagccgcctcatcaggctcccgtgaagctcgtcttcccgtcgtcggcgccgcagaggggcagcggtgccgtcgccgccgacgccgccgctaggactaggagaacagcttcggaggctgctggtcggtcggggcggtgcgtggcggcgtcctcgtcctcgtcgtccccggccacggccgcggtggcgacgacggaggtgcccggggtgatgaaggcctgggtgtacgacgcgtacggggacgccagcgtgctcaagctcgacgaggccgcggctgtgccggccctggccgacgaccaggtgctcgtcaaggtcgtcgccggcgcgctcaaccccgtcgacgccaagcgccgggccggcaagttccaggccaccgactcccctctcccgaccgtgccggggtacgacatggccggcgtcgtcgtcaaggtgggcagccaggtgaagaacctgaaagaaggcgacgaggtgtacggcatgatcagcgagaagccgctggacgggcccaagcagtccggctcgctggcggagtacaccgccgtcgaggagaagctgctggcgctcaagcccaaggtcctcgacttcgcgcaggccgccagcctgccgctcgccgtccagaccgccaacgggggcctggacagggccggactgtccgccggcaagtccgtcctcgtcctcggtggcgccggcggtgtcggctcccttgcaatccagctagcgaagcatgtgtacggcgcgtcaaaggtggcagcgacggccagcaccaagaagatcgagctgctcaagagcctgggtgtcgatgtcgccatcgactacactaaggacagcttcgaagagctgacggacaaatacgacgtcgtcttggacgcagtcggccagggtgacaaggctgtcaaggtagtgaaggaaggcggcagcgtggtggtcctcaccggcgccgtcagccctccagggttccggttcgtcgtcacctccaacggcgccgtcttggagaagctcaacccgtacctcgagtcaggcaaggtgaagccgctcatcgacccggaggggccgttcgccttctcgcaggtcgtggaggccttctcctaccttgagaccgggagagcaaccggcaaagtagtcatctctccaatcccatga

SEQ ID NO: 7694 - protein, 400 aa, Sorghum bicolor
  misc_feature: Ceres ANNOT ID no. 6082027
  misc_feature (240)..(381): Pfam Id: ADH_zinc_N Pfam Desc: Zinc-binding dehydrogenase
  misc_feature (119)..(210): Pfam Id: ADH_N Pfam Desc: Alcohol dehydrogenase GroES-like domain
  misc_feature (69)..(400): NCBI GI: 20334864 NCBI Desc: at1g23740/f5o8_27 [arabidopsis thaliana]
  misc_feature (92)..(400): NCBI GI: 4056456 NCBI Desc: strong similarity to gbu20808 auxin-induced protein from vigna radiata and a member of the zinc-binding dehydrogenase family pf00107. ests gbt43674, gbh77006 and gbaa395179 come from
  misc_feature (92)..(400): NCBI GI: 4056456 (continued) this gene. [arabidopsis thaliana]
  misc_feature (92)..(400): NCBI GI: 21553644 NCBI Desc: quinone oxidoreductase-like protein [arabidopsis thaliana]
  misc_feature (81)..(400): NCBI GI: 29468088 NCBI Desc: quinone oxidoreductase [fragaria x ananassa]
  misc_feature (92)..(400): NCBI GI: 14532287 NCBI Desc: quinone oxidoreductase-like protein [helianthus annuus]
  misc_feature: The sequence is a functional homolog of SEQ ID NO. 530 in the 11/188,298 US application
MQAFLSSSIPATSYSRSSLFLPQPPHQAPVKLVFPSSAPQRGSGAVAADAAARTRRTASEAAGRSGRCVAASSSSSSPATAAVATTEVPGVMKAWVYDAYGDASVLKLDEAAAVPALADDQVLVKVVAGALNPVDAKRRAGKFQATDSPLPTVPGYDMAGVVVKVGSQVKNLKEGDEVYGMISEKPLDGPKQSGSLAEYTAVEEKLLALKPKVLDFAQAASLPLAVQTANGGLDRAGLSAGKSVLVLGGAGGVGSLAIQLAKHVYGASKVAATASTKKIELLKSLGVDVAIDYTKDSFEELTDKYDVVLDAVGQGDKAVKVVKEGGSVVVLTGAVSPPGFRFVVTSNGAVLEKLNPYLESGKVKPLIDPEGPFAFSQVVEAFSYLETGRATGKVVISPIP

SEQ ID NO: 7695 - DNA, 1281 bp, Sorghum bicolor
  misc_feature: Ceres ANNOT ID no. 6082100
  misc_feature: Encodes the peptide sequence at SEQ ID NO 7696
atggcggcgttgctcgcctcctcccgctgctgctgcagccgtccgtcgctgccgcccctaccgacccgcggccgccgctccgtcgcccgctgcgcgctctccggaggagagaaaagaaactccttcagctggaaagagtgtgcagtttctgttgcattgtcagttggactaatcaacggtgcaccaacgttggggtcaccggcgtatgcttctcctcttgaacctgttcttccagatgtgtctgttctgatctctggacctcccattaaagatccaggtgctttattgagatatgctttaccaatagataataaagctattcgtgaagttcaaaagccactggaggatatcaccgacagcctcaaggttgctggtgttagagccttggattcagttgaaagaaatatcaagcaagcatcaagagcactgaacaatgggagaagcttaattcttgctggtcttgctgaaccaaaaagagcaaatggagaagagttattgaataagttggctgttggacttgaggagcttcaaagaattgtggaagacagaaatagggatgcagtagctccaaagcagaaagaacttctccagtatgttggaactgtagaagaagacatggttgatggctttccgtatgaaataccagaagaatacagcaccatgcctcttctcaaaggaagagctaccgtggatatgaaggttaaaattaaggacaatcccaacgtagaagattgtgtatttcggatagttctggatggatataatgctcctgtgaccgctgggaacttcatagatctggtcgaacggaaattctatgatggcatggaaatccaaagagctgatggctttgttgttcaaactggagatccagaggggccagctgagggttttatcgatcccagcaccggcaaaattcgtacagtacctcttgaaataatggttgatggtgataaggctcctgtgtatggtgaaacacttgaagaacttggccgctacaaggctcaaacaaagcttccttttaacgcctttggaacaatggctatggctagagaagaatttgatgacaattctgcttctagtcaaatattttggctcttgaaagagagtgagctaacaccaagcaatgccaatatattggatgggcggtacgcggtatttggatatgtaactgaaaatgaggattacttggcggatgtcaaagttggggatgtcatcgaatcaatccaagtcgtctcaggcttggacaaccttgtcaacccaagctacaaaattgtaggataa

SEQ ID NO: 7696 - protein, 426 aa, Sorghum bicolor
  misc_feature: Ceres ANNOT ID no. 6082100
  misc_feature (229)..(415): Pfam Id: Pro_isomerase Pfam Desc: Cyclophilin type peptidyl-prolyl cis-trans isomerase/CLD
  misc_feature (37)..(426): NCBI GI: 2864602 NCBI Desc: thylakoid lumen rotamase [spinacia oleracea]
  misc_feature (38)..(426): NCBI GI: 2623246 NCBI Desc: poly(a) polymerase [pisum sativum]
  misc_feature (81)..(420): NCBI GI: 75908533 NCBI Desc: peptidyl-prolyl cis-trans isomerase, cyclophilin type [anabaena variabilis atcc 29413]
  misc_feature (52)..(420): NCBI GI: 119487327 NCBI Desc: peptidyl-prolyl cis-trans isomerase, cyclophilin type [lyngbya sp. pcc 8106]
  misc_feature (81)..(420): NCBI GI: 53687303 NCBI Desc: cog0652: peptidyl-prolyl cis-trans isomerase (rotamase) - cyclophilin family [nostoc punctiforme pcc 73102]
  misc_feature (37)..(426): SWISSPROT Homolog: EC 5.2.1.8 Peptidyl-prolyl cis-trans isomerase, chloroplast precursor
MAALLASSRCCCSRPSLPPLPTRGRRSVARCALSGGEKRNSFSWKECAVSVALSVGLINGAPTLGSPAYASPLEPVLPDVSVLISGPPIKDPGALLRYALPIDNKAIREVQKPLEDITDSLKVAGVRALDSVERNIKQASRALNNGRSLILAGLAEPKRANGEELLNKLAVGLEELQRIVEDRNRDAVAPKQKELLQYVGTVEEDMVDGFPYEIPEEYSTMPLLKGRATVDMKVKIKDNPNVEDCVFRIVLDGYNAPVTAGNFIDLVERKFYDGMEIQRADGFVVQTGDPEGPAEGFIDPSTGKIRTVPLEIMVDGDKAPVYGETLEELGRYKAQTKLPFNAFGTMAMAREEFDDNSASSQIFWLLKESELTPSNANILDGRYAVFGYVTENEDYLADVKVGDVIESIQVVSGLDNLVNPSYKIVG

SEQ ID NO: 7697 - DNA, 2379 bp, Sorghum bicolor
  misc_feature: Ceres ANNOT ID no. 6082120
  misc_feature: Encodes the peptide sequence at SEQ ID NO 7698
atgagcagtgccccaaagaggttgcacgaggagggtagccactccacaccgacaaaacgtcctttggatgacagcagcttgtattcgagtcctgggaaagttattcagtccagtggcagtgatttccatggttcttttgaacatgatggtagatttgccaaaattcaacgtgtggagcctcgtgatgataagaggccatccgtaccatatcggatgcctgttggctccaccaactttgctgaccaccccgtctcctctgacagcagattagaatcaaagcaaaataaagatgcacgggacaataaggcagatgaccgcgagacaaaagctgatgctagggacgtccatagtgattcaaggattgaatttcaggccaataaaattgagagtgatgtaaaggtagacaatagagcagatgaaagcgaaataagggctgacaggaggggccatcctgattacagaagtgacatcaaatttgacaaggataatcattctactgttccagcaaacataaactggaaggacaacaaggagcataggagtaaaagatattttgaacagccagctgatactgtggattggcgtttgccccgtcctagtttacaaagtattgatgaagctcccaaaggtctgatttctgtggaagagcgtaactccaaggatgcaaatgaatctgctggtgataacaaagctgaaccaaaaagtgaagataggttcagagacaaggacaggaaaaagaaggacgagaagcatagggactttggtgcaagagaaggtgatagaaatgatcgtcggactggtgtacagcttggtagtagtggtgttgagcgaagagaaatgcaaagggaagatagggatgctgagaaatgggacagggaaagaaaagattccgtgagagataaggaaggcaatgatagggagaaagattctgctaggaaggattcatctgtagtaattgaaaaggataacactatactagaaaaagcttcatctgatggagccattaagagtgctgagcatgagaatacaacagaatccaaggtacctaaggatgatgtatggaaagctcacgatagggatcctaaggacaagaaaagagagaaggatggggatgcaggggaccggatcgagcaaagaagcaaatataatgataaggaatcagatgacaatggcactgaaggagatatggagaaagataaggaagtttttggaagtgtccaacgcaggaggatggtgcgaccgaggggaggtagtcaagcatctcagcgtgaacctagatttcggtccagaatgcgtgatggtgaaggccttctcttcgttgcaggtaagtctgaggtgtctgccattgtttataaagccggggagtgcatgcaggagcttctgaaatcatggaaagagtttgatgtaactcaggatgctacaaatgctgaaagtctacaacatggtcctactcttgaaattcgaatacctgcggagtttgttacttccactaatcgtcaggtaaaaggtgctcagctttggggaacagacgtttatacaaacgattcagatcttgtggctgtgctaatgcatactggttactgctcccctacatcctcccctccaccatctgccattcaagagcttcgtgcaactgttcgagttctaccaccacaagagagttatacttcaacactgaggaacaatgtgcgctcacgtgcttggggtgctgggattggttgtagctttcggattgaacgctgctgcattgtcaagaaaggtggtggaaccattgatcttgagccacgccttagccacacatcagctgtggagcctactctcgctccagttgcagttgagcgtacaatgacgacaagaaatgcactgcgtcaacaaagatttgttcgtgaagtgactatacagtacaatctgtgcaatgagccatggttaaaatatagtataagcattgtggcagataagggattgaaaaagtctctgtatacttctgctagactgaagaaaggagaagtcatatatttagaaacacactttaataggtatgaactttgcttcaatggagagaagcctcgtcttattggatcaagctccaatgcatctgaatcagaaacggagaaacaccagagtggtagtcaccattctcagaatggtgacagatgctatgtggagcatgaactccgggatgtgttccgatggtcccgttgtaagaaggccatgcctgaaagtgccatgcgctccatcggtatcccactaccagcagaccaactagaggtattgcaagataacctagaatgggaggacgtgcagtggtcacagactggtgtgtgggtatctgggaaggagtatcccctcgcccgagtgcacttcctctcggcgaactag

SEQ ID NO: 7698 - protein, 792 aa, Sorghum bicolor
  misc_feature: Ceres ANNOT ID no. 6082120
  misc_feature (485)..(569): Pfam Id: Rxt3 Pfam Desc: Histone deacetylation protein Rxt3
  misc_feature (1)..(792): NCBI GI: 115472061 NCBI Desc: os07g0477500 [oryza sativa (japonica cultivar-group)]
  misc_feature (70)..(400): NCBI GI: 44980951 NCBI Desc: abr064wp [eremothecium gossypii]
  misc_feature (70)..(400): NCBI GI: 45185293 NCBI Desc: abr064wp [eremothecium gossypii]
  misc_feature (87)..(433): NCBI GI: 8096269 NCBI Desc: ked [nicotiana tabacum]
  misc_feature (31)..(421): NCBI GI: 90265073 NCBI Desc: h0702g05.5 [oryza sativa (indica cultivar-group)]
MSSAPKRLHEEGSHSTPTKRPLDDSSLYSSPGKVIQSSGSDFHGSFEHDGRFAKIQRVEPRDDKRPSVPYRMPVGSTNFADHPVSSDSRLESKQNKDARDNKADDRETKADARDVHSDSRIEFQANKIESDVKVDNRADESEIRADRRGHPDYRSDIKFDKDNHSTVPANINWKDNKEHRSKRYFEQPADTVDWRLPRPSLQSIDEAPKGLISVEERNSKDANESAGDNKAEPKSEDRFRDKDRKKKDEKHRDFGAREGDRNDRRTGVQLGSSGVERREMQREDRDAEKWDRERKDSVRDKEGNDREKDSARKDSSVVIEKDNTILEKASSDGAIKSAEHENTTESKVPKDDVWKAHDRDPKDKKREKDGDAGDRIEQRSKYNDKESDDNGTEGDMEKDKEVFGSVQRRRMVRPRGGSQASQREPRFRSRMRDGEGLLFVAGKSEVSAIVYKAGECMQELLKSWKEFDVTQDATNAESLQHGPTLEIRIPAEFVTSTNRQVKGAQLWGTDVYTNDSDLVAVLMHTGYCSPTSSPPPSAIQELRATVRVLPPQESYTSTLRNNVRSRAWGAGIGCSFRIERCCIVKKGGGTIDLEPRLSHTSAVEPTLAPVAVERTMTTRNALRQQRFVREVTIQYNLCNEPWLKYSISIVADKGLKKSLYTSARLKKGEVIYLETHFNRYELCFNGEKPRLIGSSSNASESETEKHQSGSHHSQNGDRCYVEHELRDVFRWSRCKKAMPESAMRSIGIPLPADQLEVLQDNLEWEDVQWSQTGVWVSGKEYPLARVHFLSAN

SEQ ID NO: 7699 - DNA, 654 bp, Sorghum bicolor
  misc_feature: Ceres ANNOT ID no. 6082126
  misc_feature: Encodes the peptide sequence at SEQ ID NO 7700
atggccgccgcgtcgttcgcgctcgcgcttctgctctacctcggcctcgacctccccgaggctgcgccggcgcagtcctacgccgtcgacccgggtaccgtcgtcgagataacctacgggtcagtgatcaagttgatgcatgagaggaccaagtttcggctgcattctcacgacgtgccctatggatctggcagcggccagcagtcggtcaccagcttccccaacgtcgacgacgccaatagctactggatagtgagacctcaaccagagtcatctgcaaaacaaggtgatcccataacacaaggaacaactataaggcttcagcatatgagaactagaaagtggctacacagccacctgcatgcttcccccataactggaaatctggaggttagctgctttggtgatgagaacgagtcagatactggagactactggaggcttgagattgagggcagtgggaaaacatggcggcaagaccagataattaggttgcggcatgttgatactggtggttatctgcacagccatgataggaagtacacgcgcattgctggtgggcagcaagaggtatgcggtgtgggtgacaaacacccagacaacctctggctggcagctgagggtgtctacctccctgtaattcagcgcaaatag

SEQ ID NO: 7700 - protein, 217 aa, Sorghum bicolor
  misc_feature: Ceres ANNOT ID no. 6082126
  misc_feature (54)..(205): Pfam Id: MIR Pfam Desc: MIR domain
  misc_feature (1)..(217): NCBI GI: 37806069 NCBI Desc: stromal cell-derived factor 2-like protein [oryza sativa (japonica cultivar-group)]
  misc_feature (1)..(217): NCBI GI: 92869637 NCBI Desc: mir [medicago truncatula]
  misc_feature (1)..(213): NCBI GI: 23505803 NCBI Desc: at2g25110/f13d4.70 [arabidopsis thaliana]
  misc_feature (37)..(211): NCBI GI: 87248597 NCBI Desc: stromal cell-derived factor 2 precursor [bombyx mori]
  misc_feature (37)..(211): NCBI GI: 24644197 NCBI Desc: cg11999-pa [drosophila melanogaster]
MAAASFALALLLYLGLDLPEAAPAQSYAVDPGTVVEITYGSVIKLMHERTKFRLHSHDVPYGSGSGQQSVTSFPNVDDANSYWIVRPQPESSAKQGDPITQGTTIRLQHMRTRKWLHSHLHASPITGNLEVSCFGDENESDTGDYWRLEIEGSGKTWRQDQIIRLRHVDTGGYLHSHDRKYTRIAGGQQEVCGVGDKHPDNLWLAAEGVYLPVIQRK

SEQ ID NO: 7701 - DNA, 861 bp, Sorghum bicolor
  misc_feature: Ceres ANNOT ID no. 6082171
  misc_feature: Encodes the peptide sequence at SEQ ID NO 7702
atgtcacaagccagggaagtgaggtacactgcacggtctattacacctcctgctgatagaaatggcacctcaagctcgcctcctccaaagagacgcagcccttcaaggtcacctccaccaaagagtgcttcacggtccccacgtccaaggagtccaaagagacgcagcacttcaaggtctcctcctaggagacgtggtagatcaaggtcaagggatagaagtcggtccaggagcccagatgatagaaatccagggactaacctttatgtgactgggttgtctactcgtgtaactgaagaagatcttcagaagttctttagtaaagaaggaaaggttaaaaactgtcatgttgttcttgatcctaggacaaaagaatcccgtggttttgccttcgtgactatggatactcttgaagatgcaagacgctgcatcaagtatctgcaccgcactgtacttgaaggtcgcctggtcactgtagagaaggctaaaagaactcgcgaaaggaccccaactcctggaaaatactgtggtcgaagaggaggatctcaaaggagcccatcaccttaccgccctcgcagaagggagcgatcccgctcaagggaacgcagaagggagcggtcccgttcaagggatcgaagggaacggtctcgctcaagggaacgccggagggagcggtcccgctcaagggaccggagggagcggtctcgctcaagggaccgccggagggaccggtcccgttcaagggaccgcagaagggagcgctcacgctcaagagaccgcaggggcagttcaccccatgacagaaggcgtggagaccggtccagatcacccaccacgaatgggaaccgtaaggcagactag

SEQ ID NO: 7702 - protein, 286 aa, Sorghum bicolor
  misc_feature: Ceres ANNOT ID no. 6082171
  misc_feature (88)..(159): Pfam Id: RRM_1 Pfam Desc: RNA recognition motif. (a.k.a. RRM, RBD, or RNP domain)
  misc_feature (2)..(220): NCBI GI: 68036464 NCBI Desc: alternative splicing regulator [triticum aestivum]
  misc_feature (29)..(263): NCBI GI: 71143084 NCBI Desc: at4g35785 [arabidopsis thaliana]
  misc_feature (39)..(219): NCBI GI: 1781299 NCBI Desc: transformer-sr ribonucleoprotein [nicotiana tabacum]
  misc_feature (75)..(276): NCBI GI: 8778550 NCBI Desc: f22g5.31 [arabidopsis thaliana]
  misc_feature (29)..(163): NCBI GI: 115470030 NCBI Desc: os06g0724600 [oryza sativa (japonica cultivar-group)]
  misc_feature: The sequence is a functional homolog of SEQ ID NO. 339 in the 11/188,298 US application
  misc_feature: The sequence is a functional homolog of SEQ ID NO. 458 in the 11/188,298 US application
MSQAREVRYTARSITPPADRNGTSSSPPPKRRSPSRSPPPKSASRSPRPRSPKRRSTSRSPPRRRGRSRSRDRSRSRSPDDRNPGTNLYVTGLSTRVTEEDLQKFFSKEGKVKNCHVVLDPRTKESRGFAFVTMDTLEDARRCIKYLHRTVLEGRLVTVEKAKRTRERTPTPGKYCGRRGGSQRSPSPYRPRRRERSRSRERRRERSRSRDRRERSRSRERRRERSRSRDRRERSRSRDRRRDRSRSRDRRRERSRSRDRRGSSPHDRRRGDRSRSPTTNGNRKAD

SEQ ID NO: 7703 - DNA, 1041 bp, Sorghum bicolor
  misc_feature: Ceres ANNOT ID no. 6082175
  misc_feature: Encodes the peptide sequence at SEQ ID NO 7704
atgcagatccgggagggccccgcgcggcggcaggcgccgtccgccgtgggggcgctgcggtcgccgatgtccgccatgatgctcgccatgttcgctaccatggcctccttctacgtcgccggacgattgtggcaggatgctcagaacagagtttatctcattaaggagctcgacagacgaacaggccaggggcaatcagcaatatctgtggatgataccttgaaggttgttgcatgcaggcagcaagggaagcggttggcatcgcttgagatggagctggctgcagcaaagcatgaaggttttgttggcaaatacaatcctgagacaaatggaactcattctgggaaaaagccactgattgttattggaataatgactagctttgggaggaaaaactaccgtgatgctgtcaggaaatcatggcttccgacaggttcaatgctgaagaaactagaagaagaaaaaggcattgtagtacgttttgttgttggaagaagtgcaaatcgaggagatacttttgatagggagattgatgaagaaaataggagcaccagggatttcttgatcttggatgatcatatagagtcagatgaagagcatcctaagaagacaaaaagtttctttgcgaatgcagcagatacatttgatgctgcattttatgctaaggtcaatgatgatatatacataaacgttgatactttgagtgcaatgctcgaaactcactgggacaagccccgtgtctatataggctgcatgaaatcgggcgaggttttttctgactcaacccataagtggtatgaaccagactggtggaaatttggtgatgggaaatcgtacttccgacacgcttctggtgaaatgtttgtcatatcaagggccatagctcagttcatttctataaacaagtctgttctccggacatatgcccatgatgatgttagtgtaggatcatggatgattggccttgctgtgaagcatgtaaatgaagcaaaactgtgttgttcatcatggccctcaggtgcgatgtgttcagcgctataa

SEQ ID NO: 7704 - protein, 346 aa, Sorghum bicolor
  misc_feature: Ceres ANNOT ID no. 6082175
  misc_feature (132)..(330): Pfam Id: Galactosyl_T Pfam Desc: Galactosyltransferase
  misc_feature (23)..(344): NCBI GI: 22553068 NCBI Desc: beta 1,3-glycosyltransferase-like protein i [oryza sativa]
  misc_feature (6)..(345): NCBI GI: 20372915 NCBI Desc: beta 1,3-glycosyltransferase-like protein i [lycopersicon esculentum]
  misc_feature (14)..(346): NCBI GI: 20148409 NCBI Desc: avr9 elicitor response protein-like [arabidopsis thaliana]
  misc_feature (14)..(346): NCBI GI: 79330759 NCBI Desc: transferase, transferring hexosyl groups [arabidopsis thaliana]
  misc_feature (14)..(336): NCBI GI: 9759181 NCBI Desc: avr9 elicitor response protein-like [arabidopsis thaliana]
  misc_feature: Useful for making plants with altered carbohydrate content
  misc_feature: Functional homolog of the protein sequence given in SEQ ID NO 13999
MQIREGPARRQAPSAVGALRSPMSAMMLAMFATMASFYVAGRLWQDAQNRVYLIKELDRRTGQGQSAISVDDTLKVVACRQQGKRLASLEMELAAAKHEGFVGKYNPETNGTHSGKKPLIVIGIMTSFGRKNYRDAVRKSWLPTGSMLKKLEEEKGIVVRFVVGRSANRGDTFDREIDEENRSTRDFLILDDHIESDEEHPKKTKSFFANAADTFDAAFYAKVNDDIYINVDTLSAMLETHWDKPRVYIGCMKSGEVFSDSTHKWYEPDWWKFGDGKSYFRHASGEMFVISRAIAQFISINKSVLRTYAHDDVSVGSWMIGLAVKHVNEAKLCCSSWPSGAMCSAL

SEQ ID NO: 7705 - DNA, 2889 bp, Sorghum bicolor
  misc_feature: Ceres ANNOT ID no. 6082221
  misc_feature: Encodes the peptide sequence at SEQ ID NO 7706
  misc_feature: Up-regulated in root tissues in response to aminocyclopropane carboxylic treatment
  misc_feature: Up-regulated in shoot tissues in response to salicylic acid treatment
atggagctccggagcggcggcgcgctggcgtggcagcagtaccgcgcgctgctccgcaagaacgccacgctcacctggcgcaaccgccgctcggcggcgctccagctcttctcctcgctcgtcttcatcttcctcatcttctgcatcgaccgcgccgtccgctccaggttctccagcaccaccgcctaccgcaacgtgccggacccggagccgctcgtcgcgccgcccatcccaccctgcgaggacaagttcttcatcaagtccccctgctacgacttcctctggagcgacggcgggagcaaccgcatcaggggcatcgtcgacgccatcaggaagaacaaccccggacgacccataccgcccgaaaaggttttaggttttaggactccagatgatgttgatgcttggttgtttcaaaacccaatgcgctgccctggtgctttgcattttcaagatataaatcccactcagataaagtatggtatccagacaaactctactccggtagcacggagaggaacatatgaagacccgaccttcaagttccagataccactccaagttgcagctgagagggaaatggcaaggctgcttattggagacccaaattttagctggactgtcggatttaaggaattcgctcacccagccacagagaccttctctaccattgctcaagcagggccaactttctttcttgccattgcaatgtttggatttgttttccaaatcagtgccttggtgtcagagaaagaactaaagcttcgtcaggctatgtctaccatggggctctatgaatcggcatactggttatcatggtttacctgggaggcccttctgacaacaatttcagcactttttaccgttctctttgggatgatgttccagtttgatttcttccttcataataattttggaatcctattcctcctgttcttcctgttccagctgaacatgcttagttttgccttcatgatatcaacgttcgtagcaaaggcagcatcagctactactgttggatttgcaatattcattattgggttcttgactcagcttgttaccacctttgggttcccttattcggctgactacaaaaagttgtaccggacattgtggtctttatttcctcctgatttatttgccaaagccctcaacattctaggcaaggcaacagccactcctgaggataaaggtattagctggaatcagcgtggggagtgcccatcttttgagactgactgcgtcattactatcgatgatatctataagtggctcatttccacatttttcttgtggtttgtcctggctatatactttgacaacatacttccaaatgtaaatggcgtccggaagtcagttttctactttcttatgccttcatactggacgggtaaaggaggcaagatggaagagggaggcctctttagcttttttggttcaagccgtcctgctgatgatgctacccctactgacgaagatgttctcgcggagcaaaacctagtaaaggaacaagctgcaaacaatgcggtagatcctggtgttgcagttcaaatacatggtctacggaagacatatccaggaactttcagcattggttgttgcaaatgctcgaaatctaagccatttcattcggttaaaggcttatgggtgaaccttgagaaggaccagctattttgtcttcttgggcctaatggagctggcaaaacaactacaatcagttgtctgactggaatcacaccaattacaggtggtgatgcattcatttatggccactctgttcgaagcactgtgggaatgtcaaacatccgtaggatgatcggagtctgcccacaggtgtttgatatcctgtgggatgcattaacagctaaagagcacatggaattgtttgccagcatcaagggattgccaccagcagcaatcacatcagtagcagaggagtcattagccaaagtgaagctcagccaagtaactaatgctagagcaggcagctacagtggaggaatgaagcgccggctaagtgtcgcgatcgcactgattggtgacccaaaattggtttttcttgatgaaccgactactggcatggatccaataacaaggaggcatgtctgggacatcatagaggaggccaagaaaggaagagctattgtcttgaccactcattccatggaggaggctgatattcttggtgaccggatagctataatggcaaaggggaaactgcggtgcattgggacatcaataaggctgaagtcaaaatttggaacaggatacattgctaacgttaatttctctggaaatggccacatgcagagccccaacatcaacagcatcactgaggctctggctaatccgaacatagaagctgtcaaatggtttttcaaggaacggcttgatattaatccaaaagaggagagcaagacattcttgacatttgtcatccctcatcacaaagaatcgcttctgacgagattctttggagagctgcaagacagggaaggggagtttggaatatcagacattcaacttggtctgacgacacttgaagaggtgttcctgaacattgcaaagcaggcagagctggagagctctactgctgaaggtaccttggtgactctcaacctgacatcaggagcaacaattcagattcccaagggggctcgttttgttggtattcctggaactgagacagaagagcatccaagaggcctcatggttgaggtttactgggatcaggatgaaaatggatcgctctgcatttctgggcactctgacgagatgcctgtgccagtccatgctgagccgaggaggcctccgtcactttctcgtagggcctcaatgggccgtggaggtccagttgggtatgtgattgacctgaaccaggccccatga

SEQ ID NO: 7706 - protein, 962 aa, Sorghum bicolor
  misc_feature: Ceres ANNOT ID no. 6082221
  misc_feature (555)..(738): Pfam Id: ABC_tran Pfam Desc: ABC transporter
  misc_feature (1)..(690): NCBI GI: 4741190 NCBI Desc: abc-type transport-like protein [arabidopsis thaliana]
  misc_feature (421)..(958): NCBI GI: 15240326 NCBI Desc: abc transporter family protein [arabidopsis thaliana]
  misc_feature (1)..(766): NCBI GI: 15240334 NCBI Desc: abc transporter family protein [arabidopsis thaliana]
  misc_feature (207)..(761): NCBI GI: 60463160 NCBI Desc: abc transporter a family protein [dictyostelium discoideum]
  misc_feature (207)..(761): NCBI GI: 19774119 NCBI Desc: abc transporter abca.1 [dictyostelium discoideum]
  misc_feature: Up-regulated in root tissues in response to aminocyclopropane carboxylic treatment
  misc_feature: Up-regulated in shoot tissues in response to salicylic acid treatment
MELRSGGALAWQQYRALLRKNATLTWRNRRSAALQLFSSLVFIFLIFCIDRAVRSRFSSTTAYRNVPDPEPLVAPPIPPCEDKFFIKSPCYDFLWSDGGSNRIRGIVDAIRKNNPGRPIPPEKVLGFRTPDDVDAWLFQNPMRCPGALHFQDINPTQIKYGIQTNSTPVARRGTYEDPTFKFQIPLQVAAEREMARLLIGDPNFSWTVGFKEFAHPATETFSTIAQAGPTFFLAIAMFGFVFQISALVSEKELKLRQAMSTMGLYESAYWLSWFTWEALLTTISALFTVLFGMMFQFDFFLHNNFGILFLLFFLFQLNMLSFAFMISTFVAKAASATTVGFAIFIIGFLTQLVTTFGFPYSADYKKLYRTLWSLFPPDLFAKALNILGKATATPEDKGISWNQRGECPSFETDCVITIDDIYKWLISTFFLWFVLAIYFDNILPNVNGVRKSVFYFLMPSYWTGKGGKMEEGGLFSFFGSSRPADDATPTDEDVLAEQNLVKEQAANNAVDPGVAVQIHGLRKTYPGTFSIGCCKCSKSKPFHSVKGLWVNLEKDQLFCLLGPNGAGKTTTISCLTGITPITGGDAFIYGHSVRSTVGMSNIRRMIGVCPQVFDILWDALTAKEHMELFASIKGLPPAAITSVAEESLAKVKLSQVTNARAGSYSGGMKRRLSVAIALIGDPKLVFLDEPTTGMDPITRRHVWDIIEEAKKGRAIVLTTHSMEEADILGDRIAIMAKGKLRCIGTSIRLKSKFGTGYIANVNFSGNGHMQSPNINSITEALANPNIEAVKWFFKERLDINPKEESKTFLTFVIPHHKESLLTRFFGELQDREGEFGISDIQLGLTTLEEVFLNIAKQAELESSTAEGTLVTLNLTSGATIQIPKGARFVGIPGTETEEHPRGLMVEVYWDQDENGSLCISGHSDEMPVPVHAEPRRPPSLSRRASMGRGGPVGYVIDLNQAP

SEQ ID NO: 7707 - DNA, 771 bp, Sorghum bicolor
  misc_feature: Ceres ANNOT ID no. 6082246
  misc_feature: Encodes the peptide sequence at SEQ ID NO 7708
atggacgagtggattcgccaagcggaggtgtgggtgcgccaagccgagagctggatccgccagcagcccccggagcagatctatgtcgcggccgcggtggttgccgtcacaatcctggtgcttatcgtagcatcttgtctgaaatcctctaaactaaacaccatagtgctatccgggcttagtggcagtggcaaaaccactcttttctaccagcttcgggacggatcatcacatcaaggaactgtgacttctatggaagaaaacagtgatacctttgtgctgcattcggagcaagaaaagaaaggcaaagtgaaacctgtgcatattgttgatgttcctggtcatgccaggctcaaacccaagcttgatgaagtcctgcctaaagctgctggggttgtttttgttgttgatgctcaagatttcttgtctagcatgcaagctgctgcagagtacctgtatgacattctgacaaaggcaaccgtagtgaagaaaaaggttcctgtgcttatattctgcaacaagacagataaagttacagcccactcgaaggaattcatcaagaagcagttggagaaagaattgaacaagctccgggaatcaaggaccgccatatcctcagctgacatctctgatgaagtccagctcggggtccctggagaggctttcaacttcagccagtgccagaacaaggtggctgttgcggagggcgccggttccgctggtaatgttttggccgtggagcaattcatccgtgagcatgtgaaggcatag

SEQ ID NO: 7708 - protein, 256 aa, Sorghum bicolor
  misc_feature: Ceres ANNOT ID no. 6082246
  misc_feature (39)..(213): Pfam Id: Arf Pfam Desc: ADP-ribosylation factor family
  misc_feature (53)..(176): Pfam Id: MMR_HSR1 Pfam Desc: GTPase of unknown function
  misc_feature (54)..(176): Pfam Id: Miro Pfam Desc: Miro-like protein
  misc_feature (1)..(255): NCBI GI: 92887265 NCBI Desc: aaa atpase; small gtp-binding protein domain [medicago truncatula]
  misc_feature (8)..(255): NCBI GI: 110736264 NCBI Desc: signal recognition particle receptor beta subunit-like protein [arabidopsis thaliana]
  misc_feature (85)..(256): NCBI GI: 51090418 NCBI Desc: signal recognition particle receptor beta subunit-like [oryza sativa (japonica cultivar-group)]
  misc_feature (118)..(256): NCBI GI: 115468056 NCBI Desc: os06g0473100 [oryza sativa (japonica cultivar-group)]
  misc_feature (27)..(235): NCBI GI: 50540210 NCBI Desc: zgc:92746 [danio rerio]
  misc_feature: Useful for making plants with modulated cold sensitivity
  misc_feature: GREAT-hit functional homolog of the protein sequence given in SEQ ID NO 12929
  misc_feature: Useful for making plants with modulated cold sensitivity
  misc_feature: Functional homolog of the protein sequence given in SEQ ID NO 12929
MDEWIRQAEVWVRQAESWIRQQPPEQIYVAAAVVAVTILVLIVASCLKSSKLNTIVLSGLSGSGKTTLFYQLRDGSSHQGTVTSMEENSDTFVLHSEQEKKGKVKPVHIVDVPGHARLKPKLDEVLPKAAGVVFVVDAQDFLSSMQAAAEYLYDILTKATVVKKKVPVLIFCNKTDKVTAHSKEFIKKQLEKELNKLRESRTAISSADISDEVQLGVPGEAFNFSQCQNKVAVAEGAGSAGNVLAVEQFIREHVKA

SEQ ID NO: 7709 - DNA, 2877 bp, Sorghum bicolor
  misc_feature: Ceres ANNOT ID no. 6082262
  misc_feature: Encodes the peptide sequence at SEQ ID NO 7710
atggacgccccggcccccacgaggggccctgcgagcttcctcacgcaggccaacgccctcctccgcaagaacctctgcttccagaagcggaacctcaagaccaacatcgggatcacgctcttcccggtgctcctctgcgtcatcctcgtcgtgctccagggcgtcatcgacaacgagctcgacaagcccaagtaccgctgcggttgcgcctgcgtcgacccgggcccggacgcggtcggggacgcgtgccgccggacggagtgcggcgtccagcactccaccctggaccaggtcggcagctgcccgatccctagcccgaccccgtggccggcgctggtgcaggtgccgcggcccgagtcacgcgccgtcaggaccgccggccagccgttcgacggcttgcctgacccgagctgccgggacactggctcctgccccgcggccgtcctcgtcaccggcaacaaccgctcgctagctcaaaacctttcgggtggactgtttcctgcttcgacttcctccttgaatttgacagattatctggatgaactctccaggatcgttgctggatcggacacgtggccatggacaacagaattaatagaatcagcgtttatcccagggaataacttgtatcggctgcaatctcggtgtttgtccaatctaacacagacagtttcattcaatgccggggtcataccccttcagctcaacatagactgcgttcagggtttgccactatggcgtgaaagtgcatcatttgtaaatgatgaactctttaagggttacagacaaaatggtggaggtagtggaggtgggaagacaaatgaatttgttgcaggttatgattttctgaacacaaatatgaatggtcttgaaatgaatatttggtacaactctacctataacaacaacaccgcatacgtatctatttcattactacgagttccacgcttggttaatgcggcatcaaatgagtacattaaatttctcagaggaagtggagtggaaatgttgcttcaatatgttaaagagatgcccaaagtaggaacaaagctgaaatttgacctctcttctcttcttggtgcattgttcttcacgtggatcattgaactactatttccagtcatattaacatatctcgtgtatgagaagcaacagaagctgaaaattatgatgaagatgcatggtctgaaggatggtccttactggctaatctcctatttttacttctttgccctgtcggctatctacatgatactgtttgtgatttttggctccttgatcggtctagatttctttaggaaaaatgactatagccttcaatttgtcttctacttcatctacataaacctgcagatttcacttgcatttcttgtagcttccttcttttctgctgtcaaaacagccacagttgttggttacatctatgtatttggctctggcttactaggggaatttcttcttcgcttttttgttgaggatactggttttccaaagggttggatagttttaatggagatcatccctggattttcattgttccgaggattatatgagtttggtcaatatgcatctgctggaaactcaatggggaccactggtatgaaatggagtaatctagatgactctcttaatggaatgcgtggtgttttgattattatggttgtggagtgggcaatacttctacccttggcattctatgtggatcaagtctcgtcgctgggtggtggattcaggaaaaattcctttttcttcttgagctgctttaaaaggcgtgctctatcattgcggagatatagctttaggagacaagaatctaaagtagtcgttgaaatggacaatcctgatgctgttcaagaaagagaggtggttgagcaacttctgctggaacccattgcaaaccaagcgatcctctctgataacctcaaaaaggtttaccatggaaaagatggaaatcctgacaaacttgctgtccgagggttgtctcttgccataccaaaaggccagtgttttggaatgcttggcccgaatggagctgggaaaacatcgttcatcagtatgatgattgggcttattccaccaacatctggtaccgcctatgtacatggaatggatataaggactgatatggatgagatctatactaacatgggtgtatgcccacagcatgacttactttgggaaacattaacaggaagagagcacctattgttttacgggagacttaagaatcttaaaggcactgaattattgaaggctgttgatgactctctgaagagtgttaatctgtttcatggtggcgttggtgataagcaagtgggaaagtacagtgggggcatgaaacgaaggcttagtgttgccatctcattaattggggatcccaaagtggttttcatggatgagccaagcaccggacttgatccagcatcaagaaacaatctgtggagtgttgtgaaggaggcaaagagaaaccgtgccatcattcttacaacacactcaatggaggaggcagaagtactatgtgatagacttggcatttttgtcgatggtggtttccagtgccttggtaacccaaaagagctgaaagctagatatggcggcacctatgtactgacaatgacaacatcttcggagaatgaaaaggaggttgagcagcttgttcaccacctatcaccaaatgcgagcaggatataccacatttcaggaacccagaaatttgagctgccaaagcaggacttgaagattgctgatgtattccatgccgtcgagagtgcaaaatgccggttcaacatatatgcttggggcctggttgacaccaccttggaggatgtctttattaaggttgccaagggagcacaagcattcaatgttgttacgtaa

SEQ ID NO: 7710 - protein, 958 aa, Sorghum bicolor
  misc_feature: Ceres ANNOT ID no. 6082262
  misc_feature (667)..(849): Pfam Id: ABC_tran Pfam Desc: ABC transporter
  misc_feature (7)..(957): NCBI GI: 115476294 NCBI Desc: os08g0398300 [oryza sativa (japonica cultivar-group)]
  misc_feature (148)..(958): NCBI GI: 144923966 NCBI Desc: aaa atpase [medicago truncatula]
  misc_feature (174)..(949): NCBI GI: 20466398 NCBI Desc: abc-type transport protein-like protein [arabidopsis thaliana]
  misc_feature (174)..(949): NCBI GI: 22331659 NCBI Desc: abc transporter family protein [arabidopsis thaliana]
  misc_feature (9)..(956): NCBI GI: 22331649 NCBI Desc: abc transporter family protein [arabidopsis thaliana]
MDAPAPTRGPASFLTQANALLRKNLCFQKRNLKTNIGITLFPVLLCVILVVLQGVIDNELDKPKYRCGCACVDPGPDAVGDACRRTECGVQHSTLDQVGSCPIPSPTPWPALVQVPRPESRAVRTAGQPFDGLPDPSCRDTGSCPAAVLVTGNNRSLAQNLSGGLFPASTSSLNLTDYLDELSRIVAGSDTWPWTTELIESAFIPGNNLYRLQSRCLSNLTQTVSFNAGVIPLQLNIDCVQGLPLWRESASFVNDELFKGYRQNGGGSGGGKTNEFVAGYDFLNTNMNGLEMNIWYNSTYNNNTAYVSISLLRVPRLVNAASNEYIKFLRGSGVEMLLQYVKEMPKVGTKLKFDLSSLLGALFFTWIIELLFPVILTYLVYEKQQKLKIMMKMHGLKDGPYWLISYFYFFALSAIYMILFVIFGSLIGLDFFRKNDYSLQFVFYFIYINLQISLAFLVASFFSAVKTATVVGYIYVFGSGLLGEFLLRFFVEDTGFPKGWIVLMEIIPGFSLFRGLYEFGQYASAGNSMGTTGMKWSNLDDSLNGMRGVLIIMVVEWAILLPLAFYVDQVSSLGGGFRKNSFFFLSCFKRRALSLRRYSFRRQESKVVVEMDNPDAVQEREVVEQLLLEPIANQAILSDNLKKVYHGKDGNPDKLAVRGLSLAIPKGQCFGMLGPNGAGKTSFISMMIGLIPPTSGTAYVHGMDIRTDMDEIYTNMGVCPQHDLLWETLTGREHLLFYGRLKNLKGTELLKAVDDSLKSVNLFHGGVGDKQVGKYSGGMKRRLSVAISLIGDPKVVFMDEPSTGLDPASRNNLWSVVKEAKRNRAIILTTHSMEEAEVLCDRLGIFVDGGFQCLGNPKELKARYGGTYVLTMTTSSENEKEVEQLVHHLSPNASRIYHISGTQKFELPKQDLKIADVFHAVESAKCRFNIYAWGLVDTTLEDVFIKVAKGAQAFNVVT

SEQ ID NO: 7711 - DNA, 2853 bp, Sorghum bicolor
  misc_feature: Ceres ANNOT ID no. 6082299
  misc_feature: Encodes the peptide sequence at SEQ ID NO 7712
atggctaccgacgacgcaggcggtcgcgcgaggttttggacacagatgcacgctctcttcctcaagaacctctccttccagaggaggaacgcgagagccaacgccacgatcgcggcgttcccagtgctggtgtgcgtgctcctgttcgggatgcagagcgtgctggacatggagatgggcaagccccagttccggtgcggctgcgcctgcgtgcgctgcgagcccggcacgggcgcatgcgccgacacggagtgcggcatccagtactccacgcccacgcaggcgcccacctgcgccgtgcctaggccgcagcggtggccggcgctggtgcaggtgccggacgcccaggcgcaccagctctggtgccaagcctccggctcctggccggactgcccggtcaccgtgctcctcaccggaggcaaccgccagctttctcaaggacttggaatggggatgttcccaattttaacacctggtgttactgctgtcaattcttccaacttttttgatgacttgtcaactgcagtccctctgggttcaagcacgccacctgcacatgtactgaacgttgagccggcctttgctccaaacgagaccctgtacgtgctccagccgcagtgtctgtggaattcaggcactgtttcagcgacttataatgagttgccactacaatactatgtagagtgtgttcaagctcagccgctgtggtgcgacaattcatcagtgataaatcagcaactgtttagcggttataagggtgcgaataagtggggcagatcaaacgaaatccttgctggttatgacttccttgatacaagcatgacaagcttacaagtatatatttcgtacaactccaccttcagttgggatgatggtgatgatgataacggcgacgacggttccatgacagttttgcgtgttccacggttggttaacatggcatccacggcatatctgaagcttcttctaggagcagatgcaaaaatggacttagactatttgaaggagatgccaaagcctgaaactaaaatgacgatggacctaactcctcttcttgacccactattctttacctgggtagttcaactcctccttccggtaacagttacacttcttgtttacgagaaggaacataaactgagactaatgatgaaaatgcatgggctaaagaatgctccttactggttgataacttacgcctacttcttgtgcctatcaacagcttacatcaccctcttaatgatttttgggtcccttttagggctagacatattcagattaaataactacggagtacaattcatattctatttcacatatatcaatctccagattgcgcttgcatttttgttcgcgtctttcttctcaagtaccaagactgctagtgtaattagttacatctatgtatttggctctggccttctcgcagattcactttttgtgtactacatccaggataccacttttccatataaatggcttgtgacgatggagctttttcctgcattctccctctaccgaggaatatacgaccttgcagggtatgcctatgcagggcgttatctgggaaatcctgggatgcaatggacggacttaaacgacctactgaacgggatcaaagatgttttggtcctaatgtctgccgaatggatatttctgattcctgtggcgtttctactggaccactggcctgtctggcaatggaatcctctatctctctacagattgctgtcgacgaagcgttcacaactttcaggaacactaaacgaagtgaacagcaaatccacgagggtgtcgattgatatggcgaagcctgatgttttcttagagcgcaaggtggttgaacgattactaaagaaaaaaatgggcaagaggggcatggtcatctgtgataatctgaagaaattgtaccccggaaagaatggaaaccctgacaaggttgcagtcagagggttgtcacttgctttgcctagagggcagtgtttcgggatgcttggtcccagtgggtcaggcaagacttctttcatcagcatgatgattggccttcagatgccatcatatggaacagcgtacatagacggaatggatttgaggaaggatatggatgaaatatatgcaaatattggtgtatgtccacagcatgatctactttgggagactctgacaggaagggagcacttaatgttctacggtcggatgaagaatctcacaggtgtcgctctaacaaaggccgtggaagaatccttgaagagtgtaaatctgttccatagcgggtttggcgacaaatctgcaagcacgtatagcggtggcatgaaaagaaggctcagcgccgccatcgccctcataggcaaccctaaagttgtttacatggatgaactaagcaccggactggaccctgcatcaaggaggtacctttggaacgccgttaagcaagcaaagaaaaactgcaccattatccttaccacgcattcgatggaggaggctgatgagttgtgtgatcgtgttggtatctttgtcgatggcgacttccattgtcttggaactcctattgagctgaaggcgaggtatggtgggacatggatcctgacgatcatgacggagccaaaacacgagggcgaggtgcaggagctggtgaaccagctctcgcctggtgcttccagaatctacagtctgtctggcacgcagaagttcaccttgcctcgtcgggaggtggggctggatggtgttttcagggtggtggacatggcgcggcgtgcattcccagtgctggggtggggtgtggcaggtgccacactggaggacgtcttcatcagagtggtcaaggacgcgcaggtgtctgacgatatgtcctag

SEQ ID NO: 7712 - protein, 950 aa, Sorghum bicolor
  misc_feature: Ceres ANNOT ID no. 6082299
  misc_feature (659)..(841): Pfam Id: ABC_tran Pfam Desc: ABC transporter
  misc_feature (2)..(944): NCBI GI: 115476294 NCBI Desc: os08g0398300 [oryza sativa (japonica cultivar-group)]
  misc_feature (76)..(941): NCBI GI: 20466398 NCBI Desc: abc-type transport protein-like protein [arabidopsis thaliana]
  misc_feature (76)..(941): NCBI GI: 22331659 NCBI Desc: abc transporter family protein [arabidopsis thaliana]
  misc_feature (8)..(944): NCBI GI: 22331657 NCBI Desc: abc transporter family protein [arabidopsis thaliana]
  misc_feature (41)..(944): NCBI GI: 4741195 NCBI Desc: abc transporter-like protein [arabidopsis thaliana]
MATDDAGGRARFWTQMHALFLKNLSFQRRNARANATIAAFPVLVCVLLFGMQSVLDMEMGKPQFRCGCACVRCEPGTGACADTECGIQYSTPTQAPTCAVPRPQRWPALVQVPDAQAHQLWCQASGSWPDCPVTVLLTGGNRQLSQGLGMGMFPILTPGVTAVNSSNFFDDLSTAVPLGSSTPPAHVLNVEPAFAPNETLYVLQPQCLWNSGTVSATYNELPLQYYVECVQAQPLWCDNSSVINQQLFSGYKGANKWGRSNEILAGYDFLDTSMTSLQVYISYNSTFSWDDGDDDNGDDGSMTVLRVPRLVNMASTAYLKLLLGADAKMDLDYLKEMPKPETKMTMDLTPLLDPLFFTWVVQLLLPVTVTLLVYEKEHKLRLMMKMHGLKNAPYWLITYAYFLCLSTAYITLLMIFGSLLGLDIFRLNNYGVQFIFYFTYINLQIALAFLFASFFSSTKTASVISYIYVFGSGLLADSLFVYYIQDTTFPYKWLVTMELFPAFSLYRGIYDLAGYAYAGRYLGNPGMQWTDLNDLLNGIKDVLVLMSAEWIFLIPVAFLLDHWPVWQWNPLSLYRLLSTKRSQLSGTLNEVNSKSTRVSIDMAKPDVFLERKVVERLLKKKMGKRGMVICDNLKKLYPGKNGNPDKVAVRGLSLALPRGQCFGMLGPSGSGKTSFISMMIGLQMPSYGTAYIDGMDLRKDMDEIYANIGVCPQHDLLWETLTGREHLMFYGRMKNLTGVALTKAVEESLKSVNLFHSGFGDKSASTYSGGMKRRLSAAIALIGNPKVVYMDELSTGLDPASRRYLWNAVKQAKKNCTIILTTHSMEEADELCDRVGIFVDGDFHCLGTPIELKARYGGTWILTIMTEPKHEGEVQELVNQLSPGASRIYSLSGTQKFTLPRREVGLDGVFRVVDMARRAFPVLGWGVAGATLEDVFIRVVKDAQVSDDMS

SEQ ID NO: 7713 - DNA, 1704 bp, Sorghum bicolor
  misc_feature: Ceres ANNOT ID no. 6082328
  misc_feature: Encodes the peptide sequence at SEQ ID NO 7714
atggtgctgatcactctcgtccgcgactacatcgaccgcatgctccacgacatcccgggcatgaaggtcctcgtccttgacccccaaaccgttgggatggtgagcgtggtgtacagccagtcggatctgctgcggaaggaggtcttcctcgtcgagaccatggacaacgcctccagctccagggagtccatggcgcatctcaaggccgtctacttcctccggccctccgccgacaacgtccagaagctccgcaggcacctcgccatgccgcgtttcgccgagtaccacctcttcttctccagtatattgaaagtcccgcagattcaaatacttgctgattcggatgagcaggaggttgtgcagcaagttcaggagttctatgctgatttttgtgccattgacccataccatttcactctcaacatacaaaacaaccacatttacatgctccctacagtggttgatcctcctggtatgcagagcttctgtgatcgagctgttgacggcattgcttctgtcttcttggccttgaagcgccggcctgttattagatttcagaggacatcagatgttgcaaaaaggattgcacaggaaactgcgagattgatgtatgagcaggagagtggccttttcgattttagacgaacagaaaactcttccttgttgttggtgattgacaggagggatgatcctgttacgcctttacttaaccagtggacctaccaggcaatggttcatgagctggttggaatcgagaacaacaaggtggatcttaggggatttgctaatgtacctaaagaccagcaggaggtggttctatcatcggttcaagatgatttttttagagctaacatgtttgagaactttggggacctcggtatgaacctcaaaagaatggtagatgactttcagcatctttctaagaacagccttaatctccagagcataggtgacatggcaaagttcgtgagcaactatccagagtatcgaaagacacatggaaatgtaacgaaacatgtcaatctggtgagcgagctgagcagaattgtggaggaaaggaaacttatgctagtttcacagacagaacaagagctagcatgtactagtggacaagcagcagcctttgaggctgtcacttccttgctaaacaatgaaagggtatctgatattgatcgcttgcgatcagtaatgctctatgctttgcggtatgaaaaagagagtccagttcaattgatgcaacttttcaacaaattggcttctcattctgccaaatacaagtcagggcttgttcaattcctccttaagcaagctggcattgataagagaacaggcgacttgtatgggaaccgtgatctgttaaatattgctcgcaatatggctcgtgggcttaagggagttgagaatgtctacacccaacaccagcctcttatcttccaaacgatggaaggaattgtgaaagggagattgcgagatgttgactatccacttgttggcaatcatttccagcagggcaggcctcaagatgttgtcatattcgttgttggagggacaacttacgaggaagcaagatcggtagccctttataatgcagcaaatccgggagttcgtttcttccttggaggttcagtggttctaaattcaaagagatttcttgaagatttgggagaggcacaaaggatatcaaaatcaagcactataatatga

SEQ ID NO: 7714 - protein, 567 aa, Sorghum bicolor
  misc_feature: Ceres ANNOT ID no. 6082328
  misc_feature (21)..(554): Pfam Id: Sec1 Pfam Desc: Sec1 family
  misc_feature (1)..(565): NCBI GI: 2921406 NCBI Desc: vacuolar protein sorting homolog [arabidopsis thaliana]
  misc_feature (1)..(566): NCBI GI: 4583679 NCBI Desc: vacuolar protein sorting [homo sapiens]
  misc_feature (1)..(554): NCBI GI: 15215175 NCBI Desc: vacuolar protein sorting 45 [mus musculus]
  misc_feature (1)..(566): NCBI GI: 62897989 NCBI Desc: vacuolar protein sorting 45a variant [homo sapiens]
  misc_feature (1)..(554): NCBI GI: 7305631 NCBI Desc: vacuolar protein sorting 45 [mus musculus]
MVLITLVRDYIDRMLHDIPGMKVLVLDPQTVGMVSVVYSQSDLLRKEVFLVETMDNASSSRESMAHLKAVYFLRPSADNVQKLRRHLAMPRFAEYHLFFSSILKVPQIQILADSDEQEVVQQVQEFYADFCAIDPYHFTLNIQNNHIYMLPTVVDPPGMQSFCDRAVDGIASVFLALKRRPVIRFQRTSDVAKRIAQETARLMYEQESGLFDFRRTENSSLLLVIDRRDDPVTPLLNQWTYQAMVHELVGIENNKVDLRGFANVPKDQQEVVLSSVQDDFFRANMFENFGDLGMNLKRMVDDFQHLSKNSLNLQSIGDMAKFVSNYPEYRKTHGNVTKHVNLVSELSRIVEERKLMLVSQTEQELACTSGQAAAFEAVTSLLNNERVSDIDRLRSVMLYALRYEKESPVQLMQLFNKLASHSAKYKSGLVQFLLKQAGIDKRTGDLYGNRDLLNIARNMARGLKGVENVYTQHQPLIFQTMEGIVKGRLRDVDYPLVGNHFQQGRPQDVVIFVVGGTTYEEARSVALYNAANPGVRFFLGGSVVLNSKRFLEDLGEAQRISKSSTII

SEQ ID NO: 7715 - DNA, 2616 bp, Sorghum bicolor
  misc_feature: Ceres ANNOT ID no. 6082338
  misc_feature: Encodes the peptide sequence at SEQ ID NO 7716
atggcggcctcgccggaccagtttcggggccaggcgcgcctcccgcgcttcgcggccccgctccgctacgacctccgcctccgcccggacctcgccgcctgcaccttcacgggcgccgcggccgtcgccgtcgccgtgtccgcgaccacccgcttcctcgtcctcaacgccgccgagctcgacgatttggcgccgacagatgtggcgcagttcgaggaggatgagatcctggttatcggcttcgaccgggacctgcccctcggcgagggagtgctcaccatggacttcaccgggacgctcaacgatcagatgaggggattctacaggagcaaatatttatacaatggagagtcaagaaatatggcggttacacagtttgaagccgctgatgcgcggaggtgctttccatgttgggatgatcctgcatttaaggctaagttcaagctaacactagaagttccatctgacctggtagcattgtccaacatgccagtggctaaggagactgtcagtggatctatcaagactgtttattatgaggaatctccactaatgtcaacctatcttgtggctatagttgttggcatctttgattacatagagagttcaacatcagagggaaccaaagttcgtgtctatactcaagttggcaagactaatcaaggaaagtttgcactagatgttgctgtaaagtcattggatttatataaggattatttcgccactccttatccactacctaagttggatatgattgctatcccggatttttctgctggggcgatggagaactatgggctagtcacttaccgagatacagctttgctgtatgatgagctactatcatcagcatccaacaagcaacaggtagcaataactgttgcacatgagttggcgcaccaatggtttggcaatcttgtgaccatggaatggtggactcacttgtggctaaacgagggttttgcttcctgggtaagctatttagcagtagaatctttattccctgaatggaataactggacacaattccttgatgagacgacctctggcctcaaattggatgcccttgcagagtctcaccctatcgaggttgaggtaaaccatgccagtgaaattgatgcaatttttgattccataagctatgacaagggtgcttctgttattcgtatgctacaaagttaccttggtgcagagcgttttcagaaagctttggcttcatatataaagaagtatgcctactcgaatgctaagactgaagacctatgggctgttcttgaggaggaatctggggagcctgttaaggatttgatgactacatggactaagcaacaaggatatcctgttatttatgcaaaaatcaatggacatgatttggaacttgaacaggcacagtttctgtctgatggatcctctggtcctggcatgtggattgttcctgtaacatcatgctgtggctcatatgatgcacagaaaaagttcttattgaaagataaaacggataagataaatattaaagaatttgctgcctctcaaagtgctgatggggagaagaatcaaaacatttggatcaaattgaatatagatcaaactggattttatagagtgaagtatgatgatgaacttgcagctggacttgtaaatgcaatcaaagcgaagaagctctcattaatggataagattggtatcgtggaagattcgtatgcactctctgttgcttgcaagcaaacactgacgtcattgttgcgactgctgaatgcttataatgatgagtctgattacactgtactttcacatgtaacctctgtatgcttaagcatttctaaaataacagttgatgctactcctgacttgaacaaagatatcaaacagcttttgatcaaccttcttctcccagctgccatgtatgccaatagaaaattaggctgggaccctaaggatggtgagagccatcttgatgtaatgcttagatcactgctcttgactgcgatggtcagacttggacataatgaaactataaatgaaggagttcggcgtttccaaatcttctttgaagaccgcaaaacttcccttcttccaccagatactagaaaggctgcatatcttgctgtgatgcgaactgttagcacctcaaacagatccggttatgatgctctccttaaaatctacagagaagcatctgaaccacaggaaaaatcacgtgtcttaggttccctgtcttcatcaccggataaggatattgttttggaggcattgaactttatgtttactgatgaggtgcggaatcaagattcattttacatccttggtggtattagcttagaaggacgagaagtagcatggacctggctgaaggaaaactgggattacgtgttgaagacatggaaatcgagttcactcatatcagacttcatcgagtccattgtcccaccgttcacctccgaggagaaagctaccgaggttaccgagttctttgctggccgcatcaagccctcattcgagagagcactgaagcagagcctcgagagggtgcggatcagcgtgaggtggatccagagcatcaggagtgaacccaagcttggtgagacagtgcaggagctgctgcaggccgaggcgtaa

SEQ ID NO: 7716 - protein, 871 aa, Sorghum bicolor
  misc_feature: Ceres ANNOT ID no. 6082338
  misc_feature (14)..(384): Pfam Id: Peptidase_M1 Pfam Desc: Peptidase family M1
  misc_feature (1)..(868): NCBI GI: 115476300 NCBI Desc: os08g0398700 [oryza sativa (japonica cultivar-group)]
  misc_feature (6)..(866): NCBI GI: 29028734 NCBI Desc: at4g33090/f4i10_20 [arabidopsis thaliana]
  misc_feature (6)..(868): NCBI GI: 92871493 NCBI Desc: peptidase m, neutral zinc metallopeptidases, zinc-binding site [medicago truncatula]
  misc_feature (325)..(866): NCBI GI: 7270256 NCBI Desc: aminopeptidase-like protein [arabidopsis thaliana]
  misc_feature (1)..(851): NCBI GI: 116126560 NCBI Desc: ensangp00000026472 [anopheles gambiae str. pest]
MAASPDQFRGQARLPRFAAPLRYDLRLRPDLAACTFTGAAAVAVAVSATTRFLVLNAAELDDLAPTDVAQFEEDEILVIGFDRDLPLGEGVLTMDFTGTLNDQMRGFYRSKYLYNGESRNMAVTQFEAADARRCFPCWDDPAFKAKFKLTLEVPSDLVALSNMPVAKETVSGSIKTVYYEESPLMSTYLVAIVVGIFDYIESSTSEGTKVRVYTQVGKTNQGKFALDVAVKSLDLYKDYFATPYPLPKLDMIAIPDFSAGAMENYGLVTYRDTALLYDELLSSASNKQQVAITVAHELAHQWFGNLVTMEWWTHLWLNEGFASWVSYLAVESLFPEWNNWTQFLDETTSGLKLDALAESHPIEVEVNHASEIDAIFDSISYDKGASVIRMLQSYLGAERFQKALASYIKKYAYSNAKTEDLWAVLEEESGEPVKDLMTTWTKQQGYPVIYAKINGHDLELEQAQFLSDGSSGPGMWIVPVTSCCGSYDAQKKFLLKDKTDKINIKEFAASQSADGEKNQNIWIKLNIDQTGFYRVKYDDELAAGLVNAIKAKKLSLMDKIGIVEDSYALSVACKQTLTSLLRLLNAYNDESDYTVLSHVTSVCLSISKITVDATPDLNKDIKQLLINLLLPAAMYANRKLGWDPKDGESHLDVMLRSLLLTAMVRLGHNETINEGVRRFQIFFEDRKTSLLPPDTRKAAYLAVMRTVSTSNRSGYDALLKIYREASEPQEKSRVLGSLSSSPDKDIVLEALNFMFTDEVRNQDSFYILGGISLEGREVAWTWLKENWDYVLKTWKSSSLISDFIESIVPPFTSEEKATEVTEFFAGRIKPSFERALKQSLERVRISVRWIQSIRSEPKLGETVQELLQAEA

SEQ ID NO: 7717 - DNA, 702 bp, Sorghum bicolor
  misc_feature: Ceres ANNOT ID no. 6082353
  misc_feature: Encodes the peptide sequence at SEQ ID NO 7718
atggggctcgagatggaggtcatgtctgaggctgctgctcctacgacggctgttgtgcctgcggcggcggcgagggagccgggggtggatgtggatatttacccgctcacacgctactacttcggcgccagggacgccgccgccgccgtgccccgcggcctggagaccgccgctgaccgcgcgctacggctcaaggcaaacttcgcggcgcgcgggctccgcaccagcgtccatggcgtcctcctggtggagctgttcgatcacccgcacctgctgctgctgcaggtccggaactcctcctttctgctccccggaggccgcctcaggcctggcgaggaagaggtccaaggcctcaagcgcaaactctccagcaagctctcctttgtcgatgcagatgatgatcagaccattgaagaagaggatgactggcagattggagagtgcatcgggatgtggtggagatctgaatttgaggccatcccatttccatacatgcctccaagcttccgtgcaccgaaggaatgcatcaagctgttcctggtcaggctgccgatgtctcggcagttcatcgtgcccaggaacatgaagctcctggccgtgcctttgtcccaggttcatggcaatgctcaggtttacggtccaattatatctggcattccgaatctactgtccaagttctccttcaacgtcatcagtgactga

SEQ ID NO: 7718 - protein, 233 aa, Sorghum bicolor
  misc_feature: Ceres ANNOT ID no. 6082353
  misc_feature (31)..(232): NCBI GI: 32488646 NCBI Desc: osjnba0032f06.22 [oryza sativa (japonica cultivar-group)]
  misc_feature (31)..(232): NCBI GI: 115461402 NCBI Desc: os04g0683100 [oryza sativa (japonica cultivar-group)]
  misc_feature (88)..(231): NCBI GI: 4914406 NCBI Desc: mrna cleavage factor subunit-like protein [arabidopsis thaliana]
  misc_feature (31)..(228): NCBI GI: 48145955 NCBI Desc: cpsf5 [homo sapiens]
  misc_feature (18)..(233): NCBI GI: 66845767 NCBI Desc: cleavage and polyadenylation specific factor 5 [aspergillus fumigatus af293]
MGLEMEVMSEAAAPTTAVVPAAAAREPGVDVDIYPLTRYYFGARDAAAAVPRGLETAADRALRLKANFAARGLRTSVHGVLLVELFDHPHLLLLQVRNSSFLLPGGRLRPGEEEVQGLKRKLSSKLSFVDADDDQTIEEEDDWQIGECIGMWWRSEFEAIPFPYMPPSFRAPKECIKLFLVRLPMSRQFIVPRNMKLLAVPLSQVHGNAQVYGPIISGIPNLLSKFSFNVISD

SEQ ID NO: 7719 - DNA, 1755 bp, Sorghum bicolor
  misc_feature: Ceres ANNOT ID no. 6082417
  misc_feature: Encodes the peptide sequence at SEQ ID NO 7720
  misc_feature: Down-regulated in shoot tissues in response to aminocyclopropane carboxylic treatment
  misc_feature: Down-regulated in shoot tissues in response to salicylic acid treatment
atggatttgatcaggagaggggcggttttcaaggccctggtgttcctctgcttcatcatatcatctcatggaagagatcatttaaccaaactgaatctccctcccttcctaaaggcaagcaggtttcccacgtttcagcacgaggcatatgactatatcattattggtgggggcacagccggatgtccattggcagctacgctgtcccaaaagtacaaggtactcctgctggagagaggtgggtctccatatggtaaccgcaacatcacgttactggagaacttccacatttgcctggccgatgtttcaccacaatcgccgtcacaaggtttcatctccactgatggcgtgataaatgcccgtgcaaaggtcctgggtggtggaacctgtatcaatgccggcttctacagtcgggcaaaaccaagcttcgtgcagaaggcaggatgggatgcagagctagtcaaccagtcctacccttgggttgaagagaggattgttcattggcccaaagttgcaccttggcaagctgcactccgggatgggcttctggaagcaggggtctcaccatacaatggatattcttatgaccatctctatggaactaaggttgggggcaccatatttgatgagtctgggtatcggcacacagctgctgacctccttgctgctggaaatcctaacaaccttagggtactacttcatgctagcgtgaacaaaattgttttcaacatgaaacaaggcaataggaagccaagggctattggagttcaattcaaagatgagaatggagggcactaccaagccttcctcaaaaggaagaggggtagtgacatcattgtttctgccggcgcaattggcagcccacagctattgttgctaagtgggatcggaccgaggagtgaacttaataagcacaacatttctgtagtacttcgcaatgaacatgtgggtaaaggaatgtcagacaatccaatgaactcaatctttgtacctatgaagaatcctacaaagcaatctttgattgaaactgtcggaataacggatgctggcgtgtttattgaagccagcagtggtttcagccagtcagatgatagcatccattgccaccacggaatcatgtctgctgagattgggcaactatcaacaattccaccaaaacaaagaagttttgacaaaatccaaaagtatgtacataacaaatatagcctacccaaagaagtatttgatggaggattcattcttgagaagatcgatggcccactgtctactggtagtttagtacttgttgacactgatatcgatagcaaccccaatgtcaccttcaactatttccagcatccacaggatctcagacgatgtgtctatgggataaaaacaatcgagaaaatattgaagacaaaccatttcactaaccttactgccaatggtgctggatatccaatggaaacgctgctcaatatgagcatatcagctaacataaacttgataccgaagcacacaaatgacaccacatccttggagcagttttgcagggacacagtaacaaccatctggcactaccatggtggatgccatgtaggtaaggtggtcgatcaacactatcgggtgattggcatctcaggcctccgtgtgatagatgggtcaaccttgtttagttcaccaggaacgaacccacaagcgacagtcctaatgatgggcagatacatgggagtgaagattctaagggaaagattaggacgagcagctggagtataa

SEQ ID NO: 7720 - protein, 584 aa, Sorghum bicolor
  misc_feature: Ceres ANNOT ID no. 6082417
  misc_feature (413)..(569): Pfam Id: GMC_oxred_C Pfam Desc: GMC oxidoreductase
  misc_feature (50)..(338): Pfam Id: GMC_oxred_N Pfam Desc: GMC oxidoreductase
  misc_feature (46)..(584): NCBI GI: 4903006 NCBI Desc: ace [arabidopsis thaliana]
  misc_feature (46)..(584): NCBI GI: 4903018 NCBI Desc: ace [arabidopsis thaliana]
  misc_feature (141)..(584): NCBI GI: 124360378 NCBI Desc: abc transporter related; choline dehydrogenase [medicago truncatula]
  misc_feature (50)..(567): NCBI GI: 115447905 NCBI Desc: os02g0678300 [oryza sativa (japonica cultivar-group)]
  misc_feature (36)..(578): NCBI GI: 9502391 NCBI Desc: t12c24.11 [arabidopsis thaliana]
  misc_feature: Down-regulated in shoot tissues in response to aminocyclopropane carboxylic treatment
  misc_feature: Down-regulated in shoot tissues in response to salicylic acid treatment
MDLIRRGAVFKALVFLCFIISSHGRDHLTKLNLPPFLKASRFPTFQHEAYDYIIIGGGTAGCPLAATLSQKYKVLLLERGGSPYGNRNITLLENFHICLADVSPQSPSQGFISTDGVINARAKVLGGGTCINAGFYSRAKPSFVQKAGWDAELVNQSYPWVEERIVHWPKVAPWQAALRDGLLEAGVSPYNGYSYDHLYGTKVGGTIFDESGYRHTAADLLAAGNPNNLRVLLHASVNKIVFNMKQGNRKPRAIGVQFKDENGGHYQAFLKRKRGSDIIVSAGAIGSPQLLLLSGIGPRSELNKHNISVVLRNEHVGKGMSDNPMNSIFVPMKNPTKQSLIETVGITDAGVFIEASSGFSQSDDSIHCHHGIMSAEIGQLSTIPPKQRSFDKIQKYVHNKYSLPKEVFDGGFILEKIDGPLSTGSLVLVDTDIDSNPNVTFNYFQHPQDLRRCVYGIKTIEKILKTNHFTNLTANGAGYPMETLLNMSISANINLIPKHTNDTTSLEQFCRDTVTTIWHYHGGCHVGKVVDQHYRVIGISGLRVIDGSTLFSSPGTNPQATVLMMGRYMGVKILRERLGRAAGV

SEQ ID NO: 7721 - DNA, 636 bp, Sorghum bicolor
  misc_feature: Ceres ANNOT ID no. 6082464
  misc_feature: Encodes the peptide sequence at SEQ ID NO 7722
atgagggcgggcgggatgctgtgccggtcgcaggcggcgacggcggtgtgcgtgccgggggacgcgcggtccatggtggtgtcccgccgcgccgaccgcaccatcgtggccgacgacgacgcccgccgcgccctgcacgacgtcaggtacgcgcgcctcggcggcggcggcggcgacgggggtcgccggtccacgtcacgcaggttcgcggcggccagggctgctgcgccgcctccgcctccgtccgctagtgcgtcatgcaagccgcgcgtggagaggcagcagcggcgccctgccacgcgcgcgcccgtggcggtggccgtgacgctgcccatggtgaccaagagccccagcaaggaggcgccgcccaaggacctcgccgccgcggccaagcgcgtgcaggccgccgtcgcggcggcgcccggcgaccagctcctccaggtggtggtgatgaaggtggccatccactgccagggctgcgcaggcaaagtcaggaagcacatctccaaaatggaaggagtgacgtcgttcagcatcgacctggagagcaagaaggtgacggtgatgggccacgtgtcgccggcgggggtcctcgagagcatctccaaggtcaagaaggccgagctcctcgcctga

SEQ ID NO: 7722 - protein, 211 aa, Sorghum bicolor
  misc_feature: Ceres ANNOT ID no. 6082464
  misc_feature (149)..(209): Pfam Id: HMA Pfam Desc: Heavy-metal-associated domain
  misc_feature (111)..(208): NCBI GI: 15290146 NCBI Desc: p0459b04.21 [oryza sativa (japonica cultivar-group)]
  misc_feature (147)..(208): NCBI GI: 79314882 NCBI Desc: metal ion binding [arabidopsis thaliana]
  misc_feature (147)..(208): NCBI GI: 92893093 NCBI Desc: heavy metal transport/detoxification protein [medicago truncatula]
  misc_feature (147)..(211): NCBI GI: 115438140 NCBI Desc: os01g0595100 [oryza sativa (japonica cultivar-group)]
  misc_feature (147)..(206): NCBI GI: 6525009 NCBI Desc: copper chaperone homolog cch [oryza sativa]
MRAGGMLCRSQAATAVCVPGDARSMVVSRRADRTIVADDDARRALHDVRYARLGGGGGDGGRRSTSRRFAAARAAAPPPPPSASASCKPRVERQQRRPATRAPVAVAVTLPMVTKSPSKEAPPKDLAAAAKRVQAAVAAAPGDQLLQVVVMKVAIHCQGCAGKVRKHISKMEGVTSFSIDLESKKVTVMGHVSPAGVLESISKVKKAELLA

SEQ ID NO: 7723 - DNA, 1647 bp, Sorghum bicolor
  misc_feature: Ceres ANNOT ID no. 6082480
  misc_feature: Encodes the peptide sequence at SEQ ID NO 7724
atggcccgcgccgccgttcgcctcctccccatcttcctcccatggcggcgccctccccctccccgcctcctccgccggggcttcctaaaccctagtagccccagaactctggccacgcgcgcggacaccctcgtcctccctggggacgagcgctcgccctcgccctcgccctcgccctcgcgcctcccaggccagctgcggccggactacggcggcggaggcgggggcggcgctcccggtaccatcgcggccatcgtcacctcactcggcggcggcccggcagcggtggggatcgtgcggctctccggccccgacgccgtcgccgtcgccgaccgcgttttccgtccggccggggcccggagggcgtcggcgccgtggcagccgcgcagccacttcgtggagtacggactcgcactcgacgcggacggcagcgttattgacgaggttttggtggtgccaatgctcgccccgaggtcgtacacgcgggaggatgtggtggagctccagtgtcatggcaacgacctctgcttgcgccgtgtgctcagggcttgcttggaggctggagccaggcttgctgatcctggtgagttcacccttcgtgcattcctgaatgggaggttggacttggcccaagcggagaatgtgtctaggcttatttcagcaaagtcagcagctgtggcggactcagctttggctggcattcagggaggcttttctaccttagtaaggtcattgagatcaaggtgcattgagctgctaacagaaatcgaggctcgtctagattttgaagatgagatgcctcctttggatctagtgatgcttgtcagcaaaattaattgtatgaggcaggaggttcaggatgctttggacacttccaattatgataaattgttacaatctggtctacagatagcaataattggccgcccaaatgttggcaagtccagcctccttaatgcttggagtaagagtgaaagggctattgttactgaaatagccggaactacacgggatgtagtagaagcaaatgtctcaattcacggtgtacctgttactctcttggacactgctggtataagagaaactgatgatgttgtggaaaaaattggcgtgaaaagatccgaggctgctgcaatgggagctgatcttattgtcatggcaataagtgcagttgatggatggactgatgatgacactaaacttatggagcatgttttgataaataggaagtcctcaggttctgcagttccgatggttcttgtaatcaacaaggtagattgtgcgccatttgttcctggagaacagtttgaacaattcagtggcctcttcataaaacatgtacagacatgtgcagtcaccggtaaagggatttctgatttggagagcgctgtaatagaggtcaggggtattgagcatgtaccttctgagggacgaaggtggactgtaaaccagaggcaatttgaacagctgttgaggactaaagaagctttcctacgtctagagtcatcaatcaacgagcagttaccaatggacttttggactgtggacttgagggaagctgcgcttgctcttgcaacgatcagcggggaggacatctctgaagaagttttgagtagcatattcagcaaattctgcatcgggaaatga

SEQ ID NO: 7724 - protein, 548 aa, Sorghum bicolor
  misc_feature: Ceres ANNOT ID no. 6082480
  misc_feature (302)..(426): Pfam Id: MMR_HSR1 Pfam Desc: GTPase of unknown function
  misc_feature (303)..(426): Pfam Id: Miro Pfam Desc: Miro-like protein
  misc_feature (21)..(548): NCBI GI: 6573766 NCBI Desc: f28k19.23 [arabidopsis thaliana]
  misc_feature (76)..(548): NCBI GI: 81300391 NCBI Desc: trna modification gtpase trme [synechococcus elongatus pcc 7942]
  misc_feature (76)..(548): NCBI GI: 56750048 NCBI Desc: thiophen and furan oxidation protein [synechococcus elongatus pcc 6301]
  misc_feature (74)..(548): NCBI GI: 119486976 NCBI Desc: trna modification gtpase [lyngbya sp. pcc 8106]
  misc_feature (80)..(548): NCBI GI: 17232169 NCBI Desc: thiophen / furan oxidation protein [nostoc sp. pcc 7120]
MARAAVRLLPIFLPWRRPPPPRLLRRGFLNPSSPRTLATRADTLVLPGDERSPSPSPSPSRLPGQLRPDYGGGGGGGAPGTIAAIVTSLGGGPAAVGIVRLSGPDAVAVADRVFRPAGARRASAPWQPRSHFVEYGLALDADGSVIDEVLVVPMLAPRSYTREDVVELQCHGNDLCLRRVLRACLEAGARLADPGEFTLRAFLNGRLDLAQAENVSRLISAKSAAVADSALAGIQGGFSTLVRSLRSRCIELLTEIEARLDFEDEMPPLDLVMLVSKINCMRQEVQDALDTSNYDKLLQSGLQIAIIGRPNVGKSSLLNAWSKSERAIVTEIAGTTRDVVEANVSIHGVPVTLLDTAGIRETDDVVEKIGVKRSEAAAMGADLIVMAISAVDGWTDDDTKLMEHVLINRKSSGSAVPMVLVINKVDCAPFVPGEQFEQFSGLFIKHVQTCAVTGKGISDLESAVIEVRGIEHVPSEGRRWTVNQRQFEQLLRTKEAFLRLESSINEQLPMDFWTVDLREAALALATISGEDISEEVLSSIFSKFCIGK

SEQ ID NO: 7725 - DNA, 1335 bp, Sorghum bicolor
  misc_feature: Ceres ANNOT ID no. 6082502
  misc_feature: Encodes the peptide sequence at SEQ ID NO 7726
atggacgagttcgagctggaggacaacctcgagttcatcctccagagcatccaggagctcatggaggaccagggggacaacaacgccttcggcgacgccaaccagaacgagctcttcgccagcctcgtcagctacgaccaggagaacatgctgcccgacgtctctgccgcggacgtcgctgcggggaaggacatgcaggggatcccgtgggagaagatgctcttcgggagggataagtaccgggagatgaagatgaagaactacagaaattaccagaacctaagttacgcacgggaggatgctttgcaggagtgcaaacacgtggagaaggatagcccttactatgatttccactacaacacaaggcgtgctcggccatcaattgtacattttcagctacggaatctagtatgggcaacaaccaaacatgatgtttatacaatgcatgatcagtcagtgacacactggtcctcactggagcagacgagcactgagctaatcgatgctgatgattgcatcgtcccgaaacagagggggcatggttcacagtcagtggcaatggtccaggtcacaacaatggccgtggatagtaatttattagtagttggtggctttcaaggggagcttatatgcaagcgcttggatgatgatggggttgtttacagcacaagggttacagatgatgaaaatgcaatcactaactctttagagatctatcaggatcccagcggatctagaaggttggtggctgctaacaatgactgctccatcaggatttttgacaccgagtactttgacctcctcaagcactatgtctttccttggtctgtgaatagtgtttctgtgagcccaaatgggaaactctttgctgtcctgggagatcatgaggatggttgtatagtggatcccaagtgtggcaaggcaattggttctcttaggggtcacttggattactcatttgcatctgcgtggcatcctgatggcaatatcgtggcaactgggagtcaagacactacatgcaggctatgggacatcaggaacctatcacagtcggtagctgtgcttggtggaaggatgggctcaattcggtgtgtcaagttctcttcagatgggcgcttccttgcgacagcagagcctgtggattttgtccacatatatgatgcttatgcggactacagcaaatgtcacgagattgacttgtttggtgagattggtggtttagcattcagcccggacactgaggccttctatgtgggccttgcggaccagacatacggaggcatgatcgagttcagaaagaggcaccaacatcactacctcaactccttgtggtga

SEQ ID NO: 7726 - protein, 444 aa, Sorghum bicolor
  misc_feature: Ceres ANNOT ID no. 6082502
  misc_feature (306)..(344): Pfam Id: WD40 Pfam Desc: WD domain, G-beta repeat
  misc_feature (1)..(444): NCBI GI: 25090156 NCBI Desc: at1g78070/f28k19_28 [arabidopsis thaliana]
  misc_feature (68)..(441): NCBI GI: 50881464 NCBI Desc: wd domain, g-beta repeat containing protein [oryza sativa (japonica cultivar-group)]
  misc_feature (1)..(444): NCBI GI: 42572153 NCBI Desc: wd-40 repeat family protein [arabidopsis thaliana]
  misc_feature (2)..(442): NCBI GI: 22655036 NCBI Desc: at3g13340/mdc11_13 [arabidopsis thaliana]
  misc_feature (46)..(444): NCBI GI: 18400003 NCBI Desc: wd-40 repeat family protein [arabidopsis thaliana]
  misc_feature: The sequence is a functional homolog of SEQ ID NO. 502 in the 11/188,298 US application
MDEFELEDNLEFILQSIQELMEDQGDNNAFGDANQNELFASLVSYDQENMLPDVSAADVAAGKDMQGIPWEKMLFGRDKYREMKMKNYRNYQNLSYAREDALQECKHVEKDSPYYDFHYNTRRARPSIVHFQLRNLVWATTKHDVYTMHDQSVTHWSSLEQTSTELIDADDCIVPKQRGHGSQSVAMVQVTTMAVDSNLLVVGGFQGELICKRLDDDGVVYSTRVTDDENAITNSLEIYQDPSGSRRLVAANNDCSIRIFDTEYFDLLKHYVFPWSVNSVSVSPNGKLFAVLGDHEDGCIVDPKCGKAIGSLRGHLDYSFASAWHPDGNIVATGSQDTTCRLWDIRNLSQSVAVLGGRMGSIRCVKFSSDGRFLATAEPVDFVHIYDAYADYSKCHEIDLFGEIGGLAFSPDTEAFYVGLADQTYGGMIEFRKRHQHHYLNSLW

SEQ ID NO: 7727 - DNA, 816 bp, Sorghum bicolor
  misc_feature: Ceres ANNOT ID no. 6082505
  misc_feature: Encodes the peptide sequence at SEQ ID NO 7728
atggcggctgctataaatctcccggggcccagcgaagatctgatgcgagcgatggagtccttcatgcaagaagacgccgccccatcccctctgcccatgccgccggcggcgcagtacccgccggcgacgccgacccacctgagcccggcgcagatgcagttcatccaggcccagctccacctgcagcggaacccggggctgggcccgcgggcgcagcccatgaagcccgcggtccccatcccgccggcgcagcagcggcctgcccagaagctgtaccgcggcgtgcggcagcgccactggggcaagtgggtggcggagatccgtctcccccggaaccgcacccgcctgtggctcggcaccttcgacaccgccgaggaagccgcgctggcctacgaccaggcggcgtaccgcctccgcggggacgcggcgcgcctcaacttccccgacaacgcggcgtccagggcgccgctcgaccccgccgtcgacgccaagctccaggccatctgcgccaccatcgccgccgcgtcgtccaagggcggcgccagggccaagcagagcaaggcgatgccgatcaacgcgcccgtcctggaagcgacggcggcgtgtccgagcaacagctcctccgacgaaggctccgggtcggacgaggagatgtcctcccggacgacgacgacgccggtggttgtggcgccgccggtggtagcggacatggggcagctggacttcagcgaggcgccgtgggacgaggccgagagcttcgttctccgcaagtacccgtcctacgagatcgactgggacgcgctgctctccaactaa

SEQ ID NO: 7728 - protein, 271 aa, Sorghum bicolor
  misc_feature: Ceres ANNOT ID no. 6082505
  misc_feature (90)..(141): Pfam Id: AP2 Pfam Desc: AP2 domain
  misc_feature (52)..(271): NCBI GI: 21908036 NCBI Desc: dre binding factor 1 [zea mays]
  misc_feature (1)..(271): NCBI GI: 31745669 NCBI Desc: ap2-domain dre binding factor dbf1 [oryza sativa (japonica cultivar-group)]
  misc_feature (29)..(270): NCBI GI: 32140997 NCBI Desc: dre binding factor 2 [oryza sativa (japonica cultivar-group)]
  misc_feature (29)..(270): NCBI GI: 49388786 NCBI Desc: dre binding factor 2 [oryza sativa (japonica cultivar-group)]
  misc_feature (31)..(271): NCBI GI: 82749740 NCBI Desc: dehydration-responsive element binding protein 3 [asparagus officinalis]
  misc_feature: The sequence is a functional homolog of SEQ ID NO 1194 in the 10/666,642US patent application
  misc_feature: The sequence is a functional homolog of SEQ ID NO 1288 in the 10/374,780US patent application
  misc_feature: The sequence is a functional homolog of SEQ ID NO 1289 in the 10/374,780US patent application
  misc_feature: The sequence is a functional homolog of SEQ ID NO 1290 in the 10/374,780US patent application
  misc_feature: The sequence is a functional homolog of SEQ ID NO 1291 in the 10/374,780US patent application
  misc_feature: The sequence is a functional homolog of SEQ ID NO 1434 in the 10/412,699US patent application
  misc_feature: The sequence is a functional homolog of SEQ ID NO 1435 in the 10/412,699US patent application
  misc_feature: The sequence is a functional homolog of SEQ ID NO 1436 in the 10/412,699US patent application
  misc_feature: The sequence is a functional homolog of SEQ ID NO 164 in the 11/375,241US patent application
  misc_feature: The sequence is a functional homolog of SEQ ID NO 179 in the 11/479,226US patent application
  misc_feature: The sequence is a functional homolog of SEQ ID NO 2233 in the 10/666,642US patent application
  misc_feature: The sequence is a functional homolog of SEQ ID NO 503 in the 10/374,780US patent application
  misc_feature: The sequence is a functional homolog of SEQ ID NO 96 in the 10/714,887US patent application
  misc_feature: The sequence is a functional homolog of SEQ ID NO 96 in the 11/435,388US patent application
  misc_feature: Useful for making plants with modulated growth and phenotype characteristics
  misc_feature: The sequence is a functional homolog of SEQ ID NO 1434 in the 20040045049 US patent application
  misc_feature: The sequence is a functional homolog of SEQ ID NO 1435 in the 20040045049 US patent application
  misc_feature: The sequence is a functional homolog of SEQ ID NO 1436 in the 20040045049 US patent application
  misc_feature: The sequence is a functional homolog of SEQ ID NO 96 in the 20060015972 US patent application
  misc_feature: The sequence is a functional homolog of SEQ ID NO 1291 in the 20060162006 US patent application
  misc_feature: The sequence is a functional homolog of SEQ ID NO 503 in the 20060162006 US patent application
  misc_feature: The sequence is a functional homolog of SEQ ID NO 179 in the 20070022495 US patent application
  misc_feature: The sequence is a functional homolog of SEQ ID NO 1194 in the 20070033671 US patent application
  misc_feature: The sequence is a functional homolog of SEQ ID NO 1288 in the 10/374,780 US patent application
  misc_feature: The sequence is a functional homolog of SEQ ID NO 1434 in the 10/412,699 US patent application
  misc_feature: The sequence is a functional homolog of SEQ ID NO 14 in the 10/903,236 US patent application
  misc_feature: The sequence is a functional homolog of SEQ ID NO 1737 in the 10/374,780 US patent application
  misc_feature: The sequence is a functional homolog of SEQ ID NO 2129 in the 10/666,642 US patent application
  misc_feature: The sequence is a functional homolog of SEQ ID NO 74 in the 10/714,887 US patent application
  misc_feature: The sequence is a functional homolog of SEQ ID NO 74 in the 11/435,388 US patent application
MAAAINLPGPSEDLMRAMESFMQEDAAPSPLPMPPAAQYPPATPTHLSPAQMQFIQAQLHLQRNPGLGPRAQPMKPAVPIPPAQQRPAQKLYRGVRQRHWGKWVAEIRLPRNRTRLWLGTFDTAEEAALAYDQAAYRLRGDAARLNFPDNAASRAPLDPAVDAKLQAICATIAAASSKGGARAKQSKAMPINAPVLEATAACPSNSSSDEGSGSDEEMSSRTTTTPVVVAPPVVADMGQLDFSEAPWDEAESFVLRKYPSYEIDWDALLSN

SEQ ID NO: 7729 - DNA, 1485 bp, Sorghum bicolor
  misc_feature: Ceres ANNOT ID no. 6082543
  misc_feature: Encodes the peptide sequence at SEQ ID NO 7730
atgaggcatccggatgcggaggcggcgtcgcgccggcggtggacgctggtgctggtgaacctggcgtcggtgctggagaaggcggacgaggtgctgctgcccgccgtgtacaaggaggtgggcgccgcgctgggcgcctccccgacggcgctgggctccctcaccctctgccgcgcgctcgtccaggccgcctgctacccgctcgccgcctacgcctccgcgcgccacgaccgggcccgcgtcgtcgccgtcggcgccttcctctgggccgccgccaccttcctcgtcgccgtctccggcagcttcctccagatggcgatctcgcggggcctcaacgggatcggcctggcgctggtcctcccggcgatcagctccctcgtcgccgactacaccgacgaccacacccgcggcgcggccttcggctggctgcagatgacctgcaacctgggctccatcctggggggctccttgggcgtgctgctcgcgccgatcaccttcctcggcgtcgccgggtggcgggtcgccttccacgccgtggccgtcatcagcgtggcgctgggcgtgctcatgtggctcttcgccgcggacccggcgatgagcccgtccgccgccgccaagtcgtccaagaccgcggcggcgggctcggaagccaaggagctgctccagcacgcccggcgcgtgctcggggtgaccacgttccagatcatcgtggcgcaggggatcgccggctccatcccgtggtccgcgctcaacttctccgccatgtggctggagctcgccgggttcaccaactgggagaccagcgtcatcacggggctgtacctgttcgccaccgcgctcggcgcgctcttcggcggactcatcggagaccccgtcgccaggcggttccccaacaccggtaggatcgcgctggcgcagatcagctcggcgtccgcgctcccgctcggcgccatcctgctgctggccttgcccaatgacccgtccaccggcgtggcgcacgccgtcgccttcttcgtcatgggcttcgccatctcctggaacgcctcgtccaccaacaaccccatcttcgcggagattgtgccggagaaggcgaggacgacggtgtacgcgctggacaagtgtttcgaagcagtgttcgcgtcgttcgcgtctcccatcgtcggcgttctcgcggagcgcgtgttcggctataagccggtgtcgtcggacacgagcgtggagacggacagggagaatgccgctgcgttggcgaaggctgtgtacacggagatcgccgtgcccatggccatctgttgcctgacctacaccttcctgtactgcacgtacccacgagacagggagcgagctcgaaaggagcttctcatggcatcggatgatcaactcggtggagaagccagtgacgacaacgagtcaagtgcggttcatactacacgggtagacgaagaatcttctgtcagctccttaaatcagaggctaatatcttga

SEQ ID NO: 7730 - protein, 494 aa, Sorghum bicolor
  misc_feature: Ceres ANNOT ID no. 6082543
  misc_feature (16)..(384): Pfam Id: MFS_1 Pfam Desc: Major Facilitator Superfamily
  misc_feature (14)..(453): Pfam Id: Sugar_tr Pfam Desc: Sugar (and other) transporter
  misc_feature (7)..(493): NCBI GI: 37806448 NCBI Desc: transporter-like protein [oryza sativa (japonica cultivar-group)]
  misc_feature (105)..(472): NCBI GI: 115476378 NCBI Desc: os08g0410500 [oryza sativa (japonica cultivar-group)]
  misc_feature (7)..(460): NCBI GI: 37806444 NCBI Desc: transporter-like protein [oryza sativa (japonica cultivar-group)]
  misc_feature (5)..(489): NCBI GI: 115478853 NCBI Desc: os09g0371200 [oryza sativa (japonica cultivar-group)]
  misc_feature (2)..(460): NCBI GI: 49389120 NCBI Desc: membrane transport protein-like [oryza sativa (japonica cultivar-group)]
MRHPDAEAASRRRWTLVLVNLASVLEKADEVLLPAVYKEVGAALGASPTALGSLTLCRALVQAACYPLAAYASARHDRARVVAVGAFLWAAATFLVAVSGSFLQMAISRGLNGIGLALVLPAISSLVADYTDDHTRGAAFGWLQMTCNLGSILGGSLGVLLAPITFLGVAGWRVAFHAVAVISVALGVLMWLFAADPAMSPSAAAKSSKTAAAGSEAKELLQHARRVLGVTTFQIIVAQGIAGSIPWSALNFSAMWLELAGFTNWETSVITGLYLFATALGALFGGLIGDPVARRFPNTGRIALAQISSASALPLGAILLLALPNDPSTGVAHAVAFFVMGFAISWNASSTNNPIFAEIVPEKARTTVYALDKCFEAVFASFASPIVGVLAERVFGYKPVSSDTSVETDRENAAALAKAVYTEIAVPMAICCLTYTFLYCTYPRDRERARKELLMASDDQLGGEASDDNESSAVHTTRVDEESSVSSLNQRLIS

SEQ ID NO: 7731 - DNA, 1059 bp, Sorghum bicolor
  misc_feature: Ceres ANNOT ID no. 6082544
  misc_feature: Encodes the peptide sequence at SEQ ID NO 7732
atggcggcgctgggcacggcgaccacacccgcagcagctcccggggcgccgcgctgctataatcggcacccgcggccgcggcaccacatcgcggcgcgccggaaccgggttgcctcggcgaggaggcttgacctgtgcgccagcgcctcaccctcacctgccgtcactgctcccgacatacccgacgaagctgtcgaggaacccttggtggagccggcggcggagacgaagctgaggaagctggcatgtccaatctgctactaccccctcgcgggctcgagcgatcagtcggacgatgcttccagtctcgaatgttcaacctgcaagaaatcctacccgaacaaacaggattactgggatcttacagtgtcagttggttcgatagagtactctgagtccatgccagcagcaacagaattgttcaggactccactggtatcatttctttacgaaagaggatggcgccaaaatttcatatggggtggtttcccaggcctagagagagagtttgaaatggcaaaaacttatttgaagccaacatttggagggactattgttgatgcaagttgtggaagtggcctgttctcaagattgtttgttaagagtgggctatattctcttgttgtggcactggatttctcagagaatatgttgaagcagtgcaatgaatacatcaagcaggaaaacatttcagatgagagattagcattggtgagggctgacatatccagactcccttttgtgagtggttcaattgatgctgtgcatgcaggtgctgcaattcattgttggccatccccagcttgtgctgttgcagatatcagtagagtccttcgcccagggggagtttttgttgcttcgacattcgtagcagatgttattccaccagttattccagtattgaggatcggacgaccgtacattagccaaataactggcaacaataccttcttatctgaagtggagtttgaagatctttgcaaagcatgtgggctggttgatttcaaatttgtcagaagtggattctatataatgttttctgccactaaagcaagctaa

SEQ ID NO: 7732 - protein, 352 aa, Sorghum bicolor
  misc_feature: Ceres ANNOT ID no. 6082544
  misc_feature (186)..(286): Pfam Id: Methyltransf_11 Pfam Desc: Methyltransferase domain
  misc_feature (186)..(284): Pfam Id: Methyltransf_12 Pfam Desc: Methyltransferase domain
  misc_feature (137)..(350): Pfam Id: Ubie_methyltran Pfam Desc: ubiE/COQ5 methyltransferase family
  misc_feature (31)..(352): NCBI GI: 115476380 NCBI Desc: os08g0411200 [oryza sativa (japonica cultivar-group)]
  misc_feature (64)..(350): NCBI GI: 51535631 NCBI Desc: methyltransferase-like [oryza sativa (japonica cultivar-group)]
  misc_feature (149)..(282): NCBI GI: 108803794 NCBI Desc: methyltransferase type 11 [rubrobacter xylanophilus dsm 9941]
  misc_feature (180)..(314): NCBI GI: 72394837 NCBI Desc: menaquinone biosynthesis methyltransferase (2-heptaprenyl-1,4-naphthoquinone methyltransferase) [methanosarcina barkeri str. fusaro]
  misc_feature (75)..(288): NCBI GI: 121543504 NCBI Desc: methylase involved in ubiquinone/menaquinone biosynthesis-like [candidatus desulfococcus oleovorans hxd3]
MAALGTATTPAAAPGAPRCYNRHPRPRHHIAARRNRVASARRLDLCASASPSPAVTAPDIPDEAVEEPLVEPAAETKLRKLACPICYYPLAGSSDQSDDASSLECSTCKKSYPNKQDYWDLTVSVGSIEYSESMPAATELFRTPLVSFLYERGWRQNFIWGGFPGLEREFEMAKTYLKPTFGGTIVDASCGSGLFSRLFVKSGLYSLVVALDFSENMLKQCNEYIKQENISDERLALVRADISRLPFVSGSIDAVHAGAAIHCWPSPACAVADISRVLRPGGVFVASTFVADVIPPVIPVLRIGRPYISQITGNNTFLSEVEFEDLCKACGLVDFKFVRSGFYIMFSATKAS

SEQ ID NO: 7733 - DNA, 819 bp, Sorghum bicolor
  misc_feature: Ceres ANNOT ID no. 6082556
  misc_feature: Encodes the peptide sequence at SEQ ID NO 7734
atgcgggatcgcgatctgctagggtttcctccggcggcgggcgcggccatgtcgtcggccgcggcgctcctcctcctcccactcctcgccgccgcgggcgagggggcgccggtctcggtctgcgcgccgccgcccgccgccgccgtcatcctgcggcacgcgtccacctcctgtcggacggtggacgccctggggctccggggccaccgcgccggcgtcgtcgagggggatgatggggcgctgcaaaaggcagtagcacttgtgctgcagaacagggaagattttgtcgctattcttttttatgcttcgtggtgtcctttttctaaaattttctggacagattttcaaaagctgtcatcctttttcccaacaattgctcatttttcttttgaagaatctaatatcaaaccaagagtattgtcaaggtatggggttcgtgcattcccgacaattttccttcttaactctacagtgcgtgtgcgttatcatggatctcgggccatgaattccctcgctgtgttctataaagatgttacaggcctgaatcctgtgtcattggacgccacatccctggagagaatggaggatacagttactataattgatcacgacaaaaagactgaaaaggaggattctctgttatcatgggcaagatcaccagaccggttacttcatcaagatacatgtcttgcattggctagctcctttgtcctcttgaggttgcttcatttccttcttcccaagattaatgcatgtatgaagcaagcctggaggacacgactttatgaattgaataggttgtttcctagcttgtcttga

SEQ ID NO: 7734 - protein, 272 aa, Sorghum bicolor
  misc_feature: Ceres ANNOT ID no. 6082556
  misc_feature (1)..(272): NCBI GI: 58014108 NCBI Desc: adenosine 5'-phosphosulfate reductase 5 [zea mays]
  misc_feature (12)..(272): NCBI GI: 60202584 NCBI Desc: adenosine 5'-phosphosulfate reductase-like [oryza sativa (japonica cultivar-group)]
  misc_feature (12)..(240): NCBI GI: 37806190 NCBI Desc: disulfide isomerase-like protein [oryza sativa (japonica cultivar-group)]
  misc_feature (22)..(258): NCBI GI: 58014104 NCBI Desc: adenosine 5'-phosphosulfate reductase 3 [zea mays]
  misc_feature (24)..(258): NCBI GI: 58014106 NCBI Desc: adenosine 5'-phosphosulfate reductase 4 [zea mays]
MRDRDLLGFPPAAGAAMSSAAALLLLPLLAAAGEGAPVSVCAPPPAAAVILRHASTSCRTVDALGLRGHRAGVVEGDDGALQKAVALVLQNREDFVAILFYASWCPFSKIFWTDFQKLSSFFPTIAHFSFEESNIKPRVLSRYGVRAFPTIFLLNSTVRVRYHGSRAMNSLAVFYKDVTGLNPVSLDATSLERMEDTVTIIDHDKKTEKEDSLLSWARSPDRLLHQDTCLALASSFVLLRLLHFLLPKINACMKQAWRTRLYELNRLFPSLS

SEQ ID NO: 7735 - DNA, 2598 bp, Sorghum bicolor
  misc_feature: Ceres ANNOT ID no. 6082628
  misc_feature: Encodes the peptide sequence at SEQ ID NO 7736
  misc_feature: Up-regulated in root tissues in response to methyl jasmonate treatment
atggtttcaaaatcatattcaaatctgctagagatgacctctggagatggatttgactttcgacaaccttttaagtctcttcctcgtgttgtaacttctcctggcattatatctgatcctgattgggatacaataagtgatggtgattcagttggttcagcatcttctaccgagaggaaaataattgttgccaactttcttcctctgaactgtacaagagatgatactgggaagctgtccttctcattggatcatgatgcactactcatgcaacttaaagatggtttttcaaatgagactgatgctgtgtatgtgggcagtttgaaagttcaggtagatcccagtgagcaggaccaagttgcacagaagcttcttagagaatatcgatgcatacctacttttctcccatctgacctgcagcagcagttctatcatggcttctgtaaacaacaattatggccactttttcattatatgcttccaatttgcctagacaagggtgagctatttgatcgcaacctatttcaagcctatgtccgagccaacaaactttttgcagataaagttatggaagcaatcaatacagatgatgattgtgtttgggttcatgattatcatctcatgctgctccctacattcttgaggaagaggttacaccgaataaaaattggtttcttccttcacagcccttttccctcctcagaaatctacaggactctgcctgtaagggatgaaatcctgaagtcactgcttaatgctgatctcattggtttccaaacatttgactatgctcgccacttcctatcttgctgtagcagattgctaggcctgcattatgagtcaaaacgtggttacattggaatagagtattttggccgaacagtcagtctgaagatcctttctgtgggtgtccatgttggtcgtcttgaatctgtcttaaagttgcctgctacaatcagtaaggttcaagaaattgaacaaaggtataaaggcaagatactcatgttaggtgtagatgacatggacatcttcaagggaataagtctgaaattgcttggactggagcttcttctggatagaaacccaaagcttagagagaaggttgtccttgtacaaatcatcaatccagcaagaagcacagggaaggacgtgcaagaagctattacagaagctgtatctgtggctaaaaggattaatacaaagtatggttcttcaagttacaagcctgtcgtcctaattgatcaccgcataccattttatgaaaagattgcattctatgctgcgtctgattgttgtattgtaaatgctgtgagggatggcatgaacttagtaccatatgagtatactgtttgtcgacagggaaatgaggagattgataaactcagaggtcttgacaaagacacccatcacacaagcacacttattgtttcggagtttgtgggttgctccccatctcttagtggtgctttcagggtaaatccttggagtgttgatgatgtggcagatgccttgtgccgtgcaactgatttgactgaatctgagaaaaggctgcggcatgaaaagcactatcgctatgtcagtactcatgatgttgcttactgggcacgcagctttgctcaagatctggaaagagcatgcaaagatcattacagccgaaggtgttgggctattgggtttggtctgaattttagagttattgctctttctcctggcttcagaaagctgtctttggagcactttgtttcttcttataacaaggcttctagaagagcaatatttcttgattacgacggcacacttgtggctcagtcatcaatcaacaaagctccaagtgaagaagtcatatccattcttaacaccttatgcaatgatccaaagaatgttgtatttatagtaagtggacgaggacgtgattcccttgatgagtggttttctccatgtgagaagcttggtgtagctgcagaacatggctattttatcagatggagcaaggaagctgcatgggagtcaagctattcaagtccgcagcaagaatggaagcacattgctgaacctatcatgcaggtatacacagagacaacagatggatcttcaatcgagtcaaaggaaagcgctctagtatggcactatttggatgcagaccatgattttggttccttccaagccaaggagctacaagatcatcttgagagggtgctatcaaatgagcctgttgttgtaaagtgtggtcattatattgtagaagtgaaaccgcagggagttagcaagggtcttgctgtcaacaagctgattcacacactggtcaagaatgggaaggcaccggatttcctgatgtgcgttggcaatgacagatctgatgaggacatgtttgaatgcatcaacggtatgacctccaatgatgccatatcacccacagcaccagaggtgtttgcctgttcagttggtcagaagcccagcaaagcaaagtattacgtggacgacaccagtgaagtaatcagattgctcaagaatgtaacccgcgtctcatcgcagcgggaggacgtcaatgccagccatggtcgtgtgaccttcagggacgtactcgactacgtggactag

SEQ ID NO: 7736 - protein, 865 aa, Sorghum bicolor
  misc_feature: Ceres ANNOT ID no. 6082628
  misc_feature (58)..(544): Pfam Id: Glyco_transf_20 Pfam Desc: Glycosyltransferase family 20
  misc_feature (593)..(829): Pfam Id: Trehalose_PPase Pfam Desc: Trehalose-phosphatase
  misc_feature (1)..(838): NCBI GI: 55792824 NCBI Desc: trehalose 6-phosphate synthase [gossypium hirsutum]
  misc_feature (1)..(838): NCBI GI: 55792822 NCBI Desc: trehalose 6-phosphate synthase [gossypium hirsutum]
  misc_feature (1)..(861): NCBI GI: 27462090 NCBI Desc: trehalose-6-phosphate synthase 3 [arabidopsis thaliana]
  misc_feature (1)..(844): NCBI GI: 60265773 NCBI Desc: trehalose-6-phosphate synthase [ginkgo biloba]
  misc_feature (31)..(861): NCBI GI: 27462088 NCBI Desc: trehalose-6-phosphate synthase 2 [arabidopsis thaliana]
  misc_feature: Useful for making plants with altered carbohydrate content
  misc_feature: Functional homolog of the protein sequence given in SEQ ID NO 14000
  misc_feature: Up-regulated in root tissues in response to methyl jasmonate treatment
MVSKSYSNLLEMTSGDGFDFRQPFKSLPRVVTSPGIISDPDWDTISDGDSVGSASSTERKIIVANFLPLNCTRDDTGKLSFSLDHDALLMQLKDGFSNETDAVYVGSLKVQVDPSEQDQVAQKLLREYRCIPTFLPSDLQQQFYHGFCKQQLWPLFHYMLPICLDKGELFDRNLFQAYVRANKLFADKVMEAINTDDDCVWVHDYHLMLLPTFLRKRLHRIKIGFFLHSPFPSSEIYRTLPVRDEILKSLLNADLIGFQTFDYARHFLSCCSRLLGLHYESKRGYIGIEYFGRTVSLKILSVGVHVGRLESVLKLPATISKVQEIEQRYKGKILMLGVDDMDIFKGISLKLLGLELLLDRNPKLREKVVLVQIINPARSTGKDVQEAITEAVSVAKRINTKYGSSSYKPVVLIDHRIPFYEKIAFYAASDCCIVNAVRDGMNLVPYEYTVCRQGNEEIDKLRGLDKDTHHTSTLIVSEFVGCSPSLSGAFRVNPWSVDDVADALCRATDLTESEKRLRHEKHYRYVSTHDVAYWARSFAQDLERACKDHYSRRCWAIGFGLNFRVIALSPGFRKLSLEHFVSSYNKASRRAIFLDYDGTLVAQSSINKAPSEEVISILNTLCNDPKNVVFIVSGRGRDSLDEWFSPCEKLGVAAEHGYFIRWSKEAAWESSYSSPQQEWKHIAEPIMQVYTETTDGSSIESKESALVWHYLDADHDFGSFQAKELQDHLERVLSNEPVVVKCGHYIVEVKPQGVSKGLAVNKLIHTLVKNGKAPDFLMCVGNDRSDEDMFECINGMTSNDAISPTAPEVFACSVGQKPSKAKYYVDDTSEVIRLLKNVTRVSSQREDVNASHGRVTFRDVLDYVD

SEQ ID NO: 7737 - DNA, 546 bp, Sorghum bicolor
  misc_feature: Ceres ANNOT ID no. 6082757
  misc_feature: Encodes the peptide sequence at SEQ ID NO 7738
atggctgcccatgtggacccgctggtggtggggagggtgatcggcgatgtggtggacctgttcgtgccgacggtggccatgtcggtgcgcttcggcaccaaggacgtaaccaacggctgcgagatcaagccatccctcaccgccgctgctccggtcgtccagattgccggcagggccaacgacctcttcaccctggttatgactgacccagatgctccgagccccagcgagccaacgatgagggagttgatccactggctggtggttaacataccaggtggagccgatccttctcaaggtgagacggtgatgccgtacctgggcccgtgcccgccggtgggcatccaccgctacgttctggtggtgtaccagcagaaggcccgcttcagggctccgccggtgctagcaccgggggcggaggtggaggcgtcgcgcgcacggttcaggaaccgcgcctttgccgaccgccatgacctaggcctcccagtcgccgccatgtacttcaacgcgcagaaggagccagccaaccgccaccgtcactactga

SEQ ID NO: 7738 - protein, 181 aa, Sorghum bicolor
  misc_feature: Ceres ANNOT ID no. 6082757
  misc_feature (19)..(171): Pfam Id: PBP Pfam Desc: Phosphatidylethanolamine-binding protein
  misc_feature (1)..(179): NCBI GI: 83628280 NCBI Desc: mft-like protein [populus trichocarpa]
  misc_feature (1)..(179): NCBI GI: 48474193 NCBI Desc: flowering locus t like protein [populus nigra]
  misc_feature (1)..(179): NCBI GI: 99079228 NCBI Desc: cets1 [glycine max]
  misc_feature (1)..(173): NCBI GI: 82791229 NCBI Desc: terminal flower 1 [aquilegia formosa]
  misc_feature (2)..(178): NCBI GI: 28200388 NCBI Desc: sp2g [lycopersicon esculentum]
MAAHVDPLVVGRVIGDVVDLFVPTVAMSVRFGTKDVTNGCEIKPSLTAAAPVVQIAGRANDLFTLVMTDPDAPSPSEPTMRELIHWLVVNIPGGADPSQGETVMPYLGPCPPVGIHRYVLVVYQQKARFRAPPVLAPGAEVEASRARFRNRAFADRHDLGLPVAAMYFNAQKEPANRHRHY

SEQ ID NO: 7739 - DNA, 1677 bp, Sorghum bicolor
  misc_feature: Ceres ANNOT ID no. 6082776
  misc_feature: Encodes the peptide sequence at SEQ ID NO 7740
atggccgtcggcccctacactctccgcgtctccccgccgccgcggctcgatgccttgctcttcccacagctgcggcctcacctacgttgccgcgtgtccgctcgggttgctgccgccggcaccagctggtctcccgccgccggtgactccgaagatggggtcggcggctggtgggttcccgagtacgagaagccgatgaaacaggggaggaggattgggtttgggagagctgtcgtggttgggctgggagctcctgtggcgatcgccttggctgggctggcgtggcgcttcccatcctccaggaagcgtatacagcaactcattgttgctccattacactatgttcaagagaaaatgtcaacaatggagtcaacagagacaatcaaggaggatgcaagtgacagggaatctgatgaaattgaaatttctagtgcaacacatgataagaaggctgaagcaataactgatgattcaaggcaaaactacagaacagaaactgccagccattttccatttggagttcctacagatcctgtacatgaggaggctttctctatattgaagaagctacagataattgagaaagatgttagctccagtgatttttgtacacggagggaatttgcaagatggtttgttaagttatgctcaaagtttgagaggaaaaggatgcaaaggattgttcctagtaaattaacttctggcgcggtccaatgtgcctttgatgatgtcaatattgacgacccagacttcctatatatccaatctttaggagaatctggtatcgtatccagcaagttgtcaaactccttggaaacactgacaagtggctctcattccaagggaaattccttgttcctacctgatagttacctctctcgtttcgatcttgtcaactggaaagtgcttgttgagcatccatttgcagaaatagaccaaaagatgctgagtcaaaatgtttgcattttggatctgcgtgcctgcccagatgtttctccgtccatgctcatagagctaatggctggtgaaaacagcatcatcagcagagtttttggaaatactagacgccttcaaccagacaaacctgtaactaaagcgcaagcagctgctgcactaaccagtggtcgaatgaaggaagcaattcaggaagagttaaatagacttgaagcagaaaaccaagcccatctttctgttatagctgaaatattggaagagttaattagtaggggagatatacaacaacaatgggaggaaatgatgaaaaaggagcaagaacgggctcttaaagttgacaataatcttcaacatgtgttgcatgagcttgcaaatgagaggacagacagagaagaggaactagcagacttgttgaaagaaagagcagatttagaacgccagaatcaggaacttataaatttaaggtcagaagttgatggaatgtatgatagattagcaactgagaatgaagaggtcatggctgatcagcaaactttggaaaaccagttgtccgacatgaccagcaagcatcaaactgtcaatgaagctaaatcatatcttgaagctgagaaggaagctcttacaatgctaaggacttgggtggaagatgaagcagcacgtgtccatgaacgagctgagacacttgagaaggctttgagaagatggcgaatcccagaagattga

SEQ ID NO: 7740 - protein, 558 aa, Sorghum bicolor
  misc_feature: Ceres ANNOT ID no. 6082776
  misc_feature (11)..(529): NCBI GI: 115468208 NCBI Desc: os06g0499000 [oryza sativa (japonica cultivar-group)]
  misc_feature (142)..(372): NCBI GI: 126658439 NCBI Desc: s-layer region-like protein [cyanothece sp. ccy0110]
  misc_feature (197)..(394): NCBI GI: 113474253 NCBI Desc: s-layer region-like [trichodesmium erythraeum ims101]
  misc_feature (193)..(381): NCBI GI: 119511050 NCBI Desc: s-layer region-like protein [nodularia spumigena ccy9414]
  misc_feature (204)..(372): NCBI GI: 75909391 NCBI Desc: s-layer region-like [anabaena variabilis atcc 29413]
  misc_feature: The sequence is a functional homolog of SEQ ID NO. 459 in the 11/188,298 US application
MAVGPYTLRVSPPPRLDALLFPQLRPHLRCRVSARVAAAGTSWSPAAGDSEDGVGGWWVPEYEKPMKQGRRIGFGRAVVVGLGAPVAIALAGLAWRFPSSRKRIQQLIVAPLHYVQEKMSTMESTETIKEDASDRESDEIEISSATHDKKAEAITDDSRQNYRTETASHFPFGVPTDPVHEEAFSILKKLQIIEKDVSSSDFCTRREFARWFVKLCSKFERKRMQRIVPSKLTSGAVQCAFDDVNIDDPDFLYIQSLGESGIVSSKLSNSLETLTSGSHSKGNSLFLPDSYLSRFDLVNWKVLVEHPFAEIDQKMLSQNVCILDLRACPDVSPSMLIELMAGENSIISRVFGNTRRLQPDKPVTKAQAAAALTSGRMKEAIQEELNRLEAENQAHLSVIAEILEELISRGDIQQQWEEMMKKEQERALKVDNNLQHVLHELANERTDREEELADLLKERADLERQNQELINLRSEVDGMYDRLATENEEVMADQQTLENQLSDMTSKHQTVNEAKSYLEAEKEALTMLRTWVEDEAARVHERAETLEKALRRWRIPED

SEQ ID NO: 7741 - DNA, 483 bp, Sorghum bicolor
  misc_feature: Ceres ANNOT ID no. 6082940
  misc_feature: Encodes the peptide sequence at SEQ ID NO 7742
atgtgcacactaacagctccgttgttacataacagagtctggcatgacactgctgtccctttcaaggaagtgctgcaagagtttgaggactggcttggaaatcacaacctgtggaaaaaggagcaaggtggatcactcaaccgtggagcatttgtcacttgtgggaactgggatttgaagacaaaggtccctgagcagtgcaaggtttcaaaaataaagttacctagctattttatggagtggattaacttaaaggatatctacctcaacttctatagcagaagggcaactggaatgatgacaatgatgagggaacttcaactgccaattattggaaaccaccatctcgggatagacgattcaaaaaatattgcaagagtggttcagcgcatgattgctgatggtgctgtgattgaaatcactgctaagaggcagtcaactacaggcaacgtgaaatttctgttcaaggaccgaattaggtga

SEQ ID NO: 7742 - protein, 160 aa, Sorghum bicolor
  misc_feature: Ceres ANNOT ID no. 6082940
  misc_feature (13)..(160): NCBI GI: 115467982 NCBI Desc: os06g0353400 [oryza sativa (japonica cultivar-group)]
  misc_feature (11)..(159): NCBI GI: 140056141 NCBI Desc: polynucleotidyl transferase, ribonuclease h fold [medicago truncatula]
  misc_feature (11)..(160): NCBI GI: 19310525 NCBI Desc: at3g15140/f4b12_5 [arabidopsis thaliana]
  misc_feature (16)..(143): NCBI GI: 119585972 NCBI Desc: three prime histone mrna exonuclease 1, isoform cra_a [homo sapiens]
  misc_feature (16)..(143): NCBI GI: 119585973 NCBI Desc: three prime histone mrna exonuclease 1, isoform cra_b [homo sapiens]
MCTLTAPLLHNRVWHDTAVPFKEVLQEFEDWLGNHNLWKKEQGGSLNRGAFVTCGNWDLKTKVPEQCKVSKIKLPSYFMEWINLKDIYLNFYSRRATGMMTMMRELQLPIIGNHHLGIDDSKNIARVVQRMIADGAVIEITAKRQSTTGNVKFLFKDRIR

SEQ ID NO: 7743 - DNA, 960 bp, Sorghum bicolor
  misc_feature: Ceres ANNOT ID no. 6082949
  misc_feature: Encodes the peptide sequence at SEQ ID NO 7744
atgggcgcagatggcgggctgaaccgggcggcggagaagccccgggatggggagggcggggaagcgagggtgttccggtgcacggactactcgctgccgcggacgacgctggcgctgacgctctggctgggcggcatccacttcaacgtccttcttgttcttgcgtcgctcttcctcctctcccgccgcgccgctgccatagtggtggcgttccagctcttcttcatgttcgcgcccgtcaacgacagggacaaatggggccggagcgtcgccagacacgcaatgggctacttccctatcagtctgcatgtggaggactacaagtccttcgatcccagcagggcttacgtgtttggttatgagccgcactcagtgctgccgataggtctgtcagctcttgctgatcttgttgggtttatgcctctcactaagatcaagatccttgcgagcagtgcgatttggacgtggcttggattggtacctgcgacaaggaagaatttctactactaccttggagctggttatagttgtatggtagtccctggtggtgtacgggaaatgcttcacatgaacaatgattcagaggttgcatttcttaaaacaagaaaagggtttgtcaagatagctatgcagtccggatgccctttagtcccagttttctgctttgggcagagctatgcatacaagtggtggcggccaggtggcaaattgtttatcaagattgctagagcagttaaatttactcctattatcttctggggtagatttggcacaccattccccttcccaagacccatgcatgtggtcgtgggtaaacctattgaagtcaataagaatccccagcccacgattgatgagattaatgaagtgcatgaacagttcatcattgccctgcgggacctgtttgagaagtataaggggaaagctggatatcctggccttcatctaagagtcctatga

SEQ ID NO: 7744 - protein, 319 aa, Sorghum bicolor
  misc_feature: Ceres ANNOT ID no. 6082949
  misc_feature (57)..(317): Pfam Id: DAGAT Pfam Desc: Diacylglycerol acyltransferase
  misc_feature (34)..(318): NCBI GI: 86279638 NCBI Desc: type 2 diacylglycerol acyltransferase [vernicia fordii]
  misc_feature (37)..(319): NCBI GI: 62825813 NCBI Desc: diacylglycerol acyltransferase [ricinus communis]
  misc_feature (76)..(205): NCBI GI: 140066983 NCBI Desc: diacylglycerol acyltransferase [medicago truncatula]
  misc_feature (21)..(319): NCBI GI: 37183394 NCBI Desc: mono- or diacylglycerol acyltransferase [spirodela polyrrhiza]
  misc_feature (118)..(319): NCBI GI: 140066981 NCBI Desc: diacylglycerol acyltransferase [medicago truncatula]
MGADGGLNRAAEKPRDGEGGEARVFRCTDYSLPRTTLALTLWLGGIHFNVLLVLASLFLLSRRAAAIVVAFQLFFMFAPVNDRDKWGRSVARHAMGYFPISLHVEDYKSFDPSRAYVFGYEPHSVLPIGLSALADLVGFMPLTKIKILASSAIWTWLGLVPATRKNFYYYLGAGYSCMVVPGGVREMLHMNNDSEVAFLKTRKGFVKIAMQSGCPLVPVFCFGQSYAYKWWRPGGKLFIKIARAVKFTPIIFWGRFGTPFPFPRPMHVVVGKPIEVNKNPQPTIDEINEVHEQFIIALRDLFEKYKGKAGYPGLHLRVL

SEQ ID NO: 7745 - DNA, 1842 bp, Sorghum bicolor
  misc_feature: Ceres ANNOT ID no. 6082964
  misc_feature: Encodes the peptide sequence at SEQ ID NO 7746
atgggcagcgtggcgatggactccgactacggcgcgccgcgcgagctgtcgccgctccagaaggcgcgcgcgctctaccgaccggaacccccgccgtgcctccagggcaccacagtcacggtggagtacggagatgctgcaatcgcggccgataatgatgctcacgtcatcagccacgccttcccccacacctatggccagccgctggcgcacttcctcggcaagacggccaatgtgcccgacgctagcatcataacagagcatcctgtagtaagggttggcattgtcttcagtgggaggcaatccccaggagggcacaatgttatatggggcctctatgatgctataaaggctcataactcaaacagcaaaattattggttttctaggaggaactgatggattattcgcacagaaaactatggaaatcaccgatgaagctctttcatcctataaaaatcaaggtggttatgacatgcttggtcggacaagggatcagatcagaacaactgagcaggtaaaggcagcaatggctacttgccaggcattgaagctggatgctcttgttataattggaggtgtcacatccaacactgatgctgctcagcttgctgagacatttgctgagttcaaatgtccaacaaaggtagttggtgttcctgtaactctgaatggagatctcaagaaccaatttgttgaaacaacagttggttttgataccatatgcaaggtgaactcgcagttaataagcaatgtatgcacagatgctctttctgctgaaaagtattactattttattcggctgatgggacggaaagcttctcatgtggcattggaatgtgctcttcaatcacatccaaatatggttatcctaggcgaggaggttgctgcgtcaaaacttacaatatttgatattacaaaacagatatgtgatgatgtgcaggcaagagctcaaaaagacaaatatcatggagttgtacttattcctgagggtcttgttgagagtattcccgaactgtatgctttgctccaggaaattcatggactacataataaaggtgtttccgttgagaacatctcttctcatctttcaccttgggcatctgcactatttcaatttttgcctccattcattagaaatcagctgcttcttcatcctgaatctgacgattcagctcaactctctcagattgagattgagaagcttctagcacaattggttgagaatgaaatgaacaaacgcctgaaggaaggcacttataatggaaagaagttcaatgctatttgtcacttttttggataccaggccaggggtgccctgccttctaaatttgactgtgattatggctacgttcttggacatgtatgttatcacatcatagcagctggtttgaacggctacatggccactgtgaccaaccttaagagtccagtaaacaagtggaaatgtggtgctgctcccattacttctatgatgaccgtgaagagatggtcacgtggtcctgccacgagtcaaattggtaagcctgctgtccacatggcgagtgttgacttgaaaggaaaagcatacgaactgttgagacaaaactcttccagcttcatgatggaagacatctacagaaaccctgggccacttcagttcgaagggccgggtgctgatacaaagccaatttcattgtgcgttgaagatcgggactacatggggaagaatcaagtgaaaagcattgtgaagcccgggtgctcgcaggatgtccttaaagcagcgctaagtgccatggcttctgtgacggaaatgctgaccatcctgtcttccccgtcttttagtagccaggcgaccatctga

SEQ ID NO: 7746 - protein, 613 aa, Sorghum bicolor
  misc_feature: Ceres ANNOT ID no. 6082964
  misc_feature (92)..(372): Pfam Id: PFK Pfam Desc: Phosphofructokinase
  misc_feature (1)..(613): NCBI GI: 115467858 NCBI Desc: os06g0326400 [oryza sativa (japonica cultivar-group)]
  misc_feature (6)..(610): NCBI GI: 483547 NCBI Desc: pyrophosphate-dependent phosphofructokinase alpha subunit [ricinus communis]
  misc_feature (6)..(604): NCBI GI: 3790102 NCBI Desc: pyrophosphate-dependent phosphofructokinase alpha subunit [citrus x paradisi]
  misc_feature (6)..(606): NCBI GI: 169538 NCBI Desc: pyrophosphate-fructose 6-phosphate 1-phosphotransferase alpha-subunit
  misc_feature (6)..(604): NCBI GI: 30725422 NCBI Desc: at1g20950 [arabidopsis thaliana]
  misc_feature (6)..(610): SWISSPROT Homolog: EC 2.7.1.90 Pyrophosphate--fructose 6-phosphate 1-phosphotransferase alpha subunit
MGSVAMDSDYGAPRELSPLQKARALYRPEPPPCLQGTTVTVEYGDAAIAADNDAHVISHAFPHTYGQPLAHFLGKTANVPDASIITEHPVVRVGIVFSGRQSPGGHNVIWGLYDAIKAHNSNSKIIGFLGGTDGLFAQKTMEITDEALSSYKNQGGYDMLGRTRDQIRTTEQVKAAMATCQALKLDALVIIGGVTSNTDAAQLAETFAEFKCPTKVVGVPVTLNGDLKNQFVETTVGFDTICKVNSQLISNVCTDALSAEKYYYFIRLMGRKASHVALECALQSHPNMVILGEEVAASKLTIFDITKQICDDVQARAQKDKYHGVVLIPEGLVESIPELYALLQEIHGLHNKGVSVENISSHLSPWASALFQFLPPFIRNQLLLHPESDDSAQLSQIEIEKLLAQLVENEMNKRLKEGTYNGKKFNAICHFFGYQARGALPSKFDCDYGYVLGHVCYHIIAAGLNGYMATVTNLKSPVNKWKCGAAPITSMMTVKRWSRGPATSQIGKPAVHMASVDLKGKAYELLRQNSSSFMMEDIYRNPGPLQFEGPGADTKPISLCVEDRDYMGKNQVKSIVKPGCSQDVLKAALSAMASVTEMLTILSSPSFSSQATI

SEQ ID NO: 7747 - DNA, 1077 bp, Sorghum bicolor
  misc_feature: Ceres ANNOT ID no. 6082980
  misc_feature: Encodes the peptide sequence at SEQ ID NO 7748
atggcggcggcgagtgaagcggcgtatggcggaggcgtgcagaaggggtccctgcagcagcaccaggcgccgcagcctagccccggctcggtcttctacacccctgacggcatcgccgtctacgcgaaaccggccatcccgccgttctaccaacagtccgcgggcagcaatgccatcgtgccggcggctccggggctagctcattcctccgccacttctgagcccttcaagcgcaagcgcgggcgcccgcgcaagtacggccccgcggacggcgccgtgcccctggctatcgtgcccccgtcgcagccacccactgctgctgccccagctgcctctgaggcgtcacccacgattcctcctggcttcgctccaagcccgcagggtggtggcgtggtgagtccccaggcctcaccggcgccgcagccgccggcggcgtcaggtgctcccgctgtcaagaagcggggccggccgccgggcccctccagcaagaagcaacagccgcaggcggcagcgcctgcaggaccaggctgggctggatggaagcctcatattttcacagtccaagctggagaggatgtagcatcaagagtcatgtcattttctgggaatggatgggcagtttgtatcctcacagccaatggcgctgtatctaatgtgaccctgcgtcaaggagagtcttctggtggaacagtaacttatgagggccgttttgagattctctctttggctgggtcatatcttctgtcagaaagtgctggcatgagcagtcgaacaggtggacttagtgtttctcttgctggtcctgatgggcgtgttttaggtggtgctgtagcaggacctctaactgcagcttcgccagttcaggtggtcattgggagctttctggctgatacaaaaatggagcttgaccctggatcagcacccgaaaaacatgcttttggaagatttccaactgccagcagtccatctaggggtactgaatccttgggtgggcatgcaagcccaccaaacaccacaggctccttcagcaccagcacacagccaccaggcttcccaagcttccccccgtggaaatga

SEQ ID NO: 7748 - protein, 358 aa, Sorghum bicolor
  misc_feature: Ceres ANNOT ID no. 6082980
  misc_feature (143)..(349): NCBI GI: 20196849 NCBI Desc: at-hook dna-binding protein (ahp1) [arabidopsis thaliana]
  misc_feature (143)..(349): NCBI GI: 14326504 NCBI Desc: at2g33620/f4p9.39 [arabidopsis thaliana]
  misc_feature (143)..(349): NCBI GI: 2598227 NCBI Desc: at-hook protein 1 [arabidopsis thaliana]
  misc_feature (104)..(358): NCBI GI: 119657406 NCBI Desc: tpa: at-hook motif nuclear localized protein 2 [oryza sativa (japonica cultivar-group)]
  misc_feature (117)..(358): NCBI GI: 115477244 NCBI Desc: os08g0512400 [oryza sativa (japonica cultivar-group)]
  misc_feature: The sequence is a functional homolog of SEQ ID NO 10 in the 10/225,066US patent application
  misc_feature: The sequence is a functional homolog of SEQ ID NO 10 in the 10/669,824US patent application
  misc_feature: The sequence is a functional homolog of SEQ ID NO 10 in the 10/870,198US patent application
  misc_feature: The sequence is a functional homolog of SEQ ID NO 1012 in the 10/225,066US patent application
  misc_feature: The sequence is a functional homolog of SEQ ID NO 124 in the 10/374,780US patent application
  misc_feature: The sequence is a functional homolog of SEQ ID NO 136 in the 11/375,241US patent application
  misc_feature: The sequence is a functional homolog of SEQ ID NO 1395 in the 10/374,780US patent application
  misc_feature: The sequence is a functional homolog of SEQ ID NO 1399 in the 10/374,780US patent application
  misc_feature: The sequence is a functional homolog of SEQ ID NO 1400 in the 10/374,780US patent application
  misc_feature: The sequence is a functional homolog of SEQ ID NO 1402 in the 10/374,780US patent application
  misc_feature: The sequence is a functional homolog of SEQ ID NO 1403 in the 10/374,780US patent application
  misc_feature: The sequence is a functional homolog of SEQ ID NO 1404 in the 10/374,780US patent application
  misc_feature: The sequence is a functional homolog of SEQ ID NO 1406 in the 10/374,780US patent application
  misc_feature: The sequence is a functional homolog of SEQ ID NO 1408 in the 10/374,780US patent application
  misc_feature: The sequence is a functional homolog of SEQ ID NO 1410 in the 10/374,780US patent application
  misc_feature: The sequence is a functional homolog of SEQ ID NO 150 in the 10/412,699US patent application
  misc_feature: The sequence is a functional homolog of SEQ ID NO 1507 in the 10/412,699US patent application
  misc_feature: The sequence is a functional homolog of SEQ ID NO 1509 in the 10/412,699US patent application
  misc_feature: The sequence is a functional homolog of SEQ ID NO 1510 in the 10/412,699US patent application
  misc_feature: The sequence is a functional homolog of SEQ ID NO 1873 in the 11/479,226US patent application
  misc_feature: The sequence is a functional homolog of SEQ ID NO 22 in the 10/669,824US patent application
  misc_feature: The sequence is a functional homolog of SEQ ID NO 22 in the 10/870,198US patent application
  misc_feature: The sequence is a functional homolog of SEQ ID NO 26 in the 10/669,824US patent application
  misc_feature: The sequence is a functional homolog of SEQ ID NO 26 in the 10/870,198US patent application
  misc_feature: The sequence is a functional homolog of SEQ ID NO 28 in the 10/669,824US patent application
  misc_feature: The sequence is a functional homolog of SEQ ID NO 28 in the 10/870,198US patent application
  misc_feature: The sequence is a functional homolog of SEQ ID NO 304 in the 10/374,780US patent application
  misc_feature: The sequence is a functional homolog of SEQ ID NO 32 in the 10/669,824US patent application
  misc_feature: The sequence is a functional homolog of SEQ ID NO 32 in the 10/870,198US patent application
  misc_feature: The sequence is a functional homolog of SEQ ID NO 340 in the 11/435,388US patent application
  misc_feature: The sequence is a functional homolog of SEQ ID NO 342 in the 10/714,887US patent application
  misc_feature: The sequence is a functional homolog of SEQ ID NO 344 in the 11/435,388US patent application
  misc_feature: The sequence is a functional homolog of SEQ ID NO 346 in the 10/714,887US patent application
  misc_feature: The sequence is a functional homolog of SEQ ID NO 346 in the 11/435,388US patent application
  misc_feature: The sequence is a functional homolog of SEQ ID NO 348 in the 10/714,887US patent application
  misc_feature: The sequence is a functional homolog of SEQ ID NO 348 in the 11/435,388US patent application
  misc_feature: The sequence is a functional homolog of SEQ ID NO 350 in the 10/714,887US patent application
  misc_feature: The sequence is a functional homolog of SEQ ID NO 350 in the 11/435,388US patent application
  misc_feature: The sequence is a functional homolog of SEQ ID NO 352 in the 10/714,887US patent application
  misc_feature: The sequence is a functional homolog of SEQ ID NO 352 in the 11/435,388US patent application
  misc_feature: The sequence is a functional homolog of SEQ ID NO 354 in the 10/714,887US patent application
  misc_feature: The sequence is a functional homolog of SEQ ID NO 38 in the 10/669,824US patent application
  misc_feature: The sequence is a functional homolog of SEQ ID NO 38 in the 10/870,198US patent application
  misc_feature: The sequence is a functional homolog of SEQ ID NO 64 in the 10/669,824US patent application
  misc_feature: The sequence is a functional homolog of SEQ ID NO 64 in the 10/870,198US patent application
  misc_feature: The sequence is a functional homolog of SEQ ID NO 830 in the 11/435,388US patent application
  misc_feature: The sequence is a functional homolog of SEQ ID NO 838 in the 10/225,066US patent application
  misc_feature: The sequence is a functional homolog of SEQ ID NO 90 in the 10/669,824US patent application
  misc_feature: Useful for making plants with modulated growth and phenotype characteristics
  misc_feature: The sequence is a functional homolog of SEQ ID NO 150 in the 20040045049 US patent application
  misc_feature: The sequence is a functional homolog of SEQ ID NO 1507 in the 20040045049 US patent application
  misc_feature: The sequence is a functional homolog of SEQ ID NO 1509 in the 20040045049 US patent application
  misc_feature: The sequence is a functional homolog of SEQ ID NO 1510 in the 20040045049 US patent application
  misc_feature: The sequence is a functional homolog of SEQ ID NO 26 in the 20040128712 US patent application
  misc_feature: The sequence is a functional homolog of SEQ ID NO 28 in the 20040128712 US patent application
  misc_feature: The sequence is a functional homolog of SEQ ID NO 32 in the 20040128712 US patent application
  misc_feature: The sequence is a functional homolog of SEQ ID NO 38 in the 20040128712 US patent application
  misc_feature: The sequence is a functional homolog of SEQ ID NO 64 in the 20040128712 US patent application
  misc_feature: The sequence is a functional homolog of SEQ ID NO 90 in the 20040128712 US patent application
  misc_feature: The sequence is a functional homolog of SEQ ID NO 10 in the 20050160493 US patent application
  misc_feature: The sequence is a functional homolog of SEQ ID NO 1012 in the 20050160493 US patent application
  misc_feature: The sequence is a functional homolog of SEQ ID NO 1012 in the 10/225,066 US patent application
  misc_feature: The sequence is a functional homolog of SEQ ID NO 124 in the 10/374,780 US patent application
MAAASEAAYGGGVQKGSLQQHQAPQPSPGSVFYTPDGIAVYAKPAIPPFYQQSAGSNAIVPAAPGLAHSSATSEPFKRKRGRPRKYGPADGAVPLAIVPPSQPPTAAAPAASEASPTIPPGFAPSPQGGGVVSPQASPAPQPPAASGAPAVKKRGRPPGPSSKKQQPQAAAPAGPGWAGWKPHIFTVQAGEDVASRVMSFSGNGWAVCILTANGAVSNVTLRQGESSGGTVTYEGRFEILSLAGSYLLSESAGMSSRTGGLSVSLAGPDGRVLGGAVAGPLTAASPVQVVIGSFLADTKMELDPGSAPEKHAFGRFPTASSPSRGTESLGGHASPPNTTGSFSTSTQPPGFPSFPPWK

SEQ ID NO: 7749 - DNA, 282 bp, Sorghum bicolor
  misc_feature: Ceres ANNOT ID no. 6083182
  misc_feature: Encodes the peptide sequence at SEQ ID NO 7750
atgtcataccatgttcaatgggtttgccagcccaatactcatttgcaccctaattgccgtggcagtaagttttcctggcctgagcttgtgggaaagaagggcaaggaagcaagagctattatcctaaaagaaaatccttgtgtcaccaatgtggtttatgcccctcaagatgccgttattactgataactattgctgcaatcgtgttaggctccttatgaattgcgatgctggttgtgactataaaaatgctatagtgttcgatgttccaatagtcgggtga

SEQ ID NO: 7750 - protein, 93 aa, Sorghum bicolor
  misc_feature: Ceres ANNOT ID no. 6083182
  misc_feature (23)..(93): Pfam Id: potato_inhibit Pfam Desc: Potato inhibitor I family
  misc_feature (18)..(93): NCBI GI: 603890 NCBI Desc: pathogenesis-related protein pr-6 type [sambucus nigra]
  misc_feature (19)..(93): NCBI GI: 70779527 NCBI Desc: proteinase inhibitor 1 ppi3b2 [solanum tuberosum]
  misc_feature (19)..(74): NCBI GI: 70779529 NCBI Desc: proteinase inhibitor 1 ppi2c1a [solanum tuberosum]
  misc_feature (19)..(93): NCBI GI: 37359345 NCBI Desc: protease inhibitor [vitis vinifera]
  misc_feature (19)..(74): NCBI GI: 124120 NCBI Desc: wound-induced proteinase inhibitor i precursor
MSYHVQWVCQPNTHLHPNCRGSKFSWPELVGKKGKEARAIILKENPCVTNVVYAPQDAVITDNYCCNRVRLLMNCDAGCDYKNAIVFDVPIVG

SEQ ID NO: 7751 - DNA, 1113 bp, Sorghum bicolor
  misc_feature: Ceres ANNOT ID no. 6083200
  misc_feature: Encodes the peptide sequence at SEQ ID NO 7752
atggcgactaaaaaggttctttgcaagttcttcatgcatggagcttgcttgaaaggagaatactgtgaattctcccacgactggagtgatcaagcaaataatgtttgcacattctaccagaaaggtgcatgctcgtatggtagccgttgcagatatgaccatgtcaaagtttctcgtaaccccacagtgccaccaccaccctcaacgtcaagtgctgcaagacgtgtcacatctaattctcttcaacttttaagttacagtcatgcacctcacacgggacaccaaactgattcaagcaaccaaagacatcagatatctgtggatgtgctggcacattctgccagtaagcctgcatggagaaatgattttcaacatgacattgtttctgatgatggaattgactggtcctctaatcgaaatttgctaaacgaaacatcattgaaacctgcggatctgcctatttgttcttttgctgctgctggtaattgtccttatggggaagggtgccctcaaatgcatggagatctgtgtgcaacctgtggaaaaatgtgcttgcatcctcatcgtcctgatgagagggaggagcatatcaaggtatgtgagaaaaatcacaaacgccttgaagctctgaaacgcagccaagaaatagaatgcagtgtatgtttggatcgtgtgctttcaaagcctactgctgctgaaaggaagttcggactgttatccgaatgtgatcatcctttctgtattgcatgcattagaaattggcgtagcaattctcctgcatctggtatggatgtgaactcagcactgagggcttgtccaatatgtcggaaactttcatactatgtcattccaagtgttctttggtacttctcgaaggaagagaaagaggagatcactgaaagctacaaatccaagctcaagtctattgattgcaagtactttgactttgggactggctcatgcccctttggaacaagttgtttctacaggcatgcctacagagatggccgcttggaagaggttgtactacggcatcttgatgctgatgatggaagtacagtaattgcaaaagacatcaggttatcagacttcctcggtaggatgcatctttag

SEQ ID NO: 7752 - protein, 370 aa, Sorghum bicolor
  misc_feature: Ceres ANNOT ID no. 6083200
  misc_feature (31)..(56): Pfam Id: zf-CCCH Pfam Desc: Zinc finger C-x8-C-x5-C-x3-H type (and similar)
  misc_feature (218)..(275): Pfam Id: zf-C3HC4 Pfam Desc: Zinc finger, C3HC4 type (RING finger)
  misc_feature (3)..(360): NCBI GI: 140058084 NCBI Desc: zinc finger, ccch-type; zinc finger, ring-type [medicago truncatula]
  misc_feature (123)..(336): NCBI GI: 31559542 NCBI Desc: makorin ring-zinc-finger protein [pisum sativum]
  misc_feature (123)..(336): NCBI GI: 37665524 NCBI Desc: makorin ring-zinc-finger protein [pisum sativum]
  misc_feature (151)..(365): NCBI GI: 56709993 NCBI Desc: makorin ring finger protein 2 [takifugu rubripes]
  misc_feature (132)..(365): NCBI GI: 25137477 NCBI Desc: ring finger protein makorin2 [seriola quinqueradiata]
MATKKVLCKFFMHGACLKGEYCEFSHDWSDQANNVCTFYQKGACSYGSRCRYDHVKVSRNPTVPPPPSTSSAARRVTSNSLQLLSYSHAPHTGHQTDSSNQRHQISVDVLAHSASKPAWRNDFQHDIVSDDGIDWSSNRNLLNETSLKPADLPICSFAAAGNCPYGEGCPQMHGDLCATCGKMCLHPHRPDEREEHIKVCEKNHKRLEALKRSQEIECSVCLDRVLSKPTAAERKFGLLSECDHPFCIACIRNWRSNSPASGMDVNSALRACPICRKLSYYVIPSVLWYFSKEEKEEITESYKSKLKSIDCKYFDFGTGSCPFGTSCFYRHAYRDGRLEEVVLRHLDADDGSTVIAKDIRLSDFLGRMHL

SEQ ID NO: 7753 - DNA, 852 bp, Sorghum bicolor
  misc_feature: Ceres ANNOT ID no. 6083216
  misc_feature: Encodes the peptide sequence at SEQ ID NO 7754
atgtcgtcgcacggcccgtgcacggcagccacgtcgtcggcagccgtcggcgctgtcgtcacttgttgctccgccgccaaggacgaggaggagcagcggcagaggctgcaggggacagagaaggagccaagacgcgcggaggaggagtgcagctccgccgcggagcaggagcagcgagtggaggcggtgggccggaagctcagcgaggcgtcgtcgctgtgcgccaccaccaacaccaacggggaggacgacgacgacgacgatgatgaggaggaggaggcgccgcccaaggacatcgacctcggcccgcgactcagtatcaaggagcagctcgacaaggacaaggatgatgagagcctgaggagatggaaggagcagctcctgggcagcctggatttcagcaccgttggagagacgctggagccggacgtgaagatcacgagcttgtccatcctgtcgcccgggcggccggacatggtgctgccgctgccgctgcctgcggagcccaagagcagcagcaaggagccgtggttcacgctcaaggaaggcagcgcctacaggctcaagttcaccttctccgtcgccgacaacatcgtctccggcctccgctacaccaacaccgtctggaaggccggcatcagagtggacaggaccaaggagatgctgggcaccttcagcccccaggcagagccttacacctacctgacgcccgaggagacaacaccgtctgggatctttgcccgcggatcatactctgcaagaacaaagtttgtcgacgacgaccggaagtgctacctggagatgaactacgccttccacatccgccgtgattggccgtcaaccctgacctga

SEQ ID NO: 7754 - protein, 283 aa, Sorghum bicolor
  misc_feature: Ceres ANNOT ID no. 6083216
  misc_feature (67)..(280): Pfam Id: Rho_GDI Pfam Desc: RHO protein GDP dissociation inhibitor
  misc_feature (11)..(279): NCBI GI: 34451570 NCBI Desc: rho gdp dissociation inhibitor 2 [oryza sativa (japonica cultivar-group)]
  misc_feature (82)..(280): NCBI GI: 115448325 NCBI Desc: os02g0719000 [oryza sativa (japonica cultivar-group)]
  misc_feature (37)..(281): NCBI GI: 89473698 NCBI Desc: pollen tube rhogdi2 [nicotiana tabacum]
  misc_feature (87)..(280): NCBI GI: 92895123 NCBI Desc: rho protein gdp dissociation inhibitor [medicago truncatula]
  misc_feature (45)..(278): NCBI GI: 40241237 NCBI Desc: rho gdp dissociation inhibitor 2 [medicago truncatula]
MSSHGPCTAATSSAAVGAVVTCCSAAKDEEEQRQRLQGTEKEPRRAEEECSSAAEQEQRVEAVGRKLSEASSLCATTNTNGEDDDDDDDEEEEAPPKDIDLGPRLSIKEQLDKDKDDESLRRWKEQLLGSLDFSTVGETLEPDVKITSLSILSPGRPDMVLPLPLPAEPKSSSKEPWFTLKEGSAYRLKFTFSVADNIVSGLRYTNTVWKAGIRVDRTKEMLGTFSPQAEPYTYLTPEETTPSGIFARGSYSARTKFVDDDRKCYLEMNYAFHIRRDWPSTLT

SEQ ID NO: 7755 - DNA, 1743 bp, Sorghum bicolor
  misc_feature: Ceres ANNOT ID no. 6083217
  misc_feature: Encodes the peptide sequence at SEQ ID NO 7756
atggactcggaacccgacttcgagctccgaggcctcgacatcgacgtcgaactcgacccggaggaccttcagccgtcggtgcccctcaagaaggtccccggcggcgacctcttcgaagcggcgcgggccggggattgcgatcgcctcgccctcctcctcgaggccggcgccaacgtcaatgcgcgcgaccgctgggactctgtcgcgctctattacgcctgcctggcgggacacgccgaggccgcgcggatgctgctcgaggccggcgccgtctgcgccgagcgcaccttcgacggcgaccgttgccactatgcggccctcaacctgcgcctacgttggctgctcaagtcgttcgaggccaggccgccaccgctcgcgccgctccccgccgcgctgcgggcgacgttccttgcctgccccgccaaccgcaccgctttcctcgagatgctccaggggagcgccggcgccgaatctgccgccctcgccgcggccgccggattcgggccaaaggatgatccatcaagtgcttgccttttccctccagatatcacattttacgtggacagaaagcctgttgaagctcatcgggtcatcctttgtgctcgatctcctttctttgaaaagaagttcaagacagactggaaagacaggaaggaagtgagattttctaaccaaaagttgtattatggcgccttatacagcctcatccatttcttctattctgatagactcgaagtagctgttgatgacatggaaaatttggcgcgtgcatgcaaagtttgcaagtgtgaagagttgcaaaagattttggataaagaagttgtgcatcagaagtatgcggagtacaagtcagcgaaagaactggatctggacaattcacagaaacgattcatcttacaagcacagtccttgcctaaggaagatcgccttccatcagccttgcagcgtattctgcagacttgtctagcaaactcaagagaaggcgattatagtgaggaatcaaatgagatgataaggaactcagaggatgatgatcttgcagatctttatattaaagtaggcgataaggttttccattgtcatcaggtgattttggcctcaaggtcagagtactttagagccaggctttctcgaactgttgatttccttgatggtaactctggatttcaagctgctcagaatgttccacttcttgaggagcatgacttaagtgcagaagcatttgaaaagatgcttgaatacatgtacactgataagctagagcatttggatcctgatcaggctgaagaactatttgacgttgcatcaaggtacctgttgtttccccttaagcgggtcgtagctgatatgctgttgccatatctggagcatgtgtctcctgcagaactgtgccattggttgatgctgtctgacatatatggtgtcatgaaaataagggagtatatcttggatatcattgcttgcaactttgagatgtttgcagacacccgggagttccgggccttgctcttgactcttccaccaccatccggagatgactcactacggacaactcgtcccagtgcacctgggactggaggcaacactgaccaaggcaacattcttgatgatttgcgcgagaagtggctagaagcagagggtgctgagcttgacgaaagggatgagagtgcagctctgttcgacaggcgactggagatgcttatgctagttgcagagaaagaagccgatgatgtagacgcttga

SEQ ID NO: 7756 - protein, 580 aa, Sorghum bicolor
  misc_feature: Ceres ANNOT ID no. 6083217
  misc_feature (170)..(278): Pfam Id: BTB Pfam Desc: BTB/POZ domain
  misc_feature (337)..(455): Pfam Id: BTB Pfam Desc: BTB/POZ domain
  misc_feature (15)..(580): NCBI GI: 42568941 NCBI Desc: ankyrin repeat family protein [arabidopsis thaliana]
  misc_feature (182)..(499): NCBI GI: 13384866 NCBI Desc: ankyrin repeat and btb (poz) domain containing 1 [mus musculus]
  misc_feature (182)..(499): NCBI GI: 53733849 NCBI Desc: ankyrin repeat and btb (poz) domain containing 1 [rattus norvegicus]
  misc_feature (182)..(499): NCBI GI: 14149110 NCBI Desc: bpoz [mus musculus]
  misc_feature (182)..(459): NCBI GI: 47937608 NCBI Desc: mgc80260 protein [xenopus laevis]
MDSEPDFELRGLDIDVELDPEDLQPSVPLKKVPGGDLFEAARAGDCDRLALLLEAGANVNARDRWDSVALYYACLAGHAEAARMLLEAGAVCAERTFDGDRCHYAALNLRLRWLLKSFEARPPPLAPLPAALRATFLACPANRTAFLEMLQGSAGAESAALAAAAGFGPKDDPSSACLFPPDITFYVDRKPVEAHRVILCARSPFFEKKFKTDWKDRKEVRFSNQKLYYGALYSLIHFFYSDRLEVAVDDMENLARACKVCKCEELQKILDKEVVHQKYAEYKSAKELDLDNSQKRFILQAQSLPKEDRLPSALQRILQTCLANSREGDYSEESNEMIRNSEDDDLADLYIKVGDKVFHCHQVILASRSEYFRARLSRTVDFLDGNSGFQAAQNVPLLEEHDLSAEAFEKMLEYMYTDKLEHLDPDQAEELFDVASRYLLFPLKRVVADMLLPYLEHVSPAELCHWLMLSDIYGVMKIREYILDIIACNFEMFADTREFRALLLTLPPPSGDDSLRTTRPSAPGTGGNTDQGNILDDLREKWLEAEGAELDERDESAALFDRRLEMLMLVAEKEADDVDA

SEQ ID NO: 7757 - DNA, 993 bp, Sorghum bicolor
  misc_feature: Ceres ANNOT ID no. 6083285
  misc_feature: Encodes the peptide sequence at SEQ ID NO 7758
atgaaccctgttgtagaggaggctgtcactgacttgatgaagaaattcagcaatgccagcggtagcatggtgatagctgacctgggctgcggctctggccccaacgccatagcccttgcctcaatggctgtggatgctatttttcgccaccgtggccatgacgagcaggtgccaccggagctatgcgtactcctgaacgatcttccagacaatgacttcagcagtgttgcaaagcacttggttgcattccaagaggatgccccaagcttcggccctgttttaactgctattgttcctggttcattctacaagaggctctttatcggtagctctttgcatctagttcttgcatcgtacagtgtgcattggttgtcggaggcacctgaagatctaagaaagaaccggatccctatgtacgactgcgatgagggtctcaggcaagcaaggcgcccgctggtgctcgaggcttatgctcggcagttcaagaaggatttcacgctgttcttgaacttgagggctcaagagttagtccctgggggccagatggtgatctccttactaggacactgttctagtgacagtacatgccagtcaaatctactatgcgatggtgtagcttttatgctagatgacatggcatcaaagggtatcatcgacagagaaaagctagactcgttctacttacccatgtatggcccttctgataaggagttaagaaaaatcatccaagatgagaactccttcatgatcaacaagatagtggtccatgacgttgttagtgacatggacaaaaaaagctccatcaccccaaagacggtagctctcgcaactagagctgcgtacggaccaatagtcgcgcagcacttcgggtcgcaaggacaagtgctggaagagtttgagagaaccgtcgagttgcacgtgagtgcaggcagcccgaaggctgttgcaccgggctttcttatcctatgtgtgtctctcaaaaagaaggtataa

SEQ ID NO: 7758 - protein, 330 aa, Sorghum bicolor
  misc_feature: Ceres ANNOT ID no. 6083285
  misc_feature (5)..(329): Pfam Id: Methyltransf_7 Pfam Desc: SAM dependent carboxyl methyltransferase
  misc_feature (1)..(279): NCBI GI: 115467776 NCBI Desc: os06g0313200 [oryza sativa (japonica cultivar-group)]
  misc_feature (98)..(326): NCBI GI: 13676831 NCBI Desc: s-adenosyl-l-methionine:jasmonic acid carboxyl methyltransferase [arabidopsis thaliana]
  misc_feature (98)..(326): NCBI GI: 56748929 NCBI Desc: jasmonate o-methyltransferase (s-adenosyl-l-methionine:jasmonic acid carboxyl methyltransferase)
  misc_feature (98)..(326): NCBI GI: 15223601 NCBI Desc: s-adenosyl-l-methionine:jasmonic acid carboxyl methyltransferase (jmt) [arabidopsis thaliana]
  misc_feature (4)..(303): NCBI GI: 134303368 NCBI Desc: benzoic acid/salicylic acid methyltransferase [schwenckia americana]
MNPVVEEAVTDLMKKFSNASGSMVIADLGCGSGPNAIALASMAVDAIFRHRGHDEQVPPELCVLLNDLPDNDFSSVAKHLVAFQEDAPSFGPVLTAIVPGSFYKRLFIGSSLHLVLASYSVHWLSEAPEDLRKNRIPMYDCDEGLRQARRPLVLEAYARQFKKDFTLFLNLRAQELVPGGQMVISLLGHCSSDSTCQSNLLCDGVAFMLDDMASKGIIDREKLDSFYLPMYGPSDKELRKIIQDENSFMINKIVVHDVVSDMDKKSSITPKTVALATRAAYGPIVAQHFGSQGQVLEEFERTVELHVSAGSPKAVAPGFLILCVSLKKKV

SEQ ID NO: 7759 - DNA, 1086 bp, Sorghum bicolor
  misc_feature: Ceres ANNOT ID no. 6083289
  misc_feature: Encodes the peptide sequence at SEQ ID NO 7760
atggcctctgagcagtctttgcacatgaaccagggagaaggagaaacaagctatgcccggaactctagtattcagaatgctgtgcaaaaatggatgaagcctgttgtagaggaggctgtcactgacttgaagaaatttaccaataccagctgcagcatgttgatagctgacctgggctgctcctctggccccaacgccgtagcgcttgcctcaatggctgtagatgctatttttcgctaccgtgggcttgacgggaaggtcccaccggagctatgggtactcctgaacgatcttccagacaatgacttcggcgatgttgcaaagcgcttggttgcattccaaaaggatgccgccccaaatttcggcggccatgttttgactgctattgtacctggttcattctacaagaggctctttattagtagctccttgcatctagttcttgcatcaaacagtgtgcagtggctgtcagaggcacctgaagatctaagaaagaatgggatccctatgtacgactgcgatgagggtctaaggcaagcaaggcgctcactggtgctgcaggcttatgctcggcagttcaggaaggatttcacgctattcttgaacttgagggctcaagagttagtccctgggggccagatggtgatctccttgccaggccactgttccaatgacagtgcatgccagtcaaatctacgatgcgatggtacagcttttatgctaaacgacatggcatcaaggggtgtcatcgacagagaaaagctagactcgttctacttacccatgtatgacccttctgatcaggagttaagagaaatcatccaagatgagggctccttcatgatcaacaagatactggtccatgatgtcattagtgacatggacaaaatctccatcaccccaaagatggtagctctcacagttagagctgcgttcgaaccaataatcgcgcaacacttcgggtcgcagggacaagtgatggaagagtttgagagaaccgtcgagtggcacgttggtgcaggtgcaggcagaccgcaggtttttgcttcggccttcctatgtgtgtctctcaaaaagaaagtataa

SEQ ID NO: 7760 - protein, 361 aa, Sorghum bicolor
  misc_feature: Ceres ANNOT ID no. 6083289
  misc_feature (36)..(360): Pfam Id: Methyltransf_7 Pfam Desc: SAM dependent carboxyl methyltransferase
  misc_feature (3)..(318): NCBI GI: 115467776 NCBI Desc: os06g0313200 [oryza sativa (japonica cultivar-group)]
  misc_feature (7)..(361): NCBI GI: 13235641 NCBI Desc: s-adenosyl-l-methionine:salicylic acid carboxyl methyltransferase [stephanotis floribunda]
  misc_feature (7)..(332): NCBI GI: 68146505 NCBI Desc: s-adenosyl-l-methionine:salicylic acid carboxyl methyltransferase [hoya carnosa]
  misc_feature (7)..(334): NCBI GI: 28629495 NCBI Desc: s-adenosyl-l-methionine:benzoic acid/salicylic acid carboxyl methyltransferase [petunia x hybrida]
  misc_feature (7)..(334): NCBI GI: 28629497 NCBI Desc: s-adenosyl-l-methionine:benzoic acid/salicylic acid carboxyl methyltransferase [petunia x hybrida]
MASEQSLHMNQGEGETSYARNSSIQNAVQKWMKPVVEEAVTDLKKFTNTSCSMLIADLGCSSGPNAVALASMAVDAIFRYRGLDGKVPPELWVLLNDLPDNDFGDVAKRLVAFQKDAAPNFGGHVLTAIVPGSFYKRLFISSSLHLVLASNSVQWLSEAPEDLRKNGIPMYDCDEGLRQARRSLVLQAYARQFRKDFTLFLNLRAQELVPGGQMVISLPGHCSNDSACQSNLRCDGTAFMLNDMASRGVIDREKLDSFYLPMYDPSDQELREIIQDEGSFMINKILVHDVISDMDKISITPKMVALTVRAAFEPIIAQHFGSQGQVMEEFERTVEWHVGAGAGRPQVFASAFLCVSLKKKV

SEQ ID NO: 7761 - DNA, 1461 bp, Sorghum bicolor
  misc_feature: Ceres ANNOT ID no. 6083291
  misc_feature: Encodes the peptide sequence at SEQ ID NO 7762
atgattcgtctctgtcccctcctcctcctcctcaccgccgccgccgcggcgttcgccagcggcgccgacgaggcgcacgtctccatcgcggtcgcggagaagggcctggccttcgccaaggacgtgcttatcggcgaggccgtgcggtcgctgaccccgctccgcctccccggggtggagaaggctgtccgcgtgcccttcctcggcggcgtccgcgtcgccgcctccaacatcacgctcttccacctagacgtcggtgacaactccactatcttccccggggactcgggccttctcgtcgtcgcctccggcatcaccgccaacatcagtatgcactggagctactgctacgattcgtggttgtttcctatagagatcgccgacagcggaaccgcctcgatcctggttcaaggaatggaagttgggataaccatggttataaagaacaacaatgggagtttggctctgtctgcttcgcagtgtggttgttatgtgaaggacctagtgatatccctggatggtggagcatcttggttttatcaagggtttataaatgcttttgaagatcatattaaagctgcagttgagaaagcaatacctgaaaatatcattgaaggtgctgggacactggactcctttctgcaaggtctccccaggaccatcagtctggatgacgttgctgccttcaacatgactttcattaatgatccacactatggcaattcttcaattgagttcgatatcaatggattggttacttcagcagttgctaagacaaccaatctgcagaaacatccacagctttctttggcttgtggtggtgcatcaaaaatgcttttgctttcacttgatgaagatgtattgaattcagcactagaagttcattttaaggctggttcaatgcattgggttgttgacaaagtccctgatcagtctctactgaacacagctaattggaaatttatcattcctcgtttatactggaattacccaaatgatgatatgctgctaaatatttcaatggcctcatccccggtgataaggattacatcagaaaaaattgaagctaccattaacgcagatatggtaattgatgttgtagatggcaaggagatagttccagttgcatgcatctcagtgattgtcagcacttcaggtgttgtggatgcatcaggcaataaagtatatggtagagttggattagataatttctcccttgcgttgaagtggagtagaattgggaacttccatatgtctttgattcagggagtgattcgcgttttcctgaacacagtgtgcatgccctatttgaactcccggcttgggaatggatttatcttgcccgtggtccatggtttcacacttcaagacgtctacgttttaacctctgctgagcagctgacgctttgttctgatgtcaccttcaatgcaagcagcttggcgagtttatcacttttgtga

SEQ ID NO: 7762 - protein, 486 aa, Sorghum bicolor
  misc_feature: Ceres ANNOT ID no. 6083291
  misc_feature (35)..(217): Pfam Id: LBP_BPI_CETP Pfam Desc: LBP / BPI / CETP family, N-terminal domain
  misc_feature (242)..(475): Pfam Id: LBP_BPI_CETP_C Pfam Desc: LBP / BPI / CETP family, C-terminal domain
  misc_feature (139)..(486): NCBI GI: 115467760 NCBI Desc: os06g0309200 [oryza sativa (japonica cultivar-group)]
  misc_feature (139)..(479): NCBI GI: 30679067 NCBI Desc: lipid-binding serum glycoprotein family protein [arabidopsis thaliana]
  misc_feature (1)..(473): NCBI GI: 30685701 NCBI Desc: lipid-binding serum glycoprotein family protein [arabidopsis thaliana]
  misc_feature (16)..(469): NCBI GI: 49256522 NCBI Desc: mgc84153 protein [xenopus laevis]
  misc_feature (8)..(457): NCBI GI: 31321940 NCBI Desc: bactericidal permeability increasing protein/lipopolysaccharide binding protein variant b [gadus morhua]
MIRLCPLLLLLTAAAAAFASGADEAHVSIAVAEKGLAFAKDVLIGEAVRSLTPLRLPGVEKAVRVPFLGGVRVAASNITLFHLDVGDNSTIFPGDSGLLVVASGITANISMHWSYCYDSWLFPIEIADSGTASILVQGMEVGITMVIKNNNGSLALSASQCGCYVKDLVISLDGGASWFYQGFINAFEDHIKAAVEKAIPENIIEGAGTLDSFLQGLPRTISLDDVAAFNMTFINDPHYGNSSIEFDINGLVTSAVAKTTNLQKHPQLSLACGGASKMLLLSLDEDVLNSALEVHFKAGSMHWVVDKVPDQSLLNTANWKFIIPRLYWNYPNDDMLLNISMASSPVIRITSEKIEATINADMVIDVVDGKEIVPVACISVIVSTSGVVDASGNKVYGRVGLDNFSLALKWSRIGNFHMSLIQGVIRVFLNTVCMPYLNSRLGNGFILPVVHGFTLQDVYVLTSAEQLTLCSDVTFNASSLASLSLL

SEQ ID NO: 7763 - DNA, 1410 bp, Sorghum bicolor
  misc_feature: Ceres ANNOT ID no. 6083364
  misc_feature: Encodes the peptide sequence at SEQ ID NO 7764
atggcttctcctctgcttctgttggttgtcttgtgtagctactgctgctacatcgctcttggaggcaacgagcatgggtttgccgtggtgcaacgcaggtcttatgattcagaaacagtatgctcagcatccaaagtgaacctggagccgagcagcgccactgtgtcaatgtcactagtgcaccggtacggcccatgcgcgccgtcacagtactctaacgtgccgacgccgtccatctccgagacgctccgccgtagccgcgcccgcacgaactacatcatgagccaagcgtccaagagcatgggcatgggcatggcgagtacaccagacgacgatgatgccgccgtgaccatcccgacccgcctaggcggttttgtggactcgctagagtacgtcgtcacgctgggcttcggcacgccgtccgtgccgcaggtgctcctcatggacaccggcagcgacgtctcgtgggtgcagtgcacgccgtgcaactccaccaagtgctacccgcagaaggatcctctcttcgatccaagcaagtcctccacgtacgctcccatcgcctgcaacaccgacgcgtgccggaagctcggagaccactaccacaacggctgcacgagcggcggcacccagtgcggatactccgtcgagtacgccgacggttcgcattcgaggggcgtgtacagcaacgagacgctgacactcgctccggggatcaccgtcgaggatttccatttcggctgtggccgcgaccagcgcggtcccagcgacaagtacgacggcctcttgggtcttggaggcgccccggtgtcgctcgtcgtgcagacgtcttcggtttacggcggcgccttctcgtactgcctcccggcgctgaacagcgaagccgggttcctagtcctcggctcgccgccgagcggcaacaagtcggccttcgtgttcactccgatgcggcacctgccggggtatgcaacgttttacatggtgacgatgacaggcatcagcgtgggagggaagccgctgcacatcccgcaatcggcgttccgtggtggcatgatcatagactccggcacggtcgacacggagctcccagaaacagcgtacaacgcgctggaggcagcactgcggaaggccttgaaggcgtaccccctggtgccaagcgatgactttgacacctgctacaactttacgggttacagcaatatcaccgtgccgagggtcgcgttcacgttcagtggcggcgccaccatcgacctcgacgtccccaatgggattctggtgaacgactgcctcgccttccaggagtcagggccagacgacggtctcggcatcatcggcaacgtgaatcagcgcactctagaggtgctgtacgatgctggccgtggtaacgtcggattccgagccggtgcatgctga

SEQ ID NO: 7764 - protein, 469 aa, Sorghum bicolor
  misc_feature: Ceres ANNOT ID no. 6083364
  misc_feature (130)..(468): Pfam Id: Asp Pfam Desc: Eukaryotic aspartyl protease
  misc_feature (41)..(469): NCBI GI: 53792202 NCBI Desc: nucleoid dna-binding protein cnd41-like [oryza sativa (japonica cultivar-group)]
  misc_feature (41)..(469): NCBI GI: 115438424 NCBI Desc: os01g0608300 [oryza sativa (japonica cultivar-group)]
  misc_feature (56)..(469): NCBI GI: 24430421 NCBI Desc: 41 kd chloroplast nucleoid dna binding protein (cnd41) [nicotiana sylvestris]
  misc_feature (56)..(469): NCBI GI: 2541876 NCBI Desc: cnd41, chloroplast nucleoid dna binding protein [nicotiana tabacum]
  misc_feature (50)..(469): NCBI GI: 115466080 NCBI Desc: os06g0121800 [oryza sativa (japonica cultivar-group)]
MASPLLLLVVLCSYCCYIALGGNEHGFAVVQRRSYDSETVCSASKVNLEPSSATVSMSLVHRYGPCAPSQYSNVPTPSISETLRRSRARTNYIMSQASKSMGMGMASTPDDDDAAVTIPTRLGGFVDSLEYVVTLGFGTPSVPQVLLMDTGSDVSWVQCTPCNSTKCYPQKDPLFDPSKSSTYAPIACNTDACRKLGDHYHNGCTSGGTQCGYSVEYADGSHSRGVYSNETLTLAPGITVEDFHFGCGRDQRGPSDKYDGLLGLGGAPVSLVVQTSSVYGGAFSYCLPALNSEAGFLVLGSPPSGNKSAFVFTPMRHLPGYATFYMVTMTGISVGGKPLHIPQSAFRGGMIIDSGTVDTELPETAYNALEAALRKALKAYPLVPSDDFDTCYNFTGYSNITVPRVAFTFSGGATIDLDVPNGILVNDCLAFQESGPDDGLGIIGNVNQRTLEVLYDAGRGNVGFRAGAC

SEQ ID NO: 7765 - DNA, 948 bp, Sorghum bicolor
  misc_feature: Ceres ANNOT ID no. 6083514
  misc_feature: Encodes the peptide sequence at SEQ ID NO 7766
atggccaaatcatcatacaccttccttagacctcacatagcagggcccttattgttccaaagaagcttggtcgtctcaccaccaccggtaccccctccccccgtcacaaaggaagcactccctctcctcagcctcctaccttcttcaagccatgactacaaccagcatggtgacaacaatgataaagcagatcaaccacgcaacaagaataatgaagaggaggctatggaggatacagaaacaatcaagctccgaattggtccaccatctccaaactgtgattcccccctcgatctcgcaactgtcgtcgccggtgctggcgatagcaaggcggcagaagaaggcgaagaagagcttggatcacaggccgggggcactgctaccggcgatgatggctgctcggagtacttcaccataggggagaagaaactcacaaacgggaagtattggatccctacagcagctcagatcatgtttggccccatgctctttgcctgccctgtgtgctgcaagacattcagcagatacaacaacctgcagatgcacatgtgggggcacgggtcgcagtaccgccgcggcccagactcgctccgtggcacgcagccggcggcgatgctccggctgccgtgcttctgttgcgcgcctgggtgccggaaccacgtggaccacccgcgggcgcggccgctcaaggacttccgtaccctgcagacgcactaccggcgcaggcattgcgcaaggcctttcctctgccgccggtgcggcaaggccctcgccgtgcgcggggactggcgcacgcacgagaagaactgcggccgccggtggcgctgcgcctgcggctccgacttcaagcacaagcgctcgctcaaggaccacgtccgcgcgttcggccgcggccacgtcgaggaccatcccgccgttatcgtcggccaaaccaaacccacggtgtag

SEQ ID NO: 7766 - protein, 315 aa, Sorghum bicolor
  misc_feature: Ceres ANNOT ID no. 6083514
  misc_feature (31)..(299): NCBI GI: 92897606 NCBI Desc: zinc finger, c2h2-type [medicago truncatula]
  misc_feature (7)..(300): NCBI GI: 9294415 NCBI Desc: zinc finger-like protein [arabidopsis thaliana]
  misc_feature (7)..(300): NCBI GI: 18376500 NCBI Desc: wip4 protein [arabidopsis thaliana]
  misc_feature (47)..(299): NCBI GI: 59958298 NCBI Desc: at3g57670 [arabidopsis thaliana]
  misc_feature (31)..(300): NCBI GI: 18376498 NCBI Desc: wip5 protein [arabidopsis thaliana]
  misc_feature: The sequence is a functional homolog of SEQ ID NO 1074 in the 10/666,642US patent application
  misc_feature: The sequence is a functional homolog of SEQ ID NO 1075 in the 10/666,642US patent application
  misc_feature: The sequence is a functional homolog of SEQ ID NO 1076 in the 10/666,642US patent application
  misc_feature: The sequence is a functional homolog of SEQ ID NO 1077 in the 10/666,642US patent application
  misc_feature: The sequence is a functional homolog of SEQ ID NO 1078 in the 10/666,642US patent application
  misc_feature: The sequence is a functional homolog of SEQ ID NO 1079 in the 10/666,642US patent application
  misc_feature: The sequence is a functional homolog of SEQ ID NO 1086 in the 10/666,642US patent application
  misc_feature: The sequence is a functional homolog of SEQ ID NO 1087 in the 10/666,642US patent application
  misc_feature: The sequence is a functional homolog of SEQ ID NO 1490 in the 10/666,642US patent application
  misc_feature: The sequence is a functional homolog of SEQ ID NO 1781 in the 11/479,226US patent application
  misc_feature: The sequence is a functional homolog of SEQ ID NO 1785 in the 10/374,780US patent application
  misc_feature: The sequence is a functional homolog of SEQ ID NO 270 in the 10/374,780US patent application
  misc_feature: The sequence is a functional homolog of SEQ ID NO 2792 in the 10/374,780US patent application
  misc_feature: The sequence is a functional homolog of SEQ ID NO 4 in the 10/225,066US patent application
  misc_feature: The sequence is a functional homolog of SEQ ID NO 432 in the 10/225,066US patent application
  misc_feature: Useful for making plants with modulated growth and phenotype characteristics
  misc_feature: The sequence is a functional homolog of SEQ ID NO 4 in the 20050160493 US patent application
  misc_feature: The sequence is a functional homolog of SEQ ID NO 432 in the 20050160493 US patent application
  misc_feature: The sequence is a functional homolog of SEQ ID NO 1785 in the 20060162006 US patent application
  misc_feature: The sequence is a functional homolog of SEQ ID NO 1074 in the 20070033671 US patent application
  misc_feature: The sequence is a functional homolog of SEQ ID NO 1075 in the 20070033671 US patent application
  misc_feature: The sequence is a functional homolog of SEQ ID NO 1076 in the 20070033671 US patent application
  misc_feature: The sequence is a functional homolog of SEQ ID NO 1078 in the 20070033671 US patent application
  misc_feature: The sequence is a functional homolog of SEQ ID NO 1079 in the 20070033671 US patent application
  misc_feature: The sequence is a functional homolog of SEQ ID NO 1086 in the 20070033671 US patent application
  misc_feature: The sequence is a functional homolog of SEQ ID NO 1087 in the 20070033671 US patent application
  misc_feature: The sequence is a functional homolog of SEQ ID NO 1076 in the 10/666,642 US patent application
  misc_feature: The sequence is a functional homolog of SEQ ID NO 1075 in the 10/666,642 US patent application
  misc_feature: The sequence is a functional homolog of SEQ ID NO 1077 in the 10/666,642 US patent application
  misc_feature: The sequence is a functional homolog of SEQ ID NO 1078 in the 10/666,642 US patent application
  misc_feature: The sequence is a functional homolog of SEQ ID NO 1490 in the 10/666,642 US patent application
  misc_feature: The sequence is a functional homolog of SEQ ID NO 2792 in the 10/374,780 US patent application
  misc_feature: The sequence is a functional homolog of SEQ ID NO 432 in the 10/225,066 US patent application
  misc_feature: The sequence is a functional homolog of SEQ ID NO 306 in the 10/666,642 US patent application
  misc_feature: The sequence is a functional homolog of SEQ ID NO 1074 in the 10/666,642 US patent application
  misc_feature: The sequence is a functional homolog of SEQ ID NO 1079 in the 10/666,642 US patent application
  misc_feature: The sequence is a functional homolog of SEQ ID NO 630 in the 10/666,642 US patent application
  misc_feature: The sequence is a functional homolog of SEQ ID NO. 455 in the 11/188,298 US application
MAKSSYTFLRPHIAGPLLFQRSLVVSPPPVPPPPVTKEALPLLSLLPSSSHDYNQHGDNNDKADQPRNKNNEEEAMEDTETIKLRIGPPSPNCDSPLDLATVVAGAGDSKAAEEGEEELGSQAGGTATGDDGCSEYFTIGEKKLTNGKYWIPTAAQIMFGPMLFACPVCCKTFSRYNNLQMHMWGHGSQYRRGPDSLRGTQPAAMLRLPCFCCAPGCRNHVDHPRARPLKDFRTLQTHYRRRHCARPFLCRRCGKALAVRGDWRTHEKNCGRRWRCACGSDFKHKRSLKDHVRAFGRGHVEDHPAVIVGQTKPTV

SEQ ID NO: 7767 - DNA, 5223 bp, Sorghum bicolor
  misc_feature: Ceres ANNOT ID no. 6083590
  misc_feature: Encodes the peptide sequence at SEQ ID NO 7768
atggcgggggagctggggcagcagacggtggagctgggcgcggtggtgcggcgtgcggcggaggagtcgtatctcgcgctgcgggagctcgtggagaagtcgcaggcggaggccgaggggaagggcctcggcgctggagccaatggcggctggcagcggtccgacaccgagaagaagatcgacttgctcaagttcatcacacgcacacgccagcgcatgcttcgcctccacgtccttgccaagtggtgtcagcaggttcctttggtccattattgtcaacagctcggatcaactctccacagtcatgagacatgcttcacccaaacagccgactcgctgttttatatgcacgagtgcttgcagcaggctcgggctcctatgttcgatgttccttctgctattgaagtcatgcttacagggggttatcagaggctgccaagatgcatagaagagataggaagtcaaaataaactttccccagatgaagaaaagtgcgctctgcggaaattagacgctagcgtgcgatacaaagtacttgtgaccccaagacctaaagaagtatctaatgtttcagtaactgatgggatagctgttttccgtgtggatggggaatttaaagttcttcttacattgggttaccgtggtaatgtagacttatggaggatattgcatatggagttactggttggtgagaagaagggtcctattaaactggatcaaagtaggagatttgctcttggtgatgatatagaaagaagaatggcagcttctgagaatccctttgcagtgctatatgctatacttcatgaattctgcatctctcttgctatggacactattattaggcaggctaatgttcttcgacagggaaggtggaaagatgccataagatctgaactcatctctgacagtgctactggacaaactggaaatactcctctaatgcagcttgttcaagatggggaattcgatgcaagtggttttaagatacctggcctgaaagttaattactggctagatgagaaaagcactggcacaacagaacctgattcatctccatttatcaaaattgaggcagggctggacatgcaaataaagtgtcagcacagttcatttatacttgatccatttacagataaagaggcgaacctttctcttgatctaagttgcattgatgttgaacaacttattttgagagcaattgcttgcaataggcacacacgccttcttaatattcagagacaactgtgcaaaaatgtccaaatttctcagtccccaaaagatgttgtcttgacacgagatgttgcagcagcgaaggacccaacgaagaatgcagagaagaagggcttctcagattgttttgggaacgaagtgcttcaagtaagggcatatggtcaggcgtatgttagtcttggaataaatatcaggagtggccgctttctcctccaatcaccggaaaatatattaccccgtgctgcgattatggactgtgaggaagctctaaacaaagggagtacatcagctactgaggttttttcaagcttaaggaccaggagcatcctccacctatttgctgcatctggaagtttttttggccttaaggtctatcagcaatctcagggcactctgaagattcccaagaccatattacatggctcagatttgatggtcatgggatttccacattgtgcaaatgcctattatttgttgatgcaacttgataaggacttcaggcctgtttttcatttgcttgagacacagtgtgatgcaaatgataagactaatgcaaatggagatgcgaaagaagctatcaggtttaacaaaatcaatataggacagatgcaaatacttaaaaatgagacaaatgcaaatccttttgatatgaagctgcaggccctacaaagtttagtggaccctgctgacatgatggagagtgatcttcctgtccagaatggaattgagactcttccactacttcctgcttgttcaccatcattttcatctattgtcgatgaggtttttgaatatgaacgtggttctactgctgcgcaaaatcattctctttcagttgatattcaaggaataaatgctagggttgtctcaccaatgcatgatggaagcttatctcatacccaagctaataatatagcaaaaattcatcctagtggcagtttgaatagctatttcccaagtaattttagatatttacaaggtacaaacacattttcttcaagccctgtaatgtctatgaccaaattgtcaggtgtaaataaatcacttcatcttgtaccttcaagcaataataacagcagccaaatccctgctcaaagctcacattcagggaatcttgggaacgctatgcctggtcatttggttgggtcttcaactataactggaggattagagaagtccatcaccgctggttctgatggtgcatctaggaagcgctctctttcagatttcttgccaagtatcccttcattacgaggactgcaagctagtgagccaagaaagcggagaaaaaaatcagaatcagtgcagaatatcctgcctttgcaggcgcactcctctaatttgcaatcaagagtcagcctcacctatggagatgttcttgcagaaagaaataattgtgttccagcaactatatatgcttctgtgctactacatgtcataagacactgttcattatgcatcaaacatgctcaactaactgctcagatggattcccttgcaattccatatgttgaagaagttggtctgcggacaccatcatcgaatctttggttaagattaccttttgcacaagatgattcttggaagcatatatgcttgcgccttggtaaggctggaagcatgtcttgggatgttaggataaatgatccacatttcagggaactttgggaacttaatggaggaagcaccacaacacaatggggtgttggcattcgcattgcgaatagctcagaaatggattcacatatctcatttgattccaatggtgttgttttaacttacaacactgttgaggcagatagtgtccagaagcttgtgtcagatttacgacgactttcaaatgctcgttcctttgctcgtggaatgaggagactgattggtgtgaaattggatgacaagctagacgacaatcagttatccatggaggttaaatcacaatctgttaataaaggtaacagtgatgctgctgacaagctatctgagcagatgagaaagacattcaggattgaagctgtgggtctaatgagcttgtggtttagttacggcaccatgcctatggtacacatagttgttgaatgggagattgataagggtggttgcacaatgcatgtttctccagatcagctttggccacacacaaagtttctggaggatttcgtgaatggtggagaggtagcatccttcttggattgcattcggcttacagcaggaccattacttgcccttggaggtgcaattcgtcctgcaaggatgcctgttactgtttcatctggatatagctctatgccaaagcagccgaacatcctgacacaagggcctttagcaaatggttcatcttcatcaaccatacatcatgcacctgtcccccaaaatgctgcagctgcccaattaggcagtcataatcttcatgctgctgccatgctttcagccgctggacggggtggacctgggcttgttcccagttcattactgccttttgatgtttcggtcgtacttcgtgggccatactggatacgcattatatatcgcaagaaattctctgttgacatgcgctgctttgctggggatcaggtttggctccagccggctactcctcctaaaggtggaccttcagttggtggatcgttgccatgcccacagttccggcctttcataatggaacatgttgctcagggtctaaatgctcttgaacccaacttcatgaatgctacacaggctagtggacacttaaataacaatgctggagctccacaaactgctcctagtgcaaatcgtttaagtgctacccctggtgtttctatgtcccggccaacttctggtgttgctaaccatgtagcagccagtttgagtcgagcaggaaatgccatgttggcttcttcggctcttgcttctggtattagtggagcttctgtgcgacttactgctggagctggtctccctgttcacatgaaaggggaactaaacacagcttttatagggctgggggatgatggtggatatggtggtggttgggttcctttggcagctctgaaaaaggtgctgagaggaatcctaaagtaccttggagttctatggttgtttgcacaattgcctgaacttttgaaagaaatattaggatcaatcttaaaggacaatgaaggtgctctcttgaatttggatcaagagcagcctgcgctccggttctatgtcggaggatatgtatttgcagtaagtgtccatcgcgttcaactgcttctacaagtcttgagtgtgaaaagatttcaccaccagcaacagcagcagcaagctcagagcaatgctcaggaagagctagcagctgctgaaatcaatgaaatatgtgactactttagcaggcgtgttgcctctgaaccatatgatgcttctagagttgcttcttttatcactttgcttacattgccaatttcggtactgcgtgagtttttaaagctgattacatggaagaaaggtctttccccggtcaacggggacattgctactgctcagagggctcggatcgagctttgtttggagaatcactcaggatcagctgcagctgataacacagagaacagcactttagccaagagtaatattcatcatgatagagcccacagttcagtagaatttgccctgacatttgtacttgaccatgctctcattcctcacatgaatgtagctggtggagctgcctggcttccatattgtgtatctgtgaaacttcgctattcttttggggacaacaatcatatagctttccttgctatgaatgggagccatggtgggagagcctgctggttgcagtttgaggagtgggaaagatgtaagcaaaaggtttcaagagctgtggaaactgtgaatgggtctggtgtagctggagaggtgggccaaggaaggctgcgaatggttgccgagatgatccaaaagcagcttcaactctgtctacaacagctaagagatggcccactttctgcaggctctactgcatcatga

SEQ ID NO: 7768 - protein, 1740 aa, Sorghum bicolor
  misc_feature: Ceres ANNOT ID no. 6083590
  misc_feature (8)..(215): Pfam Id: MED14 Pfam Desc: Mediator complex subunit MED14
  misc_feature (3)..(1740): NCBI GI: 50251645 NCBI Desc: thyroid hormone receptor-associated protein complex component trap170-like protein [oryza sativa (japonica cultivar-group)]
  misc_feature (1)..(435): NCBI GI: 38424028 NCBI Desc: swp1 protein-like [oryza sativa (japonica cultivar-group)]
  misc_feature (1352)..(1740): NCBI GI: 115475950 NCBI Desc: os08g0333000 [oryza sativa (japonica cultivar-group)]
  misc_feature (1371)..(1740): NCBI GI: 38424029 NCBI Desc: swp1 protein-like [oryza sativa (japonica cultivar-group)]
  misc_feature (52)..(299): NCBI GI: 4587087 NCBI Desc: similar to 5'region of human exlm1 gene [mus musculus]
MAGELGQQTVELGAVVRRAAEESYLALRELVEKSQAEAEGKGLGAGANGGWQRSDTEKKIDLLKFITRTRQRMLRLHVLAKWCQQVPLVHYCQQLGSTLHSHETCFTQTADSLFYMHECLQQARAPMFDVPSAIEVMLTGGYQRLPRCIEEIGSQNKLSPDEEKCALRKLDASVRYKVLVTPRPKEVSNVSVTDGIAVFRVDGEFKVLLTLGYRGNVDLWRILHMELLVGEKKGPIKLDQSRRFALGDDIERRMAASENPFAVLYAILHEFCISLAMDTIIRQANVLRQGRWKDAIRSELISDSATGQTGNTPLMQLVQDGEFDASGFKIPGLKVNYWLDEKSTGTTEPDSSPFIKIEAGLDMQIKCQHSSFILDPFTDKEANLSLDLSCIDVEQLILRAIACNRHTRLLNIQRQLCKNVQISQSPKDVVLTRDVAAAKDPTKNAEKKGFSDCFGNEVLQVRAYGQAYVSLGINIRSGRFLLQSPENILPRAAIMDCEEALNKGSTSATEVFSSLRTRSILHLFAASGSFFGLKVYQQSQGTLKIPKTILHGSDLMVMGFPHCANAYYLLMQLDKDFRPVFHLLETQCDANDKTNANGDAKEAIRFNKINIGQMQILKNETNANPFDMKLQALQSLVDPADMMESDLPVQNGIETLPLLPACSPSFSSIVDEVFEYERGSTAAQNHSLSVDIQGINARVVSPMHDGSLSHTQANNIAKIHPSGSLNSYFPSNFRYLQGTNTFSSSPVMSMTKLSGVNKSLHLVPSSNNNSSQIPAQSSHSGNLGNAMPGHLVGSSTITGGLEKSITAGSDGASRKRSLSDFLPSIPSLRGLQASEPRKRRKKSESVQNILPLQAHSSNLQSRVSLTYGDVLAERNNCVPATIYASVLLHVIRHCSLCIKHAQLTAQMDSLAIPYVEEVGLRTPSSNLWLRLPFAQDDSWKHICLRLGKAGSMSWDVRINDPHFRELWELNGGSTTTQWGVGIRIANSSEMDSHISFDSNGVVLTYNTVEADSVQKLVSDLRRLSNARSFARGMRRLIGVKLDDKLDDNQLSMEVKSQSVNKGNSDAADKLSEQMRKTFRIEAVGLMSLWFSYGTMPMVHIVVEWEIDKGGCTMHVSPDQLWPHTKFLEDFVNGGEVASFLDCIRLTAGPLLALGGAIRPARMPVTVSSGYSSMPKQPNILTQGPLANGSSSSTIHHAPVPQNAAAAQLGSHNLHAAAMLSAAGRGGPGLVPSSLLPFDVSVVLRGPYWIRIIYRKKFSVDMRCFAGDQVWLQPATPPKGGPSVGGSLPCPQFRPFIMEHVAQGLNALEPNFMNATQASGHLNNNAGAPQTAPSANRLSATPGVSMSRPTSGVANHVAASLSRAGNAMLASSALASGISGASVRLTAGAGLPVHMKGELNTAFIGLGDDGGYGGGWVPLAALKKVLRGILKYLGVLWLFAQLPELLKEILGSILKDNEGALLNLDQEQPALRFYVGGYVFAVSVHRVQLLLQVLSVKRFHHQQQQQQAQSNAQEELAAAEINEICDYFSRRVASEPYDASRVASFITLLTLPISVLREFLKLITWKKGLSPVNGDIATAQRARIELCLENHSGSAAADNTENSTLAKSNIHHDRAHSSVEFALTFVLDHALIPHMNVAGGAAWLPYCVSVKLRYSFGDNNHIAFLAMNGSHGGRACWLQFEEWERCKQKVSRAVETVNGSGVAGEVGQGRLRMVAEMIQKQLQLCLQQLRDGPLSAGSTAS

SEQ ID NO: 7769 - DNA, 681 bp, Sorghum bicolor
  misc_feature: Ceres ANNOT ID no. 6083594
  misc_feature: Encodes the peptide sequence at SEQ ID NO 7770
atgtctcggggcggtagccacggggagctgggccagaggatcgattacgtcttcaaggtggttctcatcggcgactccgctgtgggcaagtcgcagctgctcgcccgcttcgcccgcaacgagttcaacctcgactccaaggccaccatcggagtcgagttccagacgcgcaccctcaacatcgacgcccgcaccgtcaaggcacagatctgggacaccgcaggccaggaaaggtaccgagcagtaacaagtgcctactacaggggtgcagttggagctatgttagtatatgacataaccaagcgccagtcctttgatcatgtggctaggtggcttgaggaactacgtggccatgctgataagaacattgttatcatgcttattggtaacaaatctgatctgggaacacttcgttctgtcgcaactgaagatgcaaaagagtttgctgagcgtgagaacctcttctttatggagacctctgcacttgaggctgtcaatgttgaaaatgctttcatgactgtactgacggagatttaccgggttgtcagcaagaaaaaccttgttgccaatgaggagtctgattctagtggaaactcgagtttactgaaaggaacaaagattgttgtccctggtcaagagccaccccctacatccaaggcaacatgttgtatgtcctcctaa

SEQ ID NO: 7770 - protein, 226 aa, Sorghum bicolor
  misc_feature: Ceres ANNOT ID no. 6083594
  misc_feature (19)..(180): Pfam Id: Ras Pfam Desc: Ras family
  misc_feature (19)..(133): Pfam Id: Miro Pfam Desc: Miro-like protein
  misc_feature (3)..(178): Pfam Id: Arf Pfam Desc: ADP-ribosylation factor family
  misc_feature (1)..(225): NCBI GI: 109940137 NCBI Desc: ras-related protein rgp1 (gtp-binding regulatory protein rgp1)
  misc_feature (1)..(225): NCBI GI: 20356 NCBI Desc: gtp-binding protein [oryza sativa]
  misc_feature (12)..(226): NCBI GI: 9758522 NCBI Desc: ras superfamily gtp-binding protein-like [arabidopsis thaliana]
  misc_feature (7)..(226): NCBI GI: 9294115 NCBI Desc: gtp-binding protein-like [arabidopsis thaliana]
  misc_feature (1)..(225): NCBI GI: 303738 NCBI Desc: gtp-binding protein [pisum sativum]
  misc_feature: Useful for making plants with altered lignin content
  misc_feature: Functional homolog of the protein sequence given in SEQ ID NO 13076
  misc_feature: Useful for making plants with altered alkaloid content
  misc_feature: Functional homolog of the protein sequence given in SEQ ID NO 13220
  misc_feature: Useful for making plants with altered terpenoid content
  misc_feature: Functional homolog of the protein sequence given in SEQ ID NO 13157
  misc_feature: The sequence is a functional homolog of SEQ ID NO. 400 in the 11/188,298 US application
MSRGGSHGELGQRIDYVFKVVLIGDSAVGKSQLLARFARNEFNLDSKATIGVEFQTRTLNIDARTVKAQIWDTAGQERYRAVTSAYYRGAVGAMLVYDITKRQSFDHVARWLEELRGHADKNIVIMLIGNKSDLGTLRSVATEDAKEFAERENLFFMETSALEAVNVENAFMTVLTEIYRVVSKKNLVANEESDSSGNSSLLKGTKIVVPGQEPPPTSKATCCMSS

SEQ ID NO: 7771 - DNA, 624 bp, Sorghum bicolor
  misc_feature: Ceres ANNOT ID no. 6083603
  misc_feature: Encodes the peptide sequence at SEQ ID NO 7772
atgtctaagaagagggggctttcgttggaggagaaacgggagcaaatgcttcaaatattttatgagagccaggacttctttctgcttaaggagctagagaaaatgggtcctaaaaagggagtgattagtcagtctgtgaaggatgtggtgcaaagcctggtggatgatgatcttgtcttgaaggacaaaattgggacttctgtgtacttttggagtcttccaagttgtgctgggaaccagctgaggaatacttacaacaagctggaatctgatctttcaaactctagaaagcgttacatggagcttgttgaacatagagacaacttgaaaagaggccgggaagactctgaagagagggaagctgctctggaggggctgaaggctgtagagctacaccataagaaactcaaggaggaactgggtgcatatgcagatagtgatccagctgcagtagaagcaatgagggatgctattgatgttgctcattcagcagctaacaggtggacagacaacattttcactttgcaacaatggtgttcaaccacattcccagaagcaaaagagcaacttgaacatatgtacagggaggttgggatcaccgaagattttgagtacctgcagtga

SEQ ID NO: 7772 - protein, 207 aa, Sorghum bicolor
  misc_feature: Ceres ANNOT ID no. 6083603
  misc_feature (16)..(205): Pfam Id: Mnd1 Pfam Desc: Mnd1 family
  misc_feature (16)..(207): NCBI GI: 145334177 NCBI Desc: atmnd1 [arabidopsis thaliana]
  misc_feature (1)..(206): NCBI GI: 20380711 NCBI Desc: gaj protein [mus musculus]
  misc_feature (1)..(206): NCBI GI: 14149769 NCBI Desc: gaj protein [homo sapiens]
  misc_feature (1)..(206): NCBI GI: 123982216 NCBI Desc: meiotic nuclear divisions 1 homolog (s. cerevisiae) [synthetic construct]
  misc_feature (1)..(173): NCBI GI: 50417161 NCBI Desc: zgc:101017 protein [danio rerio]
MSKKRGLSLEEKREQMLQIFYESQDFFLLKELEKMGPKKGVISQSVKDVVQSLVDDDLVLKDKIGTSVYFWSLPSCAGNQLRNTYNKLESDLSNSRKRYMELVEHRDNLKRGREDSEEREAALEGLKAVELHHKKLKEELGAYADSDPAAVEAMRDAIDVAHSAANRWTDNIFTLQQWCSTTFPEAKEQLEHMYREVGITEDFEYLQ

SEQ ID NO: 7773 - DNA, 624 bp, Sorghum bicolor; identical to SEQ ID NO: 7771
  misc_feature: Ceres ANNOT ID no. 6083605
  misc_feature: Encodes the peptide sequence at SEQ ID NO 7774

SEQ ID NO: 7774 - protein, 207 aa, Sorghum bicolor; identical to SEQ ID NO: 7772
  misc_feature: Ceres ANNOT ID no. 6083605
  misc_feature (16)..(205): Pfam Id: Mnd1 Pfam Desc: Mnd1 family
  misc_feature (16)..(207): NCBI GI: 145334177 NCBI Desc: atmnd1 [arabidopsis thaliana]
  misc_feature (1)..(206): NCBI GI: 20380711 NCBI Desc: gaj protein [mus musculus]
  misc_feature (1)..(206): NCBI GI: 14149769 NCBI Desc: gaj protein [homo sapiens]
  misc_feature (1)..(206): NCBI GI: 123982216 NCBI Desc: meiotic nuclear divisions 1 homolog (s. cerevisiae) [synthetic construct]
  misc_feature (1)..(173): NCBI GI: 50417161 NCBI Desc: zgc:101017 protein [danio rerio]

SEQ ID NO: 7775 - DNA, 1077 bp, Sorghum bicolor
  misc_feature: Ceres ANNOT ID no. 6083672
  misc_feature: Encodes the peptide sequence at SEQ ID NO 7776
atggcaggggaaggcaacggccgcgcggagcttcctaggatcgcggtgatcggcgccggcatctttgcgcgcacgcagtacatcccaaggctccgcgagatcgcgcacctcgtcgtcctcaaggccatctggagccgcacccaggaatctgcaaaggcggccgcggagcttgctcgtgacttcgcgcccgatattgagtgcaaatggggtgatgtgggcctggaggagatcatgggagatagttcaatcatgggcgttgctgttgttctcgctgggcaagtccaggttgagctttccctaaagatgctcaaggctggaaaacatgttattcaagcaacaacagaagcagaaactgcactgtcaatctacaactcatttccaaaccagttcccgcataaacccatttgggctgttggagagaactacagatttgaacctgcctttattgagtcaagcaagctgatcaatgatatcggggatatgatgcacatccaagttatcatcgaagggtcaatgaacagttcgaacccatatttcaatagcacctggagacgcaattttgtgggtggtttcattctggacatgggtgttcacttcattgcaggactacgaatgcttgtaggttcagaaatcacaagtgtatcatctatctcgcgtcatgtggatatgactttgccgccaccagataacatatgttcccttttccaactggaaaatggatgtgctggtgtctttgtgtttgcagtcaattcaagatcgccaaagatattatggcgggttgatggaacaaaaggaacaattcaggtagaacgtggagttgatagtggaaaacatggctaccaggtgttattctctggtgaaaatgggcagtgccagaagacattttacccgttctgtggagtgaatgaagaactgaagacatttgtccatgacatgttggcggctgacaaagatggagatcacaaggctgaaccccgcagttcttatgtcgaaggtgctcgtgatgttgccgtgctagaagccatgttggaatctagtgcgaagcaaggagccccagttcaagtgaagagattctaa

SEQ ID NO: 7776 - protein, 358 aa, Sorghum bicolor
  misc_feature: Ceres ANNOT ID no. 6083672
  misc_feature (13)..(237): NCBI GI: 92881006 NCBI Desc: oxidoreductase, c-terminal [medicago truncatula]
  misc_feature (14)..(350): NCBI GI: 119404075 NCBI Desc: nad-binding rossmann fold oxidoreductase family protein [aspergillus clavatus nrrl 1]
  misc_feature (13)..(269): NCBI GI: 119885824 NCBI Desc: oxidoreductase-like [thermotoga petrophila rku-1]
  misc_feature (13)..(270): NCBI GI: 57158910 NCBI Desc: nad(p)-dependent dyhydrogenase, gfo/idh/moca family [thermococcus kodakaraensis]
  misc_feature (13)..(269): NCBI GI: 67463987 NCBI Desc: chain b, crystal structure of oxidoreductase (tm0312) from thermotoga maritima at 2.50 a resolution
MAGEGNGRAELPRIAVIGAGIFARTQYIPRLREIAHLVVLKAIWSRTQESAKAAAELARDFAPDIECKWGDVGLEEIMGDSSIMGVAVVLAGQVQVELSLKMLKAGKHVIQATTEAETALSIYNSFPNQFPHKPIWAVGENYRFEPAFIESSKLINDIGDMMHIQVIIEGSMNSSNPYFNSTWRRNFVGGFILDMGVHFIAGLRMLVGSEITSVSSISRHVDMTLPPPDNICSLFQLENGCAGVFVFAVNSRSPKILWRVDGTKGTIQVERGVDSGKHGYQVLFSGENGQCQKTFYPFCGVNEELKTFVHDMLAADKDGDHKAEPRSSYVEGARDVAVLEAMLESSAKQGAPVQVKRF

SEQ ID NO: 7777 - DNA, 2079 bp, Sorghum bicolor
  misc_feature: Ceres ANNOT ID no. 6083673
  misc_feature: Encodes the peptide sequence at SEQ ID NO 7778
atggacacctccgacgacgaggctactgccgccgctgcggagaccaaaaagaagacacccaaggcagcggcggccaaggggaaggcgacggggaaggggaaagcggctgccggccccaaggcgtcggccaaggagagcagcctcctcaagcagaaatcgcccgccgaattctttgcagagaacaagaacattgccgggtttgacaatcctggtaaatccctgtacacaacgttgcgggagctagttgagaatgcccttgattccgccgaatccatatcagagctccctgatatagagattacaatagaagagatcacaaggaccaagtacaacacaatgatagggctagtggagcgacagcgtgttgacgaggcactatatgatgattttgagtcagaaaaggatcgtgagaaacgcctggccaaggaagcacgtttccaagaaattcaagctaaaaacgctgcacttgggaagaaagttaaggaggctccatctgttcgaggaaaaggtcggggtgaggctgtacttttcaaagtgacttgcaaggataatggtagaggtatgccacatgatgatatcccaaatatgcttgggagagttttgtcgggcacaaagtatggtttgaggcaaacacgtggaaaatttggacttggtgctaaaatggcacttatatggtcaaagatgagcacaggacttcctattgaaattaagtcgtcgatgaaaggccagaactatacttccttctgtcgcctggacatagatattcataaaaatatccctcatgttcatttacatgagaaaagggagaacaaaactaactggcatggggcagagattgaagttataattgagggaaattggacaactcatcgttcaaagatcctccattatatgcgtcagatggcagtcatcacaccatatgctcagttcctttttaaatttctatctgatgcagcagacaaaaacttaacaataaagtttgctcgccggacagatgttatgcctcctgttccacttcaaacaaagcatcacccatctgcagttgatttattactgataaaaggtttagttgcagagactacaaagcaaaatcttttacagtttctacaacacgagttcgtgaatataagcaaatcacatgctgaacgtttaattggggagatgggacctgatttcagtccaaaaatgacagtcaagagccttacttctcagcaattagtgcgaatacatcaattatttaggcaggctaagttcgatgatcccagcggcaattgtcttagtcctgcaggtgaatataatttacgcctgggtatcataaaagagttgcaccctgatatggttgcaacacatgcaagcagccctcaggtttttgaaggtcacccatttattgttgaagctgggataagcattggtggaaaagatgttaaacaaggtataaacatctttaggtttgcaaacagaataccacttctttttgaacaaggtgctgacgtcatcacaagaactgctacaaaaaggatggtttggagcagctacaaaattaatcaacatcaagataagattggtgtctttgtgagcattgtaagtacaaagatacctttcaaaggaactggaaaggagtacattggggatgacataactgaaatatcatctgctgttaagtcagcgctgaagcagtgctgtcttcaactgaagtctaagattgtgaagaaacttcaggctcgtgagcggcaggacaggaaaaggaacctgaacagatatattcctgacgttgcaagagcgattatggaaactctggtagaaattgcagatcaatctcccccaaaacggccacgctatgataaggaagatgaggaactccttgagaaggtaaattctcaggaggtgacagagatgacatttagagactgcttgactcagcatgttgaacaggtcgactatgaaatggcgctggactacgccatgcagagtggagtaagcgaggagccccgagaagcgatatatttgaactcacttgaaggatcttacaagtttgtcgacttacaaagtccagtcttcgtgttcagatttgttccttga

SEQ ID NO: 7778 - protein, 692 aa, Sorghum bicolor
  misc_feature: Ceres ANNOT ID no. 6083673
  misc_feature (421)..(580): Pfam Id: Topo-VIb_trans Pfam Desc: Topoisomerase VI B subunit, transducer
  misc_feature (78)..(692): NCBI GI: 34558725 NCBI Desc: topoisomerase 6 subunit b-like protein [oryza sativa (japonica cultivar-group)]
  misc_feature (45)..(689): NCBI GI: 92881005 NCBI Desc: atp-binding region, atpase-like [medicago truncatula]
  misc_feature (38)..(691): NCBI GI: 12331188 NCBI Desc: topoisomerase 6 subunit b [arabidopsis thaliana]
  misc_feature (38)..(453): NCBI GI: 9294405 NCBI Desc: dna topoisomerase vi subunit b-like protein [arabidopsis thaliana]
  misc_feature (169)..(645): NCBI GI: 116062484 NCBI Desc: type ii dna topoisomerase vi subunit b [aeropyrum pernix k1]
MDTSDDEATAAAAETKKKTPKAAAAKGKATGKGKAAAGPKASAKESSLLKQKSPAEFFAENKNIAGFDNPGKSLYTTLRELVENALDSAESISELPDIEITIEEITRTKYNTMIGLVERQRVDEALYDDFESEKDREKRLAKEARFQEIQAKNAALGKKVKEAPSVRGKGRGEAVLFKVTCKDNGRGMPHDDIPNMLGRVLSGTKYGLRQTRGKFGLGAKMALIWSKMSTGLPIEIKSSMKGQNYTSFCRLDIDIHKNIPHVHLHEKRENKTNWHGAEIEVIIEGNWTTHRSKILHYMRQMAVITPYAQFLFKFLSDAADKNLTIKFARRTDVMPPVPLQTKHHPSAVDLLLIKGLVAETTKQNLLQFLQHEFVNISKSHAERLIGEMGPDFSPKMTVKSLTSQQLVRIHQLFRQAKFDDPSGNCLSPAGEYNLRLGIIKELHPDMVATHASSPQVFEGHPFIVEAGISIGGKDVKQGINIFRFANRIPLLFEQGADVITRTATKRMVWSSYKINQHQDKIGVFVSIVSTKIPFKGTGKEYIGDDITEISSAVKSALKQCCLQLKSKIVKKLQARERQDRKRNLNRYIPDVARAIMETLVEIADQSPPKRPRYDKEDEELLEKVNSQEVTEMTFRDCLTQHVEQVDYEMALDYAMQSGVSEEPREAIYLNSLEGSYKFVDLQSPVFVFRFVP

SEQ ID NO: 7779 - DNA, 711 bp, Sorghum bicolor
  misc_feature: Ceres ANNOT ID no. 6083675
  misc_feature: Encodes the peptide sequence at SEQ ID NO 7780
atggcagtggttggcgctttttcccctctcagaggttcttggatagctgtgaggatcaggcagggtgggaaacctgcagggatcagcctcctgtctccaacaaggaggaggaggaactgcgcggcagtggttcgggcggaggtgagcttcgtgggcgccgacgaggcgaagaggctggtggacgaggagggctacacggtgctggacatcagggacaggacgcagcgcgagagggcacacatcaagtcctctacccatgtgcctctcttcattgagaaccaagacaacgacattgggaccatcgtgaagcgccagctgcacaacaacttcgcggggctcttcttcggtctgcccttcaccaagctcaacccggatttcgccaggacagtcaaggacaagttctcgccggagagcaaggtgctggttgtctgccaggaaggtctcaggtcagcagccgctgcagatgcgctggagaaagaaggtttccaaaatattgcgtgcattacgtcaggtcttcagacagtgaagccaggaacgtttgaatctgtcggaaaaagtgagctgcagaatgcggggaaagctggtcttgtcaccatccaagggaagatttcagtagtccttgggactgtactgatcagtgcctatctgtttataacattcttccctgaccaggctgagaagctttttgacttggctggcatcagtttgtga

SEQ ID NO: 7780 - protein, 236 aa, Sorghum bicolor
  misc_feature: Ceres ANNOT ID no. 6083675
  misc_feature (1)..(236): NCBI GI: 49387840 NCBI Desc: rhodanese family protein-like [oryza sativa (japonica cultivar-group)]
  misc_feature (26)..(229): NCBI GI: 15010630 NCBI Desc: at2g42220/t24p15.13 [arabidopsis thaliana]
  misc_feature (26)..(229): NCBI GI: 2673913 NCBI Desc: rhodanese-like family protein [arabidopsis thaliana]
  misc_feature (14)..(231): NCBI GI: 124360655 NCBI Desc: rhodanese-like [medicago truncatula]
  misc_feature (24)..(207): NCBI GI: 21592651 NCBI Desc: rhodanese-like family protein [arabidopsis thaliana]
MAVVGAFSPLRGSWIAVRIRQGGKPAGISLLSPTRRRRNCAAVVRAEVSFVGADEAKRLVDEEGYTVLDIRDRTQRERAHIKSSTHVPLFIENQDNDIGTIVKRQLHNNFAGLFFGLPFTKLNPDFARTVKDKFSPESKVLVVCQEGLRSAAAADALEKEGFQNIACITSGLQTVKPGTFESVGKSELQNAGKAGLVTIQGKISVVLGTVLISAYLFITFFPDQAEKLFDLAGISL

SEQ ID NO: 7781 - DNA, 438 bp, Sorghum bicolor
  misc_feature: Ceres ANNOT ID no. 6083676
  misc_feature: Encodes the peptide sequence at SEQ ID NO 7782
atggagggttctaacttgaaaggtttggtggatgatgaaattgtcatgaagacgggcaaggctgcaggcatcggtttagcttttggcggtgtgtttggtgcactaaattctatgctgcatgatgggcctcaggttggcagtaatgtcaagtatccccagctgatcagaactaccaaggtgtgtgggcattatgcagcaaacttagcggttgttggagctacatttgtaggcgtcgagcaggctcttgcaagatacaggatgaagaaggacatcattaatggtgctgctgctggttttgctgctggtgctgttttgggtttcagagttaggagcttccggacagcattcttttcagggtctgcactcgccttgacatctgtactgctggatgtcaccggaatgaaaattactgatgaagaagaaaaaggcaaccactag

SEQ ID NO: 7782 - protein, 145 aa, Sorghum bicolor
  misc_feature: Ceres ANNOT ID no. 6083676
  misc_feature (3)..(137): Pfam Id: Tim17 Pfam Desc: Tim17/Tim22/Tim23 family
  misc_feature (11)..(142): NCBI GI: 124360646 NCBI Desc: mitochondrial import inner membrane translocase, subunit tim17/22 [medicago truncatula]
  misc_feature (11)..(133): NCBI GI: 79324885 NCBI Desc: protein translocase/ protein transporter [arabidopsis thaliana]
  misc_feature (27)..(136): NCBI GI: 145341012 NCBI Desc: mpt family transporter: inner membrane translocase (import) tim22 [ostreococcus lucimarinus cce9901]
  misc_feature (23)..(130): NCBI GI: 116129149 NCBI Desc: ensangp00000014763 [anopheles gambiae str. pest]
  misc_feature (65)..(141): NCBI GI: 13447155 NCBI Desc: tim22 [neurospora crassa]
MEGSNLKGLVDDEIVMKTGKAAGIGLAFGGVFGALNSMLHDGPQVGSNVKYPQLIRTTKVCGHYAANLAVVGATFVGVEQALARYRMKKDIINGAAAGFAAGAVLGFRVRSFRTAFFSGSALALTSVLLDVTGMKITDEEEKGNH

SEQ ID NO: 7783 - DNA, 1125 bp, Sorghum bicolor
  misc_feature: Ceres ANNOT ID no. 6083749
  misc_feature: Encodes the peptide sequence at SEQ ID NO 7784
atgggagcatatgcgacgactggtatgcagatgatggcaacgcgcccttgcatcccagcctgcaggcaaatgcttgggccgacatcagcactgtctgcatttggaagggcaatttgtaccagaactggttttgctagctcttctaaagccacatcagcaggaccactggtttctttaaatcgcaagagggttgttgtgagggcaatgtcgcagagaggtgcccaaggacttcccattgatctcacaggtaaaagagcatttattgctggagttgctgatgataatggttatggttgggcaatttctaaggctcttgctgctgctggtgctgagattcttgtcggtacatgggtgcctgcgctgaacatatttgagacaagcttgagacgtggaaagtttgatgaatcacggaagctacctgatggatctcttatggaaattgctaaagtatatccactggacgcagtttatgacacccctgaggatgttcctgaagatgttaaagcaaacaaaagatatgctggagcttcaaactggactgttaaggaagttgctgagactgtaaagaatgattttggtagcattgacatccttgtacactctcttgccaatggtcctgaggtaacaaaaccactgctggagacatcaaggagaggataccttgctgcaatttcagcatctagttattcttatgtttctttacttcaacacttccttcccataatgaatccaggaggtgctagtatctctttaacttacatagcttctgaaaggataattcctggatatggtggtggtatgagttcagccaaagcagcacttgagagtgatacaagagttcttgcttacgaagcaggtcgaaaaggcaaaatcagagtgaacacaatatcagcaggtccattgggaagccgagcagcaaaagccattggatttatcgagaagatgatagagtattcttatgtcaatgcaccactccagaaggaattattggcagatgaagtggggaacacggcagcattcctcgcgtctcctttggcatcagcaatcactggttcaactatttacgttgacaatgggctcaacacaatgggacttgcacttgacagccctactttatccacatga

SEQ ID NO: 7784 - protein, 374 aa, Sorghum bicolor
  misc_feature: Ceres ANNOT ID no. 6083749
  misc_feature (1)..(374): NCBI GI: 2653285 NCBI Desc: enoyl-acp reductase [oryza sativa (japonica cultivar-group)]
  misc_feature (5)..(370): NCBI GI: 14422261 NCBI Desc: enoyl-[acyl carrier-protein] reductase [brassica napus]
  misc_feature (1)..(370): NCBI GI: 14422255 NCBI Desc: enoyl-[acyl-carrier protein] reductase [brassica napus]
  misc_feature (5)..(370): NCBI GI: 7546501 NCBI Desc: enoyl-acyl carrier protein reductase [brassica napus]
  misc_feature (5)..(370): NCBI GI: 14422259 NCBI Desc: enoyl-[acyl-carrier protein] reductase [brassica napus]
  misc_feature (5)..(370): SWISSPROT Homolog: EC 1.3.1.9 Enoyl-[acyl-carrier-protein] reductase [NADH], chloroplast precursor
  misc_feature: The sequence is a functional homolog of SEQ ID NO 2 in US patent 7141721
MGAYATTGMQMMATRPCIPACRQMLGPTSALSAFGRAICTRTGFASSSKATSAGPLVSLNRKRVVVRAMSQRGAQGLPIDLTGKRAFIAGVADDNGYGWAISKALAAAGAEILVGTWVPALNIFETSLRRGKFDESRKLPDGSLMEIAKVYPLDAVYDTPEDVPEDVKANKRYAGASNWTVKEVAETVKNDFGSIDILVHSLANGPEVTKPLLETSRRGYLAAISASSYSYVSLLQHFLPIMNPGGASISLTYIASERIIPGYGGGMSSAKAALESDTRVLAYEAGRKGKIRVNTISAGPLGSRAAKAIGFIEKMIEYSYVNAPLQKELLADEVGNTAAFLASPLASAITGSTIYVDNGLNTMGLALDSPTLST

SEQ ID NO: 7785 - DNA, 441 bp, Sorghum bicolor
  misc_feature: Ceres ANNOT ID no. 6083865
  misc_feature: Encodes the peptide sequence at SEQ ID NO 7786
atggcacaaaagaccttgcaagaattctctgctccaagccttgagaacattccaactggtccaagattttcagtagaagaaggagcacccgagttcgagctcaagtcaagcctcatcaatttggtgcaagctacacaattcagtggaaagaatttctcagagattgaaagcacaatccacatcaatggagttgacaaagacatcatactgcttcgcctttttccattctcactagaaggaaaagcgaggaagtggttctacactcatcaagataacatcaacaactggacgaacttgtcagatgtctttctttcaatgtttttccctataggcaaaacaactgccttaagaggaaatattgtcagtttccaacagcagaagatagaaaccatttcagaagcatgggagcgttttcaaggatacaaatcagattgttgttga

SEQ ID NO: 7786 - protein, 146 aa, Sorghum bicolor
  misc_feature: Ceres ANNOT ID no. 6083865
  misc_feature (72)..(147): Pfam Id: Retrotrans_gag Pfam Desc: Retrotransposon gag protein
  misc_feature (1)..(145): NCBI GI: 38344353 NCBI Desc: osjnba0061a09.14 [oryza sativa (japonica cultivar-group)]
  misc_feature (1)..(145): NCBI GI: 58532094 NCBI Desc: osjnba0085c10.7 [oryza sativa (japonica cultivar-group)]
  misc_feature (1)..(134): NCBI GI: 38347239 NCBI Desc: osjnba0059h15.3 [oryza sativa (japonica cultivar-group)]
  misc_feature (1)..(141): NCBI GI: 38605787 NCBI Desc: osjnbb0045p24.1 [oryza sativa (japonica cultivar-group)]
  misc_feature (50)..(145): NCBI GI: 38605824 NCBI Desc: osjnba0011k22.15 [oryza sativa (japonica cultivar-group)]
MAQKTLQEFSAPSLENIPTGPRFSVEEGAPEFELKSSLINLVQATQFSGKNFSEIESTIHINGVDKDIILLRLFPFSLEGKARKWFYTHQDNINNWTNLSDVFLSMFFPIGKTTALRGNIVSFQQQKIETISEAWERFQGYKSDCC

SEQ ID NO: 7787 - DNA, 3243 bp, Sorghum bicolor
  misc_feature: Ceres ANNOT ID no. 6084055
  misc_feature: Encodes the peptide sequence at SEQ ID NO 7788
atgatgcagatgctaggcctccgcggctcgtctaaggaccgtggccgcgggggcgacccgtccccgtcctcgtcctccgctgcggcggggggcacagggaccccgcgctcgcctttcgcggcggaggcgggcggcgagggcgggggcggccggccgctgcggctggtgtactgcgacgagcgcggcctgttccggatggacccagaggccgtggccgctctgcagctcgtcaagggacccgtcggggtcgtctccgtctgtggccgcgcgcgccaggggaagagcttcatccttaaccagcttctaggaagaagtagcgggtttcaagtggcaagtactcatcgtccctgcaccaagggcctttggatgtggagtgccccaataaagagaactgcccttgacggaactgaatatagtcttttgctacttgacagcgagggcattgatgcctatgatcagacgggcacttatagcattcagatattctcattggcagtcctactatcaagcatgttcatatataatcagatgggtggtatagatgaggcagcccttgatcgcctttcacttgttactgaaatgaccaagcatatccgtgtgagggcaaatggtgggaggtctactgcatctgaacttgggcagttttcacctatttttatctggctactgagggatttctatctagatttagtggagaatggtagaaagataactccacgagattacctggaaattgcactgaggcctcttgaaggcagaggaaaagacatatcttcaaagaatgagatccgtgagtccatacgtgcccttttccccgatagagaatgtttcacactggtgcgcccattgaacagtgaaaatgaacttcaacgtcttgatcaaatccctcttgagaaattgcgccatgaatttcaagctggactggacgaattaacaaggtttatttttgagaggacaaggcctaagcaagttgctggtacaatcatgacaggaccagtactagctggtgttgcacagtccttcctggatgcaataaacaatggagctgtgcctaccatttcgtcctcttggcagagtgtagaagaagcagaatgccggagagcatatgattgtgctgctgaggtttacatgtcatctttcagccacagcaaattagctgaagaagatgctttaagggatgcacacgaagctgctttaagaaaggcacttgatgcatacaatactactgctgttggaactggtacttcacgtacccattatgagaaagttcttaacaatttctgcagaaaggcattccaggattataaaaagaatgctttcttagaggctgacaagcagtgctcaaatgcaatacactacatggagaagaagatccgagcagcatgcactgctcccagtgtcaaagtttctgctgtgattcaggtcctggaaattgcacttgctgaatatgaagcatcttgtactggcccagccaaatggagaatgcttgcttcctttctaagacagtgtttggaagggcctatattggacctctgcttgaagttaataaatgaaacagaatcagagaggacttcctttactttaagatgtcggtcaaatgaagaccaactagaacttctaaagaagcaacttgaggccaatgaggcacacaaatctgaatatctaaagcgctacgaagcttctataagtgaaaaacagagagccactgctgatcttagtggtaatcttgcaaacctgaggaccaagtgtagcacattagaagaacgctgtgtaagcatatctaaagaacttgatcatgtccgacatgaatgcactgattggagggtgaagtatgaacaatctgtttctcagcacaaggctgaacaagatagatttgtcgctcagttggcatctcttaagtctagacatagctctgcagaaggaaagttgggagcagctcaggaacaagcagcctctgctcaagatgaggctgcagaatggaagaagagatacgaaatggctactctgcaggctaaaactgcattggagagactcgcatcagtgcaagaacaaattaacaaaattgcacaagaaagggaaagtgctataagggaagaatttgcctcacatttggaggaaaaggaagaggaaataaggaaattagttgcaaagattagagaagaggagagtgaagaaagtgtattgactgagcggttgctggttgcagaatcaaaaacacatggccataacaaggaaactgcaggcttgaaggatgaaatcaaagaactaacaagcaagttggagtttctgagagacagagcagtatcatatgaaaaacaagctagaatgcttgaacaagaaaaaaaccatcttcaagagaagttcttatctgaatgtaagaaatatgatgaggcagaacaaagatacaagtctgcagaaagggatgtgaaaaaggctactgagttggctgatgcagctcgaacagaggctattgcatcccagaaagggaaggatgaggcacagcggttatcgatggaaaaggtagcagttatagagagagttcaaaggcaggtagacagactggagcaggaaaaagttaatctattgggcgaagttcagagaatgcgtaattctgaatctgatgcctggtccaaggttaccttgcttgagagtagggttgctgagagggagaaagaaatggatgatttactgagctgtagcaacgaacaaaggtccagcacccttcatgtccttgagagtctgttggcaacggaacgtgcagctagagctgaagccaataagcgtgcagaggccttatctatacaactacaatccgcccaaggtaaacttgatatactccatcaggagctgacatcgattcgtcttgttgagactgcacttgatagcaagctccggaccattacctatggcaaaagatttagagataatgaagtacggctggattctatccaagatatggacattgatcctccagagaggagcacaaaaagaactaaaagcaacactaccccattgaagcctgtccaaactgaggatggtggttctgttcatatgagagaagacagtgttacagttagcacggatgtaaaagatggcaatccagatggttacaaaaagttcaccatagctaaactgaaagaagagctaactaagcatggatttgcagcgcagttgctagagctcaagaatccaaacaagaaagatatacttgcactttatatgaagcatgttttgtgcgagtaa

SEQ ID NO: 7788 - protein, 1080 aa, Sorghum bicolor
  misc_feature: Ceres ANNOT ID no. 6084055
  misc_feature (61)..(324): Pfam Id: GBP Pfam Desc: Guanylate-binding protein, N-terminal domain
  misc_feature (325)..(624): Pfam Id: GBP_C Pfam Desc: Guanylate-binding protein, C-terminal domain
  misc_feature (15)..(1078): NCBI GI: 145358912 NCBI Desc: gtp binding / gtpase [arabidopsis thaliana]
  misc_feature (64)..(986): NCBI GI: 89305791 NCBI Desc: guanylate-binding protein, n-terminal domain containing protein [tetrahymena thermophila sb210]
  misc_feature (55)..(853): NCBI GI: 89291280 NCBI Desc: guanylate-binding protein, n-terminal domain containing protein [tetrahymena thermophila sb210]
  misc_feature (55)..(811): NCBI GI: 89295164 NCBI Desc: guanylate-binding protein, n-terminal domain containing protein [tetrahymena thermophila sb210]
  misc_feature (63)..(544): NCBI GI: 89304068 NCBI Desc: guanylate-binding protein, n-terminal domain containing protein [tetrahymena thermophila sb210]
MMQMLGLRGSSKDRGRGGDPSPSSSSAAAGGTGTPRSPFAAEAGGEGGGGRPLRLVYCDERGLFRMDPEAVAALQLVKGPVGVVSVCGRARQGKSFILNQLLGRSSGFQVASTHRPCTKGLWMWSAPIKRTALDGTEYSLLLLDSEGIDAYDQTGTYSIQIFSLAVLLSSMFIYNQMGGIDEAALDRLSLVTEMTKHIRVRANGGRSTASELGQFSPIFIWLLRDFYLDLVENGRKITPRDYLEIALRPLEGRGKDISSKNEIRESIRALFPDRECFTLVRPLNSENELQRLDQIPLEKLRHEFQAGLDELTRFIFERTRPKQVAGTIMTGPVLAGVAQSFLDAINNGAVPTISSSWQSVEEAECRRAYDCAAEVYMSSFSHSKLAEEDALRDAHEAALRKALDAYNTTAVGTGTSRTHYEKVLNNFCRKAFQDYKKNAFLEADKQCSNAIHYMEKKIRAACTAPSVKVSAVIQVLEIALAEYEASCTGPAKWRMLASFLRQCLEGPILDLCLKLINETESERTSFTLRCRSNEDQLELLKKQLEANEAHKSEYLKRYEASISEKQRATADLSGNLANLRTKCSTLEERCVSISKELDHVRHECTDWRVKYEQSVSQHKAEQDRFVAQLASLKSRHSSAEGKLGAAQEQAASAQDEAAEWKKRYEMATLQAKTALERLASVQEQINKIAQERESAIREEFASHLEEKEEEIRKLVAKIREEESEESVLTERLLVAESKTHGHNKETAGLKDEIKELTSKLEFLRDRAVSYEKQARMLEQEKNHLQEKFLSECKKYDEAEQRYKSAERDVKKATELADAARTEAIASQKGKDEAQRLSMEKVAVIERVQRQVDRLEQEKVNLLGEVQRMRNSESDAWSKVTLLESRVAEREKEMDDLLSCSNEQRSSTLHVLESLLATERAARAEANKRAEALSIQLQSAQGKLDILHQELTSIRLVETALDSKLRTITYGKRFRDNEVRLDSIQDMDIDPPERSTKRTKSNTTPLKPVQTEDGGSVHMREDSVTVSTDVKDGNPDGYKKFTIAKLKEELTKHGFAAQLLELKNPNKKDILALYMKHVLCE

SEQ ID NO: 7789 - DNA, 567 bp, Sorghum bicolor
  misc_feature: Ceres ANNOT ID no. 6085079
  misc_feature: Encodes the peptide sequence at SEQ ID NO 7790
atggaaaatcatgttaacccagaaaaggaaactgatgaaactccaggatctgaggttaaccaagagcctgtgggaacatgtcaggatgcaatggtggaaactgatattatcccagaaaagcaagctgttccagaggcaggctttgaggttaatgaagaacctacggaaacatgccaggaagcagctgcagaatctgatgttaacccagagaagcaaacttctgatccaggtgttatttaccgctgcagaaaatgccggagaatgcttgcaacacaagaatttgttgttacccatgaagtaggtgcgggtggcaagagcttcagagcaggaaaacagtctaatgtgaatgaggatggcaaaaaaacagaatgtccatgcatcttcgttgagcccatgaagtggatgcaaactgtggaagaaggatatgttgcgaacaagctcttttgcatgggatgcaaagctcgtctgggacaattcaactgggctggtatgcagtgcagctgtggagcctgggtgattccagcatttcagctgaccaaaagcaagatcgacaaatgttcaatgtaa

SEQ ID NO: 7790 - protein, 188 aa, Sorghum bicolor
  misc_feature: Ceres ANNOT ID no. 6085079
  misc_feature (64)..(186): NCBI GI: 18415129 NCBI Desc: dual specificity protein phosphatase-related [arabidopsis thaliana]
  misc_feature (54)..(184): NCBI GI: 87241169 NCBI Desc: dual specificity protein phosphatase [medicago truncatula]
  misc_feature (64)..(172): NCBI GI: 7268653 NCBI Desc: pollen-specific protein-like [arabidopsis thaliana]
  misc_feature (59)..(185): NCBI GI: 62857951 NCBI Desc: dusp12 [xenopus tropicalis]
  misc_feature (78)..(188): NCBI GI: 12006110 NCBI Desc: vh1 [mus musculus]
  misc_feature: The plant is abnormally small.
  misc_feature: Useful for making plants with modulated biomass
  misc_feature: Functional homolog of the protein sequence given in SEQ ID NO 13059
  misc_feature: Useful for making plants with modulated biomass
  misc_feature: Functional homolog of the protein sequence given in SEQ ID NO 13059
MENHVNPEKETDETPGSEVNQEPVGTCQDAMVETDIIPEKQAVPEAGFEVNEEPTETCQEAAAESDVNPEKQTSDPGVIYRCRKCRRMLATQEFVVTHEVGAGGKSFRAGKQSNVNEDGKKTECPCIFVEPMKWMQTVEEGYVANKLFCMGCKARLGQFNWAGMQCSCGAWVIPAFQLTKSKIDKCSM

SEQ ID NO: 7791 - DNA, 1161 bp, Sorghum bicolor
  misc_feature: Ceres ANNOT ID no. 6085105
  misc_feature: Encodes the peptide sequence at SEQ ID NO 7792
atggaggctggaggcgcaggaaatggtttgaatggggcggtgcagacaaaggggagtgggggtgatggctctgccaagccgctgcccccttgctgtgtcaaggcgagagccgccgcgcccgagtctgaggccaagtgccatgctactgtcgtttcaggatggttcactgaaccgcgatcacgatgtggtaaagccagcaaagttcaatattacaataacccgatgtggccaggagaggcccattctttgaaggtggagaagatcttgtaccaggggaaatctccataccaagaagtcctagtttttgagtcgtcaacctatgggaaagtccttgtgcttgatggtattgttcagttgactgacaaggatgaatgtgcataccaggaaatgattactcacctaccactctgttcaattccatcccctaaaaaagttttggttattggtggtggtgatggaggtgtacttcgagagatatccagacatagttcagtggagtctattgacatatgtgagattgatcagctagttattgatgtttgcaaagatcttttcccacacttgtctgttggatttgaagatcctcgtgttcaacttcatgttggtgatgctgtggaattcttgagaaatgctcctgaagggacatatgatgccatcattgttgattcatcagacccaatagggcctgctcaggaacttgtggagaagcctttttttgagacaattgctagagctttgaggcctggtggcgttctttgtaatcaagctgagagtatgtggttacatacacatttgattcaggatatgctttcaatttgtcgtgaaactttcaagggttctgtacgctatgcatggactagtgtcccaacttacccgagtggggtgattgggtttttactatgtgccaaagaaggtccatcggtcaactttctgactcctataaatccaattgaaaaggtggaaggagctacaaaagctggaagggagatcagattttataattcggagatgcatagggcagcatttgttcttccagcctttgcaaagagagagctagaagcatattttgcttccactgaaacagagcaggcagaggaaacagcggcgacacgactgaagttaactcttgcatcgaagagtgaaattctcactgcgtcctag

SEQ ID NO: 7792 - protein, 386 aa, Sorghum bicolor
  misc_feature: Ceres ANNOT ID no. 6085105
  misc_feature (53)..(312): Pfam Id: Spermine_synth Pfam Desc: Spermine/spermidine synthase
  misc_feature (1)..(386): NCBI GI: 115468348 NCBI Desc: os06g0528600 [oryza sativa (japonica cultivar-group)]
  misc_feature (1)..(386): NCBI GI: 74481421 NCBI Desc: spermidine synthase [zea mays]
  misc_feature (5)..(366): NCBI GI: 73486701 NCBI Desc: spermine synthase [malus sylvestris]
  misc_feature (2)..(352): NCBI GI: 126153733 NCBI Desc: spermine synthase [lotus japonicus]
  misc_feature (1)..(358): NCBI GI: 15983394 NCBI Desc: at5g53120/mfh8_5 [arabidopsis thaliana]
  misc_feature (73)..(354): SWISSPROT Homolog: EC 2.5.1.16 Spermidine synthase 2
  misc_feature (75)..(354): SWISSPROT Homolog: EC 2.1.1.53 Putrescine N-methyltransferase 1
MEAGGAGNGLNGAVQTKGSGGDGSAKPLPPCCVKARAAAPESEAKCHATVVSGWFTEPRSRCGKASKVQYYNNPMWPGEAHSLKVEKILYQGKSPYQEVLVFESSTYGKVLVLDGIVQLTDKDECAYQEMITHLPLCSIPSPKKVLVIGGGDGGVLREISRHSSVESIDICEIDQLVIDVCKDLFPHLSVGFEDPRVQLHVGDAVEFLRNAPEGTYDAIIVDSSDPIGPAQELVEKPFFETIARALRPGGVLCNQAESMWLHTHLIQDMLSICRETFKGSVRYAWTSVPTYPSGVIGFLLCAKEGPSVNFLTPINPIEKVEGATKAGREIRFYNSEMHRAAFVLPAFAKRELEAYFASTETEQAEETAATRLKLTLASKSEILTAS

SEQ ID NO: 7793 - DNA, 2103 bp, Sorghum bicolor
  misc_feature: Ceres ANNOT ID no. 6085113
  misc_feature: Encodes the peptide sequence at SEQ ID NO 7794
atggcgggccgggaggagagatatgtgaggtttcaggactggaaatcagagcaatctgtttctgttacttcagatagggtaaactcagaaagagggcataccatctttggtttgttaaaggacacaactgcaggagccttttcattcctggggaactcttcacattctgaagctctaaacaaatcaggcccagaggaaaagaagtccaaaacaagagttcttgatcctcaagggccatttttgcagagatggaacaagatatttgtgatatcatgtctttttgcagtttttgtggacccattgttcttgtatatcccagtaattgatggtggcaagaactgcctgtacttggacaagaagttagagaccgtagcaagtatcctgcgctttttcacagacatcttctatttactccatatgctatttcagttcagaacaggctttattgctccctcttctagagtgttcggtcggggtgtcttggtcaaggacacatttgcaatagcaaagcgatatatatcaacactgttcctggtggatttcttagcagttctgcccctccctcaggtttttgtgttggtggtgctgcctactctccaaggtcctgaagttatgaaggcaaaaattgtactactggttattattatttgtcagtatgtgcctcgactgctccgaataataccactttaccttcaaatcacgagatctgctggcatacttacagagacagcatgggctggtgctgctttcaaccttataatttatatgcttgccagtcatggctttggagctctttggtacattctttccatacagcgagaagacacctgttggagacaagcatgtaacaatcagactagctgtgagcttacatctttatactgtgggtatcatccacttgcaaataattctttcttacaaagtgcatgcccaacaaatagcacttccaattccaatccagacccgatatttggaatctttctaccagctctccaaaatgtttcacaatcaacaagtttctttgaaaaactattctattgcttttggtggggcctacagaatctaagttcccttggccagaacatgaaaacaagcactaatacgttggagaatctgtttgctgtttttgtctcgacatcgggtttggttctatttgcactacttattggtaatgtgcagtcagcttctgtgcgtatagaagaaatgagagtgaaaaggcgtgatacagagcagtggatggcacataggttactccctgagaatctcaaggatcggattatgcaccatgaacaatataggtggcaagaaacaagaggggttgacgaagagggccttcttaaaaatcttcccaaggatcttagaagagaaataaagagacatctttgtttgtcgcttctcatgaaggttccaatgtttgaaaacatggatgaacaactgttggatgccatgtgtgatcgtctgaagcctatgctgtacacagaaggaagctgcatcattcgggaaggtgacccagtgaatgaaatgctcttcatcatgagaggaacactagagagtaccacaacaaatggtggacaaactgggttcttcaactctaatgttctaaaaggtggagacttctgtggtgaagagctcctcacatgggcccttgaccccacttcagcttcaaatcttcctggctcaactaggacagtgaagacgttgtctgaagttgaagcttttgctctgagggctgatgacttgaagtttgttgccacacaattcaggaggctccacagcaaacaactccaacataccttccgattttactcacagcaatggaggacctgggctgcttgcttcatacaggcagcttggcacagatactgcagaaagaagctggaagaggctttatatgagaaggagaagaggttacaagcagcaattgtaagtgatggcactacttcgctcagtcttggtgcagcgctctatgcttcacgttttgctggcaacatgatgcggatcttacggagaaacgccaccagaaaggcccgtttgcaggaaagagtacctgcaagactgttacaaaagccagcagaacccaacttcttcgctgaagatagctga

SEQ ID NO: 7794 - protein, 700 aa, Sorghum bicolor
  misc_feature: Ceres ANNOT ID no. 6085113
  misc_feature (128)..(392): Pfam Id: Ion_trans Pfam Desc: Ion transport protein
  misc_feature (489)..(589): Pfam Id: cNMP_binding Pfam Desc: Cyclic nucleotide-binding domain
  misc_feature (1)..(700): NCBI GI: 6969231 NCBI Desc: cyclic nucleotide-gated calmodulin-binding ion channel [nicotiana tabacum]
  misc_feature (1)..(697): NCBI GI: 38503202 NCBI Desc: probable cyclic nucleotide-gated ion channel 10 (cyclic nucleotide-and calmodulin-regulated ion channel 10) (cam-regulated potassium ion channel)
  misc_feature (5)..(695): NCBI GI: 6969229 NCBI Desc: cyclic nucleotide-gated calmodulin-binding ion channel [nicotiana tabacum]
  misc_feature (38)..(695): NCBI GI: 7484881 NCBI Desc: cyclic nucleotide gated channel homolog f3i3.30 - arabidopsis thaliana
  misc_feature (3)..(695): NCBI GI: 7267598 NCBI Desc: cyclic nucleotide gated channel (cngc4) like protein [arabidopsis thaliana]
  misc_feature: The sequence is a functional homolog of SEQ ID NO. 503 in the 11/188,298 US application
MAGREERYVRFQDWKSEQSVSVTSDRVNSERGHTIFGLLKDTTAGAFSFLGNSSHSEALNKSGPEEKKSKTRVLDPQGPFLQRWNKIFVISCLFAVFVDPLFLYIPVIDGGKNCLYLDKKLETVASILRFFTDIFYLLHMLFQFRTGFIAPSSRVFGRGVLVKDTFAIAKRYISTLFLVDFLAVLPLPQVFVLVVLPTLQGPEVMKAKIVLLVIIICQYVPRLLRIIPLYLQITRSAGILTETAWAGAAFNLIIYMLASHGFGALWYILSIQREDTCWRQACNNQTSCELTSLYCGYHPLANNSFLQSACPTNSTSNSNPDPIFGIFLPALQNVSQSTSFFEKLFYCFWWGLQNLSSLGQNMKTSTNTLENLFAVFVSTSGLVLFALLIGNVQSASVRIEEMRVKRRDTEQWMAHRLLPENLKDRIMHHEQYRWQETRGVDEEGLLKNLPKDLRREIKRHLCLSLLMKVPMFENMDEQLLDAMCDRLKPMLYTEGSCIIREGDPVNEMLFIMRGTLESTTTNGGQTGFFNSNVLKGGDFCGEELLTWALDPTSASNLPGSTRTVKTLSEVEAFALRADDLKFVATQFRRLHSKQLQHTFRFYSQQWRTWAACFIQAAWHRYCRKKLEEALYEKEKRLQAAIVSDGTTSLSLGAALYASRFAGNMMRILRRNATRKARLQERVPARLLQKPAEPNFFAEDS

SEQ ID NO: 7795 - DNA, 840 bp, Sorghum bicolor
  misc_feature: Ceres ANNOT ID no. 6085277
  misc_feature: Encodes the peptide sequence at SEQ ID NO 7796
atggacgaagtcacacaagctgttgaagatctgaagaaagaatggagccaagcggtttcacagcttgaggagagcattgctgcaattgagacatgtggaaaaacagggaaaggaacagaggaagcaacttctcttccaaggttgaatggttctgcacaggatgctctgcagttgctcaagtcactgcagttccggcttgatcttctagctcagcagctacccacttttgatgaagtgcagtctgggcaagcaaccttagagtcatgggatgaacaatacaagaagctgcgtgctagcctgaggaatgctaacttacaagcgaaagagaacattagaaaagctgctcaggaggagagggagcttcttctagggggtggagaagagtcaacgatccgtaggcgtaatctccagacaaaggctgggatgacctctgctgctgaaagtatcaccgagagcctccgacggtctcgccagatgatggttcaggaagtggaaaggagtgcaagtaccttggcaacatttgatgaatcaacaagtgttctccggaaggctgaaggtgaatatcaaggacaccgctctttgctgatgcgtacccgtggtttgctctccacgatgcaacggcaagatgttcttgataggatcatcctgaccatcggctttatcattttctccttggcggttctttatgttgtctcaagacgtattggtctgttgacgctgcaaaggaaactggccaacgccatcagatccggttcattatcagctgcggacatcgtagcgaaagcccaacatgtccctgccccagcaaatgtccctgctcccatttacgatgaactgtga

SEQ ID NO: 7796 - protein, 279 aa, Sorghum bicolor
  misc_feature: Ceres ANNOT ID no. 6085277
  misc_feature (144)..(235): Pfam Id: Sec20 Pfam Desc: Sec20
  misc_feature (1)..(250): NCBI GI: 18404139 NCBI Desc: sec20 family protein [arabidopsis thaliana]
  misc_feature (171)..(279): NCBI GI: 140044987 NCBI Desc: sec20 [medicago truncatula]
  misc_feature (5)..(235): NCBI GI: 119492475 NCBI Desc: sec20 domain protein [neosartorya fischeri nrrl 181]
  misc_feature (43)..(235): NCBI GI: 45154861 NCBI Desc: snare protein sec20 [mus musculus]
  misc_feature (43)..(235): NCBI GI: 18266702 NCBI Desc: bcl2/adenovirus e1b 19kd interacting protein 1 [rattus norvegicus]
MDEVTQAVEDLKKEWSQAVSQLEESIAAIETCGKTGKGTEEATSLPRLNGSAQDALQLLKSLQFRLDLLAQQLPTFDEVQSGQATLESWDEQYKKLRASLRNANLQAKENIRKAAQEERELLLGGGEESTIRRRNLQTKAGMTSAAESITESLRRSRQMMVQEVERSASTLATFDESTSVLRKAEGEYQGHRSLLMRTRGLLSTMQRQDVLDRIILTIGFIIFSLAVLYVVSRRIGLLTLQRKLANAIRSGSLSAADIVAKAQHVPAPANVPAPIYDEL

SEQ ID NO: 7797 - DNA, 1227 bp, Sorghum bicolor
  misc_feature: Ceres ANNOT ID no. 6085293
  misc_feature: Encodes the peptide sequence at SEQ ID NO 7798
atgttggcaatggggtcagaagagtgggagctctatccttcttcctacattggttcacaggtcatagaatacagaccggtctctgaagacagcgatgacgatcagaatggggatgtggcagtgtcgctggacgctgttctccctgatgatctcttggagaaggttctttccttcttgcctgttgcaagtattataagatctgggtctgtttgcaaaaggtggcatgagattgtgcatgcccagaggcacgcatggagcaaaatggtgcctcagaagccatggtacttcatgtttacctgtagtgaggatgcagtttcaggttttgcctatgatccaagcctccgcaaatggtatggatttgatttcccttgcattgagaagagcaactggtctacatcctcatcggctgggttggtgtgcctgatggacagtgagaacaggcgccgcattttggtgtgcaaccccatcactaaggactggaagagacttcttgatgctcctgggggcaaaacagctgattacagtgctcttgccttttctgtggacagaagttctcatcattacactgtggctgttgcaagaagcaaccaggttccatcagagtattatcagtgggagtttaccatccatttgtatgagtcggtctctggtagttgggtgactcccttcactggagtattgcttggatggagaggtggcgacgagtgtgtcatctgtgatggaatcctctactatttggtgtactccacaggagttctggtgaacaataatgagcatcgccattgtcttgtaatgtatgatctcactgcaagacctaaccacacttctctgatgagcatggctattccagtgccatgtgctcttacgtgtggccgattgatgaacctgagtgggaagcttgtgctggttggtggcattggcaagcaagataggcctgggatcatcaagggaattggcatttgggagctccataacaaagagtggtgtgaggttgctcggatgcctcacaagttttttcaaggatttggtgagttcgatgatgtttttgcaagctgtggggcagatgatcttatctatatccagagctatgggtcgccagctcttctcacctttgaaataaaccacaagtcatggaagtggtccgtgaagagccctgtttcgaagaggttcccgctgcagctgttcactggattctcttttgagccaaggctggacattgctctctaa

SEQ ID NO: 7798 - protein, 408 aa, Sorghum bicolor
  misc_feature: Ceres ANNOT ID no. 6085293
  misc_feature (42)..(89): Pfam Id: F-box Pfam Desc: F-box domain
  misc_feature (287)..(335): Pfam Id: Kelch_2 Pfam Desc: Kelch motif
  misc_feature (1)..(407): NCBI GI: 115445403 NCBI Desc: os02g0260200 [oryza sativa (japonica cultivar-group)]
  misc_feature (67)..(403): NCBI GI: 74483458 NCBI Desc: f-box family protein [zea mays]
  misc_feature (6)..(406): NCBI GI: 55773953 NCBI Desc: fimbriata-like [oryza sativa (japonica cultivar-group)]
  misc_feature (45)..(219): NCBI GI: 124361081 NCBI Desc: cyclin-like f-box; galactose oxidase, central [medicago truncatula]
  misc_feature (103)..(404): NCBI GI: 30526089 NCBI Desc: stp-h4 [pisum sativum]
  misc_feature: The sequence is a functional homolog of SEQ ID NO. 456 in the 11/188,298 US application
MLAMGSEEWELYPSSYIGSQVIEYRPVSEDSDDDQNGDVAVSLDAVLPDDLLEKVLSFLPVASIIRSGSVCKRWHEIVHAQRHAWSKMVPQKPWYFMFTCSEDAVSGFAYDPSLRKWYGFDFPCIEKSNWSTSSSAGLVCLMDSENRRRILVCNPITKDWKRLLDAPGGKTADYSALAFSVDRSSHHYTVAVARSNQVPSEYYQWEFTIHLYESVSGSWVTPFTGVLLGWRGGDECVICDGILYYLVYSTGVLVNNNEHRHCLVMYDLTARPNHTSLMSMAIPVPCALTCGRLMNLSGKLVLVGGIGKQDRPGIIKGIGIWELHNKEWCEVARMPHKFFQGFGEFDDVFASCGADDLIYIQSYGSPALLTFEINHKSWKWSVKSPVSKRFPLQLFTGFSFEPRLDIAL

SEQ ID NO: 7799 - DNA, 927 bp, Sorghum bicolor
  misc_feature: Ceres ANNOT ID no. 6085298
  misc_feature: Encodes the peptide sequence at SEQ ID NO 7800
atggcgaaaagcggcgagtccacggtggaggttgcgtcctccagctcctctcctcttactcccgcttccgcgtcggctacgaggccgaaggcgaagcaccgtatggagatcgaggggtacccagtggatggcgtctccatcggcggccaagagacctgcgtcatcttcccgacgctgagcctcgccttcgacatcggccggtgcccgcagcgtgccgtctcgcaggagttcctcttcgtctcccacgggcacctcgaccacatcgggggccttcccatgtacgtggccacgcgggggctcttcaggttgcgtccgcccaccatcttcgtcccggcgtgcctccgggaactcgtggagcggctcttcgaggtgcaccgcgccatagaccagtccgagctcaaccacaacctggtccccctcgaggtcggggaggagtacgagttcaggagggacctcaaggtcagggctttcaggacctaccacaccatacccagccaggggtatgtgatatactcggtgaagcagaagcttaagcaggagttcattggcctaccagggagcgagatcaagcacctcaagctatcaggtgtggagatcacgaatacagtgtccacccctgaaattgctttcacgggagatacaacagcagatttcattcttgatccggataatgcagatgtgctgcaggcaaaaattcttgttgtcgagagtacttttctagacgactccatttcagttgagcatgcaagagaatatgggcacacacatttatatgagatagcaagtcagtcagacaagcttggaaacaaagctattctactgatccacttttctgctcgttatactacagaggaaattgatgctgcaataaacagattgccaccatctttccgtagcagagtttatgccttaaaggaaggcttctaa

SEQ ID NO: 7800 - protein, 308 aa, Sorghum bicolor
  misc_feature: Ceres ANNOT ID no. 6085298
  misc_feature (32)..(308): NCBI GI: 20975609 NCBI Desc: rnase z [arabidopsis thaliana]
  misc_feature (32)..(308): NCBI GI: 5882718 NCBI Desc: ests gbaa067482 and gbai100542 come from this gene. [arabidopsis thaliana]
  misc_feature (35)..(308): NCBI GI: 20975607 NCBI Desc: rnase z [arabidopsis thaliana]
  misc_feature (30)..(204): NCBI GI: 41017597 NCBI Desc: nuclear ribonuclease z (rnase z) (trna 3 endonuclease) (zinc phosphodiesterase elac)
  misc_feature (40)..(301): NCBI GI: 42523833 NCBI Desc: metallo-beta-lactamase superfamily protein [bdellovibrio bacteriovorus hd100]
  misc_feature (32)..(308): SWISSPROT Homolog: EC 3.1.26.11 Nuclear ribonuclease Z
  misc_feature: The plant produces a reduced number of seeds.
  misc_feature: The plant senesces significantly earlier than wild-type.
  misc_feature: Useful for biocontainment applications
  misc_feature: Useful for making plants with modulated time to senescence
  misc_feature: GREAT-hit functional homolog of the protein sequence given in SEQ ID NO 13532
  misc_feature: Useful for biocontainment applications
  misc_feature: Useful for making plants with modulated time to senescence
  misc_feature: Functional homolog of the protein sequence given in SEQ ID NO 13532
MAKSGESTVEVASSSSSPLTPASASATRPKAKHRMEIEGYPVDGVSIGGQETCVIFPTLSLAFDIGRCPQRAVSQEFLFVSHGHLDHIGGLPMYVATRGLFRLRPPTIFVPACLRELVERLFEVHRAIDQSELNHNLVPLEVGEEYEFRRDLKVRAFRTYHTIPSQGYVIYSVKQKLKQEFIGLPGSEIKHLKLSGVEITNTVSTPEIAFTGDTTADFILDPDNADVLQAKILVVESTFLDDSISVEHAREYGHTHLYEIASQSDKLGNKAILLIHFSARYTTEEIDAAINRLPPSFRSRVYALKEGF

SEQ ID NO: 7801 - DNA, 669 bp, Sorghum bicolor
  misc_feature: Ceres ANNOT ID no. 6085309
  misc_feature: Encodes the peptide sequence at SEQ ID NO 7802
atgatccagctgctgttcgccgtgctggtggcggaggcgtccctgacggcggcgctgctcttcaagacgccgctgcggaagctcgccgtgctagtggtcgaccggctcaagcgcggccgccacgcgcccgtcgtcgtcaagacggtcgcgggcgttgtcctggccctgctcgcttcgacgctctacagcatgtctcagatcagcggcggcgcgagcgactcagactccggctccggcggcgggcccacgcccaccgaccaggtgctcttctcgcgtcacctcctggaggcgtgcctcatggggtactccttatttcttgctctagtgattgaccggctccaccaatacatcagagatttgcgtgtgttcaagaaggacttagaggctgtacgtaagcataataaaatgttggaggaaacaaaacatggaaattcagaggacgcaaagaagtaccaggaagagattgccattctgaacaaggagatgaagaaactgaagctacaagtccaagaaaagatagaagaggtccatgttgctgaggacaaggcacttactatccaaaaacaatctgaaggcttgctgattgaatatgaccgcctgctggaggacaatcagcatcttcgggatcagctgatgtcaattgacctcaagctttccagctcttcttga

SEQ ID NO: 7802 - protein, 222 aa, Sorghum bicolor
  misc_feature: Ceres ANNOT ID no. 6085309
  misc_feature (4)..(198): Pfam Id: Bap31 Pfam Desc: B-cell receptor-associated protein 31-like
  misc_feature (8)..(221): NCBI GI: 115468026 NCBI Desc: os06g0367500 [oryza sativa (japonica cultivar-group)]
  misc_feature (1)..(215): NCBI GI: 144924959 NCBI Desc: b-cell receptor-associated 31-like; prefoldin [medicago truncatula]
  misc_feature (1)..(219): NCBI GI: 124360513 NCBI Desc: prefoldin [medicago truncatula]
  misc_feature (102)..(215): NCBI GI: 144924211 NCBI Desc: prefoldin [medicago truncatula]
  misc_feature (101)..(214): NCBI GI: 115471595 NCBI Desc: os07g0291200 [oryza sativa (japonica cultivar-group)]
MIQLLFAVLVAEASLTAALLFKTPLRKLAVLVVDRLKRGRHAPVVVKTVAGVVLALLASTLYSMSQISGGASDSDSGSGGGPTPTDQVLFSRHLLEACLMGYSLFLALVIDRLHQYIRDLRVFKKDLEAVRKHNKMLEETKHGNSEDAKKYQEEIAILNKEMKKLKLQVQEKIEEVHVAEDKALTIQKQSEGLLIEYDRLLEDNQHLRDQLMSIDLKLSSSS

SEQ ID NO: 7803 - DNA, 699 bp, Sorghum bicolor
  misc_feature: Ceres ANNOT ID no. 6085329
  misc_feature: Encodes the peptide sequence at SEQ ID NO 7804
atggcttcacccgcggaggagactcccgccgccgaggatacggcgtcgcctccgccgccgccgccggcgaggtcccggggcttctggttccttggggaggacaagtctgtgcacaaggctctcggcgggggtaaaactgctgatgtactgttgtggaaagacaagaagacctctgctgctgtagtcggtggtgcaactatcctatgggttctgttcgaaattgtggaataccatctcctgaccctggtttctcatgtgctgattgttgcactgaccatcttgttcctatggtccaatgccactgtctttatcaaaaagagtcctcctgatgttcctgaagtgcagatatctgaagatcttgctgtgaacattgcgctagcattgcgtgctgacatcaacaaggcacttgccttgcttcgggagattgctctgggccataacctgatgaagttcctaggggtgatcgttgccctttggattctatcagagataggagagctctgtgaactcctgagattcatgtacattgcggtcttgatcctccatacggtgccgatattgtaccacaagtatcaggaccaggtggacgatttcgctgcaaaggcacacagggagctctgcaagcagtacaaggtcctggacgccaaagttctgagcaagattccgagagctacaccaaaagataagaagcagaactag

SEQ ID NO: 7804 - protein, 232 aa, Sorghum bicolor
  misc_feature: Ceres ANNOT ID no. 6085329
  misc_feature (46)..(229): Pfam Id: Reticulon Pfam Desc: Reticulon
  misc_feature (33)..(230): NCBI GI: 78714222 NCBI Desc: reticulon [hordeum vulgare]
  misc_feature (2)..(230): NCBI GI: 20160502 NCBI Desc: osjnbb0021a09.5 [oryza sativa (japonica cultivar-group)]
  misc_feature (17)..(229): NCBI GI: 56381963 NCBI Desc: at3g61560 [arabidopsis thaliana]
  misc_feature (54)..(230): NCBI GI: 115435410 NCBI Desc: os01g0226300 [oryza sativa (japonica cultivar-group)]
  misc_feature (18)..(224): NCBI GI: 92874883 NCBI Desc: reticulon [medicago truncatula]
MASPAEETPAAEDTASPPPPPPARSRGFWFLGEDKSVHKALGGGKTADVLLWKDKKTSAAVVGGATILWVLFEIVEYHLLTLVSHVLIVALTILFLWSNATVFIKKSPPDVPEVQISEDLAVNIALALRADINKALALLREIALGHNLMKFLGVIVALWILSEIGELCELLRFMYIAVLILHTVPILYHKYQDQVDDFAAKAHRELCKQYKVLDAKVLSKIPRATPKDKKQN

SEQ ID NO: 7805 - DNA, 696 bp, Sorghum bicolor
  misc_feature: Ceres ANNOT ID no. 6085337
  misc_feature: Encodes the peptide sequence at SEQ ID NO 7806
atgcctcggtattactgtgactactgtgacacctacctgacccatgactcgccatctgtccggaagcaacacaacgctggatacaaacacaaggcgaatgttcgaacctactatcagcaatttgaggagcagcaaactcaaagtttaattgatcaaagaatcaaggagcatcttggacaagctgcagctttccaggcaggtgcccctttcaaccaacatatgctcacattcccaggagctgtggcccgtcctcgtcttccaattctgccaacccctggcatgcctcatggattccctcaagcacctggtgccccattgatgccaggagttagacctccgattttaccagctccaggtattccaggttatcctggtggtccaccaaccatgctgcaaccaggcgccccacctggctccatgccacaaccaggcgccccacctggctccatgccacaaccgggcgctccacctggttctatgccgatgcagatggccccactcccaaggcctccaacgttaccgcctccaacatctggagtcccaggtgcccccattcctaacagtgcagcacctccagcaatttaccaaacgaatccaccagcacctgcaggtccgacttctggtgctcctccagctccaccaactgctccacagcctgcgttctcctatgcgcagccatcagagggcaaccactga

SEQ ID NO: 7806 - protein, 231 aa, Sorghum bicolor
  misc_feature: Ceres ANNOT ID no. 6085337
  misc_feature (1)..(38): Pfam Id: zf-U1 Pfam Desc: U1 zinc finger
  misc_feature (1)..(176): NCBI GI: 62751087 NCBI Desc: similar to u1 small nuclear ribonucleoprotein c [lycopersicon esculentum]
  misc_feature (1)..(153): NCBI GI: 24648101 NCBI Desc: cg5454-pa [drosophila melanogaster]
  misc_feature (65)..(229): NCBI GI: 49250573 NCBI Desc: mgc69562 protein [xenopus tropicalis]
  misc_feature (1)..(170): NCBI GI: 62897757 NCBI Desc: small nuclear ribonucleoprotein polypeptide c variant [homo sapiens]
  misc_feature (3)..(170): NCBI GI: 56204353 NCBI Desc: small nuclear ribonucleoprotein polypeptide c [homo sapiens]
MPRYYCDYCDTYLTHDSPSVRKQHNAGYKHKANVRTYYQQFEEQQTQSLIDQRIKEHLGQAAAFQAGAPFNQHMLTFPGAVARPRLPILPTPGMPHGFPQAPGAPLMPGVRPPILPAPGIPGYPGGPPTMLQPGAPPGSMPQPGAPPGSMPQPGAPPGSMPMQMAPLPRPPTLPPPTSGVPGAPIPNSAAPPAIYQTNPPAPAGPTSGAPPAPPTAPQPAFSYAQPSEGNH

SEQ ID NO: 7807 - DNA, 1458 bp, Sorghum bicolor
  misc_feature: Ceres ANNOT ID no. 6085339
  misc_feature: Encodes the peptide sequence at SEQ ID NO 7808
atgccggggagccagaacggggggccgaggcctcggccggtcaaagccgagaccatccacggtcttgcgcgcgccggcgacctcgccggcgtccagaggaagctgcgggagaaccccgccctcctcaacgacaagaatcccgtgatgtgtcaaacaccacttcatgttgctgctggctacaataatacagaaatagtcaagttcttgcttaaccagcaaggtacagaaacagttgatctggaggcaaagaacatgtatggagagactcctctgcatatggcagtgaagaacagctcttgcggatcaacaaatctactccttgaacatggtgcacacatagaagccaaagccaataacggcatgacaccattgcatttagcagtctggcatgcacttcaagctggagactgcagcacggttagcgtgttactaagctacaacgcggattgctttgcaaaagatgatgaaggcaaaatgcccttaaatcatattccaggaggagctggtagtgagaagctgctgaaactcctcactcatcatatggaagagcaaagaaaaaagaaagctctcatgtcatgcgttgaagggcaagcaatgtcagagtttgaagaggcaatatcacaaattgttggattgcaggagctcaaaatgcaattgcgccgatgggcaaggggaatgctttttgatgagaagcgacgggctatgggcttagggattgctagaaggagagctccccatatggcatttcttggcaatccaggaactggcaaaactatggttgctcgaattcttggaaagctccttcacatggttggaattctccctactgacaaagtaactgaagttcagcgaactgatcttgttggagaattcgtggggcatactggaccgaagactaggaggaagatacaagacgcagagggaggtattctcttcgtggatgaagcttacaggttgataccaatgcaaaaatccgatgacaaggattatggtttagaagccttggaggagataatgtctgtaatggacagtggcaagatagttgtcatatttgctgggtactgtgatccaatgaagcgagtcatcacctcgaatgatggtttctgtaggcgggtcacaaaattcttctatttcgacgatttcagcacgacagaactagcagagatcctacatatgaagatgatgagcccaagtgagagtagcttgctttatgggtttaagctgcacccaagctgcagcattgaagtcattggagagctgattgccagagagaccactgaagagaggcggaaacagatgaatggaggccttgtagacacactgctcatcaatgcccgtgagaacctggattcacggcttgatttcaactgcgacgacactgatactatgatcacgatcatgttggaagacctggaagcagggcttcggcagatttccagacaacggcaattgcagtga

SEQ ID NO: 7808 - protein, 485 aa, Sorghum bicolor
  misc_feature: Ceres ANNOT ID no. 6085339
  misc_feature (49)..(85): Pfam Id: Ank Pfam Desc: Ankyrin repeat
  misc_feature (86)..(118): Pfam Id: Ank Pfam Desc: Ankyrin repeat
  misc_feature (119)..(155): Pfam Id: Ank Pfam Desc: Ankyrin repeat
  misc_feature (246)..(447): Pfam Id: AAA Pfam Desc: ATPase family associated with various cellular activities(AAA)
  misc_feature (203)..(473): NCBI GI: 16263937 NCBI Desc: probable cbbx protein [sinorhizobium meliloti 1021]
  misc_feature (190)..(471): NCBI GI: 116075371 NCBI Desc: probable rubisco-expression protein cbbx [synechococcus sp. rs9916]
  misc_feature (199)..(472): NCBI GI: 52080367 NCBI Desc: spovk [bacillus licheniformis atcc 14580]
  misc_feature (204)..(392): NCBI GI: 118072794 NCBI Desc: aaa atpase, central region [shewanella woodyi atcc 51908]
  misc_feature (203)..(396): NCBI GI: 113873269 NCBI Desc: probable cbbx protein [sinorhizobium medicae wsm419]
MPGSQNGGPRPRPVKAETIHGLARAGDLAGVQRKLRENPALLNDKNPVMCQTPLHVAAGYNNTEIVKFLLNQQGTETVDLEAKNMYGETPLHMAVKNSSCGSTNLLLEHGAHIEAKANNGMTPLHLAVWHALQAGDCSTVSVLLSYNADCFAKDDEGKMPLNHIPGGAGSEKLLKLLTHHMEEQRKKKALMSCVEGQAMSEFEEAISQIVGLQELKMQLRRWARGMLFDEKRRAMGLGIARRRAPHMAFLGNPGTGKTMVARILGKLLHMVGILPTDKVTEVQRTDLVGEFVGHTGPKTRRKIQDAEGGILFVDEAYRLIPMQKSDDKDYGLEALEEIMSVMDSGKIVVIFAGYCDPMKRVITSNDGFCRRVTKFFYFDDFSTTELAEILHMKMMSPSESSLLYGFKLHPSCSIEVIGELIARETTEERRKQMNGGLVDTLLINARENLDSRLDFNCDDTDTMITIMLEDLEAGLRQISRQRQLQ

SEQ ID NO: 7809 - DNA, 909 bp, Sorghum bicolor
  misc_feature: Ceres ANNOT ID no. 6085406
  misc_feature: Encodes the peptide sequence at SEQ ID NO 7810
atgtcatccgtccacttcttccctgcctcctcccagaccccggtccccgcccgcctcctcaaaacctccccaaagccacccctcccgtgcccccgcaccaccgctttccagagcgtcggcggcaattgcaatgcgtggcgcggcccgtacatacggctgcggcggagggtccgcaccccggcagcgccggccgacgcgccgcccgtgggccccgacggcgggagcgggggcggcggcgcggggggagggagcggaggggaggacgaggaggaggagggggagaagaaggagaagggattgttgcccgagtggatgaacttgaccacggaggacgccaagacggtgctggccgccgtggctatctcgctcgctttccgaaccttcgtcgccgagccgcgcttcatcccctcgctctccatgttccccaccttcgacgtcggcgaccgcatcgtcgccgagaaggttacttactactttaggaagccatgtgtcaatgatatagtaattttcaaaagccctccagtgctgcaggaggttgggtataccgataatgatgttttcatcaaaagagtagttgccagggagggcgatgttgttgaggttcaccaaggaaaacttgttgtgaatggtgaggctagaaatgaagaattcattcttgagccaccttcttatgacatgaaccctgtgcaagtacccgaaaactctgtttttgtgatgggagataaccgaaacaatagctatgattcacatgtgtggggccctcttccagcaaagaacatactggggagatcaatttttcggtattggcctcctggccgaatagggggtactaccaagggttgctttaaccctgaattagattctgaaacaaaaccaggatcgcttattgatgtcaaattgacaaagtag

SEQ ID NO: 7810 - protein, 302 aa, Sorghum bicolor
  misc_feature: Ceres ANNOT ID no. 6085406
  misc_feature (134)..(211): Pfam Id: Peptidase_S24 Pfam Desc: Peptidase S24-like
  misc_feature (12)..(281): NCBI GI: 51536582 NCBI Desc: at1g05140 [arabidopsis thaliana]
  misc_feature (75)..(295): NCBI GI: 144924728 NCBI Desc: peptidase s26a, signal peptidase i [medicago truncatula]
  misc_feature (87)..(275): NCBI GI: 126656044 NCBI Desc: leader peptidase i [cyanothece sp. ccy0110]
  misc_feature (141)..(277): NCBI GI: 71535009 NCBI Desc: chloroplast thylakoidal processing peptidase [medicago sativa]
  misc_feature (102)..(275): NCBI GI: 113475047 NCBI Desc: signal peptidase i [trichodesmium erythraeum ims101]
MSSVHFFPASSQTPVPARLLKTSPKPPLPCPRTTAFQSVGGNCNAWRGPYIRLRRRVRTPAAPADAPPVGPDGGSGGGGAGGGSGGEDEEEEGEKKEKGLLPEWMNLTTEDAKTVLAAVAISLAFRTFVAEPRFIPSLSMFPTFDVGDRIVAEKVTYYFRKPCVNDIVIFKSPPVLQEVGYTDNDVFIKRVVAREGDVVEVHQGKLVVNGEARNEEFILEPPSYDMNPVQVPENSVFVMGDNRNNSYDSHVWGPLPAKNILGRSIFRYWPPGRIGGTTKGCFNPELDSETKPGSLIDVKLTK

SEQ ID NO: 7811 - DNA, 1428 bp, Sorghum bicolor
  misc_feature: Ceres ANNOT ID no. 6085408
  misc_feature: Encodes the peptide sequence at SEQ ID NO 7812
atggacgcaggcacctactccatctcatcagagaagagccacaaggcggcgaaggcagcggcggcgccacggccgcctctccaggaggccggctctcagccctacatgccgtcgctgagcacggggtcgcgcaacccgtcggccaagtgctacggcgataggttcatcccagacaggtcggcgatggatatggacgtggcgcagtacctgctcacggagcccaggaaggacaaggagaacgcggcagcggcggcatccccatccaaggagatgtaccggaggctgctcgccgagaagctgctcaacaaccggacgcggatcctcgccttcaggaacaagccgcctgagcctgaaaacgtctcagcaaccatcgcggcttccgcccaccacgccaagccggccaagcagcggcgacacattccccagtctgctgagaggactctggacgcaccagagctcgttgatgactactacctcaacctccttgactgggggagcaacaacgtgctgtccattgctctgggcgacacggtgtacctgtgggatgcctccactggatccacgtctgagcttgtgaccatcgacgaggacagcggtcccatcaccagcgttagctgggctccagacggcaagcatatcgctgttgggctcaactcgtctgatgtccagctctgggacaccagctccaaccgactgttgagaactctcagaggtgtgcatgaggcaagagttggctcactggcatggaacaacagcatcctcaccactggcggcatggatggcaagatcgtgaacaacgacgtgaggattaggaaccatgtcgtgcagacgtacgaggggcacagtcaggaggtgtgtgggctcaagtggtctggatcagggcagcagctggccagcgggggtaatgacaaccttctgcacatttgggacgtgtcgatggcatcctccatgccatccgctggccgcaaccagtggctgcacaggcttgaggaccacacagctgctgttaaggcactcgcatggtgtccgttccagagcaacttgctggcaaccggtggtggtggtagtgatagatgcatcaagttttggaacacgcacaccggtgcatgtctgaactctgttgacaccggatcacaggtctgtgcccttctctggaacaagaatgagagagagctgctgagttcacacggatttacacagaaccagctaacattgtggaagtacccatcaatggtaaagatggctgaactcactggccatacttctcgtgtccttttcatggctcagagccctgatggttgcacagtagcatcagccgctgcagatgagacccttcggttctggaacgtgtttggagcccctgaagcgcccaagccggtcaaggcttcccacactgggatgttcaacagcttcaaccatatccgatag

SEQ ID NO: 7812 - protein, 475 aa, Sorghum bicolor
  misc_feature: Ceres ANNOT ID no. 6085408
  misc_feature (188)..(226): Pfam Id: WD40 Pfam Desc: WD domain, G-beta repeat
  misc_feature (272)..(310): Pfam Id: WD40 Pfam Desc: WD domain, G-beta repeat
  misc_feature (411)..(449): Pfam Id: WD40 Pfam Desc: WD domain, G-beta repeat
  misc_feature (1)..(474): NCBI GI: 38345769 NCBI Desc: osjnba0083n12.7 [oryza sativa (japonica cultivar-group)]
  misc_feature (1)..(429): NCBI GI: 115460308 NCBI Desc: os04g0599800 [oryza sativa (japonica cultivar-group)]
  misc_feature (1)..(474): NCBI GI: 7270275 NCBI Desc: wd-repeat protein-like protein [arabidopsis thaliana]
  misc_feature (16)..(429): NCBI GI: 115478106 NCBI Desc: os09g0242300 [oryza sativa (japonica cultivar-group)]
  misc_feature (53)..(474): NCBI GI: 15240441 NCBI Desc: wd-40 repeat family protein [arabidopsis thaliana]
  misc_feature: Useful for making plants with modulated biomass
  misc_feature: Functional homolog of the protein sequence given in SEQ ID NO 13536
  misc_feature: The sequence is a functional homolog of SEQ ID NO. 502 in the 11/188,298 US application
MDAGTYSISSEKSHKAAKAAAAPRPPLQEAGSQPYMPSLSTGSRNPSAKCYGDRFIPDRSAMDMDVAQYLLTEPRKDKENAAAAASPSKEMYRRLLAEKLLNNRTRILAFRNKPPEPENVSATIAASAHHAKPAKQRRHIPQSAERTLDAPELVDDYYLNLLDWGSNNVLSIALGDTVYLWDASTGSTSELVTIDEDSGPITSVSWAPDGKHIAVGLNSSDVQLWDTSSNRLLRTLRGVHEARVGSLAWNNSILTTGGMDGKIVNNDVRIRNHVVQTYEGHSQEVCGLKWSGSGQQLASGGNDNLLHIWDVSMASSMPSAGRNQWLHRLEDHTAAVKALAWCPFQSNLLATGGGGSDRCIKFWNTHTGACLNSVDTGSQVCALLWNKNERELLSSHGFTQNQLTLWKYPSMVKMAELTGHTSRVLFMAQSPDGCTVASAAADETLRFWNVFGAPEAPKPVKASHTGMFNSFNHIR

SEQ ID NO: 7813 - DNA, 1092 bp, Sorghum bicolor
  misc_feature: Ceres ANNOT ID no. 6085457
  misc_feature: Encodes the peptide sequence at SEQ ID NO 7814
atggcgagagctgagatgctccgcctcgcgctgtgcctcgtggcctccgcactggccgccaccggtgccggcggagcgaggaagacgattggggtgtacgagctcaggcatggggatttctccgtcaagatcaccaactggggcaccacgatcatgtcggtcattctccccgactccaaagggaacttggctgatgtcgtccttggcaaggacactatcgctgaatacattaacgacacttctttcttcggcccggtggccgggcgcgtagcagggagaattgccaggggccggttcgtcctcgacgggaaagtataccatctggacatcaacgacggcaggaatacgcttcaaggtggcggcagaggattcaacaaagtcatctggacggtgaaggagtacgtcgccggcggcgactccccgtacgtcaccctatactatcgcagcttcgacggagagcaaggtttcccgggtgacctggacgtgtacgtgacgtaccgtctgtcgccgtacgagctgggcgtgcacatgaacgcgacggcgctgggcagggcgacgccggtgaacctcctgcagcacacgtactggaacctgggcgggcacggcgccggcgacgtgctgggccacacgctccggctccacgcgtcgcgctacaccccgctggacgccgagatgctgccgtcgtcgggccgcggcgccgcgcccgtcgccggcacgcccttcgacttcctcgcgccgacgcccatcggcgcgcgcatccgcggcgtcgtcgggggccgcgtgcccgggtacgacgccaactacgtcgtcgatggggagcccggcgagatgcggcccgtggcacgggccttggacggcgcgtccggcaggacgctggagctgtggggcaaccagccggcgatgcagctctacacggccaactggctcaaccacaccaaggggaaaggcggcgcggtgtacgagcggtacggggggttctgcctggagacgcaggggtaccccgacgccgtgaaccaccctgagttcccgtcgcagatcgtcaggcctggccaggtgtacaggcacgacatggtcttcaagttctcgttctag

SEQ ID NO: 7814 - protein, 363 aa, Sorghum bicolor
  misc_feature: Ceres ANNOT ID no. 6085457
  misc_feature (31)..(360): Pfam Id: Aldose_epim Pfam Desc: Aldose 1-epimerase
  misc_feature (1)..(363): NCBI GI: 38567884 NCBI Desc: osjnba0036b21.19 [oryza sativa (japonica cultivar-group)]
  misc_feature (1)..(363): NCBI GI: 115458758 NCBI Desc: os04g0458600 [oryza sativa (japonica cultivar-group)]
  misc_feature (1)..(363): NCBI GI: 115458754 NCBI Desc: os04g0458300 [oryza sativa (japonica cultivar-group)]
  misc_feature (1)..(363): NCBI GI: 116310050 NCBI Desc: osigba0097p08.2 [oryza sativa (indica cultivar-group)]
  misc_feature (120)..(363): NCBI GI: 38567883 NCBI Desc: osjnba0036b21.18 [oryza sativa (japonica cultivar-group)]
  misc_feature: Abnormal phyllotaxy, leaf number higher than wild-type
  misc_feature: The plant flowers significantly late compared to wild-type.
  misc_feature: The plant is abnormally large.
  misc_feature: The plant is abnormally small.
  misc_feature: The plant produces a reduced number of seeds.
  misc_feature: Useful for biocontainment applications
  misc_feature: Useful for making plants with altered oil content
  misc_feature: Useful for making plants with modulated biomass
  misc_feature: Useful for making plants with modulated flowering time
  misc_feature: Useful for making plants with modulated heat sensitivity
  misc_feature: Useful for making plants with modulated drought sensitivity
  misc_feature: Functional homolog of the protein sequence given in SEQ ID NO 13360
  misc_feature: Functional homolog of the protein sequence given in SEQ ID NO 13434
  misc_feature: Functional homolog of the protein sequence given in SEQ ID NO 13443
  misc_feature: Functional homolog of the protein sequence given in SEQ ID NO 13446
MARAEMLRLALCLVASALAATGAGGARKTIGVYELRHGDFSVKITNWGTTIMSVILPDSKGNLADVVLGKDTIAEYINDTSFFGPVAGRVAGRIARGRFVLDGKVYHLDINDGRNTLQGGGRGFNKVIWTVKEYVAGGDSPYVTLYYRSFDGEQGFPGDLDVYVTYRLSPYELGVHMNATALGRATPVNLLQHTYWNLGGHGAGDVLGHTLRLHASRYTPLDAEMLPSSGRGAAPVAGTPFDFLAPTPIGARIRGVVGGRVPGYDANYVVDGEPGEMRPVARALDGASGRTLELWGNQPAMQLYTANWLNHTKGKGGAVYERYGGFCLETQGYPDAVNHPEFPSQIVRPGQVYRHDMVFKFSF

SEQ ID NO: 7815 - DNA, 741 bp, Sorghum bicolor
  misc_feature: Ceres ANNOT ID no. 6085492
  misc_feature: Encodes the peptide sequence at SEQ ID NO 7816
atgcagcggatttcgctgcgacttctgcgctcctccgccgccgccgccgcctccaccacctcctcgtccctccgcggcctggcagtactccgcggcggttggcccgcccgaccggcgctgcagcctccggcgcgaaccgcggcgccggccgacctcacccggtggccgccgcggaggggttactcccagttcgccagcgggttcaccccgctgaagccgaagccgctgggatccatcctcgacatcgaacgcgccaagggcctctcccccgagcacctcgtcgccgcctgggatgactatcatttaggaaggggtcatataggtgcatctatgaaagcgaagctttaccatctcttggaacaaagatcagattcatgccgacactttgttattcctttgtggaagggaagtggatacaccactatgttcatgcaagtccagatgccatacattatcttcacaggacttgaagactataaagcacgaggcactcaagcaagtccttactacacagtcactcattacacagagttttcagagaccaaggacacggtacttattcgaggagatgttgttttcaccagcaaactaactgattcagaggcaaagactcttctagagacagctcactcgttctacctgaatgatgtgaggtacagactcgtggagcgattcaacaaagagacccatgattttgagttccgagatgtccttcaagtgcttgatatgccaaccatgtga

SEQ ID NO: 7816 - protein, 246 aa, Sorghum bicolor
  misc_feature: Ceres ANNOT ID no. 6085492
  misc_feature (2)..(245): Pfam Id: ATP11 Pfam Desc: ATP11 protein
  misc_feature (1)..(145): NCBI GI: 115445749 NCBI Desc: os02g0312700 [oryza sativa (japonica cultivar-group)]
  misc_feature (67)..(242): NCBI GI: 55960825 NCBI Desc: atp synthase mitochondrial f1 complex assembly factor 1 [homo sapiens]
  misc_feature (67)..(242): NCBI GI: 119627301 NCBI Desc: atp synthase mitochondrial f1 complex assembly factor 1, isoform cra_a [homo sapiens]
  misc_feature (57)..(242): NCBI GI: 108873863 NCBI Desc: chaperone atp11p [aedes aegypti]
  misc_feature (60)..(242): NCBI GI: 30794370 NCBI Desc: atp synthase mitochondrial f1 complex assembly factor 1 [mus musculus]
MQRISLRLLRSSAAAAASTTSSSLRGLAVLRGGWPARPALQPPARTAAPADLTRWPPRRGYSQFASGFTPLKPKPLGSILDIERAKGLSPEHLVAAWDDYHLGRGHIGASMKAKLYHLLEQRSDSCRHFVIPLWKGSGYTTMFMQVQMPYIIFTGLEDYKARGTQASPYYTVTHYTEFSETKDTVLIRGDVVFTSKLTDSEAKTLLETAHSFYLNDVRYRLVERFNKETHDFEFRDVLQVLDMPTM

SEQ ID NO: 7817 - DNA, 777 bp, Sorghum bicolor
  misc_feature: Ceres ANNOT ID no. 6085511
  misc_feature: Encodes the peptide sequence at SEQ ID NO 7818
atggctcaagctcgagtcttcacgctcttggtgctcgcagctgccggttgggtgtcggccatggcagctaatgctccggcaccaaccgggtggctgaaggcacatgccaccttctacggaggcgctgatgcctccgacaccatgggcggcgcgtgcgggtacggcaacctcttctcacagggctacggcacgcggacggcggcgctgagcacggtgctcttcaacgacggcgcctcatgcgggcagtgctacaagatcgcgtgtgaccgcaagagagccgaccccatgttctgtaaacctggtgtcacggtgaccatcacggccaccaacttctgcccgcctaacatggcgctgcctgagggcggctggtgcaatcagcagcgcccgcactttgacatggcgcagccggcgtttgagaaaatcggcgtctacagcggcggcatcatccccgtcatgtacaagagagttccttgcgtgaagcgaggtggagtcaggttcacaatcaatgggcatgactacttcaatcttgtgcttgtgaccaatgttgcggctgccggctccatcaagtccatggatgtcaagagctcgaattcgaccgaatggaccccaatggcacgaaactggggcgcaaactggcactctctggcctatctcacagggcaactgctctcgttcagagtcaccgacacggatggacaaactattgaattcacaaacgtggtgccacagggatggaagtttggccaaacatttgcatccaagttgcagttcaagtga

SEQ ID NO: 7818 - protein, 258 aa, Sorghum bicolor
  misc_feature: Ceres ANNOT ID no. 6085511
  misc_feature (164)..(242): Pfam Id: Pollen_allerg_1 Pfam Desc: Pollen allergen
  misc_feature (66)..(153): Pfam Id: DPBB_1 Pfam Desc: Rare lipoprotein A (RlpA)-like double-psi beta-barrel
  misc_feature (1)..(258): NCBI GI: 50251490 NCBI Desc: alpha-expansin osexpa23 [oryza sativa (japonica cultivar-group)]
  misc_feature (1)..(258): NCBI GI: 16517056 NCBI Desc: alpha-expansin osexpa23 [oryza sativa]
  misc_feature (1)..(258): NCBI GI: 115502182 NCBI Desc: expansin-a23 precursor (osexpa23) (alpha-expansin-23) (osexp23) (osaexpa1.12)
  misc_feature (6)..(258): NCBI GI: 67037391 NCBI Desc: alpha-expansin 23 [oryza sativa (japonica cultivar-group)]
  misc_feature (1)..(258): NCBI GI: 16517039 NCBI Desc: alpha-expansin osexpa14 [oryza sativa]
  misc_feature: Useful for making plants with altered Lignin content
  misc_feature: Useful for making plants with altered cell wall content and/or composition
  misc_feature: Functional homolog of the protein sequence given in SEQ ID NO 12888
  misc_feature: Useful for making plants with altered carbohydrate content
  misc_feature: Functional homolog of the protein sequence given in SEQ ID NO 13784
  misc_feature: Useful for making plants with altered cell wall content and/or composition
  misc_feature: Functional homolog of the protein sequence given in SEQ ID NO 14001
  misc_feature: Useful for making plants with altered lignin content
  misc_feature: Functional homolog of the protein sequence given in SEQ ID NO 12888
MAQARVFTLLVLAAAGWVSAMAANAPAPTGWLKAHATFYGGADASDTMGGACGYGNLFSQGYGTRTAALSTVLFNDGASCGQCYKIACDRKRADPMFCKPGVTVTITATNFCPPNMALPEGGWCNQQRPHFDMAQPAFEKIGVYSGGIIPVMYKRVPCVKRGGVRFTINGHDYFNLVLVTNVAAAGSIKSMDVKSSNSTEWTPMARNWGANWHSLAYLTGQLLSFRVTDTDGQTIEFTNVVPQGWKFGQTFASKLQFK

SEQ ID NO: 7819 - DNA, 300 bp, Sorghum bicolor
  misc_feature: Ceres ANNOT ID no. 6085566
  misc_feature: Encodes the peptide sequence at SEQ ID NO 7820
atgttggaggggaaggcgcgggtggaggacacggacatgccggcgcggatgcaggcggcggccaccacggcggcgtcccgcgcgctcgatctcttcgacgtcgccgacttccgcggcatcgccggccacatcaagacggagttcgacaagcggtacggcgtggggtggcagtgcgtggtgggcgccagcttcgggtgcttcttcacccacaccagcggcaccttcatctacttctccctcgagcgcctctccttcctcctcttcaaggccgccgccgccgtcgccgtcgccgcctcctaa

SEQ ID NO: 7820 - protein, 99 aa, Sorghum bicolor
  misc_feature: Ceres ANNOT ID no. 6085566
  misc_feature (1)..(91): Pfam Id: Dynein_light Pfam Desc: Dynein light chain type 1
  misc_feature (1)..(99): NCBI GI: 50251496 NCBI Desc: dynein light chain type 1-like [oryza sativa (japonica cultivar-group)]
  misc_feature (1)..(93): NCBI GI: 92896477 NCBI Desc: dynein light chain, type 1 [medicago truncatula]
  misc_feature (8)..(93): NCBI GI: 114215596 NCBI Desc: dynein light chain [oryza sativa (indica cultivar-group)]
  misc_feature (5)..(96): NCBI GI: 140069144 NCBI Desc: dynein light chain, type 1 [medicago truncatula]
  misc_feature (1)..(90): NCBI GI: 2208914 NCBI Desc: outer arm dynein lc6 [anthocidaris crassispina]
MLEGKARVEDTDMPARMQAAATTAASRALDLFDVADFRGIAGHIKTEFDKRYGVGWQCVVGASFGCFFTHTSGTFIYFSLERLSFLLFKAAAAVAVAAS

SEQ ID NO: 7821 - DNA, 753 bp, Sorghum bicolor
  misc_feature: Ceres ANNOT ID no. 6085592
  misc_feature: Encodes the peptide sequence at SEQ ID NO 7822
atgacgctggcggcggggctggggtacgccctgatcgcgctgggccccgctttctccctcttcgccggcgtcgtcgccaggaagcccttcctcgtcctcaccctcctctccagcaccttgttttggcttataagtttgatagtcctctcgggaatatggaggggatttcttcctataaaatcagaagcttggtgggcatatgcaattctgatccttacatctgtcgcattgcaagaaggcactcgtcttgtgttttggaggctttacaagaaaatggaagagatgctagatgcttttgctgatagaatatccaagccacgtcttagtttgactgacaagatgctcatttctttagctggtggtttaggccatggagtggctcatgcagtctttttctgtctcagtcttttgactccagcgtttggtcgagccacattttatattgaaacatgctcaaagatgccatttttccttgcttcagccctaattgcacttggattcttggtcatccatacgttctcaatgattattgcttttaatgcatatgatgagagaaagaaaagtgatcaggtttttgttccagttattcatttggctgctgctgtgatgacacttgttaacctcgccccaggaggctgtctcattggtaccccactgttgttggtcatggctgcgctgaccttgcagcactgctggcgagtggcatgccagagattaactgagcaccggcatcagcagcacaacagcaactag

SEQ ID NO: 7822 - protein, 250 aa, Sorghum bicolor
  misc_feature: Ceres ANNOT ID no. 6085592
  misc_feature (1)..(243): Pfam Id: Aph-1 Pfam Desc: Aph-1 protein
  misc_feature (1)..(249): NCBI GI: 50252282 NCBI Desc: presenilin stabilization factor-like [oryza sativa (japonica cultivar-group)]
  misc_feature (1)..(235): NCBI GI: 55236032 NCBI Desc: ensangp00000015809 [anopheles gambiae str. pest]
  misc_feature (1)..(235): NCBI GI: 20129183 NCBI Desc: cg2855-pa [drosophila melanogaster]
  misc_feature (1)..(207): NCBI GI: 54644318 NCBI Desc: ga15487-pa [drosophila pseudoobscura]
  misc_feature (1)..(231): NCBI GI: 37682171 NCBI Desc: anterior pharynx defective 1b-like [danio rerio]
MTLAAGLGYALIALGPAFSLFAGVVARKPFLVLTLLSSTLFWLISLIVLSGIWRGFLPIKSEAWWAYAILILTSVALQEGTRLVFWRLYKKMEEMLDAFADRISKPRLSLTDKMLISLAGGLGHGVAHAVFFCLSLLTPAFGRATFYIETCSKMPFFLASALIALGFLVIHTFSMIIAFNAYDERKKSDQVFVPVIHLAAAVMTLVNLAPGGCLIGTPLLLVMAALTLQHCWRVACQRLTEHRHQQHNSN

SEQ ID NO: 7823 - DNA, 2184 bp, Sorghum bicolor
  misc_feature: Ceres ANNOT ID no. 6085656
  misc_feature: Encodes the peptide sequence at SEQ ID NO 7824
atggcggcggggtcgatccgggtcaccatggaggtgggcgccgacggcgtcgcgctcatcaccatcgccaacccgcccgtcaacgcgctccaccccatcatcatcgccgggctcaaggacaagtacgcggaggccatgcgccgtgacgacgtcaaggccatcgtgctcactggtgctggaggcaagttctgtggaggatttgatatcaacgtcttcacaaaggttcatcagactggggatgtatcacttatgccggacgtatccgtcgagcttgtgtcaaacatgatggaagagggcaaaaaaccttctgttgcagccattcaaggtcttgcgctgggtggtggcctagagttgattatgggttgtcatgctcggatatctactcctgaagctcaacttggattgccagagctaacccttggcatcatccctggatttggaggtacccagcgtctgccgaggcttgtaggtctacccaaagcgattgaaatgatgctgcaaagtaagttcattacggcaaaggaagggaaggaacgtggtttgattgatgctctttgctctcctgatgaattgataaagacatcacgtctttgggctctggaaattgctaattgccgtaaaccttggatgagatctcttggcagaacagataggcttggatcactatctgaagctcgtgctgtattaaatgcagcaagacagcaagcaatgaagattgcaccaaacatgccacagcaccaggcctgccttgatgtaatggaagaaggcatattatatggaggtcaagctggtgttttgaaggaagccaaggttttcaaggagctggtgatagcaccaacatcaaaggctcttgtccatgttttctttgcacaacgttcgacaacaaaggtgccaggtgtaactgatgttcaactgaaaccaaggccaattagaaaagttgcagttattggtggtggtctgatgggctctggaattgctacatcacttcttgttagcaacatttctgttgtgctcaaggaagtaaaccctcagtttctgcaaaggggagagaaaatgatagcaggcaatcttgagggcctggtcaaaagaggttcgcttacaaaggataggatgcacaaggccatgtcgcttctcaagggtgctttggattattcagatttcaaggatgttgatatggttattgaggctgttatcgagaagattcctttgaagcaatcaatattttctgacattgagaaaatctgtccaaaacattgcatacttgcgacaaacacatccaccattgatttgaatgttgttggcgagaagacaaattctcaagatagaattataggggctcactttttcagccctgctcatattatgcctttgcttgaaattgtccggacggagaagacatcaccacaagctatccttgatctcatcaccgttgggaagataataaagaaagtcccagttgtggtcggcaactgcacaggatttgcagtcaaccgtacattttttccttacacacagggttctcatcttctagttagtcttggtattgatgttttcagaattgatcgagtaataagtagcttcggcatgccaatgggaccttttcaactccaagatgtggctgggtatggagtggccttggcagtaaaaggtatctacgctgatgcctttggagaaagaaatttgaactctaaccttgtggacttgatggtaaaggatggacgacagggaaaggtgaatggcaaaggttactacatttatgagaagggcgggaagccaaagccagaccctagtgttaagcatgtgcttgaggagtaccaaaagcaggcaaacacaatgcctggtggaaagcctgttactttaacggatcaagatattttggagatgattttcttcccagttgtgaatgaggcatgcagggttatggatgaaaatgttgtaattcgagcttctgatcttgatattgcttctgttcttggaatgggctttcccaaatacaggggtggtcttgtcttctgggctgacactgttggagcaccttacatacattcgaagctaagcaagtgggctgaaatttatggtcccttcttcaaaccatcatcgtatttggaacaacgagctaaaagtggtgtaccattgagtgcaaaaggagcatcacagcaaggttcagcgaggtcacgcatgtga

SEQ ID NO: 7824 - protein, 727 aa, Sorghum bicolor
  misc_feature: Ceres ANNOT ID no. 6085656
  misc_feature (312)..(491): Pfam Id: 3HCDH_N Pfam Desc: 3-hydroxyacyl-CoA dehydrogenase, NAD binding domain
  misc_feature (18)..(187): Pfam Id: ECH Pfam Desc: Enoyl-CoA hydratase/isomerase family
  misc_feature (493)..(586): Pfam Id: 3HCDH Pfam Desc: 3-hydroxyacyl-CoA dehydrogenase, C-terminal domain
  misc_feature (3)..(727): NCBI GI: 47848048 NCBI Desc: peroxisomal fatty acid beta-oxidation multifunctional protein [oryza sativa (japonica cultivar-group)]
  misc_feature (3)..(727): NCBI GI: 116257652 NCBI Desc: peroxisomal fatty acid beta-oxidation multifunctional protein (mfp) [includes: enoyl-coa hydratase ; 3-2-trans-enoyl-coa isomerase ; 3-hydroxybutyryl-coa epimerase ;
  misc_feature (3)..(727): NCBI GI: 116257652 (continued) 3-hydroxyacyl-coa dehydrogenase ]
  misc_feature (10)..(727): NCBI GI: 33338559 NCBI Desc: multifunctional protein [oryza sativa]
  misc_feature (3)..(727): NCBI GI: 17105223 NCBI Desc: peroxisomal multifunctional protein [oryza sativa]
  misc_feature (5)..(727): NCBI GI: 92874519 NCBI Desc: iq calmodulin-binding region; fatty oxidation complex, alpha subunit fadj [medicago truncatula]
MAAGSIRVTMEVGADGVALITIANPPVNALHPIIIAGLKDKYAEAMRRDDVKAIVLTGAGGKFCGGFDINVFTKVHQTGDVSLMPDVSVELVSNMMEEGKKPSVAAIQGLALGGGLELIMGCHARISTPEAQLGLPELTLGIIPGFGGTQRLPRLVGLPKAIEMMLQSKFITAKEGKERGLIDALCSPDELIKTSRLWALEIANCRKPWMRSLGRTDRLGSLSEARAVLNAARQQAMKIAPNMPQHQACLDVMEEGILYGGQAGVLKEAKVFKELVIAPTSKALVHVFFAQRSTTKVPGVTDVQLKPRPIRKVAVIGGGLMGSGIATSLLVSNISVVLKEVNPQFLQRGEKMIAGNLEGLVKRGSLTKDRMHKAMSLLKGALDYSDFKDVDMVIEAVIEKIPLKQSIFSDIEKICPKHCILATNTSTIDLNVVGEKTNSQDRIIGAHFFSPAHIMPLLEIVRTEKTSPQAILDLITVGKIIKKVPVVVGNCTGFAVNRTFFPYTQGSHLLVSLGIDVFRIDRVISSFGMPMGPFQLQDVAGYGVALAVKGIYADAFGERNLNSNLVDLMVKDGRQGKVNGKGYYIYEKGGKPKPDPSVKHVLEEYQKQANTMPGGKPVTLTDQDILEMIFFPVVNEACRVMDENVVIRASDLDIASVLGMGFPKYRGGLVFWADTVGAPYIHSKLSKWAEIYGPFFKPSSYLEQRAKSGVPLSAKGASQQGSARSRM

SEQ ID NO: 7825 - DNA, 1473 bp, Sorghum bicolor
  misc_feature: Ceres ANNOT ID no. 6085661
  misc_feature: Encodes the peptide sequence at SEQ ID NO 7826
atgcggtggaagcttaactcctccgtctacaagcgcgtgccgtccagggaaaccgccatggaacccgacgtcgagacgccaatgagaatgacggacggcggcggcggaggcggaggcggtggtggcgctgggccatcgtggcgcatgtccttgccgcatgtctgcgtcgccacgctcacatcgttcctcttcggataccactccggggtggtgaacgagcccttggagagcatctccgctgaccttggcttctctggcaacacgcttgctgaagggctcgtggtgagtatctgcttgggaggagcttttgttgggtgcctcttcagcggctccatcgctgatgggattgggcgacgccgtgcgttccagctcagtgcactgcctatgatcattggtgctgccataagtgctctcaccaatagtttggagggtatgctcttcggaagatttttggtaggaacagggatgggattgggtccaccagttgcttcactttatataacggaggtttctcctcctacagtgaggggtacatatggtagctttgttcagattgcaacctgccttggaattatagtatcactcctaattggtacacctgtcaaagatatcgatagatggtggagagtgtgtttctgggttgccactatcccagcgactttacaagctcttggtatggagttttgtgctgagagcccccagtggctctataagtgtggaagaataagtgaagcagagatgcaatttgaaaagctcctaggcccccttcatgtaaaatctgccatggcagaactttctagatctgaaagaggagatgatggagaaagtgtgaagtactcagagctgttctatggtcgccactttaatgttgtttttattggcacaacgctctttgctttacaacagttatccggcataaattctgtgttctatttctcatcaactgtgttcagaagtgtgggggtgccctctaaccttgccaacatatgcatggggatttcaaatctatcaggatcaattgtagcaatgcttctaatggacaagctaggtagaaaagtgctgctttcagggagtttccttgggatggcttttgcaatggggcttcaggctgttggagcaaaccgtcagtctcttggttctacaagtgtatatctttcagttggtggcattctgttgtttgtcttgtcattttcactaggagcaggcccagtcccaggacttcttttgcctgagattttccccaataaaatccgagctaaggctatggctctctgcatgtctgtacattggatcgtgaacttctttgttagtttgctgttcttgcgtcttctggagcaacttggtccacagcttctctacacaatattttcgtcagtctgcgtggtagcctcaatatttgtgcggcgccatgtggtagaaacaaagggaaagactttacaagagatagaagtttcactcctgcaaccacaataa

SEQ ID NO: 7826 - protein, 490 aa, Sorghum bicolor
  misc_feature: Ceres ANNOT ID no. 6085661
  misc_feature (53)..(486): Pfam Id: Sugar_tr Pfam Desc: Sugar (and other) transporter
  misc_feature (57)..(437): Pfam Id: MFS_1 Pfam Desc: Major Facilitator Superfamily
  misc_feature (7)..(490): NCBI GI: 27261731 NCBI Desc: sugar transporter [citrus unshiu]
  misc_feature (6)..(490): NCBI GI: 92896490 NCBI Desc: sugar transporter [medicago truncatula]
  misc_feature (61)..(487): NCBI GI: 7715596 NCBI Desc: f20b17.24 [arabidopsis thaliana]
  misc_feature (11)..(288): NCBI GI: 79321503 NCBI Desc: carbohydrate transporter/ sugar porter [arabidopsis thaliana]
  misc_feature (44)..(486): NCBI GI: 8347246 NCBI Desc: hexose transporter [solanum tuberosum]
  misc_feature: The sequence is a functional homolog of SEQ ID NO. 331 in the 11/188,298 US application
  misc_feature: The sequence is a functional homolog of SEQ ID NO. 488 in the 11/188,298 US application
  misc_feature: The sequence is a functional homolog of SEQ ID NO. 449 in the 11/188,298 US application
  misc_feature: The sequence is a functional homolog of SEQ ID NO. 296 in the 11/188,298 US application
MRWKLNSSVYKRVPSRETAMEPDVETPMRMTDGGGGGGGGGGAGPSWRMSLPHVCVATLTSFLFGYHSGVVNEPLESISADLGFSGNTLAEGLVVSICLGGAFVGCLFSGSIADGIGRRRAFQLSALPMIIGAAISALTNSLEGMLFGRFLVGTGMGLGPPVASLYITEVSPPTVRGTYGSFVQIATCLGIIVSLLIGTPVKDIDRWWRVCFWVATIPATLQALGMEFCAESPQWLYKCGRISEAEMQFEKLLGPLHVKSAMAELSRSERGDDGESVKYSELFYGRHFNVVFIGTTLFALQQLSGINSVFYFSSTVFRSVGVPSNLANICMGISNLSGSIVAMLLMDKLGRKVLLSGSFLGMAFAMGLQAVGANRQSLGSTSVYLSVGGILLFVLSFSLGAGPVPGLLLPEIFPNKIRAKAMALCMSVHWIVNFFVSLLFLRLLEQLGPQLLYTIFSSVCVVASIFVRRHVVETKGKTLQEIEVSLLQPQ

SEQ ID NO: 7827 - DNA, 459 bp, Sorghum bicolor
  misc_feature: Ceres ANNOT ID no. 6085666
  misc_feature: Encodes the peptide sequence at SEQ ID NO 7828
atggcagctgaggaagacgtcaaacagaggcagattgttgaaaatcgtgcgagaaatataagccacaatgttcggtgcactgagtgtggtagccaatcaattgaagattcacaggctgatgttgctattctgcttaggaagctcattcgtgatgaaataaaagcaggaaagagtgataaagagatctacaagaaactagaggatgagtatggggagacagtgctatatgcccctaaatttgatcttcagactgctgggatatggctttcacctgtcattgtgggtggtatagcagctggcatctgggcttaccaaaagcacaggcaaaggacaaatgttcacattatggctctgaacctggtccgaggggtaccactgactcctagggagaaggagaccatgttagacatccttacacctccaccgcctccaaggaaatggtggtggccaggcaaatga

SEQ ID NO: 7828 - protein, 152 aa, Sorghum bicolor
  misc_feature: Ceres ANNOT ID no. 6085666
  misc_feature (1)..(139): Pfam Id: CcmH Pfam Desc: Cytochrome C biogenesis protein
  misc_feature (1)..(152): NCBI GI: 47848060 NCBI Desc: cytochrome c biogenesis protein-like [oryza sativa (japonica cultivar-group)]
  misc_feature (5)..(146): NCBI GI: 90423345 NCBI Desc: cytochrome c biogenesis protein [rhodopseudomonas palustris bisb18]
  misc_feature (14)..(145): NCBI GI: 115523948 NCBI Desc: cytochrome c biogenesis protein [rhodopseudomonas palustris bisa53]
  misc_feature (5)..(110): NCBI GI: 92116993 NCBI Desc: cytochrome c biogenesis protein [nitrobacter hamburgensis x14]
  misc_feature (14)..(110): NCBI GI: 39934991 NCBI Desc: cycl cytochrome c-type biogenesis protein [rhodopseudomonas palustris cga009]
MAAEEDVKQRQIVENRARNISHNVRCTECGSQSIEDSQADVAILLRKLIRDEIKAGKSDKEIYKKLEDEYGETVLYAPKFDLQTAGIWLSPVIVGGIAAGIWAYQKHRQRTNVHIMALNLVRGVPLTPREKETMLDILTPPPPPRKWWWPGK

SEQ ID NO: 7829 - DNA, 1812 bp, Sorghum bicolor
  misc_feature: Ceres ANNOT ID no. 6085667
  misc_feature: Encodes the peptide sequence at SEQ ID NO 7830
atggagaagcaggccggaagcggtggtggaaaggcggccggcgtggctgcggccaagcagcagcgttcctcggccgccgtgttctcacatgcggcggcggccgagctccggctcgaggccatcacgaggaggtggtggccgttgagaagccgcacgacgatgaggaccgtctgcgtcgttgcggtggccgtgaccgccgctgccatcgtgctaaccgccggcggctgggcctcctcgccgaacgagatgccgacctcctcgtttttcgacgcacgtctcctgagggttgacatgccactaattattaatagtaaaattagtgattgctccgaccctccgttgaacatcaccgacgagcattttctcgacggccttcttaccgccgatttcagctacatgtcgtgccgaagtcgctacgagttcgccgcctaccacaagaaatcgtcgcacaagccatccccatacctcatctccaagctccggaagcaagaagcgctccaaaagcgatgcggccctggaacggccgcgcacaagaaggcggtccggcggctcgactccggcgagggcgtcgtcgacgatgacgacggctgccgctacctcgtctacatcagctaccgtggcctcggcaaccgcatgctcgccatcgcgtcgaccttcctctatgcggtgctcaccgagcgcgtcctcctcgtcgacggtggcaaggacgccgacgcgctcttctgcgagccctttccggggacgacgtggctgctaccgcgacccggctggttgtccttctccccgctcaggagactccagggctacgagggtggctccaaggagagcctcggcagcatgctgcagagcggcggcatcaccgtgtccgccgacgggaacgcgtcgtggtcgtcggcgccgcggccgccgtacctgtacctccacctctccggcaccgacgaattccacgacaagctcttcttctgcggcgcgcaccagcgactcctcggcgaggtgccgtggctcttcatgtggacggataactacatcgtgccgggactcttcctcacgccgacgttcagcggcgagctcgaggccatgttcccggagaaggacgccgtgttctaccacctcggacggtacctcttccacccgacaaaccgcgtgtggcacgccatcaagagctactaccacgacaaccttgccggcgtcggccagcgcgtcggcgtgcagatcagggtgttccagaagaagcagccgccacagtccgtgctggaccagctcctctcgtgcctccgcgacgagaagctcctgccggagacgacggacgcggcgggcggcaacggcacgccctcgcgcgccgtcctgttgacgtcgctgagctcgtggtactacgaccggatcagggacgagtacggcggcagggtcgccggcggcgtgcaccagccgagccatgaggggcggcagcggtggcgcgacgcggcacacgacatgaaggcgctgagcgagatgtacctgctcagcatgtgcgacgtgctcgtcaccagcggcttctccacgttcgggtacgtcgcgcaggggctcgccgggctgcgcccctgggtgatgcccagggcgccaatgtgggctgccaactggatggaggagctggaccagggagacctcccatgccggcgggcagtctccgtcgagccgtgcttccacgcaccgtcggcctacgactgcgcggcggcgagggaggtggacctggacaaggtttcgccatacatcagccactgcgtggacgtcaaatacggcataaagcttgtcaacgaaagcagcggacagtggtga

SEQ ID NO: 7830 - protein, 603 aa, Sorghum bicolor
  misc_feature: Ceres ANNOT ID no. 6085667
  misc_feature (83)..(570): Pfam Id: XG_FTase Pfam Desc: Xyloglucan fucosyltransferase
  misc_feature (253)..(603): NCBI GI: 115448871 NCBI Desc: os02g0764400 [oryza sativa (japonica cultivar-group)]
  misc_feature (122)..(597): NCBI GI: 115467050 NCBI Desc: os06g0212500 [oryza sativa (japonica cultivar-group)]
  misc_feature (115)..(596): NCBI GI: 5231145 NCBI Desc: xyloglucan fucosyltransferase [arabidopsis thaliana]
  misc_feature (114)..(597): NCBI GI: 7453579 NCBI Desc: xyloglucan fucosyltransferase [pisum sativum]
  misc_feature (49)..(441): NCBI GI: 115458656 NCBI Desc: os04g0449100 [oryza sativa (japonica cultivar-group)]
  misc_feature: Useful for making plants with altered cell wall content and/or composition
  misc_feature: Functional homolog of the protein sequence encoded by LOCUS at2g03220
MEKQAGSGGGKAAGVAAAKQQRSSAAVFSHAAAAELRLEAITRRWWPLRSRTTMRTVCVVAVAVTAAAIVLTAGGWASSPNEMPTSSFFDARLLRVDMPLIINSKISDCSDPPLNITDEHFLDGLLTADFSYMSCRSRYEFAAYHKKSSHKPSPYLISKLRKQEALQKRCGPGTAAHKKAVRRLDSGEGVVDDDDGCRYLVYISYRGLGNRMLAIASTFLYAVLTERVLLVDGGKDADALFCEPFPGTTWLLPRPGWLSFSPLRRLQGYEGGSKESLGSMLQSGGITVSADGNASWSSAPRPPYLYLHLSGTDEFHDKLFFCGAHQRLLGEVPWLFMWTDNYIVPGLFLTPTFSGELEAMFPEKDAVFYHLGRYLFHPTNRVWHAIKSYYHDNLAGVGQRVGVQIRVFQKKQPPQSVLDQLLSCLRDEKLLPETTDAAGGNGTPSRAVLLTSLSSWYYDRIRDEYGGRVAGGVHQPSHEGRQRWRDAAHDMKALSEMYLLSMCDVLVTSGFSTFGYVAQGLAGLRPWVMPRAPMWAANWMEELDQGDLPCRRAVSVEPCFHAPSAYDCAAAREVDLDKVSPYISHCVDVKYGIKLVNESSGQW

SEQ ID NO: 7831 - DNA, 588 bp, Sorghum bicolor
  misc_feature: Ceres ANNOT ID no. 6085756
  misc_feature: Encodes the peptide sequence at SEQ ID NO 7832
atggcgcctacgacgatgtggagcgagactgcaatgctcgtcatcgacatgcagaaggaattcgtggatccggcaatgagcagcccagcgctgcttcccgccggcgaggccatcatccctgcggtcaccgaggccgtcgccgtcgctcggcagcgcggcatcttcatcgtctgggttgtgagagagcatgaccctacaggaagagatgttgaactgtttcgcaggcacttttattctagggggagtggtccggctgtaaaaggttccaaaggtgcagagctggccgaggggtttgttatcaaggacggggagtacaagctggtgaagggaagattcagctctttctttgccaccaacctcgattctgtcctcaaaacttcagggatcaagaacttggttgtaactggggtccaaacaccaaactgcatcaggcagactgtcttcgatgctgtcgcactggactatgagaaagttacagttattattgatgctacagctgctgctaatccagaaatacatttggctaacatcagggatatgaagaacattggagttgaaacaccaaccttggaagaatggcgtcactag

SEQ ID NO: 7832 - protein, 195 aa, Sorghum bicolor
  misc_feature: Ceres ANNOT ID no. 6085756
  misc_feature (8)..(195): Pfam Id: Isochorismatase Pfam Desc: Isochorismatase family
  misc_feature (7)..(194): NCBI GI: 115445527 NCBI Desc: os02g0276200 [oryza sativa (japonica cultivar-group)]
  misc_feature (7)..(194): NCBI GI: 50252495 NCBI Desc: isochorismatase hydrolase-like [oryza sativa (japonica cultivar-group)]
  misc_feature (7)..(194): NCBI GI: 115445529 NCBI Desc: os02g0276400 [oryza sativa (japonica cultivar-group)]
  misc_feature (7)..(174): NCBI GI: 50252493 NCBI Desc: isochorismatase hydrolase-like [oryza sativa (japonica cultivar-group)]
  misc_feature (12)..(193): NCBI GI: 116750067 NCBI Desc: isochorismatase hydrolase [syntrophobacter fumaroxidans mpob]
MAPTTMWSETAMLVIDMQKEFVDPAMSSPALLPAGEAIIPAVTEAVAVARQRGIFIVWVVREHDPTGRDVELFRRHFYSRGSGPAVKGSKGAELAEGFVIKDGEYKLVKGRFSSFFATNLDSVLKTSGIKNLVVTGVQTPNCIRQTVFDAVALDYEKVTVIIDATAAANPEIHLANIRDMKNIGVETPTLEEWRH

SEQ ID NO: 7833 - DNA, 1497 bp, Sorghum bicolor
  misc_feature: Ceres ANNOT ID no. 6085794
  misc_feature: Encodes the peptide sequence at SEQ ID NO 7834
atggcccgcgggttgtggctcatctcccgcgcggtggggaggctgcggccactgcttgtccaggggccgacgaggagcttctctgcctccgcaccggagcagctccatgtctgcgtcgttggcagcggccccgctgggttctacaccgccgacaggatgttgaagggtcatgaaggagcacaggttgatataattgataggctacccacgccatttggcctagtccgttctggagtggctccagatcatccagaaacaaagattgtggtgaatcaattttctcgtgtagctgcaaatgggcgctgttcattctttgggaatgtaactctgggaagggatatatctctgtcagagcttcgcaaaacatatcatgctgttgttcttgcttatggtgcagaaagtgataggtcacttggtattcctggagaggacctgaaaggaattcattcagctcgagagtttgtctggtggtacaatggacatccagacatgtgcgacttgtgtcctgatttgaaaaacacagaatctgctgttgtccttggtcagggaaatgttgctctagatgttgctcgtattcttttacgctgtaaagctgagttggctactacagacattactgattatgcattggatgctctacgtggcagcacaataaggaaggtatatttggttgggcgacggggtccagtgcaggcagcttgcactgcaaaggaattgcgtgaaattttaggtttgaaaaatgttcgtatttgcatcaaggaaactgatctggtgaccacacctgcagatgaggaggagatgaggaatagtagaatccaaagaagagtttatgagttgctgttgaaagctgcaagtgcacatgggggaaacaattacaatgaccaaaaggagcttcattttgtgtttttcaggaggcctaccaggttcatccctgcagaaaatggttccacgattggtgctgttcaacttgagaagacagttttaaaaggtgatgaagtaactgggaagcaggtcgctgttggagctggtgagtttgaagacctaaaatgtggtctggtcttgaaaagtattggttacaaatccttgcctgtacaaggtttgcctttcgacaaaaacagaggagttgtgccaaatttaagaggaagagtcctgagcagcgaatcagagattgccacagtagaaagaggcttgtacgtggtaggatggttaaagagaggaccaactgggattgttgcaacaaatcttcactgtgctgaagaaacagtggctagcattcttgaagatgataagaagggtgtattaaggcccccatctggttcgaagaagcatggaaggacaggacttcttgagatcctagaacaaaagaatgtccgttttgtgccattcagtggctgggagaagattgattccatggaaaagatggcaggggaggtgagaaataagcctagagagaagatcacaacctgggatgggctccaaaaagctgcaaacgagtaa

SEQ ID NO: 7834 - protein, 498 aa, Sorghum bicolor
  misc_feature: Ceres ANNOT ID no. 6085794
  misc_feature (36)..(408): Pfam Id: Pyr_redox_2 Pfam Desc: Pyridine nucleotide-disulphide oxidoreductase
  misc_feature (24)..(496): NCBI GI: 28192433 NCBI Desc: nadp adrenodoxin-like ferredoxin reductase [arabidopsis thaliana]
  misc_feature (181)..(496): NCBI GI: 7270140 NCBI Desc: ferredoxin-nadp+ reductase-like protein [arabidopsis thaliana]
  misc_feature (33)..(360): NCBI GI: 144924832 NCBI Desc: nad-binding site [medicago truncatula]
  misc_feature (5)..(486): NCBI GI: 18202431 NCBI Desc: nadph:adrenodoxin oxidoreductase, mitochondrial precursor (adrenodoxin reductase) (ar) (ferredoxin--nadp(+) reductase)
  misc_feature (22)..(486): NCBI GI: 61372884 NCBI Desc: ferredoxin reductase [synthetic construct]
MARGLWLISRAVGRLRPLLVQGPTRSFSASAPEQLHVCVVGSGPAGFYTADRMLKGHEGAQVDIIDRLPTPFGLVRSGVAPDHPETKIVVNQFSRVAANGRCSFFGNVTLGRDISLSELRKTYHAVVLAYGAESDRSLGIPGEDLKGIHSAREFVWWYNGHPDMCDLCPDLKNTESAVVLGQGNVALDVARILLRCKAELATTDITDYALDALRGSTIRKVYLVGRRGPVQAACTAKELREILGLKNVRICIKETDLVTTPADEEEMRNSRIQRRVYELLLKAASAHGGNNYNDQKELHFVFFRRPTRFIPAENGSTIGAVQLEKTVLKGDEVTGKQVAVGAGEFEDLKCGLVLKSIGYKSLPVQGLPFDKNRGVVPNLRGRVLSSESEIATVERGLYVVGWLKRGPTGIVATNLHCAEETVASILEDDKKGVLRPPSGSKKHGRTGLLEILEQKNVRFVPFSGWEKIDSMEKMAGEVRNKPREKITTWDGLQKAANE

SEQ ID NO: 7835 - DNA, 1374 bp, Sorghum bicolor
  misc_feature: Ceres ANNOT ID no. 6085903
  misc_feature: Encodes the peptide sequence at SEQ ID NO 7836
atggggctggagatggaggcgatggcggcgtcgatcggcgtgtcggtgcccgtgctccggttcctgctctgcttcgcggccaccatcccgacgggcctcctgtggcgcgcggtgcccggcgccacggggcgtcacctctacgcggggctcacgggtgccacgctctcctacctctccttcgggccctcgtccaacctcctcttcgtcgtgcccatgacgctcggttaccttgccatgctcttgtcccgtcgccacgccgggctcatcaccttcctcggcgccttcggcttcctcatcgcatgtcatgtgtactacatgagcggggatgcatggaaggagggaggcattgatgcaactggcgctttaatggttttaacgctgaaagtcatttcatgcgcaataaactacagtgatggtatcttgaaggaagagggtttacgcgatgctcagaaaaaataccgactgactaagcttccttctctaattgaatattttgggtactgtctctgttgtgggagccattttgctggaccggtatatgagatgaaagattatcttgattggactgagaggaaaggaatatgggctagcccaactccttcgccattgttacctactttgcgtgctctagttcaggctggtgtatgcatggggttatatttatacctgtcacctaaatttccactctcacggtttagtgagcccttatattatgaatggggtttctggcaccgactcttctatcagtacatgtcaggcttcactgctcgttggaaatattactttatatggtcaatttcagaagcctcaattatcatatctggtctgggctttactggttggtcagaatcttctcccccgaaagccaaatgggatcgtgcgaaaaatgttgatgtattaggtgttgaattagctggaagtgcagttcaaattccccttgtgtggaatattcaagtgagcacatggttacgatactatgtctatgagaggctaattcagaaaggaaagaaaccaggtttccttcagttgttgggtacacagacagtcagcgccatctggcatggactgtatcctggatatatcatattctttgttcagtcagcattgatgataaatggttcacgagttatatacagatggcagcaagcagtgagcagttcattcctccgcggtatcctggcttttctaaattttgcttatacattgctggtgcttaactactcctgcatcgggttcctggtactgagcttcaaagaaaccttggcgtcctaccagagcgtatattatgttggcacaattgttcccattgtgtttctcctgctgggcaatgttatcaagccagcaaggaaggcgaaggctcggaagaccgagtga

SEQ ID NO: 7836 - protein, 457 aa, Sorghum bicolor
  misc_feature: Ceres ANNOT ID no. 6085903
  misc_feature (103)..(417): Pfam Id: MBOAT Pfam Desc: MBOAT family
  misc_feature (1)..(457): NCBI GI: 50253260 NCBI Desc: membrane bound o-acyl transferase-like [oryza sativa (japonica cultivar-group)]
  misc_feature (3)..(457): NCBI GI: 22329514 NCBI Desc: membrane bound o-acyl transferase (mboat) family protein [arabidopsis thaliana]
  misc_feature (8)..(457): NCBI GI: 9502387 NCBI Desc: t12c24.17 [arabidopsis thaliana]
  misc_feature (13)..(438): NCBI GI: 119467776 NCBI Desc: mboat family protein [neosartorya fischeri nrrl 181]
  misc_feature (19)..(457): NCBI GI: 56207871 NCBI Desc: novel protein similar to mouse and human o-acyltransferase (membrane bound) domain containing 2 (oact2) [danio rerio]
MGLEMEAMAASIGVSVPVLRFLLCFAATIPTGLLWRAVPGATGRHLYAGLTGATLSYLSFGPSSNLLFVVPMTLGYLAMLLSRRHAGLITFLGAFGFLIACHVYYMSGDAWKEGGIDATGALMVLTLKVISCAINYSDGILKEEGLRDAQKKYRLTKLPSLIEYFGYCLCCGSHFAGPVYEMKDYLDWTERKGIWASPTPSPLLPTLRALVQAGVCMGLYLYLSPKFPLSRFSEPLYYEWGFWHRLFYQYMSGFTARWKYYFIWSISEASIIISGLGFTGWSESSPPKAKWDRAKNVDVLGVELAGSAVQIPLVWNIQVSTWLRYYVYERLIQKGKKPGFLQLLGTQTVSAIWHGLYPGYIIFFVQSALMINGSRVIYRWQQAVSSSFLRGILAFLNFAYTLLVLNYSCIGFLVLSFKETLASYQSVYYVGTIVPIVFLLLGNVIKPARKAKARKTE

SEQ ID NO: 7837 - DNA, 753 bp, Sorghum bicolor
  misc_feature: Ceres ANNOT ID no. 6085912
  misc_feature: Encodes the peptide sequence at SEQ ID NO 7838
atgctccgacacacgttcctcctcccccccgctcgccacggccaccaccacacccgcccttcacccatggacgccgcatccttcagcgactactcctctggaacgccgtcccctgtcggtggcgtcagcggcggcgtggacggcgacgacggcggctcctcctcgtcgtacatgacggtgtcgtcggcgccgccgaagcggcgagccgggcggaccaagttcaaggagacgcggcaccccgtgtacaagggcgtgcggcggaggaaccccgggaggtgggtctgcgaggtgcgggagccgcacggcaagcagcggatatggctcgggaccttcgagaccgccgagatggcggcgcgcgcgcacgacgtcgccgcgctcgcgctgcgggggcgcgccgcctgcctcaacttcgcagactcgccgcggctcctcagggtgccgcccatgggctccggccatgacgagatacgccgggcggccgccgtcgcggcggaccagttccggccggcgcctgatcgtcagggcaatgtggccaccgccgaggaggcggcggatactacgccgctggatgcgacgacgcagagcgtagtcgatgacccgtactgcattatcgacgacaggctcgacttcgggatgcaggggtacctcgacatggcgcaagggatgctcattgatccaccacccatggctggttcgtccaccagtggcggtgacgacgatgacgacggtgaggtcaagctctggagctactga

SEQ ID NO: 7838 - protein, 250 aa, Sorghum bicolor
  misc_feature: Ceres ANNOT ID no. 6085912
  misc_feature (80)..(131): Pfam Id: AP2 Pfam Desc: AP2 domain
  misc_feature (23)..(250): NCBI GI: 19071243 NCBI Desc: crt/dre binding factor 1 [hordeum vulgare subsp. vulgare]
  misc_feature (29)..(250): NCBI GI: 38605941 NCBI Desc: osjnba0019k04.2 [oryza sativa (japonica cultivar-group)]
  misc_feature (29)..(250): NCBI GI: 32455222 NCBI Desc: transcription factor [oryza sativa (japonica cultivar-group)]
  misc_feature (32)..(250): NCBI GI: 60593403 NCBI Desc: tacbf11 [triticum aestivum]
  misc_feature (29)..(250): NCBI GI: 60547489 NCBI Desc: hvcbf11 [hordeum vulgare subsp. vulgare]
  misc_feature: The sequence is a functional homolog of SEQ ID NO 1223 in the 10/374,780US patent application
  misc_feature: The sequence is a functional homolog of SEQ ID NO 1224 in the 10/374,780US patent application
  misc_feature: The sequence is a functional homolog of SEQ ID NO 1225 in the 10/374,780US patent application
  misc_feature: The sequence is a functional homolog of SEQ ID NO 1227 in the 10/374,780US patent application
  misc_feature: The sequence is a functional homolog of SEQ ID NO 1232 in the 10/374,780US patent application
  misc_feature: The sequence is a functional homolog of SEQ ID NO 1238 in the 10/374,780US patent application
  misc_feature: The sequence is a functional homolog of SEQ ID NO 1239 in the 10/374,780US patent application
  misc_feature: The sequence is a functional homolog of SEQ ID NO 1243 in the 10/374,780US patent application
  misc_feature: The sequence is a functional homolog of SEQ ID NO 1314 in the 11/479,226US patent application
  misc_feature: The sequence is a functional homolog of SEQ ID NO 1412 in the 10/412,699US patent application
  misc_feature: The sequence is a functional homolog of SEQ ID NO 1413 in the 10/412,699US patent application
  misc_feature: The sequence is a functional homolog of SEQ ID NO 16 in the 10/225,068US patent application
  misc_feature: The sequence is a functional homolog of SEQ ID NO 1720 in the 10/412,699US patent application
  misc_feature: The sequence is a functional homolog of SEQ ID NO 1722 in the 10/412,699US patent application
  misc_feature: The sequence is a functional homolog of SEQ ID NO 186 in the 10/374,780US patent application
  misc_feature: The sequence is a functional homolog of SEQ ID NO 190 in the 11/375,241US patent application
  misc_feature: The sequence is a functional homolog of SEQ ID NO 192 in the 11/375,241US patent application
  misc_feature: The sequence is a functional homolog of SEQ ID NO 1956 in the 10/374,780US patent application
  misc_feature: The sequence is a functional homolog of SEQ ID NO 1958 in the 10/374,780US patent application
  misc_feature: The sequence is a functional homolog of SEQ ID NO 196 in the 11/375,241US patent application
  misc_feature: The sequence is a functional homolog of SEQ ID NO 2239 in the 10/666,642US patent application
  misc_feature: The sequence is a functional homolog of SEQ ID NO 2241 in the 10/666,642US patent application
  misc_feature: The sequence is a functional homolog of SEQ ID NO 422 in the 10/714,887US patent application
  misc_feature: The sequence is a functional homolog of SEQ ID NO 424 in the 10/714,887US patent application
  misc_feature: The sequence is a functional homolog of SEQ ID NO 44 in the 10/412,699US patent application
  misc_feature: The sequence is a functional homolog of SEQ ID NO 46 in the 10/412,699US patent application
  misc_feature: The sequence is a functional homolog of SEQ ID NO 516 in the 11/435,388US patent application
  misc_feature: The sequence is a functional homolog of SEQ ID NO 55 in the 10/838,616US patent application
  misc_feature: The sequence is a functional homolog of SEQ ID NO 566 in the 10/225,066US patent application
  misc_feature: The sequence is a functional homolog of SEQ ID NO 57 in the 10/838,616US patent application
  misc_feature: The sequence is a functional homolog of SEQ ID NO 574 in the 11/435,388US patent application
  misc_feature: The sequence is a functional homolog of SEQ ID NO 576 in the 11/435,388US patent application
  misc_feature: The sequence is a functional homolog of SEQ ID NO 616 in the 10/412,699US patent application
  misc_feature: The sequence is a functional homolog of SEQ ID NO 692 in the 11/435,388US patent application
  misc_feature: The sequence is a functional homolog of SEQ ID NO 698 in the 11/435,388US patent application
  misc_feature: The sequence is a functional homolog of SEQ ID NO 70 in the 10/669,824US patent application
  misc_feature: The sequence is a functional homolog of SEQ ID NO 70 in the 10/870,198US patent application
  misc_feature: The sequence is a functional homolog of SEQ ID NO 702 in the 11/435,388US patent application
  misc_feature: The sequence is a functional homolog of SEQ ID NO 706 in the 11/435,388US patent application
  misc_feature: The sequence is a functional homolog of SEQ ID NO 710 in the 11/435,388US patent application
  misc_feature: The sequence is a functional homolog of SEQ ID NO 716 in the 11/435,388US patent application
  misc_feature: The sequence is a functional homolog of SEQ ID NO 718 in the 11/435,388US patent application
  misc_feature: The sequence is a functional homolog of SEQ ID NO 72 in the 10/669,824US patent application
  misc_feature: The sequence is a functional homolog of SEQ ID NO 72 in the 10/870,198US patent application
  misc_feature: The sequence is a functional homolog of SEQ ID NO 764 in the 11/435,388US patent application
  misc_feature: The sequence is a functional homolog of SEQ ID NO 768 in the 11/435,388US patent application
  misc_feature: The sequence is a functional homolog of SEQ ID NO 770 in the 11/435,388US patent application
  misc_feature: The sequence is a functional homolog of SEQ ID NO 776 in the 11/435,388US patent application
  misc_feature: The sequence is a functional homolog of SEQ ID NO 778 in the 11/435,388US patent application
  misc_feature: The sequence is a functional homolog of SEQ ID NO 780 in the 11/435,388US patent application
  misc_feature: The sequence is a functional homolog of SEQ ID NO 96 in the 10/675,852US patent application
  misc_feature: The sequence is a functional homolog of SEQ ID NO 98 in the 10/675,852US patent application
  misc_feature: Useful for making plants with modulated drought sensitivity
  misc_feature: Useful for making plants with modulated growth and phenotype characteristics
  misc_feature: Useful for making plants with modulated low light sensitivity
  misc_feature: Useful for making plants with modulated seed size
  misc_feature: Useful for making plants with modulated nitrogen use efficiency
  misc_feature: Functional homolog of the protein sequence given in SEQ ID NO 13481
  misc_feature: Functional homolog of the protein sequence given in SEQ ID NO 13482
  misc_feature: Functional homolog of the protein sequence given in SEQ ID NO 13485
  misc_feature: The sequence is a functional homolog of SEQ ID NO 1412 in the 20040045049 US patent application
  misc_feature: The sequence is a functional homolog of SEQ ID NO 1413 in the 20040045049 US patent application
  misc_feature: The sequence is a functional homolog of SEQ ID NO 1720 in the 20040045049 US patent application
  misc_feature: The sequence is a functional homolog of SEQ ID NO 1722 in the 20040045049 US patent application
  misc_feature: The sequence is a functional homolog of SEQ ID NO 616 in the 20040045049 US patent application
  misc_feature: The sequence is a functional homolog of SEQ ID NO 1225 in the 20060162006 US patent application
  misc_feature: The sequence is a functional homolog of SEQ ID NO 1227 in the 20060162006 US patent application
  misc_feature: The sequence is a functional homolog of SEQ ID NO 1232 in the 20060162006 US patent application
  misc_feature: The sequence is a functional homolog of SEQ ID NO 1238 in the 20060162006 US patent application
  misc_feature: The sequence is a functional homolog of SEQ ID NO 1239 in the 20060162006 US patent application
  misc_feature: The sequence is a functional homolog of SEQ ID NO 1243 in the 20060162006 US patent application
  misc_feature: The sequence is a functional homolog of SEQ ID NO 692 in the 20060272060 US patent application
  misc_feature: The sequence is a functional homolog of SEQ ID NO 698 in the 20060272060 US patent application
  misc_feature: The sequence is a functional homolog of SEQ ID NO 702 in the 20060272060 US patent application
  misc_feature: The sequence is a functional homolog of SEQ ID NO 776 in the 20060272060 US patent application
  misc_feature: The sequence is a functional homolog of SEQ ID NO 778 in the 20060272060 US patent application
  misc_feature: The sequence is a functional homolog of SEQ ID NO 780 in the 20060272060 US patent application
  misc_feature: Useful for making plants with modulated water use efficiency
  misc_feature: Functional homolog of the protein sequence given in SEQ ID NO 13860
  misc_feature: The sequence is a functional homolog of SEQ ID NO 1232 in the 10/374,780 US patent application
  misc_feature: The sequence is a functional homolog of SEQ ID NO 718 in the 11/435,388 US patent application
  misc_feature: The sequence is a functional homolog of SEQ ID NO 1223 in the 10/374,780 US patent application
  misc_feature: The sequence is a functional homolog of SEQ ID NO 1412 in the 10/412,699 US patent application
  misc_feature: The sequence is a functional homolog of SEQ ID NO 716 in the 11/435,388 US patent application
  misc_feature: The sequence is a functional homolog of SEQ ID NO 1239 in the 10/374,780 US patent application
  misc_feature: The sequence is a functional homolog of SEQ ID NO 764 in the 11/435,388 US patent application
  misc_feature: The sequence is a functional homolog of SEQ ID NO 4 in US patent 7317141
  misc_feature: The sequence is a functional homolog of SEQ ID NO 750 in the 11/435,388 US patent application
  misc_feature: The sequence is a functional homolog of SEQ ID NO 1245 in the 10/374,780 US patent application
  misc_feature: Useful for making plants with altered terpenoid content
  misc_feature: Useful for making plants with modulated flowering time
  misc_feature: Functional homolog of the protein sequence given in SEQ ID NO 13195
  misc_feature: The sequence is a functional homolog of SEQ ID NO 1248 in the 10/374,780 US patent application
MLRHTFLLPPARHGHHHTRPSPMDAASFSDYSSGTPSPVGGVSGGVDGDDGGSSSSYMTVSSAPPKRRAGRTKFKETRHPVYKGVRRRNPGRWVCEVREPHGKQRIWLGTFETAEMAARAHDVAALALRGRAACLNFADSPRLLRVPPMGSGHDEIRRAAAVAADQFRPAPDRQGNVATAEEAADTTPLDATTQSVVDDPYCIIDDRLDFGMQGYLDMAQGMLIDPPPMAGSSTSGGDDDDDGEVKLWSY

SEQ ID NO: 7839 - DNA, 1068 bp, Sorghum bicolor
  misc_feature: Ceres ANNOT ID no. 6085914
  misc_feature: Encodes the peptide sequence at SEQ ID NO 7840
atggacatagagaccgacgggcgattcggcaacaagcgagtgcaccatcgcctcggcccgggctccggcggtgctccgtcatctaccaacggcaaggtctgcaactactggcgcgccgggcggtgcaaccgtttcccgtgccccttcctccacagcgagctccccgaggctgcgccgcccaagcgccccagtggacccggggggaacgtctggcgcaacccccacaccggaggaagaggcggcggcggcggcggtcacagtagatgggggaagggccccggaggcggcagcgggattgtgagccacaagccgcctgacaggccctgcaagttctttctcgccggtaccgaatgcagctatggcgagaggtgccgctatccgcacagctactgcataagcgatagtgtcacgatgcttaccccgctcaagggccatgagaagggtgttacgggcattgcattacccgcggggtcagacaagctgtattccggtagtaaggatggaactgttcgcatgtgggattgccaaactggccagtgtgccggtatcatccctgttggtcgtgaggttgggtgcatgatcattgaaggtccatggttatttgttggaatgcctgatgcagtgaaggtttggaatatgcaaacagcagcggaaatgagccttaccggaccaactgggcaagtctatgcactcgccgttgccagtgagttactctttgctgcaacacaagacgggaggattttagcatggagatttagtgctgcaactaactgttttgaaccagctgcttctcttgatggccataagcttgctgttgtttcattgatagtaggaggcatgaggctttattctgcttcgatggataaaactatcagagtatgggatttggcaacactgcagtgcatacagactctttctgatcataccgatgttgttatgtctgtgctgtgctgggatcaatttctattatcttgctctttggatcaaacaataaaagtttgggcagctacagagagtggaaacttagaagtaacatatacgcacaaagaagatcagtctgtattgtga

SEQ ID NO: 7840 - protein, 355 aa, Sorghum bicolor
  misc_feature: Ceres ANNOT ID no. 6085914
  misc_feature (136)..(174): Pfam Id: WD40 Pfam Desc: WD domain, G-beta repeat
  misc_feature (259)..(295): Pfam Id: WD40 Pfam Desc: WD domain, G-beta repeat
  misc_feature (299)..(335): Pfam Id: WD40 Pfam Desc: WD domain, G-beta repeat
  misc_feature (104)..(130): Pfam Id: zf-CCCH Pfam Desc: Zinc finger C-x8-C-x5-C-x3-H type (and similar)
  misc_feature (1)..(333): NCBI GI: 115447899 NCBI Desc: os02g0677700 [oryza sativa (japonica cultivar-group)]
  misc_feature (1)..(355): NCBI GI: 12057166 NCBI Desc: zfwd2 protein [arabidopsis thaliana]
  misc_feature (1)..(355): NCBI GI: 12057164 NCBI Desc: zfwd1 protein [arabidopsis thaliana]
  misc_feature (104)..(354): NCBI GI: 12057168 NCBI Desc: zfwd3 protein [arabidopsis thaliana]
  misc_feature (180)..(354): NCBI GI: 115434986 NCBI Desc: os01g0187500 [oryza sativa (japonica cultivar-group)]
  misc_feature: The plant is abnormally small.
  misc_feature: Useful for making plants with altered terpenoid content
  misc_feature: Useful for making plants with modulated biomass
  misc_feature: GREAT-hit functional homolog of the protein sequence given in SEQ ID NO 12972
  misc_feature: GREAT-hit functional homolog of the protein sequence given in SEQ ID NO 13137
  misc_feature: Useful for making plants with altered terpenoid content
  misc_feature: Functional homolog of the protein sequence given in SEQ ID NO 13137
  misc_feature: Useful for making plants with modulated biomass
  misc_feature: Functional homolog of the protein sequence given in SEQ ID NO 12972
  misc_feature: The sequence is a functional homolog of SEQ ID NO. 485 in the 11/188,298 US application
MDIETDGRFGNKRVHHRLGPGSGGAPSSTNGKVCNYWRAGRCNRFPCPFLHSELPEAAPPKRPSGPGGNVWRNPHTGGRGGGGGGHSRWGKGPGGGSGIVSHKPPDRPCKFFLAGTECSYGERCRYPHSYCISDSVTMLTPLKGHEKGVTGIALPAGSDKLYSGSKDGTVRMWDCQTGQCAGIIPVGREVGCMIIEGPWLFVGMPDAVKVWNMQTAAEMSLTGPTGQVYALAVASELLFAATQDGRILAWRFSAATNCFEPAASLDGHKLAVVSLIVGGMRLYSASMDKTIRVWDLATLQCIQTLSDHTDVVMSVLCWDQFLLSCSLDQTIKVWAATESGNLEVTYTHKEDQSVL

SEQ ID NO: 7841 - DNA, 2091 bp, Sorghum bicolor
  misc_feature: Ceres ANNOT ID no. 6085915
  misc_feature: Encodes the peptide sequence at SEQ ID NO 7842
  misc_feature: Up-regulated in root tissues in response to salicylic acid treatment
  misc_feature: Up-regulated in shoot tissues in response to salicylic acid treatment
atggttaatttcggtaagaaattgatggcagaccagttggaggagtggcgagaatattatattaattataagatgatgaagaaaaaggtgaaacagtatgtacagcagacccaaactggtggaaaaaatcgtgaccaggttcttaaggagttctcaaggatgcttgatgaccagattgaaaaggttgtactatttcttctgcaacaacaaggtcatcttgctaggaggatcgagaaattaggagtacagcgtgccatgcttatgcaacagtctgatgtatcccaaatttgtcaactacgccaggcttacagggaagttgggtatgatcttgtgaagctacttaggtttcttgatatgaatgctactggtatccggaagatacttaagaagttcgataagcgctttggctataagttcacagattattacgtctctactcgagcaaaccatccttattctcagcttcagcagatcttcaagcaagtgggagtcgtcgccgttgttggtgctttgtctcgcaaccttgcttatctacaagatcatcaaggatacttagcaaatatctatgattacccatcactcatcttgaaggatcccgtcatagaacaaataaatcattcagtacagaaactcacacactccacaagctttctgcaatttttagggcaacatgcacttatcgttccggaggatatgcagagtggctcagatctcgatgatgacaaggattaccatttcctgtcactgctgctaaacttagtaaacacgtttctgtacatggttaacacatacatcatcgttccaactgctgatgactattcagtgagcctcggagctgcagcgactgtttgcggtgtgattatcggatcaatggcagtcgcccaaatcttctcctcagtatatttcagtgcctggtcgaacaaatcgtacttcagacccctggtatttagcagcattatgctatttctggggaacctgttgtatgctttggcatatgatcttaattccctaactgctcttattgtcggtcgactactgtgcggtttgggttcggccagagccgtgaaccgccgctacatcagcgactgtgtacccctgaaaagcaggatgcaggcatctgctgggtttgtcagtgctagtgctcttggaatggcatgtggtcctggtcttgccggtctgctgcagacaaaatttaagatctatgggcttacattcaatcagaacaccttacctgggtgggtcatgtgtgttgcttggcttgcatatttgttctggttgtggatttcattcaaagagccaggccatattgcttcagagaattcagtcaacacgcagtcatctgattctggccgtccagtaagcggtaatttggaggatggcgtcagagagcctttgctcatagatgcgaaggcaggaccggatgacgatgttgaggacaatgacgacaacgatgacgaccccgaggaatctcatagacccgcgacatcgcttgctgcagcatacagattgctgacaccatctgtgaaggttcagctactgatctactttatgctcaagttcgccatggaaatcctactctcggagtcaagtgttgtgaccacgttctatttcaagtggacaactagtaccgtggcaatctttctagcagttcttggcctgacggttcttcccgttaatgtcatcgtcgggagctatgtcaccaacttgttccaggacaggcaaattctggtggcctccgagatcatggtgttgatcggcattgtcatgagcttccgcttcacccctcactactccgttccccaatatgtcacgtcagctctcatcaccttcgtattcgccgaggtgctcgaaggagtgaacctgtccctcctctctcgcgtgatgtcgtcgaggctctcccgcgggacctacaacggcgggctgctctcgacggaggccggaacgctggcccgcgtcgccgccgacatgactatcacggcggcgggcaacctggggcagagccgcctcctgaacgccaccctcctgccgtccctggtgatctgtttagcctctatcgtcgcgacgttctgcacttacaactcactctactga

SEQ ID NO: 7842 - protein, 696 aa, Sorghum bicolor
  misc_feature: Ceres ANNOT ID no. 6085915
  misc_feature (2)..(148): Pfam Id: SPX Pfam Desc: SPX domain
  misc_feature (251)..(648): Pfam Id: MFS_1 Pfam Desc: Major Facilitator Superfamily
  misc_feature (1)..(696): NCBI GI: 50253121 NCBI Desc: spx (syg1/pho81/xpr1) domain-containing protein-like [oryza sativa (japonica cultivar-group)]
  misc_feature (1)..(696): NCBI GI: 115460022 NCBI Desc: os04g0573000 [oryza sativa (japonica cultivar-group)]
  misc_feature (1)..(696): NCBI GI: 116309924 NCBI Desc: osigba0147h17.5 [oryza sativa (indica cultivar-group)]
  misc_feature (1)..(391): NCBI GI: 115447903 NCBI Desc: os02g0678200 [oryza sativa (japonica cultivar-group)]
  misc_feature (19)..(691): NCBI GI: 115466164 NCBI Desc: os06g0129400 [oryza sativa (japonica cultivar-group)]
  misc_feature: Up-regulated in root tissues in response to salicylic acid treatment
  misc_feature: Up-regulated in shoot tissues in response to salicylic acid treatment
MVNFGKKLMADQLEEWREYYINYKMMKKKVKQYVQQTQTGGKNRDQVLKEFSRMLDDQIEKVVLFLLQQQGHLARRIEKLGVQRAMLMQQSDVSQICQLRQAYREVGYDLVKLLRFLDMNATGIRKILKKFDKRFGYKFTDYYVSTRANHPYSQLQQIFKQVGVVAVVGALSRNLAYLQDHQGYLANIYDYPSLILKDPVIEQINHSVQKLTHSTSFLQFLGQHALIVPEDMQSGSDLDDDKDYHFLSLLLNLVNTFLYMVNTYIIVPTADDYSVSLGAAATVCGVIIGSMAVAQIFSSVYFSAWSNKSYFRPLVFSSIMLFLGNLLYALAYDLNSLTALIVGRLLCGLGSARAVNRRYISDCVPLKSRMQASAGFVSASALGMACGPGLAGLLQTKFKIYGLTFNQNTLPGWVMCVAWLAYLFWLWISFKEPGHIASENSVNTQSSDSGRPVSGNLEDGVREPLLIDAKAGPDDDVEDNDDNDDDPEESHRPATSLAAAYRLLTPSVKVQLLIYFMLKFAMEILLSESSVVTTFYFKWTTSTVAIFLAVLGLTVLPVNVIVGSYVTNLFQDRQILVASEIMVLIGIVMSFRFTPHYSVPQYVTSALITFVFAEVLEGVNLSLLSRVMSSRLSRGTYNGGLLSTEAGTLARVAADMTITAAGNLGQSRLLNATLLPSLVICLASIVATFCTYNSLY

SEQ ID NO: 7843 - DNA, 1314 bp, Sorghum bicolor
  misc_feature: Ceres ANNOT ID no. 6085920
  misc_feature: Encodes the peptide sequence at SEQ ID NO 7844
atggatgaggtgacggtttcgtctccgctgatgctgccggcaacggaggccaggggaggaggggtgtccgtggttgagatggtgacgggggcgctccggaggtcgctcatactgtgcagcagcagcgccggcgccggtgtgcgcgagccagaggagctggaggaggacggggctgcgcccccgccgggtatgcagatagggggaccaacggatgtgcggcacgtctcgcacgtcaccttcgaccgcttcgtcggcttcctcggcctccccgccgacctcgagcccgacgtacctcgccccgtgccgagcgccagtgtaagcgtatttggagtttcaccaacttccatgcagtgctcgtatgatagaagaggaaacagtgtgccgacaatactgttgactatgcaaaggaagttatattcacttgggggtcttcaggctgaagggatattcaggataaatgcagacaatagccaggagctatatgtgagggatcaactaaacaggggggttgttccagatggtgttgatttgcactgcctcgctggactgattaaggcatggtttcgagaacttccaagtggagtattggactcgttgactccagaacaagtgatgcactgcaacactgaagaagagtgtagccatcttgcaagtaccctacctcctgttgaagcagcattacttgaatgggccatcaatctcatggcagatgttgtggaaaatgaaagctacaacaagatgaatgctcgcaacattgctatggtttttgccccaaatatgaccaagatggcggaccccttgactgctttgatacatgcagttcaagtgatgaatttcctcaagacattgatcttgaaaactgtagatgaaagggaggaggctgctaaagtaaccagggcattcccatcgaactctggttccccaagcgacaaagatgaaccacaaactttagagcatttggacatgccctccgtctgttcaagtcagcaaaatatggattatcctataattgatgaggctaagctcgatcagttccttttcagagtggaagcagctcttcatcatgagacgcaaggcagcacagatggacacaagaatcatgacagtagtaggggtgaccagaaaagcgacagtgaagttactccattggacactgatctgaccagccaaaacgagttcaataacagcaacgaggaaggtctctttgacaaatttaaatttaggaaaggagtagggaggctctgcagacaccctgtattccagttcagtaggtccatgaagaagtccgatgaagcagagcaagcttgtgtatag

SEQ ID NO: 7844 - protein, 437 aa, Sorghum bicolor
  misc_feature: Ceres ANNOT ID no. 6085920
  misc_feature (128)..(265): Pfam Id: RhoGAP Pfam Desc: RhoGAP domain
  misc_feature (65)..(111): Pfam Id: PBD Pfam Desc: P21-Rho-binding domain
  misc_feature (3)..(437): NCBI GI: 34451568 NCBI Desc: rho gtpase activating protein 2 [oryza sativa (japonica cultivar-group)]
  misc_feature (44)..(437): NCBI GI: 115447915 NCBI Desc: os02g0679500 [oryza sativa (japonica cultivar-group)]
  misc_feature (2)..(429): NCBI GI: 116309679 NCBI Desc: h0404f02.3 [oryza sativa (indica cultivar-group)]
  misc_feature (23)..(428): NCBI GI: 3695061 NCBI Desc: rac gtpase activating protein 2 [lotus japonicus]
  misc_feature (23)..(428): NCBI GI: 140055673 NCBI Desc: rhogap; wiscott-aldrich syndrome, c-terminal [medicago truncatula]
MDEVTVSSPLMLPATEARGGGVSVVEMVTGALRRSLILCSSSAGAGVREPEELEEDGAAPPPGMQIGGPTDVRHVSHVTFDRFVGFLGLPADLEPDVPRPVPSASVSVFGVSPTSMQCSYDRRGNSVPTILLTMQRKLYSLGGLQAEGIFRINADNSQELYVRDQLNRGVVPDGVDLHCLAGLIKAWFRELPSGVLDSLTPEQVMHCNTEEECSHLASTLPPVEAALLEWAINLMADVVENESYNKMNARNIAMVFAPNMTKMADPLTALIHAVQVMNFLKTLILKTVDEREEAAKVTRAFPSNSGSPSDKDEPQTLEHLDMPSVCSSQQNMDYPIIDEAKLDQFLFRVEAALHHETQGSTDGHKNHDSSRGDQKSDSEVTPLDTDLTSQNEFNNSNEEGLFDKFKFRKGVGRLCRHPVFQFSRSMKKSDEAEQACV

SEQ ID NO: 7845 - DNA, 1278 bp, Sorghum bicolor
  misc_feature: Ceres ANNOT ID no. 6085923
  misc_feature: Encodes the peptide sequence at SEQ ID NO 7846
atggcgctgccctacctggaggccgtgctttgctttatgattctcatgtacatatttgagacatatcttgacattcgtcagcatagagccctcaagctgccaactttgccaaaacccctgctgggagtaattagtgatgaaaaatttgaacgctctagagcttatagtcttgacaaaagctacttccattttgttcatgaggctgtgactattttaatggataccacaatactgtactatagagttcttccctggttttggaagaaatctggagagttagttaccaatgttgggctgaatgctgagaatgagataatacacacccttgcattcttagctggtgccatggtttggtcacagattacagacttgccgttctctctttattcaacttttgttatagaggctcggcatggttttaacaagcaaactatatggctcttcattagggatatgatcaaaggaattttactatccatgatattggggccaccaattgttgctgctatcatctacatagtacagattggaggaccttacctggctatttatctctggggttttatgttcgtattagctcttctgatgatgacaatatacccaattgtgatagctcctctgttcaacaagttcactcctcttcctgaaggagtcctcagggagaaaatagagaagctggcagcttccctcaagtttcctttgaaaaagctttttgtggtagatgggtctaccagatcaagccacagtaatgcctacatgtatgggtttttcaagaataaacgcattgtactctatgacacattgattcagcagtgtagcaatgaggatgagatagtttctgttattgcacatgaacttgggcactggaaactcaatcatactgtctattcctttgtagctgtccagctgcttatgtttcttcaatttggaggatatactctagtgaggaactccaaagatctatttgaaagttttggcttcgaggaccagccaataataattggattgatcattttccagcacaccataatacccatccagcaccttctgagcttctgcctgaaccttgtcagcagagcatttgaattccaggctgatgcctttgccaagaaccttggatatgcccctcagctccgagcggcccttgttaaactacaggaggagaacttgtctgcgatgaacaccgatccttggtattcggcatatcactactcccacccacctctcgtcgaaaggctgcaagctcttgaagattcagacagcaaaaaagaagactaa

SEQ ID NO: 7846 - protein, 425 aa, Sorghum bicolor
  misc_feature: Ceres ANNOT ID no. 6085923
  misc_feature (226)..(426): Pfam Id: Peptidase_M48 Pfam Desc: Peptidase family M48
  misc_feature (1)..(425): NCBI GI: 110835659 NCBI Desc: caax peptidase [hordeum vulgare subsp. vulgare]
  misc_feature (1)..(425): NCBI GI: 13785909 NCBI Desc: caax processing zinc-metallo endoprotease [arabidopsis thaliana]
  misc_feature (121)..(302): NCBI GI: 2191141 NCBI Desc: a_ig002n01.21 gene product [arabidopsis thaliana]
  misc_feature (8)..(276): NCBI GI: 30724782 NCBI Desc: farnesylated-proteins converting enzyme-1 [mus musculus]
  misc_feature (8)..(276): NCBI GI: 119627638 NCBI Desc: zinc metallopeptidase (ste24 homolog, yeast), isoform cra_a [homo sapiens]
MALPYLEAVLCFMILMYIFETYLDIRQHRALKLPTLPKPLLGVISDEKFERSRAYSLDKSYFHFVHEAVTILMDTTILYYRVLPWFWKKSGELVTNVGLNAENEIIHTLAFLAGAMVWSQITDLPFSLYSTFVIEARHGFNKQTIWLFIRDMIKGILLSMILGPPIVAAIIYIVQIGGPYLAIYLWGFMFVLALLMMTIYPIVIAPLFNKFTPLPEGVLREKIEKLAASLKFPLKKLFVVDGSTRSSHSNAYMYGFFKNKRIVLYDTLIQQCSNEDEIVSVIAHELGHWKLNHTVYSFVAVQLLMFLQFGGYTLVRNSKDLFESFGFEDQPIIIGLIIFQHTIIPIQHLLSFCLNLVSRAFEFQADAFAKNLGYAPQLRAALVKLQEENLSAMNTDPWYSAYHYSHPPLVERLQALEDSDSKKED

SEQ ID NO: 7847 - DNA, 1530 bp, Sorghum bicolor
  misc_feature: Ceres ANNOT ID no. 6085929
  misc_feature: Encodes the peptide sequence at SEQ ID NO 7848
atgtttaggagtgcagcaattttgcgatggtcttgccaagcagccagtgttcggagtcccagagaggcatctcctgagcagtgtttatattctggagttccttggagatggttcagctgtgctgagcttgagcactctgaaaagctgggcacttatcccgtaagaatagaaaaaagcagcacgatgcattttacagttcattcaaagaattgttggttggttacggcaaagcatcactacaaccaatcactggggttctcaggtgtatcaagtcttcgtcgcatgtcttcctcgtatactagaactaaaccagatggtcttgaaaatgctgtctcagaggtttcttctacaggatcttctaaagttgacaacacagatggtggtggaaacacctggattgatatgtcagaagatgctcatcgttctgctgttgatgctagcactgctgcaggcaacaacataaagcgtccgaatgatgcaattacacttcatttccaagagttatttggtaatcacacagatctagaaaaggtaattgttccacttggtgggacactgatcggtacagcaatggcatggtttgtaatgcctattgttctaagaaagctgcacaagtatgcatcagatggtccccttaggacactctggggagactctactaagaaacatgtgtcttatgaaacaagcttgtggagtgcactggaagatcctgcaaaatatatgatcacatttatggcattttcgcagatggctgcagttattgaaccaggcatttcagattatcttccacaggcatggaagggggcatttgctgtctctttagtgtggttccttcacaggtggaagactaacttcattggccatgctatggccaaacaagctgctacaagaactgaccgtgaaagattgtcagcatttgataaggtgtcatcactaggactgatagcacttggagttatagctcttgctgaagcttgtggtgtacctgtgcagtcaatattaactgttggtggtgttggaggtgttgctactgcttttgcggcaagagatatccttggtaacatgctgagtggattctctatacaattttcaaggccattctcagttggagactatatcaaggctggttcaatagaagggcaagttgttgaaattggattgacctctacttcgttgataaatacagaaaagctccctgttgtagtccctaactcacttttctccagccaaatgatagtgaacaaatcaagggcccagtggcatgctagtgtggccaaacttcccataagaattgaagacatcgaaaaggttcctgctataacagaggagataaaagtaatgttgacgtccaactcaaaaattgacgctgcatactgctatctctcacggttagaaatttcaagtggagagcttaccattggttgcaatatcaaaagcacgaaaacagaggagtggtcatctacagaacaagacattctcctgaaagctgccagtatcatcaagcgacataaactttggactcccgtgtaa

SEQ ID NO: 7848 - protein, 509 aa, Sorghum bicolor
  misc_feature: Ceres ANNOT ID no. 6085929
  misc_feature (307)..(508): Pfam Id: MS_channel Pfam Desc: Mechanosensitive ion channel
  misc_feature (1)..(504): NCBI GI: 50253141 NCBI Desc: mechanosensitive ion channel domain-containing protein-like [oryza sativa (japonica cultivar-group)]
  misc_feature (5)..(503): NCBI GI: 116309692 NCBI Desc: h0404f02.16 [oryza sativa (indica cultivar-group)]
  misc_feature (5)..(503): NCBI GI: 115460084 NCBI Desc: os04g0578700 [oryza sativa (japonica cultivar-group)]
  misc_feature (5)..(374): NCBI GI: 32488506 NCBI Desc: osjnba0011j08.13 [oryza sativa (japonica cultivar-group)]
  misc_feature (78)..(374): NCBI GI: 7267116 NCBI Desc: at4g00290 [arabidopsis thaliana]
MFRSAAILRWSCQAASVRSPREASPEQCLYSGVPWRWFSCAELEHSEKLGTYPVRIEKSSTMHFTVHSKNCWLVTAKHHYNQSLGFSGVSSLRRMSSSYTRTKPDGLENAVSEVSSTGSSKVDNTDGGGNTWIDMSEDAHRSAVDASTAAGNNIKRPNDAITLHFQELFGNHTDLEKVIVPLGGTLIGTAMAWFVMPIVLRKLHKYASDGPLRTLWGDSTKKHVSYETSLWSALEDPAKYMITFMAFSQMAAVIEPGISDYLPQAWKGAFAVSLVWFLHRWKTNFIGHAMAKQAATRTDRERLSAFDKVSSLGLIALGVIALAEACGVPVQSILTVGGVGGVATAFAARDILGNMLSGFSIQFSRPFSVGDYIKAGSIEGQVVEIGLTSTSLINTEKLPVVVPNSLFSSQMIVNKSRAQWHASVAKLPIRIEDIEKVPAITEEIKVMLTSNSKIDAAYCYLSRLEISSGELTIGCNIKSTKTEEWSSTEQDILLKAASIIKRHKLWTPV

SEQ ID NO: 7849 - DNA, 768 bp, Sorghum bicolor
  misc_feature: Ceres ANNOT ID no. 6085936
  misc_feature: Encodes the peptide sequence at SEQ ID NO 7850
atggggaggggacgagttgagctgaagcggatcgagaacaagatcaaccgccaggtcaccttctccaagcgccgcaacggcctgctcaagaaggcgtacgagctctccgtgctctgcgacgccgaggtcgcgctcatcatcttctccagccgcggcaagctctacgagttcggcagcgccggcataactaaaacactagaaaggtatcaacattgctgctacaacgctcaagattccaatggtgcactctctgaaactcagagctggtaccaggaaatgtcaaaactgagggcaaaatttgaagccttgcagcgcactcagaggcacttgctcggggaggaccttggcccactgagtgttaaggaattgcagcagctagagaaacagctagaatgtgctttgtcacaggcaagacagagaaagacacaacttatgatggagcaagtggaagagcttcgcagaaaggagcgtcacctgggagaaatgaacaggcaactcaaacacaagcttgaagctgaaggttctagcaactacagaaccttgcagcatgccgccgcctggccagctcccggcggcaccatcgtggagcatgacggcgccacgtatcatgttcatccacctgctcactcagttgctatagactgtgaacccactctgcaaattgggtaccctcatcaccagtttctgccttctgatcaggcagccaataatatcccaaggaacgcccccggaggcgagaacaacttcatgctgggatgggttctttga

SEQ ID NO: 7850 - protein, 255 aa, Sorghum bicolor
  misc_feature: Ceres ANNOT ID no. 6085936
  misc_feature (74)..(172): Pfam Id: K-box Pfam Desc: K-box region
  misc_feature (9)..(59): Pfam Id: SRF-TF Pfam Desc: SRF-type transcription factor (DNA-binding and dimerisationdomain)
  misc_feature (1)..(255): NCBI GI: 939779 NCBI Desc: mads box protein
  misc_feature (1)..(255): NCBI GI: 939781 NCBI Desc: mads box protein
  misc_feature (1)..(255): NCBI GI: 44888603 NCBI Desc: agamous like6-like protein [hordeum vulgare subsp. vulgare]
  misc_feature (1)..(255): NCBI GI: 3688591 NCBI Desc: mads box transcription factor [triticum aestivum]
  misc_feature (1)..(255): NCBI GI: 47681319 NCBI Desc: mads17 protein [dendrocalamus latiflorus]
  misc_feature: Abnormal phyllotaxy, leaf number higher than wild-type
  misc_feature: The plant flowers significantly earllier than wild-type.
  misc_feature: The sequence is a functional homolog of SEQ ID NO 1028 in the 10/225,066US patent application
  misc_feature: The sequence is a functional homolog of SEQ ID NO 122 in the 10/666,642US patent application
  misc_feature: The sequence is a functional homolog of SEQ ID NO 1362 in the 10/666,642US patent application
  misc_feature: The sequence is a functional homolog of SEQ ID NO 164 in the 10/666,642US patent application
  misc_feature: The sequence is a functional homolog of SEQ ID NO 1973 in the 10/412,699US patent application
  misc_feature: The sequence is a functional homolog of SEQ ID NO 199 in the 11/479,226US patent application
  misc_feature: The sequence is a functional homolog of SEQ ID NO 203 in the 11/479,226US patent application
  misc_feature: The sequence is a functional homolog of SEQ ID NO 2222 in the 10/374,780US patent application
  misc_feature: The sequence is a functional homolog of SEQ ID NO 34 in the 10/666,642US patent application
  misc_feature: The sequence is a functional homolog of SEQ ID NO 40 in the 10/412,699US patent application
  misc_feature: The sequence is a functional homolog of SEQ ID NO 40 in the 10/666,642US patent application
  misc_feature: The sequence is a functional homolog of SEQ ID NO 406 in the 10/412,699US patent application
  misc_feature: The sequence is a functional homolog of SEQ ID NO 42 in the 10/666,642US patent application
  misc_feature: The sequence is a functional homolog of SEQ ID NO 58 in the 10/412,699US patent application
  misc_feature: The sequence is a functional homolog of SEQ ID NO 642 in the 11/435,388US patent application
  misc_feature: The sequence is a functional homolog of SEQ ID NO 70 in the 10/666,642US patent application
  misc_feature: The sequence is a functional homolog of SEQ ID NO 707 in the 10/666,642US patent application
  misc_feature: Useful for making plants with altered alkaloid content
  misc_feature: Useful for making plants with altered terpenoid content
  misc_feature: Useful for making plants with modulated biomass
  misc_feature: Useful for making plants with modulated endosperm cell number
  misc_feature: Useful for making plants with modulated endosperm cell size
  misc_feature: Useful for making plants with modulated flowering time
  misc_feature: Useful for making plants with modulated growth and phenotype characteristics
  misc_feature: Functional homolog of the protein sequence given in SEQ ID NO 12958
  misc_feature: GREAT-hit functional homolog of the protein sequence given in SEQ ID NO 13021
  misc_feature: GREAT-hit functional homolog of the protein sequence given in SEQ ID NO 13523
  misc_feature: GREAT-hit functional homolog of the protein sequence given in SEQ ID NO 13524
  misc_feature: The sequence is a functional homolog of SEQ ID NO 1973 in the 20040045049 US patent application
  misc_feature: The sequence is a functional homolog of SEQ ID NO 40 in the 20040045049 US patent application
  misc_feature: The sequence is a functional homolog of SEQ ID NO 406 in the 20040045049 US patent application
  misc_feature: The sequence is a functional homolog of SEQ ID NO 58 in the 20040045049 US patent application
  misc_feature: The sequence is a functional homolog of SEQ ID NO 642 in the 20060272060 US patent application
  misc_feature: The sequence is a functional homolog of SEQ ID NO 203 in the 20070022495 US patent application
  misc_feature: The sequence is a functional homolog of SEQ ID NO 42 in the 20070033671 US patent application
  misc_feature: The sequence is a functional homolog of SEQ ID NO 70 in the 20070033671 US patent application
  misc_feature: The sequence is a functional homolog of SEQ ID NO 707 in the 20070033671 US patent application
  misc_feature: Useful for making plants with modulated flowering time
  misc_feature: Functional homolog of the protein sequence given in SEQ ID NO 13524
  misc_feature: The sequence is a functional homolog of SEQ ID NO 707 in the 10/666,642 US patent application
  misc_feature: Useful for making plants with altered alkaloid content
  misc_feature: Useful for making plants with altered terpenoid content
  misc_feature: Functional homolog of the protein sequence given in SEQ ID NO 13021
  misc_feature: The sequence is a functional homolog of SEQ ID NO 1362 in the 10/666,642 US patent application
  misc_feature: The sequence is a functional homolog of SEQ ID NO 199 in the 11/479,226 US patent application
  misc_feature: The sequence is a functional homolog of SEQ ID NO 34 in the 10/666,642 US patent application
  misc_feature: The sequence is a functional homolog of SEQ ID NO 58 in the 10/412,699 US patent application
  misc_feature: The sequence is a functional homolog of SEQ ID NO 4 in US patent 7057087
  misc_feature: The sequence is a functional homolog of SEQ ID NO 30 in the 10/666,642 US patent application
  misc_feature: The sequence is a functional homolog of SEQ ID NO 36 in the 10/666,642 US patent application
  misc_feature: The sequence is a functional homolog of SEQ ID NO 60 in the 10/412,699 US patent application
  misc_feature: Useful for making plants with modulated biomass
  misc_feature: Functional homolog of the protein sequence given in SEQ ID NO 13569
  misc_feature: The sequence is a functional homolog of SEQ ID NO 203 in the 11/479,226 US patent application
  misc_feature: The sequence is a functional homolog of SEQ ID NO 40 in the 10/666,642 US patent application
  misc_feature: The sequence is a functional homolog of SEQ ID NO 6 in US patent 7279615
  misc_feature: Useful for making plants with modulated phosphate use efficiency
  misc_feature: Functional homolog of the protein sequence given in SEQ ID NO 13166
  misc_feature: The sequence is a functional homolog of SEQ ID NO 2 in US patent 7273968
  misc_feature: The sequence is a functional homolog of SEQ ID NO 46 in the 10/666,642 US patent application
  misc_feature: The sequence is a functional homolog of SEQ ID NO 730 in the 10/666,642 US patent application
  misc_feature: The sequence is a functional homolog of SEQ ID NO 122 in the 10/666,642 US patent application
  misc_feature: The sequence is a functional homolog of SEQ ID NO 406 in the 10/412,699 US patent application
  misc_feature: The sequence is a functional homolog of SEQ ID NO 1364 in the 10/666,642 US patent application
  misc_feature: The sequence is a functional homolog of SEQ ID NO 1728 in the 10/412,699 US patent application
  misc_feature: The sequence is a functional homolog of SEQ ID NO 164 in the 10/666,642 US patent application
  misc_feature: The sequence is a functional homolog of SEQ ID NO 642 in the 11/435,388 US patent application
  misc_feature: The sequence is a functional homolog of SEQ ID NO 1368 in the 10/666,642 US patent application
  misc_feature: The sequence is a functional homolog of SEQ ID NO 422 in the 11/435,388 US patent application
  misc_feature: The sequence is a functional homolog of SEQ ID NO 919 in the 10/666,642 US patent application
  misc_feature: The sequence is a functional homolog of SEQ ID NO 1701 in the 10/412,699 US patent application
  misc_feature: The sequence is a functional homolog of SEQ ID NO 1955 in the 10/412,699 US patent application
  misc_feature: Useful for making plants with altered lignin content
  misc_feature: Functional homolog of the protein sequence given in SEQ ID NO 12944
  misc_feature: The sequence is a functional homolog of SEQ ID NO 1949 in the 10/412,699 US patent application
  misc_feature: The sequence is a functional homolog of SEQ ID NO 1967 in the 10/412,699 US patent application
  misc_feature: The sequence is a functional homolog of SEQ ID NO 1965 in the 10/412,699 US patent application
  misc_feature: The sequence is a functional homolog of SEQ ID NO 1963 in the 10/412,699 US patent application
  misc_feature: The sequence is a functional homolog of SEQ ID NO 1957 in the 10/412,699 US patent application
  misc_feature: The sequence is a functional homolog of SEQ ID NO 1959 in the 10/412,699 US patent application
  misc_feature: The sequence is a functional homolog of SEQ ID NO. 361 in the 11/188,298 US application
  misc_feature: The sequence is a functional homolog of SEQ ID NO. 273 in the 11/188,298 US application
  misc_feature: The sequence is a functional homolog of SEQ ID NO. 518 in the 11/188,298 US application
  misc_feature: The sequence is a functional homolog of SEQ ID NO. 359 in the 11/188,298 US application
  misc_feature: The sequence is a functional homolog of SEQ ID NO. 420 in the 11/188,298 US application
  misc_feature: The sequence is a functional homolog of SEQ ID NO. 377 in the 11/188,298 US application
MGRGRVELKRIENKINRQVTFSKRRNGLLKKAYELSVLCDAEVALIIFSSRGKLYEFGSAGITKTLERYQHCCYNAQDSNGALSETQSWYQEMSKLRAKFEALQRTQRHLLGEDLGPLSVKELQQLEKQLECALSQARQRKTQLMMEQVEELRRKERHLGEMNRQLKHKLEAEGSSNYRTLQHAAAWPAPGGTIVEHDGATYHVHPPAHSVAIDCEPTLQIGYPHHQFLPSDQAANNIPRNAPGGENNFMLGWVL

SEQ ID NO: 7851 - DNA, 1167 bp, Sorghum bicolor
  misc_feature: Ceres ANNOT ID no. 6085956
  misc_feature: Encodes the peptide sequence at SEQ ID NO 7852
atgtggtcgtggttgacgaagattgcgtccgcgtgcttgggcccggtccggaggtgcgcgcgtacgaggaagggtgaggacggcgccagcgataatggccgcggcgtcgccgacgacctgctgtggtcgcgggacctcgggcgccacgcggcgggtgagttctcgtttgccgtcgtgcaggccaacgaggcgttggaggaccacagccaggtggagacaggctctgccgcaacatttgtgggcgtctacgacggccatggcggcgctgaggcggcccgcttcatatctgaccacatcttcgcacacctcatccgacttgctcaggaaaatggaacaatatctgaggatgttgttcggagtgcggtttctgctactgaggaagacttcttgacacttgtgcgcagaacacattttataaagcctttgattgctgcggttggatcctgctgtctagttggtgtcatatggagagggacactatatgtggctaatctaggtgattccagggctgtaattggctgtctaggtagatcaaacaagatcatggctgaaccactcacaagagatcataatgcaagtatggaggaggtcaggcaggaacttatatcccgtcatccagatgattctcaaattgtcgttctcaagcatggtgtttggcgcatcaagggcataattcaggtttcaaggacaattggggatgcttacttgaagaggcgtgaatttgctcttgatccctctattactcgtttccgcctttcggagcctcttcgtcggcctgttcttacagcagagccatctatgtgtacaagggtgcttaatccacaagataaatttattatttttgcatctgatggtctttgggagcagttgacaaatcaacaggccgttgaaattgtccacagcaatccacgaagaggaatcgcaaagaggctgataagggcagcactgaaacaagctgcgcggaagagggaaatgaggtataatgacctgaggaaagttgaaaagggagttcgccgcttcttccacgacgacattacagtagttgttgtttacatagagcatggattactgcaagggagggatacttctgtgccagaactttcagtccgtggttttgttgattcagttggcccctcaagtttctcagggataaccgccatatcatga

SEQ ID NO: 7852 - protein, 388 aa, Sorghum bicolor
  misc_feature: Ceres ANNOT ID no. 6085956
  misc_feature (44)..(324): Pfam Id: PP2C Pfam Desc: Protein phosphatase 2C
  misc_feature (1)..(337): NCBI GI: 115460136 NCBI Desc: os04g0584300 [oryza sativa (japonica cultivar-group)]
  misc_feature (1)..(382): NCBI GI: 21536936 NCBI Desc: protein phosphatase 2c-like [arabidopsis thaliana]
  misc_feature (8)..(382): NCBI GI: 9759303 NCBI Desc: protein phosphatase 2c-like [arabidopsis thaliana]
  misc_feature (1)..(371): NCBI GI: 20340237 NCBI Desc: protein phosphatase 2c-like protein [thellungiella halophila]
  misc_feature (30)..(371): NCBI GI: 10177123 NCBI Desc: protein phosphatase 2c-like protein [arabidopsis thaliana]
  misc_feature: Abnormal phyllotaxy, leaf number higher than wild-type
  misc_feature: Useful for making plants with modulated biomass
  misc_feature: Useful for making plants with modulated low light sensitivity
  misc_feature: GREAT-hit functional homolog of the protein sequence given in SEQ ID NO 13347
  misc_feature: Useful for making plants with modulated biomass
  misc_feature: Useful for making plants with modulated low light sensitivity
  misc_feature: Functional homolog of the protein sequence given in SEQ ID NO 13347
  misc_feature: The sequence is a functional homolog of SEQ ID NO. 386 in the 11/188,298 US application
  misc_feature: The sequence is a functional homolog of SEQ ID NO. 448 in the 11/188,298 US application
  misc_feature: The sequence is a functional homolog of SEQ ID NO. 406 in the 11/188,298 US application
MWSWLTKIASACLGPVRRCARTRKGEDGASDNGRGVADDLLWSRDLGRHAAGEFSFAVVQANEALEDHSQVETGSAATFVGVYDGHGGAEAARFISDHIFAHLIRLAQENGTISEDVVRSAVSATEEDFLTLVRRTHFIKPLIAAVGSCCLVGVIWRGTLYVANLGDSRAVIGCLGRSNKIMAEPLTRDHNASMEEVRQELISRHPDDSQIVVLKHGVWRIKGIIQVSRTIGDAYLKRREFALDPSITRFRLSEPLRRPVLTAEPSMCTRVLNPQDKFIIFASDGLWEQLTNQQAVEIVHSNPRRGIAKRLIRAALKQAARKREMRYNDLRKVEKGVRRFFHDDITVVVVYIEHGLLQGRDTSVPELSVRGFVDSVGPSSFSGITAIS

SEQ ID NO: 7853 - DNA, 1191 bp, Sorghum bicolor
  misc_feature: Ceres ANNOT ID no. 6085959
  misc_feature: Encodes the peptide sequence at SEQ ID NO 7854
atggcgaggccgtcgcgccaaaacccgacccatgcctccgtcacatccctgcgcggcttcgtgggacgctcgccgcacccgccttcgcgcgcgtcggcggcgttacggcgagcggcggcggtgctcctcctcgcggccgcagtggcgctgccctgcgccgtgctgtaccgcgccgccgtggagactacgaagcccatatatgtcccgcgtgtgcaccggcccttattgcctgcgccgccgcttcctccggttcaagtccccgaggatgacggcgacttcgatcctttgcctgtcggcgatctggacagcgaagatctcagactagaactggttctgcaggaggcctccatggacaataagaccataatattgacaaccctcaatgctgcatgggcttcgccgggctcagtgatagatcttttcattgatagttttcggcgtggtgttggtactagttcactcttgaggcatcttgtgatagtagcatttgatttgaaggcgtatgaacaatgtgtcaagatccatccctactgctttgctcttccaaccaaggatgtggatttttctcaagagaagaggttccagacaactgggtatctggaaatgatgtggaaaaggctggacttcttgcggcttgtgcttgaaaaaggttacagctttgttttctcggatgctgatatcatgtggttccgcaatccatttccccacttttatactgatggagactttcagattgcatgtgatcactatgtagggaatgcgactgacttgaggaacatagccaatggaggattcaactatgtgaagtcaaacgatcaaagcatagagttctacaagttttggtattcttctcgatttagatatcctgggtaccatgatcaggatgtatttaattttataaagcatgatccttacaccacagacattggtctaacaattaagttcttaagtactacatacttcggcggcatttgtgagccaagcagagatttaaacaaggtttgcaccatgcatgcgaactgttgtattggactgcacagcaagatccatgacctaagaatcatgttggaagactggagtagctatatgtcgatgccaccaagcttaaagcaatacaaggcattgtcatggagggtaccacaaaattgcaggtatggtgcctgcatgggtttgagtgtgaatactttttaa

SEQ ID NO: 7854 - protein, 396 aa, Sorghum bicolor
  misc_feature: Ceres ANNOT ID no. 6085959
  misc_feature (1)..(383): NCBI GI: 115447979 NCBI Desc: os02g0686300 [oryza sativa (japonica cultivar-group)]
  misc_feature (27)..(383): NCBI GI: 116309821 NCBI Desc: h0307d04.3 [oryza sativa (indica cultivar-group)]
  misc_feature (27)..(383): NCBI GI: 38344278 NCBI Desc: osjnba0013k16.10 [oryza sativa (japonica cultivar-group)]
  misc_feature (89)..(383): NCBI GI: 50198979 NCBI Desc: at1g14590 [arabidopsis thaliana]
  misc_feature (100)..(383): NCBI GI: 23306127 NCBI Desc: putataive insb from escherichia coli [oryza sativa (japonica cultivar-group)]
  misc_feature: Useful for making plants with modulated biomass
  misc_feature: Functional homolog of the protein sequence given in SEQ ID NO 13568
MARPSRQNPTHASVTSLRGFVGRSPHPPSRASAALRRAAAVLLLAAAVALPCAVLYRAAVETTKPIYVPRVHRPLLPAPPLPPVQVPEDDGDFDPLPVGDLDSEDLRLELVLQEASMDNKTIILTTLNAAWASPGSVIDLFIDSFRRGVGTSSLLRHLVIVAFDLKAYEQCVKIHPYCFALPTKDVDFSQEKRFQTTGYLEMMWKRLDFLRLVLEKGYSFVFSDADIMWFRNPFPHFYTDGDFQIACDHYVGNATDLRNIANGGFNYVKSNDQSIEFYKFWYSSRFRYPGYHDQDVFNFIKHDPYTTDIGLTIKFLSTTYFGGICEPSRDLNKVCTMHANCCIGLHSKIHDLRIMLEDWSSYMSMPPSLKQYKALSWRVPQNCRYGACMGLSVNTF

SEQ ID NO: 7855 - DNA, 540 bp, Sorghum bicolor
  misc_feature: Ceres ANNOT ID no. 6085974
  misc_feature: Encodes the peptide sequence at SEQ ID NO 7856
atgggtttggcgatggggaggcttcttgggtggaagcaggaggcgcggatcgtgctactaggcctcgcctgcgctggcaagacagccatcctgcacaagctcaagcacggccacgtcgtcaccaccggaccaacgatagggttcaacaccgagacgcttgaatacaatggcatcagcttcagtgtttgggacgtgggtggtagtcaaggcgagctcctacggctcttgctaaggcactacctctatgccgcccagggcgtgatattcgtcgtcgacagcagcgaccaggagtggtttcatcaagccaaagatctgctaaacatgattctgaacgaggacaagttcagggatcccgcgctgcttttgtttgcaaccaagcaagaccttccgaacgccatgagcgcagcagagatagcagacaagttggggcttcagtcactgctttgcaaccgtagacgatggcacattcaaagttgttgtgcgatctcaggagaaggcctccatgaggggatggattggctctgcgccaacatacaatag

SEQ ID NO: 7856 - protein, 179 aa, Sorghum bicolor
  misc_feature: Ceres ANNOT ID no. 6085974
  misc_feature (1)..(178): Pfam Id: Arf Pfam Desc: ADP-ribosylation factor family
  misc_feature (16)..(128): Pfam Id: Miro Pfam Desc: Miro-like protein
  misc_feature (15)..(128): Pfam Id: MMR_HSR1 Pfam Desc: GTPase of unknown function
  misc_feature (16)..(180): Pfam Id: Ras Pfam Desc: Ras family
  misc_feature (1)..(178): NCBI GI: 47026876 NCBI Desc: adp-ribosylation factor [hyacinthus orientalis]
  misc_feature (1)..(178): NCBI GI: 22093618 NCBI Desc: adp-ribosylation factor 1 [oryza sativa (japonica cultivar-group)]
  misc_feature (1)..(178): NCBI GI: 2293566 NCBI Desc: adp-ribosylation factor 1 [oryza sativa]
  misc_feature (1)..(178): NCBI GI: 29124981 NCBI Desc: adp-ribosylation factor 2 [populus tremuloides]
  misc_feature (1)..(178): NCBI GI: 2852443 NCBI Desc: adp-ribosylation factor [salix bakko]
  misc_feature: Useful for making plants with altered Lignin content
  misc_feature: Useful for making plants with altered alkaloid content
  misc_feature: Functional homolog of the protein sequence given in SEQ ID NO 12945
  misc_feature: Useful for making plants with altered alkaloid content
  misc_feature: Useful for making plants with altered lignin content
  misc_feature: Functional homolog of the protein sequence given in SEQ ID NO 12945
  misc_feature: Useful for making plants with altered terpenoid content
  misc_feature: Functional homolog of the protein sequence given in SEQ ID NO 13081
  misc_feature: The sequence is a functional homolog of SEQ ID NO. 400 in the 11/188,298 US application
MGLAMGRLLGWKQEARIVLLGLACAGKTAILHKLKHGHVVTTGPTIGFNTETLEYNGISFSVWDVGGSQGELLRLLLRHYLYAAQGVIFVVDSSDQEWFHQAKDLLNMILNEDKFRDPALLLFATKQDLPNAMSAAEIADKLGLQSLLCNRRRWHIQSCCAISGEGLHEGMDWLCANIQ

SEQ ID NO: 7857 - DNA, 1344 bp, Sorghum bicolor
  misc_feature: Ceres ANNOT ID no. 6086005
  misc_feature: Encodes the peptide sequence at SEQ ID NO 7858
  misc_feature: Up-regulated in shoot tissues in response to salicylic acid treatment
atggcatccccggcaccggcgtcgcttaaggacaccgtgggcagcctcgaccgcgacggcttcgtcggcctcctctccaagctgatcggcgagaccgcgcacctgcagaacgacccgccgacccacaggcctcaggaggagcgcgtggcgcagcacgtcgtcgacgtgctccgcccggtgtccgcggacaccgggggcggccctctcctcgtgcggaagatcagctacgtcgagggcaggagcaacgtcatcgtcgagtaccccggcaccgtccccggccgcgttgtctccttcgtcggcatgcacatggatgtcgtccctgccaacgccagcgagtgggactttgatcctttctcactaacctttgatagcgaggataaggacaagctttgcggacgtgggacaactgactgtcttggacatgttgcactggtggctcagctaatgcggcggcttggtgaggtcaagccacccttgaagcattctgtcatcgctgtgtttattgccaacgaggagaactcatctgtcactggcattggtgttgatggcctcgtgaaggatggattgcttgacaagctcaagacaggacccttgttttggatagatacagctgataagcagccgtgcatcggcactggtggaatgattccatggcatctcatggcaacagggaagctgttccacagtggccttgcacataaggccataaatgcaatggagatgaacatggaagcgctgaaagtaatccaaaaacggttttacactgacttccctccacacgagaaagagaagctctataagtttgctactccatcgacaatgaagccaactaaatggagctatccaggtggggggcttaatcaaattcccggggaatgcacaatttcaggggatgtaaggttgactcctttctatagcacttctcatgtcatagagaagttgaaggaatatgtagaggacatcaatcagagatttgagacaatacttgatactcgtggtcctgtgtccaaatatattcttcctgatgaaaatctacaaggaaggcttgaaatcacttttgatggagatgtgatgaatggggtggcttgcaatctggagtctcgaggctatcatgcattatgcaaagcaaccaaggaaatagttggccaagtggagccatattccatcaccgggagtctacctctgattcgggaattacaggatgaaggatttgatgttcaaacagctggatatggcttactgaagacgtaccatgcgaagaatgagtactgcctgttttcagacatggcccagggctttgaggtgtttctgagcatcatttcacaactggaagaagaggtctga

SEQ ID NO: 7858 - protein, 447 aa, Sorghum bicolor
  misc_feature: Ceres ANNOT ID no. 6086005
  misc_feature (98)..(442): Pfam Id: Peptidase_M20 Pfam Desc: Peptidase family M20/M25/M40
  misc_feature (210)..(326): Pfam Id: M20_dimer Pfam Desc: Peptidase dimerisation domain
  misc_feature (44)..(445): NCBI GI: 7268535 NCBI Desc: n-acetylornithine deacetylase-like protein, fragment [arabidopsis thaliana]
  misc_feature (8)..(445): NCBI GI: 7707791 NCBI Desc: dip-1 [citrullus lanatus]
  misc_feature (7)..(446): NCBI GI: 10998336 NCBI Desc: silverleaf whitefly-induced protein 1; m20b peptidase [cucurbita pepo]
  misc_feature (16)..(445): NCBI GI: 60475207 NCBI Desc: acetylornithine deacetylase [dictyostelium discoideum]
  misc_feature (16)..(445): NCBI GI: 763048 NCBI Desc: p52d
  misc_feature: Useful for making plants with modulated water use efficiency
  misc_feature: Functional homolog of the protein sequence given in SEQ ID NO 14002
  misc_feature: Up-regulated in shoot tissues in response to salicylic acid treatment
MASPAPASLKDTVGSLDRDGFVGLLSKLIGETAHLQNDPPTHRPQEERVAQHVVDVLRPVSADTGGGPLLVRKISYVEGRSNVIVEYPGTVPGRVVSFVGMHMDVVPANASEWDFDPFSLTFDSEDKDKLCGRGTTDCLGHVALVAQLMRRLGEVKPPLKHSVIAVFIANEENSSVTGIGVDGLVKDGLLDKLKTGPLFWIDTADKQPCIGTGGMIPWHLMATGKLFHSGLAHKAINAMEMNMEALKVIQKRFYTDFPPHEKEKLYKFATPSTMKPTKWSYPGGGLNQIPGECTISGDVRLTPFYSTSHVIEKLKEYVEDINQRFETILDTRGPVSKYILPDENLQGRLEITFDGDVMNGVACNLESRGYHALCKATKEIVGQVEPYSITGSLPLIRELQDEGFDVQTAGYGLLKTYHAKNEYCLFSDMAQGFEVFLSIISQLEEEV

SEQ ID NO: 7859 - DNA, 765 bp, Sorghum bicolor
  misc_feature: Ceres ANNOT ID no. 6086019
  misc_feature: Encodes the peptide sequence at SEQ ID NO 7860
atggcgagggaggacgggttcccggtgtgggaggcggcgctgctcgccgccgtggccgccgtcttcgctgcggggctggccggcgtctacgtctccatgcctcgctccgactacagcttcctcaagctgccccgcaacctccaggagctccaagtcctcactgtccatctggagggctacaccagtgattacaccatccaggtgctggtgggatactgtgccgtgtacatcttcatgcagacgttcatgatcccagggaccattttcatgtccctgcttgctggggccctctttgggcagctcggtggtctagccctggtgatctttgctgccactgccggtgcttcttcctgttatttcctgtccaagctggtagggaaaccactggtcttctcgttgtggccagacaagctcatgttcttccaaaagcaggttgcaaaaagaagagagaagctgctgaattacatgcttttcctgagagtcaccccgacactgcccaatactttcatcaatttttcttcacctatagtgggtgtgccataccatactttcttcttggcgacagccattggcctcatcccagcagcctatgtgactgtcagggctggaattgctttgagcgacctgagatcgttgaatgacctgtacgatccacagtcgatagcagtgctgttcctgatcgggcttgtttcggtgatgccgacattgctgggcaagaacgagacgccaagcagagcaccagacatggcagctagcaccaactga

SEQ ID NO: 7860 - protein, 254 aa, Sorghum bicolor
  misc_feature: Ceres ANNOT ID no. 6086019
  misc_feature (84)..(205): Pfam Id: SNARE_assoc Pfam Desc: SNARE associated Golgi protein
  misc_feature (1)..(254): NCBI GI: 115460234 NCBI Desc: os04g0592600 [oryza sativa (japonica cultivar-group)]
  misc_feature (1)..(254): NCBI GI: 116311043 NCBI Desc: osigba0142i02-osigba0101b20.17 [oryza sativa (indica cultivar-group)]
  misc_feature (7)..(201): NCBI GI: 51997111 NCBI Desc: gtk16 protein [gerbera hybrid cultivar]
  misc_feature (15)..(241): NCBI GI: 54643111 NCBI Desc: ga21055-pa [drosophila pseudoobscura]
  misc_feature (15)..(241): NCBI GI: 18859941 NCBI Desc: cg8408-pa [drosophila melanogaster]
MAREDGFPVWEAALLAAVAAVFAAGLAGVYVSMPRSDYSFLKLPRNLQELQVLTVHLEGYTSDYTIQVLVGYCAVYIFMQTFMIPGTIFMSLLAGALFGQLGGLALVIFAATAGASSCYFLSKLVGKPLVFSLWPDKLMFFQKQVAKRREKLLNYMLFLRVTPTLPNTFINFSSPIVGVPYHTFFLATAIGLIPAAYVTVRAGIALSDLRSLNDLYDPQSIAVLFLIGLVSVMPTLLGKNETPSRAPDMAASTN

SEQ ID NO: 7861 - DNA, 3783 bp, Sorghum bicolor
  misc_feature: Ceres ANNOT ID no. 6086020
  misc_feature: Encodes the peptide sequence at SEQ ID NO 7862
  misc_feature: Down-regulated in shoot tissues in response to salicylic acid treatment
atgagctcgtcgtcggacaatggcgccggcccggaggccggcgggaagaagaagaagaagaaggcggcggaggaggaggcggcggcggccaaggtgccgttcctgaagctgttctcgttcgcggaccggtgggactgcgtgctgatggctgtgggctcgctgggcgcgtgcgcgcacggcgcctccgtcccggtcttcttcatcttcttcggcaagctcatcaacatcatcggcctcgcctacctcttccccaccaccgtctccggccgcgtcgccaagtactcgctggacttcgtgtacctcggcgtcgtcatactcttctcgtcctggaccgaggtggcgtgctggatgcacacgggggagcggcaggcggcgaagatgcggcaggcgtacctgcgcgcgatgctggaccaggacatcgccgtcttcgacacggaggcgtccaccggcgaggtcatcaacgccatcaccagcgacatcctcgtcgtccaggacgccatctccgagaaggtgggcaacttcatgcactacatcagccggttcctggccggcttcgccatcggcttctcgcaggtgtggcagatcagcctcgtcaccctcgccatcgtccccctcatcgccattgccggcggcacctacgcctacgtcaccatcggcctcatggcccgcgtccgcaagtcctacgtcaaggccggcgagatcgccgaggaggtgatcggcaacgtgcggacggtgcaggcgttcgtcggcgaggagaaggccgtgaggtcgtaccgggaggcgcttctgaggacgtacaagtacggcaagaggggcggcctcgccaagggcctcggcctcggctccatgcactctgtgcttttcctctcctgggcactgctcatctggttcaccagcgtcgtcgtccacaagcggatttccaacggcggcgagtccttcaccaccatgctcaacgtcgtcattgctggcctgtcgctcggccaggcggcgccgaacatctcgacgttcctgcgggcgaggacggcggcgttccccatcttccagatgatcgagaggagcaccgtgaacaaggcgagctccaagaccggccgcacgctgcccgcggtcgacgggcacatccagttccgcaacgtccacttcagctacccctcacggccggacgttgtcatcctcgataggttcagcctggactttccggccgggaagatcgtcgctctcgtcggtgggagcgggtccggcaagagcaccgtcgtctcgctcattgagcgcttctatgagccgctgtccggctccattctgcttgatgggcacgacatcaaggagctcgacgtcaagtggctgcgccggcagatcgggctggttaatcaggagccggccctgttcgcgacgagcatccgcgagaacatactctacggcaaaggcgacgccaccatggaggagatcaaccacgccgcgaagctgtcagaggcgatcacgttcatcaaccacctccctgatcggtacgagacgcaggtcggcgagcgcgggatacagctctccggcggccagaagcagcgcatcgcgatctcgagagcgatactgaagaacccgtcgatactgctcctcgatgaggcgacgagcgcactggacgccgagtccgagaagagcgtgcaggaggcgcttgaccgcgtcatggtcggccgcaccaccgtggtgatcgcgcaccgcctgtcgactatccggaacgccgacacaatcgcagtcgtcgacggtggcaggatcgtcgaaacaggcacgcacgagcagctcatggcgaacccgtgcagtgcctactcctcgctgatccaacttcaagaggccgcccagcttcagcacaaaccttctttgtctgacagtgcaagcatcaccaggccactaagtttcaagtattcgagggagttgtccgggaggacgagcatgggcgccagcttccgctctgacaaggactcaatcagccggtacggtgctggtgaggcgcatgacgaagtgcgcaaggggaagcccgtgtccatgaagaagctctactccatggtgcggccggattggttcttcggcgtgtcgggcaccatcagcgcctttgtggccggctcccagatgccgctcttcgcgcttggcgtcacgcaggcgctggtgtcctactacatggggtgggagaccacgaagctggaggtgcgcaagatcgccgtgctcttctgctgtggcgccgtgctgacagtcgtgttccacgtgatcgagcacctcagcttcggcatcatgggtgagcggctcaccctgcgggtccgggagaagatgttctcggcgatactgcggaacgagatcgggtggttcgacgacaccagcaacacgagcgccatgctatcgtcgcggctcgaggctgatgcgacgcttgtgcgcaccatcgttgtcgaccgctccaccatcttgctccagaacatcggtatgatcgtgacgtcgctcatcattgccttcatacttaactggaggatcacgctggtcgtccttgccacctatcccctcatggtcagcggccacatcagcgagaaaatgttcatgaaaggctacggaggcaacctcagcaagtcctatctgaaggccaacatgctcgccgcggaggcagtgagcaacatccggacggtggccgccttctgctcggaggagaaggtgataaaactctacgcggacgagctgaaggagccttctaagaggtccttccggcgaggccagggcgccggcctcttctatggagtctcccagttcttcctcttctcctcttacgcactggcgttatggtatggttcagtgctgatgagcaaggaattggccagcttcaagtccgtgatgaagtccttcatggtgctcatagtgacagcactggcaatgggggagacgctagcaatggcacctgatatcatcaaagggaaccagatggcgtcctcggtgttcgagatcctggaccgcaagactgacgtccggatcgacacaggtgaggacatcaagaaggtagaggggctgatcgagctgcgcggcgtcgagttccggtacccagctaggcccgacgtgaccgtgttcaagggccttgacctgctgatgaaggccggcaagagcatggcgcttgtcgggatgagcggctccggcaagagcaccgtgctgtcgctcatcctccggttctacgacccgatcgctggaagagtcttgatcgatgggaaggacgtcaagaagcttaagctgaagtctctgaggaaacatattgggctggtccagcaagagccggcgctgttcgcgacgacgatctacgacaacatcctgtacggcaaggacggggccacggaggccgaggtcgtcgaggcggccaagctggcgaacgcgcactcgttcatcagctcgctgccggaggggtacaagaccaaggtcggggagcgcggcgtgcagctgtcgggcgggcagaagcagcggatcgcgatcgcgcgcgccatcgtgaaggacccggctatcctgctgctggacgaggcgacgagcgcgctggacgtggagtcggagcgcgtcgtgcagcaggcgctggaccgggtgatgaagaaccggaccaccgtgatggtggcgcaccggctgtccacgatcaagaacgccgacgtcatctcggtgctgcaggacggcaagatcatcgagcagggggcgcaccagcacctgatcgagaacaagaacggcgcctaccacaagctcgtcaacttgcaacagcagcaacagatgcagacgcagcagagctcatga

SEQ ID NO: 7862 - protein, 1260 aa, Sorghum bicolor
  misc_feature: Ceres ANNOT ID no. 6086020
  misc_feature (401)..(585): Pfam Id: ABC_tran Pfam Desc: ABC transporter
  misc_feature (1039)..(1223): Pfam Id: ABC_tran Pfam Desc: ABC transporter
  misc_feature (49)..(326): Pfam Id: ABC_membrane Pfam Desc: ABC transporter transmembrane region
  misc_feature (687)..(969): Pfam Id: ABC_membrane Pfam Desc: ABC transporter transmembrane region
  misc_feature (12)..(1257): NCBI GI: 27368851 NCBI Desc: mdr-like abc transporter [oryza sativa (japonica cultivar-group)]
  misc_feature (9)..(1255): NCBI GI: 6671365 NCBI Desc: p-glycoprotein [gossypium hirsutum]
  misc_feature (24)..(1253): NCBI GI: 2108252 NCBI Desc: p-glycoprotein-2 [arabidopsis thaliana]
  misc_feature (24)..(1253): NCBI GI: 79487035 NCBI Desc: atpase, coupled to transmembrane movement of substances [arabidopsis thaliana]
  misc_feature (24)..(1253): NCBI GI: 20466380 NCBI Desc: p-glycoprotein-2 [arabidopsis thaliana]
  misc_feature: Down-regulated in shoot tissues in response to salicylic acid treatment
MSSSSDNGAGPEAGGKKKKKKAAEEEAAAAKVPFLKLFSFADRWDCVLMAVGSLGACAHGASVPVFFIFFGKLINIIGLAYLFPTTVSGRVAKYSLDFVYLGVVILFSSWTEVACWMHTGERQAAKMRQAYLRAMLDQDIAVFDTEASTGEVINAITSDILVVQDAISEKVGNFMHYISRFLAGFAIGFSQVWQISLVTLAIVPLIAIAGGTYAYVTIGLMARVRKSYVKAGEIAEEVIGNVRTVQAFVGEEKAVRSYREALLRTYKYGKRGGLAKGLGLGSMHSVLFLSWALLIWFTSVVVHKRISNGGESFTTMLNVVIAGLSLGQAAPNISTFLRARTAAFPIFQMIERSTVNKASSKTGRTLPAVDGHIQFRNVHFSYPSRPDVVILDRFSLDFPAGKIVALVGGSGSGKSTVVSLIERFYEPLSGSILLDGHDIKELDVKWLRRQIGLVNQEPALFATSIRENILYGKGDATMEEINHAAKLSEAITFINHLPDRYETQVGERGIQLSGGQKQRIAISRAILKNPSILLLDEATSALDAESEKSVQEALDRVMVGRTTVVIAHRLSTIRNADTIAVVDGGRIVETGTHEQLMANPCSAYSSLIQLQEAAQLQHKPSLSDSASITRPLSFKYSRELSGRTSMGASFRSDKDSISRYGAGEAHDEVRKGKPVSMKKLYSMVRPDWFFGVSGTISAFVAGSQMPLFALGVTQALVSYYMGWETTKLEVRKIAVLFCCGAVLTVVFHVIEHLSFGIMGERLTLRVREKMFSAILRNEIGWFDDTSNTSAMLSSRLEADATLVRTIVVDRSTILLQNIGMIVTSLIIAFILNWRITLVVLATYPLMVSGHISEKMFMKGYGGNLSKSYLKANMLAAEAVSNIRTVAAFCSEEKVIKLYADELKEPSKRSFRRGQGAGLFYGVSQFFLFSSYALALWYGSVLMSKELASFKSVMKSFMVLIVTALAMGETLAMAPDIIKGNQMASSVFEILDRKTDVRIDTGEDIKKVEGLIELRGVEFRYPARPDVTVFKGLDLLMKAGKSMALVGMSGSGKSTVLSLILRFYDPIAGRVLIDGKDVKKLKLKSLRKHIGLVQQEPALFATTIYDNILYGKDGATEAEVVEAAKLANAHSFISSLPEGYKTKVGERGVQLSGGQKQRIAIARAIVKDPAILLLDEATSALDVESERVVQQALDRVMKNRTTVMVAHRLSTIKNADVISVLQDGKIIEQGAHQHLIENKNGAYHKLVNLQQQQQMQTQQSS

SEQ ID NO: 7863 - DNA, 765 bp, Sorghum bicolor
  misc_feature: Ceres ANNOT ID no. 6086022
  misc_feature: Encodes the peptide sequence at SEQ ID NO 7864
atgttggatccgagatccgaaatctatcccaccatagagtatcgccctatccagccctccgacctagaagctcttgagaagattcatcttgctctctttccaataaggtacgagagagagttcttcttgaacgttgtcagcggcaatgggattgtttcctggggcgctgtggacaccagcagatcagatgaccgcagggatgagataataggttttgtaaccacgaggatgattgcggcaaaagatagcgagattgaggacctgttcaggtataacagttcacgcaaagatctaacacttctgtatatattgacgctgggtgtggtggataggtacagaaaccttgggatagcatcatcactggtccgagaagtggttaaatatgcagcaagcatatcaaattgcagaggtgtttatttacatgtcatttcatacaaccagcctgctatcagcttctataagaagatgctatttaagctagtcagaaggcttccaatgttttactacataagaggacaacattatgactcatacttgtttgtgtactatgtgaacggtggtcgttcgccttgctcacctctggagattgtaacttcatttgttgttgacttcagggctttcgtgaagatgctggttgccaagttctggaacaaggaggaccattgcaatccgagatgggccagatgtcaggaatccaacatcctcttggcaacacaaagtaataaacggatgatcagcggtgataataccagatgtcatgtctaa

SEQ ID NO: 7864 - protein, 254 aa, Sorghum bicolor
  misc_feature: Ceres ANNOT ID no. 6086022
  misc_feature (61)..(159): Pfam Id: Acetyltransf_1 Pfam Desc: Acetyltransferase (GNAT) family
  misc_feature (1)..(254): NCBI GI: 41053000 NCBI Desc: gcn5-related n-acetyltransferase-like [oryza sativa (japonica cultivar-group)]
  misc_feature (1)..(252): NCBI GI: 92899421 NCBI Desc: gcn5-related n-acetyltransferase [medicago truncatula]
  misc_feature (1)..(246): NCBI GI: 45773876 NCBI Desc: at5g16800 [arabidopsis thaliana]
  misc_feature (1)..(196): NCBI GI: 42567895 NCBI Desc: gcn5-related n-acetyltransferase (gnat) family protein [arabidopsis thaliana]
  misc_feature (100)..(194): NCBI GI: 67611050 NCBI Desc: gcn5-related n-acetyltransferase (gnat) family [cryptosporidium hominis]
MLDPRSEIYPTIEYRPIQPSDLEALEKIHLALFPIRYEREFFLNVVSGNGIVSWGAVDTSRSDDRRDEIIGFVTTRMIAAKDSEIEDLFRYNSSRKDLTLLYILTLGVVDRYRNLGIASSLVREVVKYAASISNCRGVYLHVISYNQPAISFYKKMLFKLVRRLPMFYYIRGQHYDSYLFVYYVNGGRSPCSPLEIVTSFVVDFRAFVKMLVAKFWNKEDHCNPRWARCQESNILLATQSNKRMISGDNTRCHV

SEQ ID NO: 7865 - DNA, 1005 bp, Sorghum bicolor
  misc_feature: Ceres ANNOT ID no. 6086027
  misc_feature: Encodes the peptide sequence at SEQ ID NO 7866
atgatgaatcagtggctagtgtttgcatgtgccttgctggcggcctcctcctcggcggcgctcgcgtccgcgtcctcgccgctgcaggtcgggttctacaagcactcgtgcccgcaggccgaggacatggtgcgcaacgccgtccgccgcgccgtcgccagggaccccggcgtcgccgcgggcctcatccggatgcacttccacgactgcttcgtccgggggtgcgacgcctccatcctgctcgactccacgccggggcagccgcagcaggaggccgagaagcactcgccggccaacttcccgagcctgcgcgggttcgaggtcatcgatgaggccaaggccatcgtggaggcgcactgcccgcgcacggtctcctgcgccgacatcgtcgccttcgccgcgcgcgacggggcctacctcgccggcggcatcgactaccgcgtccccgccggccgccgcgacggccgcgtgtccgtcaaggacgaggtgctcaaggacaacctgccgttcccggactccaccgtggcgaagctcatcgagagcttcaggcgcaagggcctctccgcggacgacatggtcacgctctccggcgcgcactccatcggccgctcgcactgctcgtcggtcacggcccggctgtacagcttcctgggcgagacggggcggacggacccggccctcaacccggcgtacgcggcggacctgaagcggcggtgcccgccatccacggaggaccgcaccacggtgccgctcgacatggtgacgcccaacaccttcgacaaccagtactttaagaacgtgctggcgcacaaggtgcccttcacctccgaccagacgctgctcgacagcccctggaccgcggggctcgtcgcgttccacgccgccgtcggccaggcgtgggaggccaagttcgccaaggcgatggtcaagatgggcgccatcgaggtactcaccggccatgagggcgagatcaggcaaaagtgctccatggtgaactactactag

SEQ ID NO: 7866 - protein, 334 aa, Sorghum bicolor
  misc_feature: Ceres ANNOT ID no. 6086027
  misc_feature (44)..(296): Pfam Id: peroxidase Pfam Desc: Peroxidase
  misc_feature (1)..(332): NCBI GI: 55701007 NCBI Desc: tpa: class iii peroxidase 70 precursor [oryza sativa (japonica cultivar-group)]
  misc_feature (12)..(332): NCBI GI: 92874087 NCBI Desc: haem peroxidase, plant/fungal/bacterial [medicago truncatula]
  misc_feature (12)..(333): NCBI GI: 92895421 NCBI Desc: haem peroxidase, plant/fungal/bacterial [medicago truncatula]
  misc_feature (23)..(332): NCBI GI: 92878644 NCBI Desc: haem peroxidase, plant/fungal/bacterial [medicago truncatula]
  misc_feature (9)..(332): NCBI GI: 55701005 NCBI Desc: tpa: class iii peroxidase 69 precursor [oryza sativa (japonica cultivar-group)]
  misc_feature: Useful for making plants with altered cell wall content and/or composition
  misc_feature: Functional homolog of the protein sequence encoded by LOCUS at1g05260
  misc_feature: Useful for making plants with altered carbohydrate content
  misc_feature: Functional homolog of the protein sequence given in SEQ ID NO 13714
MMNQWLVFACALLAASSSAALASASSPLQVGFYKHSCPQAEDMVRNAVRRAVARDPGVAAGLIRMHFHDCFVRGCDASILLDSTPGQPQQEAEKHSPANFPSLRGFEVIDEAKAIVEAHCPRTVSCADIVAFAARDGAYLAGGIDYRVPAGRRDGRVSVKDEVLKDNLPFPDSTVAKLIESFRRKGLSADDMVTLSGAHSIGRSHCSSVTARLYSFLGETGRTDPALNPAYAADLKRRCPPSTEDRTTVPLDMVTPNTFDNQYFKNVLAHKVPFTSDQTLLDSPWTAGLVAFHAAVGQAWEAKFAKAMVKMGAIEVLTGHEGEIRQKCSMVNYY

SEQ ID NO: 7867 - DNA, 2283 bp, Sorghum bicolor
  misc_feature: Ceres ANNOT ID no. 6086034
  misc_feature: Encodes the peptide sequence at SEQ ID NO 7868
atgggcgagatcggcacggacgaccgcggtctggccgaggccgaggccgagcccgtcggcggcgccgtcaaggaggagggcattctcgacgacgacgaggaggaggcgtcgccgatcgaggaggtgcggctgacggtgccgacgacggacgacccgtcgctgccggtgtggacgttccggatgtggagcatcgggctcttctcgtgcgcgctcatgagcttcctcaaccagttcttctcctaccggacggagccgctcgtggtgacggggatcacggtgcaggtggcgtcgctgcccgtgggccacttcatggcccgcgtgctgccgcgcaccaggttccgcgtccccgcgctgctcggcggcggcgagtggagcctcaacccggggcccttcaacattaaggagcacgtgctcatctccatcttcgccaacgccggcttcgccttcggcggcggcagcgcctacgccgtcagcatcatcaacatcatccgcgccttctacggccgccacatctccttcatcaccgcctggctcctcgtcatcaccacgcaggtgctcggatacgggtgggcagggctcatacgcaagtacgtggtggagccggcgcacatgtggtggccgggcacgctcgtgcaggtctccctcttccaggcattgcatgagaaggacgaatccgccaaagcctcacgtcagatctctcgttccaagttcttcgtggtggtgctcacatgcagcttcgcttggtacgctgtgccgggctacctcttcccgacactaacgtccatctcatgggtgtgttggatcttctccaagtctgtgacggcgcaacagctagggtcgggcatgaatggccttggtattggtgccttcacactcgattggtccgccgtctcctccttcctcttcagtcccctcatctcacccttctttgctaccgccaacatcttctttggctacactttctttctctatattatcatgcctatagcatattgggggttcgacctatacaacgccaagacattccccatcttctcctcgcacctgttcatgtcaaatggcaccaactacgatgtccaatcaattgtgaacaatcagtttgagcttgaccaggaagcctatcgtaagagtggcaatgtcaaccttagtatattctttgcactcacttatgggttcagcttcgccaccattgcggccaccatcactcatgtcgggctcttctatggaaaggaaatctactaccgtttcaaatcatcgcagaaggagaaacctgacatccacacgaagctgatgaagaagtacagtgaaatcccagcttggtggttttacctgttgatggccttgtcaattacagtgtccctcatcctctgtactgtactaaagcatgaggtacaactcccatggtggggactcattttcgcatgtggcatggcattcatcttcacacttcccatcagcatcatcactgcgacaaccaaccagtcacctggtctaaatgtgatcactgagtatgccatgggtttaattatgccgggctatcctatcgccgttgtctgcttcaaagtctatggctacatgagcatgtcacaggctgttgccttcctctcggacttcaaacttggccactatatgaagatccctccaaagtccatgttccttgttcagtttgttggtaccattgtggctggcacggtcaacgttgggacggcatggtggctgctcggttccatccatggcatctgctcggattctctcccaccagacagcccttggacatgtcctagtgaccgtgtattcttcgacgcatcagtcatttggggccttgtcggtccaaggcgcatctttgggccagaagggaactatggtgccctcaactcgttcttcctcatcggcctagcaggcccggttatcgtatacgctttccataggatgttccccaaccagaagtggataccattgatcaatctcccggtgctctttggtgcaacagctctcatgcccccagcaagggctgtgaactataactcatggctaattattggcaccatcttcaatttcttcgtgtttcggtatcggaagaggtggtggacacggtacaactacattctctctgctgggctcgatgccggagttgcatttatgggggtggtgctgtatttttcgctaaccatgcaaaacaagagtatcgattggtggggtactgcaggagagcactgccttcttgccacgtgtcctactgctaaaggggtggacttgggtgatggcatctgtccagtcttctaa

SEQ ID NO: 7868 - protein, 760 aa, Sorghum bicolor
  misc_feature: Ceres ANNOT ID no. 6086034
  misc_feature (56)..(722): Pfam Id: OPT Pfam Desc: OPT oligopeptide transporter protein
  misc_feature (33)..(759): NCBI GI: 21592665 NCBI Desc: isp4-like protein [arabidopsis thaliana]
  misc_feature (33)..(759): NCBI GI: 23198262 NCBI Desc: isp4-like protein [arabidopsis thaliana]
  misc_feature (30)..(759): NCBI GI: 144922933 NCBI Desc: peptidase aspartic, active site; oligopeptide transporter opt superfamily [medicago truncatula]
  misc_feature (25)..(760): NCBI GI: 92895885 NCBI Desc: oligopeptide transporter opt superfamily [medicago truncatula]
  misc_feature (24)..(760): NCBI GI: 15218331 NCBI Desc: oligopeptide transporter opt family protein [arabidopsis thaliana]
MGEIGTDDRGLAEAEAEPVGGAVKEEGILDDDEEEASPIEEVRLTVPTTDDPSLPVWTFRMWSIGLFSCALMSFLNQFFSYRTEPLVVTGITVQVASLPVGHFMARVLPRTRFRVPALLGGGEWSLNPGPFNIKEHVLISIFANAGFAFGGGSAYAVSIINIIRAFYGRHISFITAWLLVITTQVLGYGWAGLIRKYVVEPAHMWWPGTLVQVSLFQALHEKDESAKASRQISRSKFFVVVLTCSFAWYAVPGYLFPTLTSISWVCWIFSKSVTAQQLGSGMNGLGIGAFTLDWSAVSSFLFSPLISPFFATANIFFGYTFFLYIIMPIAYWGFDLYNAKTFPIFSSHLFMSNGTNYDVQSIVNNQFELDQEAYRKSGNVNLSIFFALTYGFSFATIAATITHVGLFYGKEIYYRFKSSQKEKPDIHTKLMKKYSEIPAWWFYLLMALSITVSLILCTVLKHEVQLPWWGLIFACGMAFIFTLPISIITATTNQSPGLNVITEYAMGLIMPGYPIAVVCFKVYGYMSMSQAVAFLSDFKLGHYMKIPPKSMFLVQFVGTIVAGTVNVGTAWWLLGSIHGICSDSLPPDSPWTCPSDRVFFDASVIWGLVGPRRIFGPEGNYGALNSFFLIGLAGPVIVYAFHRMFPNQKWIPLINLPVLFGATALMPPARAVNYNSWLIIGTIFNFFVFRYRKRWWTRYNYILSAGLDAGVAFMGVVLYFSLTMQNKSIDWWGTAGEHCLLATCPTAKGVDLGDGICPVF

SEQ ID NO: 7869 - DNA, 1701 bp, Sorghum bicolor
  misc_feature: Ceres ANNOT ID no. 6086041
  misc_feature: Encodes the peptide sequence at SEQ ID NO 7870
atgatcacggtggctgcaccggaggcgcagccgcaggtggcggcgcccgcggcgccggaggagactgtgttccggtcgaagctgccggacatcgacatcgccagccacctgcccctccacgagtactgcttcgcgagggcggcggaggtcgcggacgcgccgtgcctcatcgcggcggccacggggaggacctacacgtacgccgagacccggctcctgtgccgcaaggccgcggcgtcgctgcacgggctcggcgtcggccacggcgaccgcgtcatgatcctgctccagaactccgtcgagttcgtgctcaccttcctcggcgcgtcgttcctcggcgccgtcaccaccgccgccaacccgttctgcacgccgctggagatccacaagcagttcagggcctccggcgccaagctcatcgtcacccagtccgcctacgtcgacaagctccggcacgaggccttcccgaggatcggcggcgaggacaaggacaatgccctcaccgtcctcaccatcgacgacgtggccgacaccccggaaggctgcctggccttctgggagctggtcacgcccgccgacgacgccgcgctcccggaggtgtccatctcccccgacgaccccgtggcgctgccgttctcgtcgggcaccacggggctgcccaagggcgtggtgctcacccacggcgggcaggtgtccaacgtggcgcagcaggtggacggcgcgaacccgaacctgtacatgcgggagggcgacgtcgcgctctgcgtgctgccgctgttccacatcttctcgctcaactccgtgctgctgtgcgcgctgcgtgccggcgcggcggtgatgctgatgcccaagttcgagatgggcgcgatgctggagggcatccagcggtggcgcgtcacggtggccgccgtcgtgccgccgctggtgctcgccttggccaagaaccccgcgctggagaagtacgacctcagttccatccggatcgtgctctccggcgccgcgccgcttggcaaggagctcgtcgacgcgctccgcgcccgcgtgccacaggccgtcttcggacaggggtacgggatgacggaggccgggcccgtgctgtccatgtgcccggcgttcgccaaggagccgacgcccgccaagccggggtcgtgcggcacggtggtgcgcaatgccgagctcaaggtggtggaccccgacacgggcctctccctcggccgcaacctccccggcgagatctgcatccggggcccgcagatcatgaaagggtacctgaacgacccggaggccaccgccaggacgatcgacgtcgacggctggctccacaccggcgacatcggctacgtcgacgacgacgacgaggtcttcatcgtcgaccgcgtcaaggagctcatcaagttcaagggcttccaggtgccgccggccgagctcgaggctctgctcatcgcccacccatccatcgccgacgcagccgtcgtcccgcaaaaggatgacgccgccggcgaggtccctgtcgccttcgtggtccgcgccgccgactccgacatcgcggaggatgccatcaaggagttcatctccaagcaggtggtgttctacaagaggctacacaaggtgtacttcaccccctccatccccaagtcggcgtccgggaagattctgaggagagagctacgcgccaagctcgcggcagccgcatccacttga

SEQ ID NO: 7870 - protein, 566 aa, Sorghum bicolor
  misc_feature: Ceres ANNOT ID no. 6086041
  misc_feature (66)..(491): Pfam Id: AMP-binding Pfam Desc: AMP-binding enzyme
  misc_feature (1)..(562): NCBI GI: 76789647 NCBI Desc: 4-coumarate--coa ligase 2 (4cl 2) (4-coumaroyl-coa synthase 2)
  misc_feature (1)..(562): NCBI GI: 41053213 NCBI Desc: 4-coumarate:coa ligase isoform 2 [oryza sativa (japonica cultivar-group)]
  misc_feature (1)..(565): NCBI GI: 7188335 NCBI Desc: 4-coumarate--coa ligase 4cl1 [lolium perenne]
  misc_feature (1)..(562): NCBI GI: 893294 NCBI Desc: 4-coumarate:coa ligase isoform 2
  misc_feature (1)..(565): NCBI GI: 3258637 NCBI Desc: 4-coumarate:coa ligase [populus tremuloides]
  misc_feature (1)..(562): SWISSPROT Homolog: EC 6.2.1.12 4-coumarate--CoA ligase 2
  misc_feature: Useful for making plants with altered cell wall content and/or composition
  misc_feature: GREAT-hit functional homolog of the protein sequence encoded by LOCUS at1g65060
  misc_feature: Useful for making plants with altered cell wall content and/or composition
  misc_feature: Functional homolog of the protein sequence given in SEQ ID NO 13696
  misc_feature: Useful for making plants with altered lignin content
  misc_feature: Functional homolog of the protein sequence given in SEQ ID NO 13358
  misc_feature: Useful for making plants with altered carbohydrate content
  misc_feature: Functional homolog of the protein sequence given in SEQ ID NO 14004
MITVAAPEAQPQVAAPAAPEETVFRSKLPDIDIASHLPLHEYCFARAAEVADAPCLIAAATGRTYTYAETRLLCRKAAASLHGLGVGHGDRVMILLQNSVEFVLTFLGASFLGAVTTAANPFCTPLEIHKQFRASGAKLIVTQSAYVDKLRHEAFPRIGGEDKDNALTVLTIDDVADTPEGCLAFWELVTPADDAALPEVSISPDDPVALPFSSGTTGLPKGVVLTHGGQVSNVAQQVDGANPNLYMREGDVALCVLPLFHIFSLNSVLLCALRAGAAVMLMPKFEMGAMLEGIQRWRVTVAAVVPPLVLALAKNPALEKYDLSSIRIVLSGAAPLGKELVDALRARVPQAVFGQGYGMTEAGPVLSMCPAFAKEPTPAKPGSCGTVVRNAELKVVDPDTGLSLGRNLPGEICIRGPQIMKGYLNDPEATARTIDVDGWLHTGDIGYVDDDDEVFIVDRVKELIKFKGFQVPPAELEALLIAHPSIADAAVVPQKDDAAGEVPVAFVVRAADSDIAEDAIKEFISKQVVFYKRLHKVYFTPSIPKSASGKILRRELRAKLAAAAST

SEQ ID NO: 7871 - DNA, 1950 bp, Sorghum bicolor
  misc_feature: Ceres ANNOT ID no. 6086046
  misc_feature: Encodes the peptide sequence at SEQ ID NO 7872
atggccgccgccgccgccgctaaggcagcggccgcggccgtctccgcgggggccgccttcgcgctctcctccgagcgggcccacgccgacgggggcggctccaccttccgcttccccggcttctactcctccgcccccgcccaggccccttcacccgccgcgccgccgccccagcagtccccaccgccgtcgggagggcggcgcgaggatgccccggaggagccgcccaaggtttcgactcagcaccctcgcaccagtgccgcgggcttcgaccccgcgccgctggagcgtggggtggaggcgcttaaccagatcaataagtcgccggaccccaaaaagctgttcgagcttatgaagaagcgggaggagacgcaccagcaggaaatagctgcgaagaaactcgagtttcagaagtcactggccgagatcgagcttgagcaaaaacgggtggatttcgaagaaaggaaaaaacttgatcaacaacgagctaaatttaagtcgcagacagctcagtacgaggatgagctgaaaaggaagcgactgcaggctgaacatgaggcgcagaggataaggaaccaggagcttgtgaagatgcaagaggaatctgggattaggctagagcaaatcaggcgggcaactgaggagcaaatccaggaacaaaggagacagacagagaggcataaggccgatctagagcagaagaccatttcaaagaaagccatggcagaggcagaggggagaatactagtaacaaagcaaactgaagatgtgaaaaggcgattgcttttggaggagataaatgctgacagggagaagtggatccaagtgataaacacaacctttgagcatataggaggtggtttacgaacgatcttaactgatcaaaataagctagtcgtagcagtgggaggtataacagcacttgctgcaggaatatacacaacaagggagggtgcaagagtagtctggggctatgttgatcgtattctaggtcagccttcactgataagggagtcatcacgagggaaatatccctggtctggttccctctcacgtgctacaagtacactgactagcaaactgaagaacggaagcaacctagggaaggatggaaatgggtttggtgatgttattctaaatccttctctccagaagagagtgaagcagcttgctaatgccacggccaatacgaaacttcatcaagctcctttcaggaacatgcttttctatgggcctcctggcacagggaaaaccatggcagcacgagaactagctcgcaattctggattagattatgcactaatgactggtggagatgttgcaccattgggatcacaagcagtcaccaagattcatcagttgtttgactgggcaaagaaatctaataggggtttgctcctcttcatagatgaagcggatgctttcttgtgcgaacggaacaaaacttacatgagtgaagctcaaaggagtgccctaaatgctctcctcttccgcacaggtgaccaatcgaaggacattgtccttgcacttgccaccaacaggcctggtgaccttgactctgctgtcgctgaccgtatcgatgaggtcctggaatttcccctgcctggggaagatgagcgattcaagctcctgaagctatacctggacaagtacatcatcaaagccggtgacaaacacgagaagagctggctccgtttcttccgccgccagccccagaagatcgaggtgaaaggcatcactgatgacctgatccgggaggcagcggctaagacccagggcttctctgggagggaaatagcaaaaatgatggcaagcgtccaggccgctgtctatgggagcaaggactgcgagctcaccccaggcctgttccgcgaggttgtggactacaaggtcgcagagcaccagcagcggagaagattagctggtgaggagccaaagcagaatgcctag

SEQ ID NO: 7872 - protein, 649 aa, Sorghum bicolor
  misc_feature: Ceres ANNOT ID no. 6086046
  misc_feature (406)..(614): Pfam Id: AAA Pfam Desc: ATPase family associated with various cellular activities(AAA)
  misc_feature (53)..(643): NCBI GI: 41053150 NCBI Desc: aaa-type atpase-like [oryza sativa (japonica cultivar-group)]
  misc_feature (60)..(643): NCBI GI: 4006905 NCBI Desc: atpase-like protein [arabidopsis thaliana]
  misc_feature (58)..(631): NCBI GI: 46229377 NCBI Desc: aaa domain containing protein [cryptosporidium parvum]
  misc_feature (58)..(631): NCBI GI: 67624637 NCBI Desc: 26s proteosome regulatory subunit [cryptosporidium hominis]
  misc_feature (58)..(631): NCBI GI: 54659798 NCBI Desc: 26s proteosome regulatory subunit [cryptosporidium hominis]
  misc_feature: The sequence is a functional homolog of SEQ ID NO. 471 in the 11/188,298 US application
  misc_feature: The sequence is a functional homolog of SEQ ID NO. 462 in the 11/188,298 US application
MAAAAAAKAAAAAVSAGAAFALSSERAHADGGGSTFRFPGFYSSAPAQAPSPAAPPPQQSPPPSGGRREDAPEEPPKVSTQHPRTSAAGFDPAPLERGVEALNQINKSPDPKKLFELMKKREETHQQEIAAKKLEFQKSLAEIELEQKRVDFEERKKLDQQRAKFKSQTAQYEDELKRKRLQAEHEAQRIRNQELVKMQEESGIRLEQIRRATEEQIQEQRRQTERHKADLEQKTISKKAMAEAEGRILVTKQTEDVKRRLLLEEINADREKWIQVINTTFEHIGGGLRTILTDQNKLVVAVGGITALAAGIYTTREGARVVWGYVDRILGQPSLIRESSRGKYPWSGSLSRATSTLTSKLKNGSNLGKDGNGFGDVILNPSLQKRVKQLANATANTKLHQAPFRNMLFYGPPGTGKTMAARELARNSGLDYALMTGGDVAPLGSQAVTKIHQLFDWAKKSNRGLLLFIDEADAFLCERNKTYMSEAQRSALNALLFRTGDQSKDIVLALATNRPGDLDSAVADRIDEVLEFPLPGEDERFKLLKLYLDKYIIKAGDKHEKSWLRFFRRQPQKIEVKGITDDLIREAAAKTQGFSGREIAKMMASVQAAVYGSKDCELTPGLFREVVDYKVAEHQQRRRLAGEEPKQNA

SEQ ID NO: 7873 - DNA, 825 bp, Sorghum bicolor
  misc_feature: Ceres ANNOT ID no. 6086049
  misc_feature: Encodes the peptide sequence at SEQ ID NO 7874
atgcaccacgatcccaaccccttcgacgatggcgccgacgagaaccccttctcgaatggaggcggaggagcgcgtggcggaggcgtcaagtcgcagtacgggttccggccggcggagcccgcggggttcggcggcggcggcggcaggggcgatgcgaccgtcgacatccccctcgacaccatgaacgattcgaagggcaaggcgaaggagctgtctcagtgggagtcagatctcaggaggcgagagtcggatatcaggagaagggaggaagctctcaagagcgctggggtgcccatggaggacaagaactggccgcctttcttcccaatcatccaccatgatattgccaatgagataccagcgaacgcccagaagttgcagtatcttgcgttcgcgagctggcttggtattgtgctttgtctcttttggaattttattgctgtcatagtctgttggatcagagggggagattccaagctatttttcctggctaccatctatggtatgcttggcatccctttgtcctatttgatgtggtatagacctctgtaccgagcaatgagaactgacagtgctttcagctttggatggtttttcctttgttacctgctccacattggcttttgcatatttgctgccattgctcctccaattatattccgcggaaaatcgttaacgggtatactggctgcaattgacaccttttctgatcatgcaatagttgggatcttttactttgttggatttgccttgttttgcttggagacacttgtgagcatatgggttcttcagaaagtatacatgtacttcagagggcacaagtag

SEQ ID NO: 7874 - protein, 274 aa, Sorghum bicolor
  misc_feature: Ceres ANNOT ID no. 6086049
  misc_feature (100)..(274): Pfam Id: SCAMP Pfam Desc: SCAMP family
  misc_feature (1)..(274): NCBI GI: 115460268 NCBI Desc: os04g0595800 [oryza sativa (japonica cultivar-group)]
  misc_feature (37)..(264): NCBI GI: 32492338 NCBI Desc: osjnba0006a01.24 [oryza sativa (japonica cultivar-group)]
  misc_feature (3)..(272): NCBI GI: 3941289 NCBI Desc: similarity to scamp37 [pisum sativum]
  misc_feature (3)..(272): NCBI GI: 15220305 NCBI Desc: secretory carrier membrane protein (scamp) family protein [arabidopsis thaliana]
  misc_feature (3)..(272): NCBI GI: 7109232 NCBI Desc: secretory carrier membrane protein [oryza sativa]
  misc_feature: Useful for biocontainment applications
  misc_feature: Functional homolog of the protein sequence given in SEQ ID NO 13043
MHHDPNPFDDGADENPFSNGGGGARGGGVKSQYGFRPAEPAGFGGGGGRGDATVDIPLDTMNDSKGKAKELSQWESDLRRRESDIRRREEALKSAGVPMEDKNWPPFFPIIHHDIANEIPANAQKLQYLAFASWLGIVLCLFWNFIAVIVCWIRGGDSKLFFLATIYGMLGIPLSYLMWYRPLYRAMRTDSAFSFGWFFLCYLLHIGFCIFAAIAPPIIFRGKSLTGILAAIDTFSDHAIVGIFYFVGFALFCLETLVSIWVLQKVYMYFRGHK

SEQ ID NO: 7875 - DNA, 585 bp, Sorghum bicolor
  misc_feature: Ceres ANNOT ID no. 6086057
  misc_feature: Encodes the peptide sequence at SEQ ID NO 7876
atggggcaggctttccgcaagctgttcgatgccttcttcggcaccagcgagatgagggttgtgatgcttggtctggatgccgccggtaaaaccaccatcctgtacaagctgcatatcggggaggttctgtcgactgttcccacgattggtttcaatgtcgagaaagttcaatacaagaatgtgatgtttactgtttgggatgttggtggccaagaaaagttgaggcccttgtggaggcactacttcaacaatactgatggcttgatctacgtagttgattcattggatcgggagagaattggtaaagccaaagctgaatttcaggctataatcaatgatcctctgatgcttaacagtgtcatattggtatttgccaataagcaagatatgaaaggggcaatgacaccaatggaggtgtgtgagggccttggcctctacgatttgaagaatcgcatctggcacatccaaggctcttgtgcgctcaaaggtgatggcctttatgagggcttggactggctggcaagcacactgaaggaattgcaagcttcaggccgcctaccctctggagggacatcgttgttctaa

SEQ ID NO: 7876 - protein, 194 aa, Sorghum bicolor
  misc_feature: Ceres ANNOT ID no. 6086057
  misc_feature (5)..(177): Pfam Id: Arf Pfam Desc: ADP-ribosylation factor family
  misc_feature (19)..(179): Pfam Id: Ras Pfam Desc: Ras family
  misc_feature (19)..(129): Pfam Id: Miro Pfam Desc: Miro-like protein
  misc_feature (1)..(192): NCBI GI: 58220034 NCBI Desc: adp-ribosylation factor [daucus carota]
  misc_feature (1)..(194): NCBI GI: 92893756 NCBI Desc: ras gtpase [medicago truncatula]
  misc_feature (1)..(192): NCBI GI: 140058498 NCBI Desc: ras small gtpase, ras type; small gtp-binding protein domain [medicago truncatula]
  misc_feature (1)..(183): NCBI GI: 92890620 NCBI Desc: ras gtpase [medicago truncatula]
  misc_feature (1)..(178): NCBI GI: 3182915 NCBI Desc: adp-ribosylation factor
  misc_feature: Useful for making plants with altered terpenoid content
  misc_feature: Functional homolog of the protein sequence given in SEQ ID NO 13081
  misc_feature: Useful for making plants with altered alkaloid content
  misc_feature: Useful for making plants with altered lignin content
  misc_feature: Functional homolog of the protein sequence given in SEQ ID NO 12945
  misc_feature: Useful for making plants with modulated nitrogen use efficiency
  misc_feature: Functional homolog of the protein sequence given in SEQ ID NO 14003
  misc_feature: Useful for making plants with altered terpenoid content
  misc_feature: Functional homolog of the protein sequence given in SEQ ID NO 13081
  misc_feature: The sequence is a functional homolog of SEQ ID NO. 400 in the 11/188,298 US application
MGQAFRKLFDAFFGTSEMRVVMLGLDAAGKTTILYKLHIGEVLSTVPTIGFNVEKVQYKNVMFTVWDVGGQEKLRPLWRHYFNNTDGLIYVVDSLDRERIGKAKAEFQAIINDPLMLNSVILVFANKQDMKGAMTPMEVCEGLGLYDLKNRIWHIQGSCALKGDGLYEGLDWLASTLKELQASGRLPSGGTSLF

SEQ ID NO: 7877 - DNA, 2361 bp, Sorghum bicolor
  misc_feature: Ceres ANNOT ID no. 6086058
  misc_feature: Encodes the peptide sequence at SEQ ID NO 7878
atgctgggccgccgcctcgcgctgctcccggcggcgaccgtcgcgcgcgggggcacggcgacgcgggcgcggatgacggtggggtgcgtgctggtcgaccacgtggcgccgcggctcgcggtggcctcggccgcgctcgtgggtgcccgggaggtgatcgcggcggctgccgccgcgggcgcggggggaagcggcgcggcgcacggcgccgtggcgtcgacgctcgcgcaggtcgccgtcacggccgtggcgattgcatcgggggcgtgcctctcaaccaaagtcgacttcctctggcctcgcatcgagcagttgccagatactcttatatttgaaggagtggaggtgacaggataccagatatttgaggatccaaaggtgcagaaagcaatagaatttgctagtacagcccaccttgggcaatttaggagaacaggagatccatatgttacacactgcatacatactgggaaaattttagctgccttggttccatcaactggagaaagagctgttaacacagttgtggctggcattcttcacgatgttgtttgtgatacatcagagagcttgaagagcatagaagaacagtttggggatgatgttgctagcttggtatctggtgtatcaaaattaagctacataaaccagctacttcgcaggcatcgacaaaaaaataccggtgggagcactcttacttcagaagaagtatgttcccttccactagtctttattgcatgctatgctcttcctgtacctaaagctgaagctgttgctcaagagacattggctgtctggtgttcacttgcttctcgattgggagtctgggctttgaaagctgagctggaagatttatgttttgctgtccttcaggacctactgcaggcagttttgccatttgacatctttttggatcggaagaggcgttcatacttccttaggaatctcaataataattctggagaatctataccaaatcctaagatagttgacgatgctgctgttgcattagcatctttagcatcttgtgaggaagaacttgagcgagaattgctcatatcaacatcatacatacctgggatggaagtgactttgtcaagtagactcaagagcttgtacagtatctactgcaagatgaaaagaaaagataaaggacttaggcaagtgtatgatgctcgtgcattgagggtgattgtcggagacaaaaatggtgccatgcatggacctgctgtgcggagttgttacagcatccttgatatagtacacaggctatggactccaattgatggggagtttgatgattacattatcaatcctaagggtagcggttaccgatcactccacacagcagttcaggcatctgatagctcaccactggaggtccagattagaacccaggtctcttcacagcgaatgcatgagtacgcagaacatggacttgctgctcattggctgtataaagagagcaaagttgagtacagaagtagcatgagtaagagaataagacaaagtacatcatattcatctagttcttcagaagatgaaagttctatacaggatgatatcccatcaaagtacagttctataaaagtggggcatccagtgctaagaattgaaggttgtgacttactagcagctgtcatagtcagtatagataaaggaggaaaggaattgattgttgctgtaagttttagtcttgaagcttctgaagctgtagctgagctaaggtcatcttttcagttgaagcgttgggaagcctatgctaggcttcataaaaaggtttctgaaaagtggtggtgtgcacctggacatggtgactggtcaacaaatctggagaggtacacactatgccaggatggaatatttcataagcaagaccaatttgggagacttttacctacatttcttcaaataattgatttgacggaagaagaagaggaagagtattggatggttgtatctgccatattcgagggcaaagaaacttgcagtctaccatctgaatcgagttatgctgataaatcatcatctgaacctccaagttctactccattaagtgatcccatcaacaataaggtgcatttgctcagaaccatgcttcagtgggaggagcaagttcgccgtggtgcatctttggcagagaaaagtcttggtgtaaacacctgcacaaaaccaatcctgcgagaggtggccataatattctggcctaatggcaagattatgagaatgagcactggtagcacagctgctgacgctgctagaagaatgggcgttgaagggaagctgctttgggttaatggccaagtagttctgccccaaacagagctcaaggatggggatatagttgaagtgagggtatag

SEQ ID NO: 7878 - protein, 786 aa, Sorghum bicolor
  misc_feature: Ceres ANNOT ID no. 6086058
  misc_feature (367)..(490): Pfam Id: RelA_SpoT Pfam Desc: Region found in RelA / SpoT proteins
  misc_feature (149)..(272): Pfam Id: HD Pfam Desc: HD domain
  misc_feature (503)..(786): NCBI GI: 140058494 NCBI Desc: atp-dependent dna ligase; metal-dependent phosphohydrolase, hd region; tgs; dna polymerase iii clamp loader subunit, c-terminal [medicago truncatula]
  misc_feature (360)..(490): NCBI GI: 76587393 NCBI Desc: rela/spot protein [thermoanaerobacter ethanolicus atcc 33223]
  misc_feature (360)..(490): NCBI GI: 20807650 NCBI Desc: guanosine polyphosphate pyrophosphohydrolases/synthetases [thermoanaerobacter tengcongensis]
  misc_feature (360)..(488): NCBI GI: 83590516 NCBI Desc: (p)ppgpp synthetase i (gtp pyrophosphokinase), spot/rela [moorella thermoacetica atcc 39073]
  misc_feature (344)..(492): NCBI GI: 146296035 NCBI Desc: (p)ppgpp synthetase i, spot/rela [caldicellulosiruptor saccharolyticus dsm 8903]
MLGRRLALLPAATVARGGTATRARMTVGCVLVDHVAPRLAVASAALVGAREVIAAAAAAGAGGSGAAHGAVASTLAQVAVTAVAIASGACLSTKVDFLWPRIEQLPDTLIFEGVEVTGYQIFEDPKVQKAIEFASTAHLGQFRRTGDPYVTHCIHTGKILAALVPSTGERAVNTVVAGILHDVVCDTSESLKSIEEQFGDDVASLVSGVSKLSYINQLLRRHRQKNTGGSTLTSEEVCSLPLVFIACYALPVPKAEAVAQETLAVWCSLASRLGVWALKAELEDLCFAVLQDLLQAVLPFDIFLDRKRRSYFLRNLNNNSGESIPNPKIVDDAAVALASLASCEEELERELLISTSYIPGMEVTLSSRLKSLYSIYCKMKRKDKGLRQVYDARALRVIVGDKNGAMHGPAVRSCYSILDIVHRLWTPIDGEFDDYIINPKGSGYRSLHTAVQASDSSPLEVQIRTQVSSQRMHEYAEHGLAAHWLYKESKVEYRSSMSKRIRQSTSYSSSSSEDESSIQDDIPSKYSSIKVGHPVLRIEGCDLLAAVIVSIDKGGKELIVAVSFSLEASEAVAELRSSFQLKRWEAYARLHKKVSEKWWCAPGHGDWSTNLERYTLCQDGIFHKQDQFGRLLPTFLQIIDLTEEEEEEYWMVVSAIFEGKETCSLPSESSYADKSSSEPPSSTPLSDPINNKVHLLRTMLQWEEQVRRGASLAEKSLGVNTCTKPILREVAIIFWPNGKIMRMSTGSTAADAARRMGVEGKLLWVNGQVVLPQTELKDGDIVEVRV

SEQ ID NO: 7879 - DNA, 1422 bp, Sorghum bicolor
  misc_feature: Ceres ANNOT ID no. 6086069
  misc_feature: Encodes the peptide sequence at SEQ ID NO 7880
atgattgctgggggaggctattttgatggttctcatgatcatattctcatggaaggatcgatgatccatgattcttcccaatcttccatctatgacaatacagatgttgaacagcagaacttcagacttgcgccctttatcatagaagatcactccaatccagccaaccttacctctgagcctgcaagggtgatcgaccaaattcatcaccagcttgggattgacatggagcaggaccatagtgatcacatgatccaaggagttcctccagcagaaactgcaaatttagttcctgttgtctatggtgtccaagatcgtatcctcagccaccagatagaaggtccacataacataactgtggaacaacaggtcctggactacgaccctgcatcatatggaaatggcacttatgcagctgcacatgatcttctaaattctctacagatccaaaggtgcagtttgattcctgaatttccttcgacagaacatatctttggtgatccagcacagaacatggtcaatcctttggacattaccaatgaccttcaaggagtagcaactcatgaaagtggaatgatgttcagcgattcaactctaccattaggttatcatgctactcaatctcatatgttgaaggatctctatcattcactaccacaaaactatgggatatttaccagtgatgatgagagagatgggatggtcggggtagcaggggtctcaggaaatattttccaggagatagatgggagacagttcgacagcccagtactggggactagaagacagaaaggtggatttggcaagggcaagggaaaagctaactttgcaactgaaagagagaggagggagcagctaaatgtgaagtatggggctttaagatcactgttcccaaaccctactaagaatgacagggcctctatagttggagatgccattgactacatcaatgagcttaatagaacagtgaaagaactgaagatcttactggaaaagaagaggaacagcactgacaggaggaagatactgaagttggatgatgaagcagctgatgatggggaaagctcttcaatgcagccagtaagtgatgaccaaaacaatcagatgaatggggctataaggagctcctgggttcaaagaaggtccaaggagtgcgatgttgatgtccgcatagttgatgatgaaataaatatcaagttcacagagaagaagagagccaactctttgctttgtgctgcaaaggttctagaggagtttcgtcttgagctcatccatgttgttgggggaatcataggagatcaccatatattcatgttcaatacaaagatacctaagggctcttcggtgtacgcgtgcgcggtggctaagaagctccttgaagctgtggagataaagaagcaggctcttaatatcttcaactag

SEQ ID NO: 7880 - protein, 473 aa, Sorghum bicolor
  misc_feature: Ceres ANNOT ID no. 6086069
  misc_feature (271)..(320): Pfam Id: HLH Pfam Desc: Helix-loop-helix DNA-binding domain
  misc_feature (1)..(473): NCBI GI: 38345766 NCBI Desc: osjnba0083n12.3 [oryza sativa (japonica cultivar-group)]
  misc_feature (262)..(375): NCBI GI: 30684870 NCBI Desc: basic helix-loop-helix (bhlh) family protein [arabidopsis thaliana]
  misc_feature (261)..(450): NCBI GI: 33339705 NCBI Desc: myc2 [catharanthus roseus]
  misc_feature (240)..(461): NCBI GI: 68342448 NCBI Desc: basic helix-loop-helix transcription factor protein [rheum australe]
  misc_feature (261)..(461): NCBI GI: 1142621 NCBI Desc: phaseolin g-box binding protein pg2 [phaseolus vulgaris]
  misc_feature: The sequence is a functional homolog of SEQ ID NO 1501 in the 10/374,780US patent application
  misc_feature: Useful for making plants with altered alkaloid content
  misc_feature: Useful for making plants with altered terpenoid content
  misc_feature: Useful for making plants with modulated growth and phenotype characteristics
  misc_feature: Functional homolog of the protein sequence given in SEQ ID NO 13307
  misc_feature: Functional homolog of the protein sequence given in SEQ ID NO 13308
  misc_feature: The sequence is a functional homolog of SEQ ID NO 1501 in the 20060162006 US patent application
  misc_feature: The sequence is a functional homolog of SEQ ID NO. 483 in the 11/188,298 US application
MIAGGGYFDGSHDHILMEGSMIHDSSQSSIYDNTDVEQQNFRLAPFIIEDHSNPANLTSEPARVIDQIHHQLGIDMEQDHSDHMIQGVPPAETANLVPVVYGVQDRILSHQIEGPHNITVEQQVLDYDPASYGNGTYAAAHDLLNSLQIQRCSLIPEFPSTEHIFGDPAQNMVNPLDITNDLQGVATHESGMMFSDSTLPLGYHATQSHMLKDLYHSLPQNYGIFTSDDERDGMVGVAGVSGNIFQEIDGRQFDSPVLGTRRQKGGFGKGKGKANFATERERREQLNVKYGALRSLFPNPTKNDRASIVGDAIDYINELNRTVKELKILLEKKRNSTDRRKILKLDDEAADDGESSSMQPVSDDQNNQMNGAIRSSWVQRRSKECDVDVRIVDDEINIKFTEKKRANSLLCAAKVLEEFRLELIHVVGGIIGDHHIFMFNTKIPKGSSVYACAVAKKLLEAVEIKKQALNIFN

SEQ ID NO: 7881 - DNA, 840 bp, Sorghum bicolor
  misc_feature: Ceres ANNOT ID no. 6086071
  misc_feature: Encodes the peptide sequence at SEQ ID NO 7882
atgagcatgttcgaggggatggagagggccgggtacggcggcgctgggccgatgggcggggtggtgctgtcgcgggaccccaagccgcggctgcggtggacgcccgacctgcacgagcgcttcgtcgaggccgtcaccaagctcggcgggcccgacaaggcgacgcccaagtcagtgctgaggctgatgggaatgaaagggctcactttgtaccacttgaagagtcacctccagaaatacaggcttggaaagcagagcaagaaagacacaggtttggaagccagcagaggggcattcgcggcgcagggcatcaatttctccacaccagtacctcctagcattccatctacggccagtaacaatacgggagaaacgccacttgcggatgcgctgaagtaccaaattgaagtccaaaggaaactgcacgaacagctcgaggttcagaagaagctgcaaatgcggatcgaggcgcaaggcaaatatctgcagacgatactcgagaaagcccagagcaacctctcctacgacgcaaccggaggcgcaaatctagaagcaaccaggtcacagctgacggacttcaacctcgcgctctcagggttcatggacaacgtgacccaagtgtgcgagcagaaaaatggcgagctggcgaaagccatgtccgaggacggcctcagagcgagcaataatcttggatttcagctgtaccaccatggagttcaggacagggacgatgtcaagtgcgcgacggatgaagggctgctgctgctggacctgaacattagaggagggtacgatcaccgggcttcggcggatctgaagatgaatcagcacatgaggtaa

SEQ ID NO: 7882 - protein, 279 aa, Sorghum bicolor
  misc_feature: Ceres ANNOT ID no. 6086071
  misc_feature (30)..(81): Pfam Id: Myb_DNA-binding Pfam Desc: Myb-like DNA-binding domain
  misc_feature (3)..(279): NCBI GI: 115448117 NCBI Desc: os02g0700300 [oryza sativa (japonica cultivar-group)]
  misc_feature (22)..(265): NCBI GI: 79530151 NCBI Desc: transcription factor [arabidopsis thaliana]
  misc_feature (20)..(174): NCBI GI: 115444531 NCBI Desc: os02g0174000 [oryza sativa (japonica cultivar-group)]
  misc_feature (14)..(192): NCBI GI: 14596181 NCBI Desc: transfactor-like protein [arabidopsis thaliana]
  misc_feature (14)..(192): NCBI GI: 28059694 NCBI Desc: transfactor-like protein [arabidopsis thaliana]
  misc_feature: The sequence is a functional homolog of SEQ ID NO 1233 in the 10/666,642US patent application
  misc_feature: The sequence is a functional homolog of SEQ ID NO 1338 in the 10/374,780US patent application
  misc_feature: The sequence is a functional homolog of SEQ ID NO 1339 in the 10/374,780US patent application
  misc_feature: The sequence is a functional homolog of SEQ ID NO 1857 in the 10/374,780US patent application
  misc_feature: The sequence is a functional homolog of SEQ ID NO 1990 in the 11/479,226US patent application
  misc_feature: The sequence is a functional homolog of SEQ ID NO 1992 in the 11/479,226US patent application
  misc_feature: The sequence is a functional homolog of SEQ ID NO 1999 in the 11/479,226US patent application
  misc_feature: The sequence is a functional homolog of SEQ ID NO 2000 in the 11/479,226US patent application
  misc_feature: The sequence is a functional homolog of SEQ ID NO 933 in the 10/666,642US patent application
  misc_feature: Useful for making plants with modulated growth and phenotype characteristics
  misc_feature: The sequence is a functional homolog of SEQ ID NO 1338 in the 20060162006 US patent application
  misc_feature: The sequence is a functional homolog of SEQ ID NO 1339 in the 20060162006 US patent application
  misc_feature: The sequence is a functional homolog of SEQ ID NO 1857 in the 20060162006 US patent application
  misc_feature: The sequence is a functional homolog of SEQ ID NO 1990 in the 20070022495 US patent application
  misc_feature: The sequence is a functional homolog of SEQ ID NO 1992 in the 20070022495 US patent application
  misc_feature: The sequence is a functional homolog of SEQ ID NO 1999 in the 20070022495 US patent application
  misc_feature: The sequence is a functional homolog of SEQ ID NO 2000 in the 20070022495 US patent application
  misc_feature: The sequence is a functional homolog of SEQ ID NO 1233 in the 20070033671 US patent application
  misc_feature: The sequence is a functional homolog of SEQ ID NO 933 in the 20070033671 US patent application
  misc_feature: The sequence is a functional homolog of SEQ ID NO 1589 in the 11/479,226 US patent application
  misc_feature: The sequence is a functional homolog of SEQ ID NO 762 in the 10/412,699 US patent application
  misc_feature: The sequence is a functional homolog of SEQ ID NO 1062 in the 10/225,066 US patent application
  misc_feature: The sequence is a functional homolog of SEQ ID NO 2788 in the 10/374,780 US patent application
  misc_feature: Useful for making plants with altered alkaloid content
  misc_feature: Useful for making plants with altered lignin content
  misc_feature: Functional homolog of the protein sequence given in SEQ ID NO 13089
  misc_feature: The sequence is a functional homolog of SEQ ID NO 1097 in the 11/479,226 US patent application
  misc_feature: The sequence is a functional homolog of SEQ ID NO 2402 in the 10/374,780 US patent application
  misc_feature: The sequence is a functional homolog of SEQ ID NO 548 in the 10/225,066 US patent application
  misc_feature: Useful for making plants with altered terpenoid content
  misc_feature: Functional homolog of the protein sequence given in SEQ ID NO 13070
  misc_feature: Useful for making plants with modulated flowering time
  misc_feature: Functional homolog of the protein sequence given in SEQ ID NO 13579
  misc_feature: The sequence is a functional homolog of SEQ ID NO 2000 in the 11/479,226 US patent application
  misc_feature: The sequence is a functional homolog of SEQ ID NO 1995 in the 11/479,226 US patent application
  misc_feature: The sequence is a functional homolog of SEQ ID NO 1996 in the 11/479,226 US patent application
  misc_feature: The sequence is a functional homolog of SEQ ID NO 1997 in the 11/479,226 US patent application
  misc_feature: The sequence is a functional homolog of SEQ ID NO 1998 in the 11/479,226 US patent application
  misc_feature: The sequence is a functional homolog of SEQ ID NO 2001 in the 11/479,226 US patent application
  misc_feature: The sequence is a functional homolog of SEQ ID NO 1999 in the 11/479,226 US patent application
MSMFEGMERAGYGGAGPMGGVVLSRDPKPRLRWTPDLHERFVEAVTKLGGPDKATPKSVLRLMGMKGLTLYHLKSHLQKYRLGKQSKKDTGLEASRGAFAAQGINFSTPVPPSIPSTASNNTGETPLADALKYQIEVQRKLHEQLEVQKKLQMRIEAQGKYLQTILEKAQSNLSYDATGGANLEATRSQLTDFNLALSGFMDNVTQVCEQKNGELAKAMSEDGLRASNNLGFQLYHHGVQDRDDVKCATDEGLLLLDLNIRGGYDHRASADLKMNQHMR

SEQ ID NO: 7883 - DNA, 1236 bp, Sorghum bicolor
  misc_feature: Ceres ANNOT ID no. 6086077
  misc_feature: Encodes the peptide sequence at SEQ ID NO 7884
atgctggcgtgcatcgcctgctcgaccaaggacggcggggatcaggacggcggcccccgcgccgccacgccccacgggagggacgccggcagcaagtcactcacatcccagctcaaggacatggtgctcaagttctccggctccggcaggcagtacaaggccgcgacgagcccgtcgttcaggggcaaccgcttccaccgtaacagccgccttgccgcgtacccgggcgtcatcgacgactcgggcttcacgtcggacggcgccgccgagggctacagtagttacatgaggacgaggacggacgcgaccgccgcgagaaccatgcctgcccctccgccgtgggacgcggccaccaaggtcgcccgtggcttcccgcagcagcacgtcaggagcccgagcgcgagctggattccgagcatcggggaggaggaggcggaggaagaggaagaggaggaggacgacgaggttgtcgtcctggaagaggatcgcgtgccgagggagtggacggcccaggtggagcccggcgtgcagatcaccttcgtctccatcccgggcggcgccggcaacgacctaaaacgaatccgcttcagccgcgacattttcaacaagtgggaggcgcagcggtggtggggggagaactacgaccgcgtggtggagctctacaacgtgcagacgttcagccggcagcagggcatctcgacgccgacgtcctccatcgacgacgccacgcagagagactcgtcgttctactcccgcgcaggctcgacgagggagagcccggtgatcctgccgccgacgacagcggtgggcagggagcagccgatcgtccgcgccacttcgtgcagggccatggcggcggcagcttcttccacggcccgtgccgcgtgcaacccgtcgtccagtgccgtgccggacccgtcggaccacgtgtgggcgcaccacttcaacctgctcaactccgcgccggcgccgggtgctccgccgcacctggacccgtcgcgcgctaccacgtcgtccctggacgaggcgtccgtgtccgtgagcaacgcgagcgacctggaggccacggagtgggtggagcaggacgagcccggcgtgtccatcaccatccgcgagttcggcgacggcacccgcgagctccgccgcgtccgcttcagccgggagaggttcggcgaggacagggccaaggtgtggtgggagcagaacagagaccgaatacacgcgcagtacctgtga

SEQ ID NO: 7884 - protein, 411 aa, Sorghum bicolor
  misc_feature: Ceres ANNOT ID no. 6086077
  misc_feature (186)..(221): Pfam Id: DZC Pfam Desc: Disease resistance/zinc finger/chromosome condensation-likeregion
  misc_feature (375)..(410): Pfam Id: DZC Pfam Desc: Disease resistance/zinc finger/chromosome condensation-likeregion
  misc_feature (112)..(259): NCBI GI: 109020194 NCBI Desc: brevis radix [arabidopsis thaliana]
  misc_feature (115)..(274): NCBI GI: 56461772 NCBI Desc: at1g54180 [arabidopsis thaliana]
  misc_feature (1)..(221): NCBI GI: 38345776 NCBI Desc: osjnba0083n12.14 [oryza sativa (japonica cultivar-group)]
  misc_feature (1)..(221): NCBI GI: 116310917 NCBI Desc: b0403h10-osigba0105a11.7 [oryza sativa (indica cultivar-group)]
  misc_feature (115)..(411): NCBI GI: 57222218 NCBI Desc: at1g54180 [arabidopsis thaliana]
MLACIACSTKDGGDQDGGPRAATPHGRDAGSKSLTSQLKDMVLKFSGSGRQYKAATSPSFRGNRFHRNSRLAAYPGVIDDSGFTSDGAAEGYSSYMRTRTDATAARTMPAPPPWDAATKVARGFPQQHVRSPSASWIPSIGEEEAEEEEEEEDDEVVVLEEDRVPREWTAQVEPGVQITFVSIPGGAGNDLKRIRFSRDIFNKWEAQRWWGENYDRVVELYNVQTFSRQQGISTPTSSIDDATQRDSSFYSRAGSTRESPVILPPTTAVGREQPIVRATSCRAMAAAASSTARAACNPSSSAVPDPSDHVWAHHFNLLNSAPAPGAPPHLDPSRATTSSLDEASVSVSNASDLEATEWVEQDEPGVSITIREFGDGTRELRRVRFSRERFGEDRAKVWWEQNRDRIHAQYL

SEQ ID NO: 7885 - DNA, 981 bp, Sorghum bicolor
  misc_feature: Ceres ANNOT ID no. 6086084
  misc_feature: Encodes the peptide sequence at SEQ ID NO 7886
atggccgcggcgctcttcctcctgctggtcccgcccgtcggcctactcgccgcgctcgcattcctcgcgcggccccgcgccgcgcggatcccgctcaaaggccgccacgtcttcatcacgggcgggtccagcggcatcgggctcgccatggccacggccgcggcgcgggagggcgcgcgggtctccatcctggcccgcaacctcgcccgcctcgaggaggcgcgcgccgccatccagcgcgactcgggccgcgacgacgtcggcgtccacgcggcggacgtgcgggacgccggcgccgtggcgcgcgcgctccgggaggccggccccgtcgacgtcctggtctgcaaccacggcgtgttcgtgccgcaggagctcgagaggcaggacatagatgagatcaagtggatggtcgacatcaacctcatgggcaccttccacctcatcaaggccgcgcttcccgccatgaaggcacgcacccgcgagacgcgcctccctgggtccgtcgcgatcatgtcctcccaggccggccaggttggtatttatggttacaccgcgtactcagcgagcaagtttgctcttcggggattgggtgaggcgttgcagcatgaggttgtcgcggacaatattcatgtctcattgatattccctcctgacaccgagactccgggatttgaagaggagcataagaggaggccagaattgacaaacatcctggcaggatcgtctggtggaatgaaggccgatgatgttgccaacaaggctctggacggcatcaaatctgcaaaattcattgtcccctgcaatttcgagggcgcaatgttagctgttgccactgctggtttatccccgcaaagctccccgttattggcattcatagaggtgattggcgctggactcatgcggtttgcggcactttgtttccaatggaattggttctctaccatagagagctattatgccaagaacaagaagagcgagtga

SEQ ID NO: 7886 - protein, 326 aa, Sorghum bicolor
  misc_feature: Ceres ANNOT ID no. 6086084
  misc_feature (35)..(205): Pfam Id: adh_short Pfam Desc: short chain dehydrogenase
  misc_feature (1)..(324): NCBI GI: 15239681 NCBI Desc: short-chain dehydrogenase/reductase (sdr) family protein [arabidopsis thaliana]
  misc_feature (7)..(323): NCBI GI: 140060068 NCBI Desc: short-chain dehydrogenase/reductase sdr [medicago truncatula]
  misc_feature (7)..(325): NCBI GI: 108883657 NCBI Desc: short-chain dehydrogenase [aedes aegypti]
  misc_feature (7)..(326): NCBI GI: 46249476 NCBI Desc: mgc81046 protein [xenopus laevis]
  misc_feature (7)..(317): NCBI GI: 55236668 NCBI Desc: ensangp00000014198 [anopheles gambiae str. pest]
  misc_feature: The sequence is a functional homolog of SEQ ID NO. 389 in the 11/188,298 US application
MAAALFLLLVPPVGLLAALAFLARPRAARIPLKGRHVFITGGSSGIGLAMATAAAREGARVSILARNLARLEEARAAIQRDSGRDDVGVHAADVRDAGAVARALREAGPVDVLVCNHGVFVPQELERQDIDEIKWMVDINLMGTFHLIKAALPAMKARTRETRLPGSVAIMSSQAGQVGIYGYTAYSASKFALRGLGEALQHEVVADNIHVSLIFPPDTETPGFEEEHKRRPELTNILAGSSGGMKADDVANKALDGIKSAKFIVPCNFEGAMLAVATAGLSPQSSPLLAFIEVIGAGLMRFAALCFQWNWFSTIESYYAKNKKSE

SEQ ID NO: 7887 - DNA, 1224 bp, Sorghum bicolor
  misc_feature: Ceres ANNOT ID no. 6086087
  misc_feature: Encodes the peptide sequence at SEQ ID NO 7888
atggcggacgggagcctctgcgcctggtggtgctgtgccgtagcctgcgcgctggcggttgtcgcagcggacggcgtcctcgtggacatcacctatgtggaaagcgccgtggccaaaggagcagtgtgtttggatggtagcgcgccggcgtaccatctcgcccgcggctccggctccggcgagaacagctggctggtccatttcgagggtggaggatggtgcaacaatgtcacgacctgcctgcagcggaagcgcacgcgattgggatcatccaaggagatggcgacgcagattgccttctccggaatcctcagtgacacgccggatggcaacccagacttttacaattggaacaaagtcaaggttcggtactgcgatggttcatctttcactggcgatgttgaagaagttgatcctacaacaaagttacactttagaggtgcgaggatatggcaagctgtcatggaggacctgcttgcaaaagggatggacaaagctgaaaatgtgtgcattctcacaagcatagttcttggcaaccataatggctgttctgctggcggtttaacctccatactacactgtgacagatttcatgaccttctgccgctggctgcaagagttaaatgcctttctgatgctgggttcttcattaacgagaaagatgttgctggagttgggtacattgctgcttttttcaacgatgtggttacaacacatgggtcagcaaataatttaccgccttcatgcacttcaatgttacctccaggaatgtgctttttccccaagaacgaggtgaaacagatacatacacctctattcatcctcaacgcagcatatgattcatggcaggtaaggaacattttggtgccaggagttgctgaccctcatggtaaatggcatagctgtaagcatgacatcggccagtgctctgcatcgcagctacgggtattgcagggattcaggggtgattttttgaaggaagtgtctgaacaagcgaactccgactcaagagggttgttcataaactcatgcttcgtgcactgccagtctgagtcgcaggagctatggttctcatctgactcccccaagctcggaaacacaacaatagcaaacgctgttggcgactggttcttcggtcgcagctccttccagaagatagactgcccgtacccttgtgactcgacctgtcacaatgggatctacgaggactcatcacaagcatag

SEQ ID NO: 7888 - protein, 407 aa, Sorghum bicolor
  misc_feature: Ceres ANNOT ID no. 6086087
  misc_feature (12)..(386): Pfam Id: PAE Pfam Desc: Pectinacetylesterase
  misc_feature (10)..(401): NCBI GI: 52421285 NCBI Desc: at4g19420 [arabidopsis thaliana]
  misc_feature (10)..(406): NCBI GI: 1431629 NCBI Desc: pectinacetylesterase precursor [vigna radiata var. radiata]
  misc_feature (9)..(402): NCBI GI: 37932212 NCBI Desc: pectin acetylesterase [lactuca sativa]
  misc_feature (41)..(401): NCBI GI: 145362544 NCBI Desc: pectinacetylesterase family protein [arabidopsis thaliana]
  misc_feature (13)..(398): NCBI GI: 38344147 NCBI Desc: osjnba0041a02.14 [oryza sativa (japonica cultivar-group)]
  misc_feature: Useful for making plants with altered cell wall content and/or composition
  misc_feature: GREAT-hit functional homolog of the protein sequence encoded by LOCUS at4g19420
  misc_feature: Useful for making plants with altered cell wall content and/or composition
  misc_feature: Functional homolog of the protein sequence given in SEQ ID NO 14007
  misc_feature: Useful for making plants with altered carbohydrate content
  misc_feature: Functional homolog of the protein sequence given in SEQ ID NO 13823
MADGSLCAWWCCAVACALAVVAADGVLVDITYVESAVAKGAVCLDGSAPAYHLARGSGSGENSWLVHFEGGGWCNNVTTCLQRKRTRLGSSKEMATQIAFSGILSDTPDGNPDFYNWNKVKVRYCDGSSFTGDVEEVDPTTKLHFRGARIWQAVMEDLLAKGMDKAENVCILTSIVLGNHNGCSAGGLTSILHCDRFHDLLPLAARVKCLSDAGFFINEKDVAGVGYIAAFFNDVVTTHGSANNLPPSCTSMLPPGMCFFPKNEVKQIHTPLFILNAAYDSWQVRNILVPGVADPHGKWHSCKHDIGQCSASQLRVLQGFRGDFLKEVSEQANSDSRGLFINSCFVHCQSESQELWFSSDSPKLGNTTIANAVGDWFFGRSSFQKIDCPYPCDSTCHNGIYEDSSQA

SEQ ID NO: 7889 - DNA, 1914 bp, Sorghum bicolor
  misc_feature: Ceres ANNOT ID no. 6086101
  misc_feature: Encodes the peptide sequence at SEQ ID NO 7890
  misc_feature: Down-regulated in shoot tissues in response to methyl jasmonate treatment
  misc_feature: Up-regulated in root tissues in response to methyl jasmonate treatment
  misc_feature: Down-regulated in shoot tissues in response to salicylic acid treatment
atggagagaacattgatcacctctaacctctccatgagtgcacatgcttcaagatcgtccgggagggttcactacatctctcctgccgcctctgctgctgcacagaactccagctacaggaagaagaagaagagcgccccgtctccgccgccgtcggccgccgcaactgccaccgttgtcacctcccctccggccactgacaatgttcagtccagtgcagtgaagcagaccgggcgacaggagctggaagagctcgtggccaccaaggctaacacttcaagaattgcaagtgcgccgagccaagctcaggctcgggctcagcctcgccgccggcctgccccggcagccacgtccctgccgatggcgttctgcagcgcgttggaggaggcgatcaacacgttcgtcgacccgccggcgctgcggccgtccgtggacccgcggaacgtgctgtcgaccaacttcgcgccagtggacgagctgccgccgacgccatgccccgtcgtgcgcggcgccatcccgcgctgcctcgccggaggcgcctacatccgcaacgggcccaacccgcagcacctcccgcgtgggccgcaccacctcttcgacggcgacggcatgctgcactcgctcctcctcccgacggcggagtcgccgtcgtcggaccccgtcctgtgctcgcgctacgtgcagacgtacaagtacctcgtggagcgtgacgcgggagcgccggtcatgccgaacgtcttctccggattccacggcgtggccgggctggcgcgcggcgccgtcgtggcggccagagtactcactgggcagatgaacccagccgagggcgtggggctcgcgaacaccagcctcgccttcttcggcggccgcctctacgcgcttggcgagtcggatctcccgtacgccgtgcgcgtcgacccggccaccggcgaggtgaccacgcacggccggtgcgacttcggcggccgtctcttcatgggcatgacagctcacccgaagaaagaccccgtcaccggcgaggtcttcgcgttccggtacggccccgtgccgccgttcgtcacctacttccggttcgacccggccgggaacaagggccccgacgtgcccatcttctcagtgcagcagccgtcgttcctgcacgacttcgccgtcacggagcggtacgccatcttcccggagatacaaatcgtcatgcagcccatgggcatggtggcgggcggcgcgcctgttgggtctgacgccggcaaggtgccccggctcggcgtgctccccaagtatgccacggacgagtcggagatgcggtggttcgaggtgccggggttcaacataatgcactcgctgaacgcgtgggaggaggccgacggcgaggagctggtgctggtggcgcccaacgtcctgtccgtggagcacgcgctggagcgcatggagctcgtgcactcgtgcgtcgagaaggtgcgcatcaacctgcgcacgggcgccgtgtcgcgcaccccgctatcggcggggaacctcgatttcggcgtgatccacccgggctacctcggccggcgcaaccggtacgggtacctcggcatcggcgaccccatgccgaagatctccggcgtggccaaactggacttggaccgcgccggcacgggagactgcacggtggcgcggcgcgacttcgggcccagctgctttgcgggggagccgttcttcgtccccgacgacgtggaggggaacggcaacgaggacgacggctacttggtgtgctacgtccacaacgagcgcactggcgagaacctgttcgtggtgatggacgcgaggtcaccacagctggacatcgtcgctgaggtggagctgcccacccgtgtcccctacggcttccacggcatctttgtcacgaaggccgagctccaggcgcagcaacaatga

SEQ ID NO: 7890 - protein, 637 aa, Sorghum bicolor
  misc_feature: Ceres ANNOT ID no. 6086101
  misc_feature (131)..(629): Pfam Id: RPE65 Pfam Desc: Retinal pigment epithelial membrane protein
  misc_feature (50)..(632): NCBI GI: 83628262 NCBI Desc: carotenoid cleavage dioxygenase 4a [citrus clementina]
  misc_feature (48)..(632): NCBI GI: 84579414 NCBI Desc: lactuca sativa carotenoid cleavage dioxygenase 1
  misc_feature (59)..(632): NCBI GI: 92894070 NCBI Desc: carotenoid oxygenase [medicago truncatula]
  misc_feature (63)..(633): NCBI GI: 22335707 NCBI Desc: nine-cis-epoxycarotenoid dioxygenase4 [pisum sativum]
  misc_feature (64)..(632): NCBI GI: 117676064 NCBI Desc: carotenoid cleavage dioxygenase [chrysanthemum x morifolium]
  misc_feature: Down-regulated in shoot tissues in response to methyl jasmonate treatment
  misc_feature: Up-regulated in root tissues in response to methyl jasmonate treatment
  misc_feature: Down-regulated in shoot tissues in response to salicylic acid treatment
MERTLITSNLSMSAHASRSSGRVHYISPAASAAAQNSSYRKKKKSAPSPPPSAAATATVVTSPPATDNVQSSAVKQTGRQELEELVATKANTSRIASAPSQAQARAQPRRRPAPAATSLPMAFCSALEEAINTFVDPPALRPSVDPRNVLSTNFAPVDELPPTPCPVVRGAIPRCLAGGAYIRNGPNPQHLPRGPHHLFDGDGMLHSLLLPTAESPSSDPVLCSRYVQTYKYLVERDAGAPVMPNVFSGFHGVAGLARGAVVAARVLTGQMNPAEGVGLANTSLAFFGGRLYALGESDLPYAVRVDPATGEVTTHGRCDFGGRLFMGMTAHPKKDPVTGEVFAFRYGPVPPFVTYFRFDPAGNKGPDVPIFSVQQPSFLHDFAVTERYAIFPEIQIVMQPMGMVAGGAPVGSDAGKVPRLGVLPKYATDESEMRWFEVPGFNIMHSLNAWEEADGEELVLVAPNVLSVEHALERMELVHSCVEKVRINLRTGAVSRTPLSAGNLDFGVIHPGYLGRRNRYGYLGIGDPMPKISGVAKLDLDRAGTGDCTVARRDFGPSCFAGEPFFVPDDVEGNGNEDDGYLVCYVHNERTGENLFVVMDARSPQLDIVAEVELPTRVPYGFHGIFVTKAELQAQQQ

SEQ ID NO: 7891 - DNA, 825 bp, Sorghum bicolor
  misc_feature: Ceres ANNOT ID no. 6086111
  misc_feature: Encodes the peptide sequence at SEQ ID NO 7892
atgccctgcctattgcttctagctccacctccaccgccaccgcctcgcccctgtctaatcgactcggtaagtcggccaccactccccaaatatcggttcttcctgccccggacccggaggcggccaagtccgtggcttggcgtgcgaatggcggagatgaccagggttgggagcggcggggaaccgcccgaggttggggtttccatggagagtgacccgcttgtgggaggggacgcgccgtcccgcccgaggtgggaagcgagccggtgggcgtccgtggaggctgcgctgaatcggatgagtaaatggctggtgtctggttcttttgcttttgcagctatatggaagcatgatgctgaaattatgtgggttttgctgggtgcggttggcaactctctgctttcattggttcttaaaaagatgctaaaccatgaaagacctgcaccagctttgcggtctgatcctgggatgccatcgtcccatgcacaatccatattctatgctacgaccatcctagctctttcattgtactactggcttgggacaaattatctgaccatgattcttgggcctgcaactctgttagtggccgcctatctgtcttggctacgagtgtctcagcgccttcatacactaaaccaggtcactgtgggagctgttgtaggatctgccttcggtgctctatggtttgtgctctggcattggcttgttcaggaggcttttgcttcttctctgctggtcaggattgcagtcatccttggatcaacaacattttgtgttagctttgtcatctacattattcatcactggctcaaggatgagtaa

SEQ ID NO: 7892 - protein, 274 aa, Sorghum bicolor
  misc_feature: Ceres ANNOT ID no. 6086111
  misc_feature (120)..(238): Pfam Id: PAP2 Pfam Desc: PAP2 superfamily
  misc_feature (5)..(274): NCBI GI: 115448161 NCBI Desc: os02g0704500 [oryza sativa (japonica cultivar-group)]
  misc_feature (54)..(274): NCBI GI: 42565815 NCBI Desc: phosphatidic acid phosphatase-related / pap2-related [arabidopsis thaliana]
  misc_feature (105)..(257): NCBI GI: 116129566 NCBI Desc: ensangp00000002778 [anopheles gambiae str. pest]
  misc_feature (114)..(230): NCBI GI: 28829339 NCBI Desc: similar to mus musculus (mouse). riken cdna 0610011h20 gene [dictyostelium discoideum]
  misc_feature (94)..(232): NCBI GI: 119398293 NCBI Desc: pap2 domain protein [aspergillus clavatus nrrl 1]
MPCLLLLAPPPPPPPRPCLIDSVSRPPLPKYRFFLPRTRRRPSPWLGVRMAEMTRVGSGGEPPEVGVSMESDPLVGGDAPSRPRWEASRWASVEAALNRMSKWLVSGSFAFAAIWKHDAEIMWVLLGAVGNSLLSLVLKKMLNHERPAPALRSDPGMPSSHAQSIFYATTILALSLYYWLGTNYLTMILGPATLLVAAYLSWLRVSQRLHTLNQVTVGAVVGSAFGALWFVLWHWLVQEAFASSLLVRIAVILGSTTFCVSFVIYIIHHWLKDE

SEQ ID NO: 7893 - DNA, 933 bp, Sorghum bicolor
  misc_feature: Ceres ANNOT ID no. 6086118
  misc_feature: Encodes the peptide sequence at SEQ ID NO 7894
atgtcaagggaggcgacgaggacgaggagccgggtcctggtggtcggcgccaccggccgcctcggtggaagcatcgctcgggccagcctcgccgcgggccacctcaccttcgcgctcgtgcggccccaccacttcgcacgccccgactcccccttgctcgagccgctcgtagccgccggcgccactctgctccaggggtcactggaagattactcgagcctgctcgaggcggtgcgtcaggtggacattgtcatctgcgcggtgcccacgaagcaggtgctcgagcagaagcccctgattcgggctataaaggatgctggatgcgtgaagagatttattccagcagaatttggagcagatccaacaaaggttcaaatttgtgacatggattatggcttctatgagaagaaaattgaaatccgccattcaatagagagtgaaggcattcctcatacctacatatgctgcaacttctttatgcgctatttgcttccttcactggtgcaacctggcctagatgctcctcctagagatgaaatcaaaatattcggtgaaggaaatactaaaggtgtttttgttaaagagaatgatgttgctaaatttacaatttgcaccatagaggatcccaggacattaaacaagacgttatatctgaggcctccaggaaacgtctgctcaatgaatgaattggctgacctctgggagacaaaaatcaagaaatccctgaaaagattctatgtaacagaagagcaacttcttaaagaaatccatgatgctccatttcccttgaagatggatctaattttcatatattcagcatttgttaagggtgaccacacattttttgaatttgacttgtcaactgaaggaactcaactatatccccatgtaaattatacaacagtgaacgagtacttggatactctagtttag

SEQ ID NO: 7894 - protein, 310 aa, Sorghum bicolor
  misc_feature: Ceres ANNOT ID no. 6086118
  misc_feature (12)..(301): Pfam Id: NmrA Pfam Desc: NmrA-like family
  misc_feature (4)..(310): NCBI GI: 7270404 NCBI Desc: isoflavone reductase-like protein [arabidopsis thaliana]
  misc_feature (9)..(310): NCBI GI: 92880918 NCBI Desc: nmra-like [medicago truncatula]
  misc_feature (8)..(310): NCBI GI: 94549038 NCBI Desc: phenylcoumaran benzylic ether reductase [pinus strobus]
  misc_feature (8)..(310): NCBI GI: 38492950 NCBI Desc: chain b, crystal structures of pinoresinol-lariciresinol and phenylcoumaran benzylic ether reductases, and their relationship to isoflavone reductases
  misc_feature (8)..(310): NCBI GI: 3415126 NCBI Desc: phenylcoumaran benzylic ether reductase [pinus taeda]
MSREATRTRSRVLVVGATGRLGGSIARASLAAGHLTFALVRPHHFARPDSPLLEPLVAAGATLLQGSLEDYSSLLEAVRQVDIVICAVPTKQVLEQKPLIRAIKDAGCVKRFIPAEFGADPTKVQICDMDYGFYEKKIEIRHSIESEGIPHTYICCNFFMRYLLPSLVQPGLDAPPRDEIKIFGEGNTKGVFVKENDVAKFTICTIEDPRTLNKTLYLRPPGNVCSMNELADLWETKIKKSLKRFYVTEEQLLKEIHDAPFPLKMDLIFIYSAFVKGDHTFFEFDLSTEGTQLYPHVNYTTVNEYLDTLV

SEQ ID NO: 7895 - DNA, 1173 bp, Sorghum bicolor
  misc_feature: Ceres ANNOT ID no. 6086119
  misc_feature: Encodes the peptide sequence at SEQ ID NO 7896
atgtccgtcgcgtccgtggccgccctccggacggccgcctccggctccggccggtgccacggcgcgggttccccacaggtcggcctgaacggtgggcgccctcgttctctaccagggggcaggttcttgatgatgcagaggagggagctggtgaccaaggccgggatcgcgctcgccgtctcctgctccatggcaacttctccagccccggccaacggctctgctcaagggctggaggttttgccgttcaaagcggacgggtacaacttctggacgtggcggggtcgccggatacactacgtcgagcaaggcgccgggcagcccattgtgctcatccacggcttcggcgcttccgccttccactggaggtacaacatccctgagctggccaagaagtacaaggtgtacgccatagacctgctggggttcgggtggagcgagaaggcgctggtggactacgaggccaccatctggatggagcaggtctccgacttcctccgggagatcgtcaaggagcctgccgtcctcgtaggcaacagcttgggaggtttcacgacgctgttcacggcaaccgaggtgccggagctggtccggggcgtcgtgctgctcaactctgccggccagttcggcgaccccaacaagccggccgccgcaccggccgaggaggaggagggcagcccgctgtccaggttcatcgtgaagccgctcaaggaggccttccagcgggtggtgctggggttcctcttctggcagtccaagcagcccgccagggtcgagaaagtcttgaaaagcgtgtacatagactccagcaacgtcgacgactacctggtcggttccatcacggcgccggcggcggaccccaacgccggcgaggtgtactacaggctgatgtcgcggttcatgtcgaaccagagccggtacacgctggaccggctgctggggaagctgtcgtgcccgctgctgctgctgtggggggacctggacccgtgggtcggcccggccaaggccgcgcggatccaggagttctacgccgacaccgccgtcgtgcacctgcaggccggccactgcccgcacgacgaggcgccggagcaggccaaccgggcgctgctcgagtggctcgcggctctcgacgcccgcgccaagccggccgagcccagcctccagaccgtctga

SEQ ID NO: 7896 - protein, 390 aa, Sorghum bicolor
  misc_feature: Ceres ANNOT ID no. 6086119
  misc_feature (133)..(371): Pfam Id: Abhydrolase_1 Pfam Desc: alpha/beta hydrolase fold
  misc_feature (39)..(390): NCBI GI: 41053146 NCBI Desc: hydrolase, alpha/beta fold family-like [oryza sativa (japonica cultivar-group)]
  misc_feature (91)..(382): NCBI GI: 86605207 NCBI Desc: hydrolase, alpha/beta fold family [cyanobacteria bacterium yellowstone a-prime]
  misc_feature (91)..(382): NCBI GI: 86608884 NCBI Desc: hydrolase, alpha/beta fold family [cyanobacteria bacterium yellowstone b-prime]
  misc_feature (90)..(376): NCBI GI: 75909310 NCBI Desc: alpha/beta hydrolase fold [anabaena variabilis atcc 29413]
  misc_feature (82)..(373): NCBI GI: 119492673 NCBI Desc: alpha/beta hydrolase fold protein [lyngbya sp. pcc 8106]
MSVASVAALRTAASGSGRCHGAGSPQVGLNGGRPRSLPGGRFLMMQRRELVTKAGIALAVSCSMATSPAPANGSAQGLEVLPFKADGYNFWTWRGRRIHYVEQGAGQPIVLIHGFGASAFHWRYNIPELAKKYKVYAIDLLGFGWSEKALVDYEATIWMEQVSDFLREIVKEPAVLVGNSLGGFTTLFTATEVPELVRGVVLLNSAGQFGDPNKPAAAPAEEEEGSPLSRFIVKPLKEAFQRVVLGFLFWQSKQPARVEKVLKSVYIDSSNVDDYLVGSITAPAADPNAGEVYYRLMSRFMSNQSRYTLDRLLGKLSCPLLLLWGDLDPWVGPAKAARIQEFYADTAVVHLQAGHCPHDEAPEQANRALLEWLAALDARAKPAEPSLQTV

SEQ ID NO: 7897 - DNA, 1302 bp, Sorghum bicolor
  misc_feature: Ceres ANNOT ID no. 6086120
  misc_feature: Encodes the peptide sequence at SEQ ID NO 7898
atgtctctcaagagcattgtgcgggagctgaaggagatgagggacggtatcgggagcatgtcgagacgcggcggcagcggctccgacgggcgtgccggccatggccgctcggggtcgcggcattcttggcctagcctgtgggccgagcagcaacagccgcagcggcagggtcaggaggggccgcagcatcagcatcagcatcaagggcggtgggcgaacctgccaccggaactgctgctggatgtgatacagagggtggagtccagcgaggcaacgtggccggcgcggcgccaggtcgtggcctgcgcggccgtttgtcggtcgtggcgcgaggtcaccaaggaggtggtgaagacgctcgaggagtgcggcaggatcaccttccccatatcccttaagcagccggggcctcgtgatctgccggtccagtgttttgtgaggagggagagggcgacatccacatatctactctacctagggctcagcccatctatgaatatggaaaacgacaagctattgcttgcagctcgtaaggtcaggcgtgccacgaggacttcttttgtgatctcactggtctctgatgatttctctcactctagtagcacctatgttggcaaactgaagccaaacttcctcggcacaaagttcacaatctttgacagccagcctcctcctgatgctgtagtgctaccaaacaataaaccaagcaaaaggcagtccaaacaagtatcaccgagactgccactaggcaattacaatgttgctacagtcacgtatgagctcaccgtcctacgcaacaggggaccaaggagaatgcaatgcaccatgcactcgataccagccgagtgcattcaggagggtgggaaggcccctacccctaccggcaccattcagtcgcttgatgagccagtgtccacttcacctagtaccaaagggaaagaagtggctttagaattttcttcgacaagcctcagtgctgatctgtctggactggcactggcctgcgcgaatgaaacacctctggttctgaagaacaaagcacctcgttggcatgagcagctgcagtgttggtgcctcaacttccgggggcgcgtcaccgtcgcatcagtgaagaacttccagctcgttgcctctgttgatccttccctaaacatccctgcagcagaacaggagaaggtgatcctccagttcgggaagatagggaaggatatattcaccatggactaccggtacccactctcggcgttccaggccttcgcaatctgcctgaccagcttcgacaccaaaccagcctgcgaataa

SEQ ID NO: 7898 - protein, 433 aa, Sorghum bicolor
  misc_feature: Ceres ANNOT ID no. 6086120
  misc_feature (135)..(427): Pfam Id: Tub Pfam Desc: Tub family
  misc_feature (69)..(124): Pfam Id: F-box Pfam Desc: F-box domain
  misc_feature (68)..(433): NCBI GI: 7635492 NCBI Desc: tubby-like protein [cicer arietinum]
  misc_feature (1)..(433): NCBI GI: 5689214 NCBI Desc: tubby-like protein [lemna paucicostata]
  misc_feature (71)..(313): NCBI GI: 87241115 NCBI Desc: tubby; di-trans-poly-cis-decaprenylcistransferase; cyclin-like f-box [medicago truncatula]
  misc_feature (70)..(433): NCBI GI: 37542296 NCBI Desc: tubby-like protein 12 [arabidopsis thaliana]
  misc_feature (70)..(433): NCBI GI: 38564318 NCBI Desc: at5g18680 [arabidopsis thaliana]
MSLKSIVRELKEMRDGIGSMSRRGGSGSDGRAGHGRSGSRHSWPSLWAEQQQPQRQGQEGPQHQHQHQGRWANLPPELLLDVIQRVESSEATWPARRQVVACAAVCRSWREVTKEVVKTLEECGRITFPISLKQPGPRDLPVQCFVRRERATSTYLLYLGLSPSMNMENDKLLLAARKVRRATRTSFVISLVSDDFSHSSSTYVGKLKPNFLGTKFTIFDSQPPPDAVVLPNNKPSKRQSKQVSPRLPLGNYNVATVTYELTVLRNRGPRRMQCTMHSIPAECIQEGGKAPTPTGTIQSLDEPVSTSPSTKGKEVALEFSSTSLSADLSGLALACANETPLVLKNKAPRWHEQLQCWCLNFRGRVTVASVKNFQLVASVDPSLNIPAAEQEKVILQFGKIGKDIFTMDYRYPLSAFQAFAICLTSFDTKPACE

SEQ ID NO: 7899 - DNA, 507 bp, Sorghum bicolor
  misc_feature: Ceres ANNOT ID no. 6086129
  misc_feature: Encodes the peptide sequence at SEQ ID NO 7900
atggattcggggggcggaggagggagcggcgcgcacaaggcagcctcgggctccgcgccctcgcctgctccgccggcgccaaaccccacggcgatgctctcggctctcatgagcaagcgcgccaagctccaggaggagctccgctccatcgagcgccaggtttatgatatggagaccacctacctacaagagtctaatcaatttggaagtgtgctgaagggtttcgaatcttttttgtcatcctcaaaaaacagctctaaccttaagcgctctcggaaatttcaggcagacgagaggttattctctctatcatcagttacttctccagcggttgatgaacaaggacgagatgatggaagagagtatggagcaggtcgttcaaagggtgggagcacccctgcaaatgggcaaggcaaaccgaagaagggagggcgccctggtgggcgagatggcaagagactacggccgtcgaatgatccagacctggacgacgaagatgactactaa

SEQ ID NO: 7900 - protein, 168 aa, Sorghum bicolor
  misc_feature: Ceres ANNOT ID no. 6086129
  misc_feature (28)..(109): Pfam Id: NuA4 Pfam Desc: Histone acetyltransferase subunit NuA4
  misc_feature (23)..(151): NCBI GI: 29164895 NCBI Desc: sarcoma antigen ny-sar-91 [homo sapiens]
  misc_feature (23)..(151): NCBI GI: 56202931 NCBI Desc: novel protein [homo sapiens]
  misc_feature (23)..(151): NCBI GI: 70888315 NCBI Desc: sarcoma antigen ny-sar-91 [homo sapiens]
  misc_feature (23)..(151): NCBI GI: 119627744 NCBI Desc: chromosome 1 open reading frame 149, isoform cra_a [homo sapiens]
  misc_feature (23)..(151): NCBI GI: 119627745 NCBI Desc: chromosome 1 open reading frame 149, isoform cra_b [homo sapiens]
MDSGGGGGSGAHKAASGSAPSPAPPAPNPTAMLSALMSKRAKLQEELRSIERQVYDMETTYLQESNQFGSVLKGFESFLSSSKNSSNLKRSRKFQADERLFSLSSVTSPAVDEQGRDDGREYGAGRSKGGSTPANGQGKPKKGGRPGGRDGKRLRPSNDPDLDDEDDY

SEQ ID NO: 7901 - DNA, 1818 bp, Sorghum bicolor
  misc_feature: Ceres ANNOT ID no. 6086130
  misc_feature: Encodes the peptide sequence at SEQ ID NO 7902
atgctgcgccgcctccgcctgcgctcgccgggtagggcggcgtcggctgtcgccggcgcggccgctgcaatggcgtcgctcaccaacgtcgcctacgccgacgggctcttccgccgccagtccccaccgtcgaatccaggcgacgaggacaatttgggagcctccgcgttcggccgcgacccggagaccctggagcgcatggcccgagcgctgcggcagatcaacaactcaccgctcgccaagcaggtgtttgagctgatgcggaagcaggaggagacgcgcctcactgagctggaggccgagaaggtcctacacgctgtccacgagaggcttagggacatggagaggatgcagaaaaaagctgaagattacagaaatagtttgcaacaagaagctcaggcaaaagctcaagcattacgctatgaggatgaattagctagaaaaagaatgcagacagagcatgctgcacaaaggagacaggatgctgaacttgtgaagatgcaagaggcatctgccctcaggagagaagaagctaggcgtggaacagaacagaagattttggaagaaatgatacggactgagaaggaaaaggctgaaatagatcaggaattaaacagagctaaagctttagcagaagcaaatgctcgcgttcatgaagagaaggaatcagaagaagttacaaaaagaatgatgttggaacgtatgaagggtgaaaaggaaaagtggctctctgcaataaatacaaccttttcgcacattgaaggtggattcaaagcgctgttaactgataggagcaaactaataatgggtattggaggagttactgcactggctgctggagtttatactactagggaaggtgccagggttacatggagttacatcaatagaatcttgggtcagccttcgctgatccgtgaatcatctatgccaaagttcccactaccaatgtctaggttactcaaacctagctcagcatctttgtcggggggagcaggctttgagaacgttattctgcacccttcactcaagcggaggattgaacatcttgcacgagcaactgcaaatacaaagtctcacggtgcacctttccgcaacatgctgttctatggacctcctggaactgggaaaactttagtagccagggagatggctcgcaaatctggcctggattatgccatgatgacgggaggagatgttgcacccttaggatcagaggctgttaccaagatccatcaaatatttgactgggctaagaagtccaagaaaggcatgctggttttcattgatgaagctgatgcattcttgtgcgagcgtaacagtacccatatgagcgaagctcagcggagtgctctcaatgcattattgtttcgaactggcgaccagtccagggacattgtccttgtcctggcaacaaacagaccgggtgaccttgatgctgctatcactgaccgcattgatgaagtcatagagttccccctgcccggagaggaggagaggtttcaactgctcaagctatacttgaaccaatatatactcaaggaagagggcaaaggatcttcttggggtgcattatttaagaagcagcagcggaagattcaggtgaatggcataagcgatgatttgctcaggaaagctgcaaggaagatcgatggcttctctgggagggagattgcgaagctcgtggctagtgtgcaagctgctgtttatggccggcctgactgtatattggatccacagttattttcggaggtagttgactacaaagtgactgagcatcaccaacgcatcaagcttgcttccgagggtatggtttga

SEQ ID NO: 7902 - protein, 605 aa, Sorghum bicolor
  misc_feature: Ceres ANNOT ID no. 6086130
  misc_feature (366)..(571): Pfam Id: AAA Pfam Desc: ATPase family associated with various cellular activities(AAA)
  misc_feature (6)..(602): NCBI GI: 41053150 NCBI Desc: aaa-type atpase-like [oryza sativa (japonica cultivar-group)]
  misc_feature (13)..(603): NCBI GI: 4006905 NCBI Desc: atpase-like protein [arabidopsis thaliana]
  misc_feature (41)..(603): NCBI GI: 37805289 NCBI Desc: mgc68616 protein [xenopus laevis]
  misc_feature (56)..(602): NCBI GI: 55233560 NCBI Desc: ensangp00000018412 [anopheles gambiae str. pest]
  misc_feature (60)..(603): NCBI GI: 15559471 NCBI Desc: atad3a protein [homo sapiens]
  misc_feature: The sequence is a functional homolog of SEQ ID NO. 462 in the 11/188,298 US application
  misc_feature: The sequence is a functional homolog of SEQ ID NO. 471 in the 11/188,298 US application
MLRRLRLRSPGRAASAVAGAAAAMASLTNVAYADGLFRRQSPPSNPGDEDNLGASAFGRDPETLERMARALRQINNSPLAKQVFELMRKQEETRLTELEAEKVLHAVHERLRDMERMQKKAEDYRNSLQQEAQAKAQALRYEDELARKRMQTEHAAQRRQDAELVKMQEASALRREEARRGTEQKILEEMIRTEKEKAEIDQELNRAKALAEANARVHEEKESEEVTKRMMLERMKGEKEKWLSAINTTFSHIEGGFKALLTDRSKLIMGIGGVTALAAGVYTTREGARVTWSYINRILGQPSLIRESSMPKFPLPMSRLLKPSSASLSGGAGFENVILHPSLKRRIEHLARATANTKSHGAPFRNMLFYGPPGTGKTLVAREMARKSGLDYAMMTGGDVAPLGSEAVTKIHQIFDWAKKSKKGMLVFIDEADAFLCERNSTHMSEAQRSALNALLFRTGDQSRDIVLVLATNRPGDLDAAITDRIDEVIEFPLPGEEERFQLLKLYLNQYILKEEGKGSSWGALFKKQQRKIQVNGISDDLLRKAARKIDGFSGREIAKLVASVQAAVYGRPDCILDPQLFSEVVDYKVTEHHQRIKLASEGMV

SEQ ID NO: 7903 - DNA, 1431 bp, Sorghum bicolor
  misc_feature: Ceres ANNOT ID no. 6086137
  misc_feature: Encodes the peptide sequence at SEQ ID NO 7904
atggggcgcgcgttcgtgtacgtgatcctgggcggcggcgtggccgcgggctacgccgtgctcgagttcgcccgccgcggagggtactctcgcggagagctctgcatcatctccgaagaggccgttgctccttatgaacgtcctgcactaagcaaaggctatttactcccagaaggtgctgctcgccttccaggatttcatacttgcgttggtgctaatgatgaattattgacaacaaaatggtacaaagaacaaggcattgaattagttcttggaacaaaagtaatttctgctgatgtgaggcgcaagacattgcttacaggcactggtgaaactatcagctacaaaactctaattattgcgacaggtgctcgggctttgaagctacaagaatttggaatacaaggttcagatgcttcaaacatatgttatttgcgcaacatcgatgatgcggataagttggtgagtgcgatgaaatcatgtcctggcggaaatgctgttgtcattggtggtggctacattggaatggagtgtgcagcggcattggttactaacaagataagggtcaccatggtcttccctgagaaacactgcatgggtcgtctatttacaccaaaaattgcagaattttatgaaaactactacacctcaaaaggggtcacctttgttaaaggaactgtccttacatcctttgaaaaagatacaacggggaaggtgactgcagtaatcctcaaagatggtagacaccttcctgctgatatggtagtagttggtattggcatccgtgcaaacactagtctttttgaaggtcagctgatgatggagaatggtgggataaaggtaaatggacagttgcagacaagtgacagctctgtatatgctgttggcgatgtggctgcattcccgatcaagctttttgatggtgatatccgacggcttgagcatgtggattcagctcgtagaactgctagacatgctgttgcctccatcttggagccttcaaaaaacaaggacattgattaccttccattcttctactccagagtgttcacattgtcctggcaattctacggggataatgttggggaagtggtccactttggagacttcacaagcagcagcccgaggtttggtgcatattgggtcaacaaaggcagaattgcgggtgcatttcttgaaggcggaagtcgggaggagtacgaggccatatcgattgctgttcggcggaaagctatggtcacaaacatgggtgaacttgagaaacaaggcctggcgcttgccattcaggagagccagaaggaggtgcctgacagtgggcttgccattgttggaaaacctacttacacgtggcatgccacagctggcgttgtagcagcagtgtcaatcgctgcaattggttattggtatggcaggaagcgccgcaggtggtga

SEQ ID NO: 7904 - protein, 476 aa, Sorghum bicolor
  misc_feature: Ceres ANNOT ID no. 6086137
  misc_feature (7)..(303): Pfam Id: Pyr_redox_2 Pfam Desc: Pyridine nucleotide-disulphide oxidoreductase
  misc_feature (165)..(260): Pfam Id: Pyr_redox Pfam Desc: Pyridine nucleotide-disulphide oxidoreductase
  misc_feature (126)..(476): NCBI GI: 15626361 NCBI Desc: monodehydroascorbate reductase [hordeum vulgare subsp. vulgare]
  misc_feature (3)..(427): NCBI GI: 117067068 NCBI Desc: monodehydroascorbate reductase [acanthus ebracteatus]
  misc_feature (5)..(427): NCBI GI: 4666287 NCBI Desc: cytosolic monodehydroascorbate reductase [oryza sativa (japonica cultivar-group)]
  misc_feature (3)..(427): NCBI GI: 21592582 NCBI Desc: monodehydroascorbate reductase (nadh)-like protein [arabidopsis thaliana]
  misc_feature (3)..(427): NCBI GI: 46093475 NCBI Desc: monodehydroascorbate reductase [brassica oleracea]
  misc_feature (5)..(427): SWISSPROT Homolog: EC 1.6.5.4 Monodehydroascorbate reductase, seedling isozyme
MGRAFVYVILGGGVAAGYAVLEFARRGGYSRGELCIISEEAVAPYERPALSKGYLLPEGAARLPGFHTCVGANDELLTTKWYKEQGIELVLGTKVISADVRRKTLLTGTGETISYKTLIIATGARALKLQEFGIQGSDASNICYLRNIDDADKLVSAMKSCPGGNAVVIGGGYIGMECAAALVTNKIRVTMVFPEKHCMGRLFTPKIAEFYENYYTSKGVTFVKGTVLTSFEKDTTGKVTAVILKDGRHLPADMVVVGIGIRANTSLFEGQLMMENGGIKVNGQLQTSDSSVYAVGDVAAFPIKLFDGDIRRLEHVDSARRTARHAVASILEPSKNKDIDYLPFFYSRVFTLSWQFYGDNVGEVVHFGDFTSSSPRFGAYWVNKGRIAGAFLEGGSREEYEAISIAVRRKAMVTNMGELEKQGLALAIQESQKEVPDSGLAIVGKPTYTWHATAGVVAAVSIAAIGYWYGRKRRRW

SEQ ID NO: 7905 - DNA, 534 bp, Sorghum bicolor
  misc_feature: Ceres ANNOT ID no. 6086143
  misc_feature: Encodes the peptide sequence at SEQ ID NO 7906
atggcggactcgtcggcgccgacgagagtgatgatggcggtgaacgagtcgtcgctcaaggggtacccgcacccctccatcagctgccgcaccgccttcgactggacgctctccaagctcgtccgctccaaccccgggggcttccacttcctcttcatccacgttcaggtccccgacgaggacggatttgatgacatggatagcatctatgcttcgccggaggacttccaccaaatgaagcggagagacaagataagagggcttcatttgcttgagtactttgtaaaccaatgccatcagttagggataaaatgcgaggcatggatcagacatggggatccaaaggaggttatctgcagcgaagtgaagagagtccagcctgaccttctagttgtgggaagtaggggccttgggccatttcagagggttttcgtgggcacggtgagcgagttctgcgttaagcatgctgaatgccccgtcatcaccataaaacggaatgctactgaagctcctcaggaccctgtcgatgattga

SEQ ID NO: 7906 - protein, 177 aa, Sorghum bicolor
  misc_feature: Ceres ANNOT ID no. 6086143
  misc_feature (21)..(164): Pfam Id: Usp Pfam Desc: Universal stress protein family
  misc_feature (5)..(177): NCBI GI: 17386130 NCBI Desc: at3g01520/f4p13_7 [arabidopsis thaliana]
  misc_feature (5)..(177): NCBI GI: 99032637 NCBI Desc: chain f, crystal structure of an universal stress protein family protein from arabidopsis thaliana at3g01520 with amp bound
  misc_feature (68)..(164): NCBI GI: 18399413 NCBI Desc: universal stress protein (usp) family protein [arabidopsis thaliana]
  misc_feature (2)..(142): NCBI GI: 30681959 NCBI Desc: universal stress protein (usp) family protein [arabidopsis thaliana]
  misc_feature (98)..(164): NCBI GI: 30694813 NCBI Desc: universal stress protein (usp) family protein [arabidopsis thaliana]
MADSSAPTRVMMAVNESSLKGYPHPSISCRTAFDWTLSKLVRSNPGGFHFLFIHVQVPDEDGFDDMDSIYASPEDFHQMKRRDKIRGLHLLEYFVNQCHQLGIKCEAWIRHGDPKEVICSEVKRVQPDLLVVGSRGLGPFQRVFVGTVSEFCVKHAECPVITIKRNATEAPQDPVDD

SEQ ID NO: 7907 - DNA, 1959 bp, Sorghum bicolor
  misc_feature: Ceres ANNOT ID no. 6086145
  misc_feature: Encodes the peptide sequence at SEQ ID NO 7908
atggaccaacatgattccatggctgactcaccaaggaggcggcacaaccttctgcgtgacaaggtccaactggtgaaaaggaaggactcaaatcgctatgagattgtccgcttccatgatccattgtctttcgagaaaggcttttttgttgtgatccgtgcttgccagctcttggcgcagcacaatgacgggataatatttgttggtgttgccggcccctctggtgctgggaagacggtgtttactgagaaggtggtcaatttcatgcctgatgttgctgtgatatcaatggacaactataatgatgcaactcgcatagtcgatggcaattttgatgatccacgtctgacagactatgacacactgctggaaaatattcatggtctgaaggaaggaaggtcagttcaggttccaatatatgatttcaagtcgagctgccggactggttatagaacagttgatgtccctagctcccgaattgttatcattgaaggtatttatgcactgagtgagaagttacggcctgtgatggacttgcgtgtttctgtcactggtggtgtccattttgacctagtgaagagggttttaagggatatacagcgagctggccaggagcctgaagaaataatacatcagatctctgaaacggtttatccaatgtacaaggctttcatcgaaccggatttggagaccgcacatattaaaatcatcaacaagttcaacccattctcagggttccaaaatcctatgtacattctaaagtcaccaaggtctctagcacctgagaaaatcaaggctgtgcttggtgatgatcatacggaaagcaacgaagaaacttatgatatatatctacttccacctggtgaagacccagaagcctgccaatcttacttgagaatgcggaatagggaagggaaatataatctaatgtttgaggaatgggtgaccgacaatccttttatcatatcaccaaggatcacttttgaagtcagtgtacgtcttcttggtggtttgatggcattgggatatactatagcagctatactgaagagaagcagtcgtgttttttctgatggcaaggcaactgttaaaattgattggctggaacaacttaacagacagtatatacaagtgcaaggaagagatcggctttatgttaaatttgtagcggatcagttaggtttggatggttcttatataccacgcacatatattgaacaaattcagctggagaaattgattaatgatgttatggcgttaccagaagatttgaagacaaagctcagcatcgatgatgagctggtctcaagtccaaaggaagccttttcccgtgtttctgctgatcggaggaacaagcttataaagagtggcctatctcaatcatattcaacgcatggagacaaaaatattgtgaaattgagtaacctaacagataccaacaggaggtttggtgcagggcgaacccttgaaccgcctgctatcaaccagggtgcgatcacccagctttcagaacagatatcaacattgaatgaaaggatggatgagtttacctctcgagttgaagaactcaattcaaaatttatggcgaagaaacatttgcccagtcagcagaacttagctcttccaaatgatgcttgtaatggttccacgcctacaaatctctttgtctctcagttaggcaatggtactctgatacctcattcttcatcgtcaaaccaacttgcaaaggattccccgatgatagaagagattatgaacatatcaagaggtcagcgtcaggttatacatcagctcgacaatctgaccaacctgcttcatgagcatttggtcttaacacgccaagcaaataacgccagcaggaaccgggtgctggatatcgacacggtcatgtgtccacttatctgcctgactgttgccagtattgggtacttcatgtttaaaggtctcaacaggggctga

SEQ ID NO: 7908 - protein, 652 aa, Sorghum bicolor
  misc_feature: Ceres ANNOT ID no. 6086145
  misc_feature (248)..(410): Pfam Id: CYTH Pfam Desc: CYTH domain
  misc_feature (67)..(241): Pfam Id: PRK Pfam Desc: Phosphoribulokinase / Uridine kinase family
  misc_feature (1)..(651): NCBI GI: 41053166 NCBI Desc: uridine kinase-like protein [oryza sativa (japonica cultivar-group)]
  misc_feature (21)..(421): NCBI GI: 60467744 NCBI Desc: uridine kinase [dictyostelium discoideum]
  misc_feature (4)..(413): NCBI GI: 11245940 NCBI Desc: uridine kinase-like protein [dictyostelium discoideum]
  misc_feature (43)..(448): NCBI GI: 39546268 NCBI Desc: osjnba0079f16.16 [oryza sativa (japonica cultivar-group)]
  misc_feature (74)..(448): NCBI GI: 115457524 NCBI Desc: os04g0280200 [oryza sativa (japonica cultivar-group)]
  misc_feature: The sequence is a functional homolog of SEQ ID NO. 532 in the 11/188,298 US application
MDQHDSMADSPRRRHNLLRDKVQLVKRKDSNRYEIVRFHDPLSFEKGFFVVIRACQLLAQHNDGIIFVGVAGPSGAGKTVFTEKVVNFMPDVAVISMDNYNDATRIVDGNFDDPRLTDYDTLLENIHGLKEGRSVQVPIYDFKSSCRTGYRTVDVPSSRIVIIEGIYALSEKLRPVMDLRVSVTGGVHFDLVKRVLRDIQRAGQEPEEIIHQISETVYPMYKAFIEPDLETAHIKIINKFNPFSGFQNPMYILKSPRSLAPEKIKAVLGDDHTESNEETYDIYLLPPGEDPEACQSYLRMRNREGKYNLMFEEWVTDNPFIISPRITFEVSVRLLGGLMALGYTIAAILKRSSRVFSDGKATVKIDWLEQLNRQYIQVQGRDRLYVKFVADQLGLDGSYIPRTYIEQIQLEKLINDVMALPEDLKTKLSIDDELVSSPKEAFSRVSADRRNKLIKSGLSQSYSTHGDKNIVKLSNLTDTNRRFGAGRTLEPPAINQGAITQLSEQISTLNERMDEFTSRVEELNSKFMAKKHLPSQQNLALPNDACNGSTPTNLFVSQLGNGTLIPHSSSSNQLAKDSPMIEEIMNISRGQRQVIHQLDNLTNLLHEHLVLTRQANNASRNRVLDIDTVMCPLICLTVASIGYFMFKGLNRG

SEQ ID NO: 7909 - DNA, 3549 bp, Sorghum bicolor
  misc_feature: Ceres ANNOT ID no. 6086149
  misc_feature: Encodes the peptide sequence at SEQ ID NO 7910
atgattcttcctgactacataagttgtgaatggctacaaaattcttttgagatgtggaaccaaaagtgtatgaatgcacatgatgctgagactattgaaatgctttgtgaggaacttcgacagtccattcttgggaacaagcttaaggaattgcggaatgcgtcagtgcagcctgaattagtccctgagtggaagacatggaaacaagaattgatgaaacaacacttttcattgcatcctgctggtaatgttggcaacttcgagaaaaccaattgttacgatgatccagctttagatcaacaaggtagtagaaagcgtccaaagcttgaggtccgaagaggggagatacacatttcacagatgggtgaagctgactacaggactccaactgaagacccaaaccaaaataaccttcctagtaactctgtcatgcatgaaaatgtaggggcatcaggagcaacaaatcaaaataatgctgtcacgttacctggaagttctggtaccaacgagaactcaatatccagtagtgccaatgcagctttacagaatgctagacttgatttagattcattcaaaagttctcggcagtgttctgcatacattgaagcaaagggaaggcagtgtggtaggtgggcaaatgatggtgatatttactgttgcgtgcatcaaagtatgcattttcttgaccattcttcaagggaggacaaggcacttaccattgaagctccattgtgcagtggtacaactaatatgggtagaaaatgcaagcatcgagctcagcatggttctaccttttgtaaaaagcaccgcctacagacaaactttgatgcaatgcacccagaaaatttgctggatccatccgaggtactccatatgggcgaagaacctccaaacaagtgggtggaagaaatttctaagtcacaagcaatgtgcatagacttggaaaaagacaagaatgtccaggcaactgtgggtatagagaactctggtgaaaaaagtacaatggagaaaactgatgtgtgtgcggcatcaacttccatggcaaatactgatgatacttctatttgtattggaattctctctcatgacaatattgtcgaatgccaggattatgccaagcgacatagtctttattgcgagaagcaccttccaaagttccttaaacgtgccaggaatggtaagagtcgactcgtttctaaagatgtcttcgttaatctactaaagggctgcacatcaagaaaagagaagatatgtctacaccaggcatgtgaatttctttattggttcttgagaaacaacctttctcatcaacggactggtcttgctagtgagcatattccccagatactggctgaagtgtccaaaaatccagatgttggagagtttttgttaaagttgatatctactgagagagagaaactagcaaatatctggggctttgatacaaatagatctaagcaaatatattctgaaaacaaagaagaatctgtaatgttgcaggaagagggaacgaatctttcatctggtccgaagtgcaaaatttgtgctcaccagttctctgatgatcaagctcttggattacattggacaactgtccacaaaaaggaagcccggtggctgtttagaggttattcttgtgctgcatgcatggaatcttttacaaacaaaaaagtccttgaaaggcatgtgcaggatgtacatggggctcagtacctccagtattcaattctcattcgatgtatgctatgtaacagcaattttttgaacacagatctgctataccctcacattgtttccgaccatgcccaacaaatcaggcttcttgatgtccctcagcggccaaatggtcaatctgctcaacaaacagaaggaacaagtggtctgcccctttatgatagccacaacgttgaggatgacgatggctcacagaagttcatctgcagattatgtgggctcaaatttgatcttttgccagatcttggccgccaccataaagtcgctcatatggactcaggtgctgttgaccacattccactgggccgtgggaagtatcagcttaaccgcggccggcactattattctgctttcaagaaaagtttacggccgacaagtacattaaagaagaggagtaactctggaattgagaaaaactttaagtttcagagctctggcttaacatctcaaatacttgaacctgaaacatccagccttggtaagttacaggatttccaatgctcagatattgcacaaactttattttccaagattcaaaagacaagacctcatccaagcaaccttgatattttgtcggttgcccgctctgtatgctgtaagacaagtcttcttgctgcattggaagttaaatacggatctttacctgagaacatatttgtgaaagctgcaaagctttgcagtgacaatggcatccaaattgattggcatcaagaggaattcatatgccctaaaggttgcaagtctagatctaattcaaatgctctgcttcctatgcaactcacggcagttgattttcctgaagctccttcagttgatcctcttaatgatgatgaaatgtgggaaatggaagaataccattatgttcttgattcgaagcactttggatggaagcctaaaaatgagagagttgttctctgtgaagacataagttttggcagggagaaagttccaattgtctgtgtcattcatgcagacgcaaaagattctttaggtatgaagcctgaagaacttttaccacatggcagttctgtgccttggaaaggtttccactatatcacaaagcgtttgatggattcatgtcttagtgattcagagaactctatgcctgggtgtgcatgttcctatcctgaatgttctcctgagaactgtggtcacgtgagtctctttgatggtgtctacagtggcctggtggatatcaatggaacaccgatgcatggcagatttgcatatgataaagatagtaaaattattttacaggaagggtatccaatatatgagtgcaattcatcatgtacttgtgactcatcctgccagaataaagtattgcagaaagggctgcttgttaagttggaactcttcagaactgagaataagggttgggctattagagctgctgaacctattccacagggtacctttgtctgcgagtatattggtgaagttgtgaaggctgacaagaccatgaaaaatgcagaaagtgtgtcatcaaagggtgggtgcagttacttgtttgacattgcttctcagattgatatggaaagagttcgaactgtaggggctattgaatacttgattgatgccacaaggtctggaaatgtttcccgctatattaatcacagttgttccccgaatctcagtacccgattggttttggtagagagcaaagattgccagcttgctcacattggcttgtttgctaatcgagacattgccgtaggagaagaacttgcctatgattaccgacaaaagcttgtagcaggcgatggctgcccctgccattgtggagctaccaattgccgaggccgtgtctattga

SEQ ID NO: 7910 - protein, 1182 aa, Sorghum bicolor
  misc_feature: Ceres ANNOT ID no. 6086149
  misc_feature (1020)..(1166): Pfam Id: SET Pfam Desc: SET domain
  misc_feature (886)..(1018): Pfam Id: Pre-SET Pfam Desc: Pre-SET motif
  misc_feature (1)..(1182): NCBI GI: 28261315 NCBI Desc: set domain protein sdg117 [zea mays]
  misc_feature (620)..(1182): NCBI GI: 115448211 NCBI Desc: os02g0708600 [oryza sativa (japonica cultivar-group)]
  misc_feature (350)..(1179): NCBI GI: 79561376 NCBI Desc: nucleic acid binding / transcription factor/ zinc ion binding [arabidopsis thaliana]
  misc_feature (350)..(1179): NCBI GI: 73761637 NCBI Desc: c2h2 set [arabidopsis thaliana]
  misc_feature (350)..(1179): NCBI GI: 73761639 NCBI Desc: c2h2 set [arabidopsis thaliana]
  misc_feature (982)..(1179): SWISSPROT Homolog: EC 2.1.1.43 Histone-lysine N-methyltransferase SUVR5
MILPDYISCEWLQNSFEMWNQKCMNAHDAETIEMLCEELRQSILGNKLKELRNASVQPELVPEWKTWKQELMKQHFSLHPAGNVGNFEKTNCYDDPALDQQGSRKRPKLEVRRGEIHISQMGEADYRTPTEDPNQNNLPSNSVMHENVGASGATNQNNAVTLPGSSGTNENSISSSANAALQNARLDLDSFKSSRQCSAYIEAKGRQCGRWANDGDIYCCVHQSMHFLDHSSREDKALTIEAPLCSGTTNMGRKCKHRAQHGSTFCKKHRLQTNFDAMHPENLLDPSEVLHMGEEPPNKWVEEISKSQAMCIDLEKDKNVQATVGIENSGEKSTMEKTDVCAASTSMANTDDTSICIGILSHDNIVECQDYAKRHSLYCEKHLPKFLKRARNGKSRLVSKDVFVNLLKGCTSRKEKICLHQACEFLYWFLRNNLSHQRTGLASEHIPQILAEVSKNPDVGEFLLKLISTEREKLANIWGFDTNRSKQIYSENKEESVMLQEEGTNLSSGPKCKICAHQFSDDQALGLHWTTVHKKEARWLFRGYSCAACMESFTNKKVLERHVQDVHGAQYLQYSILIRCMLCNSNFLNTDLLYPHIVSDHAQQIRLLDVPQRPNGQSAQQTEGTSGLPLYDSHNVEDDDGSQKFICRLCGLKFDLLPDLGRHHKVAHMDSGAVDHIPLGRGKYQLNRGRHYYSAFKKSLRPTSTLKKRSNSGIEKNFKFQSSGLTSQILEPETSSLGKLQDFQCSDIAQTLFSKIQKTRPHPSNLDILSVARSVCCKTSLLAALEVKYGSLPENIFVKAAKLCSDNGIQIDWHQEEFICPKGCKSRSNSNALLPMQLTAVDFPEAPSVDPLNDDEMWEMEEYHYVLDSKHFGWKPKNERVVLCEDISFGREKVPIVCVIHADAKDSLGMKPEELLPHGSSVPWKGFHYITKRLMDSCLSDSENSMPGCACSYPECSPENCGHVSLFDGVYSGLVDINGTPMHGRFAYDKDSKIILQEGYPIYECNSSCTCDSSCQNKVLQKGLLVKLELFRTENKGWAIRAAEPIPQGTFVCEYIGEVVKADKTMKNAESVSSKGGCSYLFDIASQIDMERVRTVGAIEYLIDATRSGNVSRYINHSCSPNLSTRLVLVESKDCQLAHIGLFANRDIAVGEELAYDYRQKLVAGDGCPCHCGATNCRGRVY

SEQ ID NO: 7911 - DNA, 468 bp, Sorghum bicolor
  misc_feature: Ceres ANNOT ID no. 6086150
  misc_feature: Encodes the peptide sequence at SEQ ID NO 7912
atggcgcccaaggcagagaagaagccggcgtcgaagaagcccgcggaggaggagccctcggagaaggcggctccggcggagaaggcccccgcggggaagaagcccaaggcggagaagcggctcccggcgggcaagtcgtccgccggcaaggagggcggcgagaagaaggggaggaagaagggcaagaagagcgtggagacctacaagatctacatcttcaaggtcctgaagcaggtgcacccggacatcggcatctcctccaaggccatgtccatcatgaactccttcatcaacgacatcttcgagaagctggccgcggagtccgccaagctcgcccgctacaacaagaagcccaccattacctcccgcgagatccagacctccgtccgcctcgtcctccccggggagctcgccaagcacgccgtctccgagggtaccaaggccgtcaccaagttcacctcctcttag

SEQ ID NO: 7912 - protein, 155 aa, Sorghum bicolor
  misc_feature: Ceres ANNOT ID no. 6086150
  misc_feature (62)..(132): Pfam Id: Histone Pfam Desc: Core histone H2A/H2B/H3/H4
  misc_feature (1)..(155): NCBI GI: 1708107 NCBI Desc: histone h2b
  misc_feature (1)..(155): NCBI GI: 577825 NCBI Desc: h2b histone [zea mays]
  misc_feature (1)..(155): NCBI GI: 22325 NCBI Desc: h2b histone [zea mays]
  misc_feature (1)..(155): NCBI GI: 21801 NCBI Desc: histone h2b [triticum aestivum]
  misc_feature (1)..(155): NCBI GI: 17385644 NCBI Desc: histone h2b [oryza sativa]
  misc_feature: No seed is being produced by the plant
  misc_feature: The plant flowers significantly late compared to wild-type.
  misc_feature: Useful for biocontainment applications
  misc_feature: Useful for making plants with modulated flowering time
  misc_feature: GREAT-hit functional homolog of the protein sequence given in SEQ ID NO 13102
  misc_feature: Useful for biocontainment applications
  misc_feature: Useful for making plants with modulated flowering time
  misc_feature: Functional homolog of the protein sequence given in SEQ ID NO 13102
MAPKAEKKPASKKPAEEEPSEKAAPAEKAPAGKKPKAEKRLPAGKSSAGKEGGEKKGRKKGKKSVETYKIYIFKVLKQVHPDIGISSKAMSIMNSFINDIFEKLAAESAKLARYNKKPTITSREIQTSVRLVLPGELAKHAVSEGTKAVTKFTSS

SEQ ID NO: 7913 - DNA, 1155 bp, Sorghum bicolor
  misc_feature: Ceres ANNOT ID no. 6086155
  misc_feature: Encodes the peptide sequence at SEQ ID NO 7914
atggccatgaggagggcggcgcagcaggcggcacggttcgccatggggccacatgtccctcacactgcgcccgctgcgaggagccttcatgcgtccgccggcagcaagaagatcgtgggcgtcttctacaagggcggcgagtacgccgaccgcaaccccaacttcgtcggctgcgccgagcacgccctcggcatccgcggctggctcgagtcgcagggccaccagtacatcgtcaccgacgacaaggacggccccaactgcgagctggagaagcacatcgcggacgcgcacgtgctcatcaccacgccgttccacccggcgtacgtgacggcggaccgcatcgcgcgcgccaagaacctggagctgctcctcacggcggggatcggctccgaccacgtcgacctgccggcggccgcggccgcggggctcaccgtcgccgaggtcacgggcagcaacacggtgtcggttgccgaggaccagctcatgcgcgtcctcgtcctcatgcgcaacttcctgccgggccaccaccaggccatcagcggggagtgggacgttgccggcgtcgcgcaccgggcgtacgacctggaggggaagacggtgggcaccgtcggcgccggccggatcgggcgcctgctgctgcagcgcctcaggccgttcaactgcaagctgctctaccacgacaggctccggatcgacccggcgctggaggcggagaccggcgcccagttcgaggcggacctcgacgccatgctgcccaagtgcgacgtcgtcgtgctcaacatgccgctcaccgagaaaacaagaggcatgttcgacaaggagaggatcgcgaggatgaagaaaggcgtgatcatcgtgaacaacgctcgaggcgcgatcatggacacgcaggccgtggcggacgcttgcgccaccgggcacatcgctggatacggcggcgatgtgtggcaccctcagcctgcgcccaaggaccacccgtggcgctacatgcccaacaacgccatgacccctcacatctccggcaccaccattgatggccagctgaggtatgcggccggggtgaaggatatgctggaaaggtacttcaagggtcaggatttcccggtgcagaattacatcgtcaaggaaggcaacctcgcgggccagtaccagtga

SEQ ID NO: 7914 - protein, 384 aa, Sorghum bicolor
  misc_feature: Ceres ANNOT ID no. 6086155
  misc_feature (161)..(340): Pfam Id: 2-Hacid_dh_C Pfam Desc: D-isomer specific 2-hydroxyacid dehydrogenase, NAD bindingdomain
  misc_feature (56)..(375): Pfam Id: 2-Hacid_dh Pfam Desc: D-isomer specific 2-hydroxyacid dehydrogenase, catalyticdomain
  misc_feature (1)..(384): NCBI GI: 75289159 NCBI Desc: formate dehydrogenase 2, mitochondrial precursor (nad-dependent formate dehydrogenase 2) (fdh 2)
  misc_feature (12)..(384): NCBI GI: 109909540 NCBI Desc: formate dehydrogenase 1, mitochondrial precursor (nad-dependent formate dehydrogenase 1) (fdh 1)
  misc_feature (12)..(384): NCBI GI: 51536124 NCBI Desc: formate dehydrogenase, mitochondrial precursor [oryza sativa (japonica cultivar-group)]
  misc_feature (12)..(384): NCBI GI: 4760553 NCBI Desc: nad-dependent formate dehydrogenase [oryza sativa]
  misc_feature (23)..(384): NCBI GI: 21263612 NCBI Desc: formate dehydrogenase, mitochondrial precursor (nad-dependent formate dehydrogenase) (fdh)
  misc_feature (1)..(384): SWISSPROT Homolog: EC 1.2.1.2 Formate dehydrogenase 2, mitochondrial precursor
MAMRRAAQQAARFAMGPHVPHTAPAARSLHASAGSKKIVGVFYKGGEYADRNPNFVGCAEHALGIRGWLESQGHQYIVTDDKDGPNCELEKHIADAHVLITTPFHPAYVTADRIARAKNLELLLTAGIGSDHVDLPAAAAAGLTVAEVTGSNTVSVAEDQLMRVLVLMRNFLPGHHQAISGEWDVAGVAHRAYDLEGKTVGTVGAGRIGRLLLQRLRPFNCKLLYHDRLRIDPALEAETGAQFEADLDAMLPKCDVVVLNMPLTEKTRGMFDKERIARMKKGVIIVNNARGAIMDTQAVADACATGHIAGYGGDVWHPQPAPKDHPWRYMPNNAMTPHISGTTIDGQLRYAAGVKDMLERYFKGQDFPVQNYIVKEGNLAGQYQ

SEQ ID NO: 7915 - DNA, 1254 bp, Sorghum bicolor
  misc_feature: Ceres ANNOT ID no. 6086156
  misc_feature: Encodes the peptide sequence at SEQ ID NO 7916
atggattgttccacccggttcctcatcggaaacccgtcgccggctgcctcccacttttccggcgagaggcggagtccagcggacagggtatttctccggaccatggcgtcggcggccccggtggaggagcccacggcggcagccagagcgaaggggcggccgaccggtgactccttcatccggcgccacctcaggaccctcgccccgtatcagcccatccttcctttcgaggtgttatcagctcggcttgggcgtagaccagaggacataatcaagttggatgcaaatgagaatccatatggtccacccccggaggtcgctgcagcgttaggtagcctcaagtttccctatgtgtaccctgatcctgaaagccgccacttgcgtgctgctcttgctgaagattctggacttgaatctgagtacatacttgctggatgtggtgcagatgagctaattgatttaattatgagatgtgtgctcgaaccaggtgacaaaattgttgattgccctccaacattcacaatgtatgagtttgatgcttcagtcaatggtgcacttgttatcaaggttccaagactgcctgatttttccctagacgttgatcgtattgtcgaagttgttgaacaggaaaagccaaaatgcatattcctgacatccccaaataatccagacggcagtgtaataaacgatgaggatcttttaaagatactggatcttccgatacttgtagtgctggatgaagcttatattgagttttcaatcctaaagtcaaagatggcatgggttaagaagcatgataatttgattattctccgaacatttagcaaacgagcaggtttggctggtcttcgtgtgggttatggtgcatttcctctgagcattattgagtatttgtggcgggccaagcagccgtacaatgtttctgtggctgcagaagtttcagcatgtgcagcattgcagaatccaacctatttggagaatgtgaaaaatttactggtacaagagagggagaggttgtttaatcttctcgaaggaataccattcctgaaaccgtttcccagtcattctaacttcattctctgtgaggtcacatcaggaaaggatgcaaagaaaataaaggaagaccttgcaaagatgggagtgatgatccgccactatgacaagaaggaactgaaagggtatatccgtatctcagttgggaaacctgagcacactgatgcattaatgaaaggcctgaatgcacttcaattgtga

SEQ ID NO: 7916 - protein, 417 aa, Sorghum bicolor
  misc_feature: Ceres ANNOT ID no. 6086156
  misc_feature (88)..(412): Pfam Id: Aminotran_1_2 Pfam Desc: Aminotransferase class I and II
  misc_feature (1)..(417): NCBI GI: 115448217 NCBI Desc: os02g0709200 [oryza sativa (japonica cultivar-group)]
  misc_feature (3)..(412): NCBI GI: 3355626 NCBI Desc: histidinol-phosphate aminotransferase [nicotiana tabacum]
  misc_feature (3)..(412): NCBI GI: 12055099 NCBI Desc: histidinol phosphate aminotransferase [nicotiana plumbaginifolia]
  misc_feature (56)..(412): NCBI GI: 145334365 NCBI Desc: emb2196 (embryo defective 2196) [arabidopsis thaliana]
  misc_feature (102)..(378): NCBI GI: 50313447 NCBI Desc: imidazole acetol-phosphate aminotransferase [alyssum lesbiacum]
  misc_feature (3)..(412): SWISSPROT Homolog: EC 2.6.1.9 Histidinol-phosphate aminotransferase, chloroplast precursor
  misc_feature: Useful for making plants with modulated nitrogen use efficiency
  misc_feature: GREAT-hit functional homolog of the protein sequence encoded by LOCUS at1g71920
  misc_feature: Useful for making plants with modulated nitrogen use efficiency
  misc_feature: Functional homolog of the protein sequence given in SEQ ID NO 14006
  misc_feature: The sequence is a functional homolog of SEQ ID NO. 527 in the 11/188,298 US application
  misc_feature: The sequence is a functional homolog of SEQ ID NO. 286 in the 11/188,298 US application
MDCSTRFLIGNPSPAASHFSGERRSPADRVFLRTMASAAPVEEPTAAARAKGRPTGDSFIRRHLRTLAPYQPILPFEVLSARLGRRPEDIIKLDANENPYGPPPEVAAALGSLKFPYVYPDPESRHLRAALAEDSGLESEYILAGCGADELIDLIMRCVLEPGDKIVDCPPTFTMYEFDASVNGALVIKVPRLPDFSLDVDRIVEVVEQEKPKCIFLTSPNNPDGSVINDEDLLKILDLPILVVLDEAYIEFSILKSKMAWVKKHDNLIILRTFSKRAGLAGLRVGYGAFPLSIIEYLWRAKQPYNVSVAAEVSACAALQNPTYLENVKNLLVQERERLFNLLEGIPFLKPFPSHSNFILCEVTSGKDAKKIKEDLAKMGVMIRHYDKKELKGYIRISVGKPEHTDALMKGLNALQL

SEQ ID NO: 7917 - DNA, 693 bp, Sorghum bicolor
  misc_feature: Ceres ANNOT ID no. 6086158
  misc_feature: Encodes the peptide sequence at SEQ ID NO 7918
atggcggcggcgcggcacctcagatccggcctccctctcctccgcgcccacctcgcatcctccgaatccgcggccgtcgcccaggtctcgaggggcttcgcgtcgcagccggccaaacccaccggcaaggacatcaaggttccagaagctctgtatggtggcacaggcaactatgccagtgcactgttcctcacagcagctaaagctaactcattggacaaagttgagtctgagattaaaactgttgtagaggcatccaagaagagcccgttgttctctctattcataaaggacctgtcagttccaaaagagaccagggtgaaggctgtaaccgaaatatttgctgacgctgggttttcggatgttacaaagaatttcttggctgtcctggcggacaatggcaggctgaaatatattgagcgcattgcggagagatttgttgatttgactatggcacataagggggaggtgaaggttgtggtcaggacagttattccacttcccgcgaaggaggagaaagaactcaaggataccttgcaggatatccttgggaagaacaaaactattttggtggaacagaagattgactacagcatcatgggaggattagtgattgaattcgggcagaaggtgtttgatatgtctatcaggaccagcgaagcaaatggaggcattcttgaggcaaccccttga

SEQ ID NO: 7918 - protein, 230 aa, Sorghum bicolor
  misc_feature: Ceres ANNOT ID no. 6086158
  misc_feature (56)..(218): Pfam Id: OSCP Pfam Desc: ATP synthase delta (OSCP) subunit
  misc_feature (3)..(167): NCBI GI: 32400863 NCBI Desc: f1-atpase [triticum aestivum]
  misc_feature (1)..(218): NCBI GI: 23507246 NCBI Desc: oligomycin sensitivity conferring protein [silene latifolia]
  misc_feature (27)..(218): NCBI GI: 114682 NCBI Desc: atp synthase delta chain, mitochondrial precursor (oligomycin sensitivity conferral protein) (oscp)
  misc_feature (1)..(218): NCBI GI: 23507248 NCBI Desc: oligomycin sensitivity conferring protein [silene latifolia]
  misc_feature (27)..(218): NCBI GI: 4774163 NCBI Desc: f1-atp synthase delta subunit [ipomoea batatas]
  misc_feature (27)..(218): SWISSPROT Homolog: EC 3.6.3.14 ATP synthase delta chain, mitochondrial precursor
MAAARHLRSGLPLLRAHLASSESAAVAQVSRGFASQPAKPTGKDIKVPEALYGGTGNYASALFLTAAKANSLDKVESEIKTVVEASKKSPLFSLFIKDLSVPKETRVKAVTEIFADAGFSDVTKNFLAVLADNGRLKYIERIAERFVDLTMAHKGEVKVVVRTVIPLPAKEEKELKDTLQDILGKNKTILVEQKIDYSIMGGLVIEFGQKVFDMSIRTSEANGGILEATP

SEQ ID NO: 7919 - DNA, 1476 bp, Sorghum bicolor
  misc_feature: Ceres ANNOT ID no. 6086175
  misc_feature: Encodes the peptide sequence at SEQ ID NO 7920
atggcgcatcggctgctgcgggacgcgcaggcggacgggtgggagcggtcggacttccccatcatctgcgagtcatgcctcggcgacaacccctacgtccggatgttaagagctgagtatgacaaagagtgcaaaatttgtgcacgtccttttactgtctttcggtggcgccctggtcgagatgcaaggtacaagaagactgagatttgccagacatgttgcaagctaaagaatgtctgccaggtctgcctgctggatcttgaatatggcctgcctgttcaggtccgggatacagcactcgctatcaattctaatgatgcaattccaaggagtgatgtcaatcgtgaatattttgcagaagagcatgataggagggccagagctggcatagactatgattcttcttatgggaaggctcgtccaaatgataccattctgaagcttcagaggacagcaccatattacaagaggaacagagctcatgtttgtagtttctttgtgcgtggtgaatgtacaagaggagctgagtgcccttatcgtcatgagatgcctgaaactggggagttatctcagcagaacattaaagatcgctactatggagttaatgacccagttgcactgaaacttttgagcaaggcaggtgagatgccatccctgacaccaccagatgatgagactataaggaccctctacattggtggactcgataacagaataactgagcaggatttgagggatcaattttatgcccatggtgagattgaatctataaggatggtacttcaacgtgcaatcgcatttgtgacatatactacaagagaaggcgcagagaaggctgcagaggagcttgctaacaagctagtcatcaagggtgtgcgcctgaagctgatgtggggcaagcctcaggctccaaagcctgaggaggatgagtctgggaggcaggggcaggtttcccatggaggactgctccctagggctgtcatatctcagcagcagagcggtgaccaacctcaaccccctgggatggagggccaacagcaacaggctgcaccagcatcctactacttcaacattccagcaccaccagcagcggagcggactctgtacccatccatggatccacagaggatgggtgctatagtaaaatcacaggacggtgaaggcaaaccagggccgcagcaagctgggcaagctcagccatcaagcagctcagcacagggtggctatcctgcaccaccgccatactaccatggtcagtatccaccatattatccacctccaccaccatatggtggctacatgcctccaccacgcatgccctacccaccacaatatccaccttaccagccgatgctagcacagccagcacaggcacaggctagttcatctcagcaaccaccgcaagaaggtgcaggacagcagccgcctcatggccctcccgctcagcagcagccgcagcagccaattcagaactga

SEQ ID NO: 7920 - protein, 491 aa, Sorghum bicolor
  misc_feature: Ceres ANNOT ID no. 6086175
  misc_feature (230)..(296): Pfam Id: RRM_1 Pfam Desc: RNA recognition motif. (a.k.a. RRM, RBD, or RNP domain)
  misc_feature (1)..(487): NCBI GI: 34394813 NCBI Desc: rrm-containing rna-binding protein-like [oryza sativa (japonica cultivar-group)]
  misc_feature (1)..(449): NCBI GI: 82400164 NCBI Desc: rrm-containing rna-binding protein-like protein [solanum tuberosum]
  misc_feature (1)..(475): NCBI GI: 92888657 NCBI Desc: u2 auxiliary factor small subunit [medicago truncatula]
  misc_feature (1)..(428): NCBI GI: 83283985 NCBI Desc: rrm-containing rna-binding protein-like protein [solanum tuberosum]
  misc_feature (1)..(485): NCBI GI: 8778549 NCBI Desc: f22g5.30 [arabidopsis thaliana]
  misc_feature: The sequence is a functional homolog of SEQ ID NO. 339 in the 11/188,298 US application
MAHRLLRDAQADGWERSDFPIICESCLGDNPYVRMLRAEYDKECKICARPFTVFRWRPGRDARYKKTEICQTCCKLKNVCQVCLLDLEYGLPVQVRDTALAINSNDAIPRSDVNREYFAEEHDRRARAGIDYDSSYGKARPNDTILKLQRTAPYYKRNRAHVCSFFVRGECTRGAECPYRHEMPETGELSQQNIKDRYYGVNDPVALKLLSKAGEMPSLTPPDDETIRTLYIGGLDNRITEQDLRDQFYAHGEIESIRMVLQRAIAFVTYTTREGAEKAAEELANKLVIKGVRLKLMWGKPQAPKPEEDESGRQGQVSHGGLLPRAVISQQQSGDQPQPPGMEGQQQQAAPASYYFNIPAPPAAERTLYPSMDPQRMGAIVKSQDGEGKPGPQQAGQAQPSSSSAQGGYPAPPPYYHGQYPPYYPPPPPYGGYMPPPRMPYPPQYPPYQPMLAQPAQAQASSSQQPPQEGAGQQPPHGPPAQQQPQQPIQN

SEQ ID NO: 7921 - DNA, 2694 bp, Sorghum bicolor
  misc_feature: Ceres ANNOT ID no. 6086179
  misc_feature: Encodes the peptide sequence at SEQ ID NO 7922
atgtcgcagccccgcagttggggagtcctcctcgccgtcctcgtcgcggcggccgtcgccgtcccgccggcgaccgcggcggtggcgagcatcgacctcggctcagagtggctcaaggtcgcggctgtgcatcttgcccctggccgtgctccgatcgctgttgccatcaacgagatgtccaagcgcaagtccccggcgctcgccgcgctcgccgacggcaaccgcctcgctggggaggaggccgcgggcatcacggcgcggcacccgtccaaggtgttcgcccgcgcgcgggacctcttggccaagcctttctcctacgtgcagtccgtcacggagtccctcttcctcccctacgacctcgtccccgacgcgcgcggcgccgccgcggtccgcgccgatgacgggcaggtatactccctcgaggagattgtcgccatggtgctccactacgccgcggggctcgccgatgcgcacgttggggcgcccgtgcgggacgcggtgatcaccgtgccgccctacttcgggcaggccgagcgccgggcgttgacgcaggcggcgcagctggctggaatcaacgtgctttctctcatccacgagcacgctggggccgcgcttcagtacgggatcgacaaggacttctccaatgcgtcgcggcatgtcatcttttacgacatgggcgctggtagcacctacgctgcattagtgtactactcggcgtacaacgccaaggagttcgggaagacagtgtccgttaaccagttccaggttaaggacgttagatggaactctgaacttggaggcgttgaattggaaatgcgtctggtcaactattttgctgatcaattcaataagcagcttggtaacggggttgatatccgtcagtctccgaaggcaatggctaagttgaaaaagcaagttaagcgcaccaaagaaattcttagtgcaaacactgcagctccaatttcagtagaatctctgtataatgatgctgacttcaggagtaccataacacgtgagaaatttgaagagctctgtgaagatttatgggagcaagctctaactccagttaaagaagtgctgacacattctgggatgaagattgatgatatctatgctgtagaactaataggaggagctacccgggttccaaaattgcaggctaagctgcaggaatttctgggtcggcgcgagctcgataaacatcttgatgctgatgaagcaactgttctgggagcctcacttcatgcggctaacctgagtgacgggattaagttgaaccgtaagttgggaatgattgatggctctacttatgctttggtacttgagatagatggtccgggttatgtcaaggatgaaagcattgatcaaactttggtaccaagaatgaagaaaatgccaataaagatgtttaggtccatcagacataccaaggactttgatatctctctcaactatgacaaagcttatgaactgcctccaggcattccatcacataagtttgcagagtattccatatcaggattgtcagatgccaatgaaaagtatgcacaccgtaatttgtctgcacccatcaaagcaaatctacatttttctttgagtagaagtggaattattgctcttgatagagcagaagcagtaattgagataactgaatgggttgaagttccaaagaagatattgactctagagagtaacaccaccaatcagaattcatcttccgaagtaggagcagctaatagcacaacagatagtaaggaaaatatgagttctggcagtgatactaattccaacacttccgttaatgagagtaatgctcaagaaattattacagagaaggtgctaaagaaaagaacatttagggttccattgaaggttgtggaaaaaacgactggtgctggaacaattctttcgaaggagttgtattctgaagcaaaaaataggttagaggcactcgataagaaggatgctgaaaggaggaaaactgctgaacttaagaataacctagagtcatacatatattctatgaaggagaagctggaggaaagcacagatattttgactgtctcaacagaacaggagagggaatcctttgcggagaaacttagtgaggtgcaggattggttatatatggacggtgaagatgctcaagctaatgaattccaagagcgccttgatcaacttaaggccattggtgacccaattcttttcagattgagtgaattaaaggcccgaccagcagcctgtgaaaatgctcgattgtatcttgatgagctgcaaaagattgtcaagaactgggacgcaaacaaaccatggctccccaaaaagagagtagatgaggttgtaagggaagcagagaaactgaaagcttggttggaggagaaggaaaacctgcagaaaaatacccctgtctatagcccaccagttttcacatctgaagaagttgatgagaaagttctggacttgcaagataaggtctcaagtgtcaataggattccgaaaccaaaacccaaggttgagaagaaaacagcaaaggaggaagaacctgctagcaaggagaaaaccacctcttcggaatctgcacccaacgagggtgaatacaccgaaacgtctcaggaatctaaggctcaagaagaggatcagtctgcatcggccaacactagcgattcagaacctgaatctcatgacgagttgtga

SEQ ID NO: 7922 - protein, 897 aa, Sorghum bicolor
  misc_feature: Ceres ANNOT ID no. 6086179
  misc_feature (28)..(740): Pfam Id: HSP70 Pfam Desc: Hsp70 protein
  misc_feature (168)..(865): NCBI GI: 110739797 NCBI Desc: hsp like protein [arabidopsis thaliana]
  misc_feature (6)..(469): NCBI GI: 7268415 NCBI Desc: growth regulator like protein [arabidopsis thaliana]
  misc_feature (31)..(896): NCBI GI: 145346774 NCBI Desc: heat shock protein 70, er lumen [ostreococcus lucimarinus cce9901]
  misc_feature (7)..(594): NCBI GI: 85718184 NCBI Desc: 150 kda oxygen-regulated protein [homo sapiens]
  misc_feature (7)..(594): NCBI GI: 62897071 NCBI Desc: oxygen regulated protein precursor variant [homo sapiens]
MSQPRSWGVLLAVLVAAAVAVPPATAAVASIDLGSEWLKVAAVHLAPGRAPIAVAINEMSKRKSPALAALADGNRLAGEEAAGITARHPSKVFARARDLLAKPFSYVQSVTESLFLPYDLVPDARGAAAVRADDGQVYSLEEIVAMVLHYAAGLADAHVGAPVRDAVITVPPYFGQAERRALTQAAQLAGINVLSLIHEHAGAALQYGIDKDFSNASRHVIFYDMGAGSTYAALVYYSAYNAKEFGKTVSVNQFQVKDVRWNSELGGVELEMRLVNYFADQFNKQLGNGVDIRQSPKAMAKLKKQVKRTKEILSANTAAPISVESLYNDADFRSTITREKFEELCEDLWEQALTPVKEVLTHSGMKIDDIYAVELIGGATRVPKLQAKLQEFLGRRELDKHLDADEATVLGASLHAANLSDGIKLNRKLGMIDGSTYALVLEIDGPGYVKDESIDQTLVPRMKKMPIKMFRSIRHTKDFDISLNYDKAYELPPGIPSHKFAEYSISGLSDANEKYAHRNLSAPIKANLHFSLSRSGIIALDRAEAVIEITEWVEVPKKILTLESNTTNQNSSSEVGAANSTTDSKENMSSGSDTNSNTSVNESNAQEIITEKVLKKRTFRVPLKVVEKTTGAGTILSKELYSEAKNRLEALDKKDAERRKTAELKNNLESYIYSMKEKLEESTDILTVSTEQERESFAEKLSEVQDWLYMDGEDAQANEFQERLDQLKAIGDPILFRLSELKARPAACENARLYLDELQKIVKNWDANKPWLPKKRVDEVVREAEKLKAWLEEKENLQKNTPVYSPPVFTSEEVDEKVLDLQDKVSSVNRIPKPKPKVEKKTAKEEEPASKEKTTSSESAPNEGEYTETSQESKAQEEDQSASANTSDSEPESHDEL

SEQ ID NO: 7923 - DNA, 996 bp, Sorghum bicolor
  misc_feature: Ceres ANNOT ID no. 6086195
  misc_feature: Encodes the peptide sequence at SEQ ID NO 7924
atggagggatccgccgccgcgccgctccgcacgcgcgtctgcatcatcgggagcggtcccgcggcgcacaccgcagccatctacgcggcccgcgcggagctcaagcccgtgctcttcgagggctggatggccaacgacatcgccgccggcgggcagctcaccaccaccaccgacgtcgagaacttcccgggcttccccaacggcatcatgggcgccgacctcatggacaactgccgcgcgcagtccctgcggttcggcaccaacatcctctccgagaccgtcaccgccgtcgacttttcggctcgccccttccgcgtcactgccgactccacaaccgtcctcgccgatgcggtcatcgttgccacgggagccgtcgcgcggcgcctccacttccccgggtccgatgcgtactggaaccgcggtatctccgcctgcgccgtctgcgacggtgccgcccccatcttccgtaacaagcccatcgctgtcgtaggcggcggcgactccgctatggaggaggccaacttcctcaccaagtacggctcccacgtctacatcatccaccgccggaataccttccgtgcttccaagatcatgcaggccagggctctcgagaaccccaaaatcaaggtcgtctgggactcggaggttgtcgaggcctatggcggtgcagacggcggcccactggctggcgtcaaggtcaagaacctgctgaacggggaggtctcggatcttcaggtggccggcctcttcttcgccatcggacacgagccggcgaccaaattcctgggcgggcagctcgaactcgattcagatggatatgttgcaaccaagccaggttccactcacaccagtgtcaagggggtctttgctgctggcgacgtgcaggacaagaagtaccgccaggccattactgccgctggatcagggtgcatggccgcattggacgctgagcactacctgcaggagattggtgcacaggagggaaagtctgattga

SEQ ID NO: 7924 - protein, 331 aa, Sorghum bicolor
  misc_feature: Ceres ANNOT ID no. 6086195
  misc_feature (12)..(299): Pfam Id: Pyr_redox_2 Pfam Desc: Pyridine nucleotide-disulphide oxidoreductase
  misc_feature (159)..(254): Pfam Id: Pyr_redox Pfam Desc: Pyridine nucleotide-disulphide oxidoreductase
  misc_feature (3)..(331): NCBI GI: 115467864 NCBI Desc: os06g0327300 [oryza sativa (japonica cultivar-group)]
  misc_feature (1)..(331): NCBI GI: 17826833 NCBI Desc: nadph-thioredoxin reductase [triticum aestivum]
  misc_feature (10)..(331): NCBI GI: 79557518 NCBI Desc: ntra [arabidopsis thaliana]
  misc_feature (11)..(331): NCBI GI: 42567414 NCBI Desc: thioredoxin reductase 1 / nadph-dependent thioredoxin reductase 1 (ntr1) [arabidopsis thaliana]
  misc_feature (11)..(331): NCBI GI: 7270497 NCBI Desc: thioredoxin reductase (nadph) 2 [arabidopsis thaliana]
  misc_feature (10)..(331): SWISSPROT Homolog: EC 1.8.1.9 Thioredoxin reductase 2
MEGSAAAPLRTRVCIIGSGPAAHTAAIYAARAELKPVLFEGWMANDIAAGGQLTTTTDVENFPGFPNGIMGADLMDNCRAQSLRFGTNILSETVTAVDFSARPFRVTADSTTVLADAVIVATGAVARRLHFPGSDAYWNRGISACAVCDGAAPIFRNKPIAVVGGGDSAMEEANFLTKYGSHVYIIHRRNTFRASKIMQARALENPKIKVVWDSEVVEAYGGADGGPLAGVKVKNLLNGEVSDLQVAGLFFAIGHEPATKFLGGQLELDSDGYVATKPGSTHTSVKGVFAAGDVQDKKYRQAITAAGSGCMAALDAEHYLQEIGAQEGKSD

SEQ ID NO: 7925 - DNA, 891 bp, Sorghum bicolor
  misc_feature: Ceres ANNOT ID no. 6086199
  misc_feature: Encodes the peptide sequence at SEQ ID NO 7926
atggctatgcagcagcagcagcagcagcacgcggggtcggcgtccgggtcggcgtccgggtcggcgtcgagctccagctcggggctgcaccttctcgcctcgccctcgtccttcggggacaccacccacaccaaggttttcgtgggcgggctcgcctgggagaccaacagcgacaggctccggcgcttctacgagcgcttcggggacattctcgaggccgtcgtcatcaccgaccgccactctggccgctccaagggatacggattcgtgacattccgtgaagccgattccgcgaggaaggcctgcgaggaccccacgccggtgatcgacggcaggcgggccaattgtaacctggcttcgttgggtcgagcccagcatcccgtgcctcctggtaatgggcggccaagatcagctgggtcctactttggtgtcccagttccaagggccttttatttagggggttatggccaccgaccgtttccacttgggtactaccaaggatttccagttccccagtacagttacccttcatatggaaccgaatacatctatccacagggtacattaaacccatattctggtcagcaatatcttcctatttatggagtctcagctgcagcaaacactggcaaccaaacatttagccagttgagtccatccatttctggtgggggcaatggttatttgtcggttcatagttacaacatgcctggaaatcaatatgtgcagctcactggatcaaacttcagcagtgcatcaccaacagctcgaccttccattcagactccttttctagtagcaacaccggttcccgcacatccacacctaataattccagccccctcaccccagtttacacaagctagtggttcagaccaaagagcaagctga

SEQ ID NO: 7926 - protein, 296 aa, Sorghum bicolor
  misc_feature: Ceres ANNOT ID no. 6086199
  misc_feature (46)..(116): Pfam Id: RRM_1 Pfam Desc: RNA recognition motif. (a.k.a. RRM, RBD, or RNP domain)
  misc_feature (1)..(296): NCBI GI: 115448273 NCBI Desc: os02g0714000 [oryza sativa (japonica cultivar-group)]
  misc_feature (16)..(264): NCBI GI: 140043717 NCBI Desc: rna-binding region rnp-1 (rna recognition motif) [medicago truncatula]
  misc_feature (27)..(296): NCBI GI: 22330665 NCBI Desc: rna recognition motif (rrm)-containing protein [arabidopsis thaliana]
  misc_feature (23)..(293): NCBI GI: 18394923 NCBI Desc: rna recognition motif (rrm)-containing protein [arabidopsis thaliana]
  misc_feature (23)..(293): NCBI GI: 23505939 NCBI Desc: at1g20880/f9h16_14 [arabidopsis thaliana]
  misc_feature: The sequence is a functional homolog of SEQ ID NO 1039 in the 10/374,780US patent application
  misc_feature: The sequence is a functional homolog of SEQ ID NO 849 in the 10/666,642US patent application
  misc_feature: Useful for making plants with modulated growth and phenotype characteristics
  misc_feature: The sequence is a functional homolog of SEQ ID NO 1039 in the 20060162006 US patent application
  misc_feature: The sequence is a functional homolog of SEQ ID NO. 339 in the 11/188,298 US application
MAMQQQQQQHAGSASGSASGSASSSSSGLHLLASPSSFGDTTHTKVFVGGLAWETNSDRLRRFYERFGDILEAVVITDRHSGRSKGYGFVTFREADSARKACEDPTPVIDGRRANCNLASLGRAQHPVPPGNGRPRSAGSYFGVPVPRAFYLGGYGHRPFPLGYYQGFPVPQYSYPSYGTEYIYPQGTLNPYSGQQYLPIYGVSAAANTGNQTFSQLSPSISGGGNGYLSVHSYNMPGNQYVQLTGSNFSSASPTARPSIQTPFLVATPVPAHPHLIIPAPSPQFTQASGSDQRAS

SEQ ID NO: 7927 - DNA, 1005 bp, Sorghum bicolor
  misc_feature: Ceres ANNOT ID no. 6086201
  misc_feature: Encodes the peptide sequence at SEQ ID NO 7928
atgggggcgggaaccaatggcctgagcaacggcgcgtccgcggccgcaggggagcgcgcggacgacgggaccacggtgttccggggcacggcgtactcgccgctgcggaccacggtggcgctcgcgctgtggctcggggccatccacttcaacgccttcctcgtcctcgcctcgctcttcctcttcccgcgccgcgtcgccgcactggtgctggcgacgcagctcttcttcatgttcgtgccgctcaatgataagagcagattgggccgcaagatcgccaggttcataagcaagtacgtgattgggtattttcccgtcactttgcacgtggaggactacggcgcctttgattccaacagagcttacgtgttcggttacgagcctcattctgttctgcccatcgctgttgggatcctcggggaccttgttggattcatgccgctaccaaagatgaagattcttgcaagcagtgcggtgttctacaccccattcctaaggcaaatatggacgtggttggggttggctcctgcatcgagaaagagtttctactcctaccttggagctggttatagctgtattatagtgccaggaggtgtgcaggaaatacttcatatggatcatgattcagaggttgcttttcttaaatcaagaaaaggttttgttaagatagctattgagatgggttgccctgtagtccccgtttttgctttcggacagagctatgtatacaaatggtggaggccaggtggcaagttaattgtcaagattgctagagcaatcaaattttctccaatcatcttctggggaaaattggggactccgatcccttttgcaacaccaatgcatgtggttgttgggaggccaattgaggttgtaaagaatcctcagccttccattgatgagataaatgaagtccacagacagttcgttgttgcgatgcaagatatgttcgagaaatacaagaccagaactggataccctgatcttcggttaagagttctctga

SEQ ID NO: 7928 - protein, 334 aa, Sorghum bicolor
  misc_feature: Ceres ANNOT ID no. 6086201
  misc_feature (58)..(334): Pfam Id: DAGAT Pfam Desc: Diacylglycerol acyltransferase
  misc_feature (21)..(333): NCBI GI: 86279638 NCBI Desc: type 2 diacylglycerol acyltransferase [vernicia fordii]
  misc_feature (39)..(334): NCBI GI: 62825813 NCBI Desc: diacylglycerol acyltransferase [ricinus communis]
  misc_feature (78)..(220): NCBI GI: 140066983 NCBI Desc: diacylglycerol acyltransferase [medicago truncatula]
  misc_feature (15)..(334): NCBI GI: 37183394 NCBI Desc: mono- or diacylglycerol acyltransferase [spirodela polyrrhiza]
  misc_feature (124)..(334): NCBI GI: 140066981 NCBI Desc: diacylglycerol acyltransferase [medicago truncatula]
MGAGTNGLSNGASAAAGERADDGTTVFRGTAYSPLRTTVALALWLGAIHFNAFLVLASLFLFPRRVAALVLATQLFFMFVPLNDKSRLGRKIARFISKYVIGYFPVTLHVEDYGAFDSNRAYVFGYEPHSVLPIAVGILGDLVGFMPLPKMKILASSAVFYTPFLRQIWTWLGLAPASRKSFYSYLGAGYSCIIVPGGVQEILHMDHDSEVAFLKSRKGFVKIAIEMGCPVVPVFAFGQSYVYKWWRPGGKLIVKIARAIKFSPIIFWGKLGTPIPFATPMHVVVGRPIEVVKNPQPSIDEINEVHRQFVVAMQDMFEKYKTRTGYPDLRLRVL

SEQ ID NO: 7929 - DNA, 1890 bp, Sorghum bicolor
  misc_feature: Ceres ANNOT ID no. 6086202
  misc_feature: Encodes the peptide sequence at SEQ ID NO 7930
atggattctgactacggcgtgccgcgcgagctctcggaggtgcagaagaagcgcgcgctctaccagcccgagctgcccccctgcctccagggcactactgtcagggtggagtatggtgatgctgcaattgcagctgacccggcaggtgctcatgtgatcagccatgtgttccctcacacctatggtcagcccctcgcacacttcctcaggaagacggctgttgtccctgatgctaaggtcatatctgaacacctggcggtcagggttggcattgtcttctgtggcaggcaatccccaggaggccacaatgttgtttggggactctatgaggctatcaaggcccacaaccaaaacagcaaactcattggttttctcggtggatcagatggtctactagcgcagagaaccttggagatcactgatgaagttcttgcttcatataaaaatcaaggtggatatgacatgcttggtcggacaaaggatcagattaggacgacagagcaggtcaatggtgcaatggctagttgccaggctttgaagctggatgctctggttatcattggaggtgtcacctccaacactgatgctgctcaacttgctgagacttttgctgaggcaaagtgtgcaacgaaggttgtaggtgttcctgtaactttgaatggggaccttaagaaccagtttgttgagactactgttggctttgacaccatatgcaaggtgaacgcacaacttatcagcaatatgtgcactgatgctctatctgctgagaagtattactactttattcgcctgatgggacgtaaggcttctcatgtggcattggaatgtgctcttcagtcacatccgaacatggtcatcctaggagaggaggtggctgcttctaaacttacaatttttgatattacgaagcagatttgtgatgcggttcaggcaagggctgaaaaagacaagaaccatggggttattcttattcctgagggccttgtggagagtattcctgaactatatgctcttcttcaggaaatccatggtctccacggccaaggtgtttctgttgagaatatctcttctcagctttcaccttgggcatctgcactctttgagtttttgcccccttttatcaggaagcagctacttctccatcctgaatctgatgattcagctcaactttctcagattgagaccgaaaagcttctagctcagttagttgagactgagatgaacagacgtttgaaggagggcacttacaaaggaaagaagtttaacgcaatctgtcacttctttggctaccaagctaggggagcgctgccttcaaagtttgactgtgattatgcctatgttttggggcatgtgtgctaccacatcatagctgccggtttgaatggttacatggctacagtgacaaatcttaagagtccagtgaacaagtggcggtgcggtgcggctcctatttcgtctatgatgactgtcaagcgatggtcgcgtggcccttcagccactcaaattggaaaacccgctgttcacatggctagcgttgacttgaaaggaaaagcatacgatgtgttgagacagaattcttccagctttttgttggaagatgtctacagaaacccaggcccgctccagtttgaaggaccaggtgctgattcaaagcctatttcattgtgtgttgaggatcaagactatatgggcaggataaagaaattgcaggaatacttggagaaggtgaagagcattgtgaagcctgggtgctcgcaggatgttcttaaagcggcgctgagtgccatgtcttctgtgacggagacactgaacatcatgacttcatcttcagctggccagactctactgcctggtttagtttacgaaaattttatgacttcactaccgtag

SEQ ID NO: 7930 - protein, 629 aa, Sorghum bicolor
  misc_feature: Ceres ANNOT ID no. 6086202
  misc_feature (88)..(368): Pfam Id: PFK Pfam Desc: Phosphofructokinase
  misc_feature (1)..(616): NCBI GI: 115467858 NCBI Desc: os06g0326400 [oryza sativa (japonica cultivar-group)]
  misc_feature (1)..(613): NCBI GI: 483547 NCBI Desc: pyrophosphate-dependent phosphofructokinase alpha subunit [ricinus communis]
  misc_feature (1)..(616): NCBI GI: 3790102 NCBI Desc: pyrophosphate-dependent phosphofructokinase alpha subunit [citrus x paradisi]
  misc_feature (1)..(614): NCBI GI: 169538 NCBI Desc: pyrophosphate-fructose 6-phosphate 1-phosphotransferase alpha-subunit
  misc_feature (1)..(613): NCBI GI: 30725422 NCBI Desc: at1g20950 [arabidopsis thaliana]
  misc_feature (1)..(613): SWISSPROT Homolog: EC 2.7.1.90 Pyrophosphate--fructose 6-phosphate 1-phosphotransferase alpha subunit
MDSDYGVPRELSEVQKKRALYQPELPPCLQGTTVRVEYGDAAIAADPAGAHVISHVFPHTYGQPLAHFLRKTAVVPDAKVISEHLAVRVGIVFCGRQSPGGHNVVWGLYEAIKAHNQNSKLIGFLGGSDGLLAQRTLEITDEVLASYKNQGGYDMLGRTKDQIRTTEQVNGAMASCQALKLDALVIIGGVTSNTDAAQLAETFAEAKCATKVVGVPVTLNGDLKNQFVETTVGFDTICKVNAQLISNMCTDALSAEKYYYFIRLMGRKASHVALECALQSHPNMVILGEEVAASKLTIFDITKQICDAVQARAEKDKNHGVILIPEGLVESIPELYALLQEIHGLHGQGVSVENISSQLSPWASALFEFLPPFIRKQLLLHPESDDSAQLSQIETEKLLAQLVETEMNRRLKEGTYKGKKFNAICHFFGYQARGALPSKFDCDYAYVLGHVCYHIIAAGLNGYMATVTNLKSPVNKWRCGAAPISSMMTVKRWSRGPSATQIGKPAVHMASVDLKGKAYDVLRQNSSSFLLEDVYRNPGPLQFEGPGADSKPISLCVEDQDYMGRIKKLQEYLEKVKSIVKPGCSQDVLKAALSAMSSVTETLNIMTSSSAGQTLLPGLVYENFMTSLP

SEQ ID NO: 7931 - DNA, 1446 bp, Sorghum bicolor
  misc_feature: Ceres ANNOT ID no. 6086204
  misc_feature: Encodes the peptide sequence at SEQ ID NO 7932
atgagcgacccgcggggccgcgccgccggtcccgaccgcgacggggacgacccgcacgacctcccgctcgccgaggacgccaacggcgaggaagcgtggcagacgcccgagaaagaggcggttgccatgtcggaaggggcggctgcgcagggtggggacacgaccccggacgccgaaccggagagcgatgacggagagggaggagcgggctccccggatcaggcggagcccaatgcgggcggggagcgcgcaccgcctgtggccgcggccgaggagctggaggggatcgttagcggcgcaaaggtggagacgaacggcgaggacgccatcagccacgacgccgacggggaggacgacgaagacgatgatggagacgaggaggacgacgacgatgacgacgactccaccccggatgcgtccccgagggctgaggtgaaggtggagggcgagagctccaccgggatggcccagagtggcgccggccaccacgtggaggtggaaccggaccccttcctcgacggcgatgactctgggacggaggaggagcaagccgcgttcatggcggagctggagcgcttccatagggagcacagtctcgagttcaagccgcccaagttctacggcaagggcctcaactgcctcaagttatggaggcaggtcgcccacctgggaggccacgagcaggtaacgatttgtaaactatggcgccaagtcggagagactttcaggccaccaaagacctgcacgactgtttcgtggtcatttcgaattttctatgagaaggcacttcttgaatacgaaaaacacaaagtccggactggtcagcttcagataccaccgcctggtttaccaccgcctagtggtgctgaccgtgaggtggtcgtgaatcaatcatcttctgccagagttagaagggatgctgcagctcgtgctatgcagggttggcatgctcaccgcctccttgccaatggcactcacggggataacattttgaaggacaaagattcaataccactttcaagtcgtgataaaaacctaaaaggctttggggtgctcaagagaaagaaagcgtctagtccagagtatgctctcaagtcgtcccgctcaaaaataaataaatcacaggaagattctatggtcattgacgttggagaaccagccgactgggtgaagatcaatgtgcgccagactaaagattgctttgaagtctatgcactagttcctggacttctacgtgaggagcaggtgcatgttcaatcagatcctgctggacgtctggttatcacaggggatccagagcagcctgataatccttgggggatcactccgttcaagaaggtggtggtcaatttgccatcaagaatcgatccccaccaaacgtctgctgttgtcacgcttcatggtcagctatttgtgcgtgcaccatttggtcatcctgatatgtag

SEQ ID NO: 7932 - protein, 481 aa, Sorghum bicolor
  misc_feature: Ceres ANNOT ID no. 6086204
  misc_feature (177)..(283): Pfam Id: ARID Pfam Desc: ARID/BRIGHT DNA binding domain
  misc_feature (6)..(481): NCBI GI: 41052881 NCBI Desc: dna-binding protein-like [oryza sativa (japonica cultivar-group)]
  misc_feature (26)..(476): NCBI GI: 51090844 NCBI Desc: dna-binding protein-like [oryza sativa (japonica cultivar-group)]
  misc_feature (175)..(476): NCBI GI: 140043723 NCBI Desc: at-rich interaction region; heat shock protein hsp20 [medicago truncatula]
  misc_feature (175)..(476): NCBI GI: 30687082 NCBI Desc: arid/bright dna-binding domain-containing protein [arabidopsis thaliana]
  misc_feature (26)..(234): NCBI GI: 51090845 NCBI Desc: dna-binding protein-like [oryza sativa (japonica cultivar-group)]
MSDPRGRAAGPDRDGDDPHDLPLAEDANGEEAWQTPEKEAVAMSEGAAAQGGDTTPDAEPESDDGEGGAGSPDQAEPNAGGERAPPVAAAEELEGIVSGAKVETNGEDAISHDADGEDDEDDDGDEEDDDDDDDSTPDASPRAEVKVEGESSTGMAQSGAGHHVEVEPDPFLDGDDSGTEEEQAAFMAELERFHREHSLEFKPPKFYGKGLNCLKLWRQVAHLGGHEQVTICKLWRQVGETFRPPKTCTTVSWSFRIFYEKALLEYEKHKVRTGQLQIPPPGLPPPSGADREVVVNQSSSARVRRDAAARAMQGWHAHRLLANGTHGDNILKDKDSIPLSSRDKNLKGFGVLKRKKASSPEYALKSSRSKINKSQEDSMVIDVGEPADWVKINVRQTKDCFEVYALVPGLLREEQVHVQSDPAGRLVITGDPEQPDNPWGITPFKKVVVNLPSRIDPHQTSAVVTLHGQLFVRAPFGHPDM

SEQ ID NO: 7933 - DNA, 999 bp, Sorghum bicolor
  misc_feature: Ceres ANNOT ID no. 6086206
  misc_feature: Encodes the peptide sequence at SEQ ID NO 7934
atggaggtcgtcgccgccgccgccgccgccgcgaagcagaagacgaagaagcacgagaagcacatacacctcttctactgctccgaatgtgaggagctcgccctcaaggtcgccgccagctccgacgccatcgagctccagtccatcaactggcggagcttcgacgacggcttcccgaacctgttcatcaacaaggcccacgacatccgggggcagcacgtggcgttcctggcctcattcagctcgccggcggtcatattcgagcagatctccgtcatcttcgcgctgcccaagctcttcatctcctcattcacgctcgtgctgcccttcttccccacgggctccttcgagcgcgttgaggaggagggcgatgtcgccaccgcgttcaccctcgcgcgcatcctctcgatgatccccaagtcgcgcggcgggccgacaagtgtcgtcatctacgacatccacgcgctccaggagaggttctacttcggggacgacgtcctgccatgcttcgagacagggatcccgctcctgctgcagcgcctccgccagctgccggacgcaaaaaatatcaccattgcctttccagatgatggagcgtggaagcggttccacaagctgttgcagcactttccaatgatagtctgtaacaaggttcgtgaaggtgacaagagaatagtccgtataaaggaaggaaatcctgaaggccgtcatgttgttattgttgatgatttagtgcaatctgggggaactcttcgagaatgccagaaagttctagcttcgcaaggcgctgcaaaagttagtgcttatgtgactcatgctgtgttccctaagcggtcatatgaacgtttcatggcgtctaattctgttgggccaggcgaccagtttgcttacttctggatcacggactcatgcccacacacagtaaaagctattggccaaagacctccatttgaggttctgagccttgctggctcaattgctgatgctcttcagatctga

SEQ ID NO: 7934 - protein, 332 aa, Sorghum bicolor
  misc_feature: Ceres ANNOT ID no. 6086206
  misc_feature (165)..(296): Pfam Id: Pribosyltran Pfam Desc: Phosphoribosyl transferase domain
  misc_feature (1)..(332): NCBI GI: 22671730 NCBI Desc: phosphoribosyl pyrophosphate synthetase [saccharum hybrid cultivar]
  misc_feature (1)..(332): NCBI GI: 68571764 NCBI Desc: ribose-phosphate pyrophosphokinase 4 (phosphoribosyl pyrophosphate synthetase 4)
  misc_feature (16)..(332): NCBI GI: 4902879 NCBI Desc: phosphoribosyl pyrophosphate synthase isozyme 4 [spinacia oleracea]
  misc_feature (20)..(332): NCBI GI: 68571765 NCBI Desc: ribose-phosphate pyrophosphokinase 3 (phosphoribosyl pyrophosphate synthetase 3)
  misc_feature (8)..(332): NCBI GI: 4902470 NCBI Desc: phosphoribosyl diphosphate synthase [arabidopsis thaliana]
  misc_feature (1)..(332): SWISSPROT Homolog: EC 2.7.6.1 Ribose-phosphate pyrophosphokinase 4
MEVVAAAAAAAKQKTKKHEKHIHLFYCSECEELALKVAASSDAIELQSINWRSFDDGFPNLFINKAHDIRGQHVAFLASFSSPAVIFEQISVIFALPKLFISSFTLVLPFFPTGSFERVEEEGDVATAFTLARILSMIPKSRGGPTSVVIYDIHALQERFYFGDDVLPCFETGIPLLLQRLRQLPDAKNITIAFPDDGAWKRFHKLLQHFPMIVCNKVREGDKRIVRIKEGNPEGRHVVIVDDLVQSGGTLRECQKVLASQGAAKVSAYVTHAVFPKRSYERFMASNSVGPGDQFAYFWITDSCPHTVKAIGQRPPFEVLSLAGSIADALQI

SEQ ID NO: 7935 - DNA, 1071 bp, Sorghum bicolor
  misc_feature: Ceres ANNOT ID no. 6086207
  misc_feature: Encodes the peptide sequence at SEQ ID NO 7936
atggaacccaagctcccggtgctcgtcctgttcctagcatttgcagcctgttctgccagtcaccaccgagacccctctgttgttggatactcccaggaagatcttgcattgcccaacaggcttgttaacctcttcaaatcctggtcggtgaagcacagaaagatctacgtcagcccgaaggagaagctgaagaggtatgggatattcaagcagaacctgatgcacattgcagaaacaaacaggaagaacgggagctactggctgggcctgaaccagttcgccgacatcactcacgaagagttcaaggccaatcatctgggattgaagcaaggattgtcaagaatgggtgcacaaacacgtaccccaacaacgttcaggtacgccgccgcagccaacctgccatggtcagtcgactggaggtacaagggagccgtgacgccggtcaagaaccaaggaaaatgcgggagctgctgggccttctcgtcagtggcagcagttgaagggatcaaccagattgtgacgggcaagctggtatcactctcggagcaggagctgatggactgcgataccatgttagatcatggctgcgaagggggtctcatggacttcgcgttcgcttacataatggggagccaggggatccacgccgaggacgactacccgtacctcatggaagaaggctactgcaaagaaaaacagccttatgccaacgtcgtcactataactggatacgaggatgtcccggagaacagcgagataagcctgctgaaagcgttggctcatcagcctgtcagtgtcggcatcgctgcagggagcagggatttccagttctacaaagggggggtgttcgacgggagctgcagcgacgagcttgatcatgcactgacggccgtcgggtatggctcgtcgtacggccagaactacatcaccatgaagaactcgtggggcaagaactggggagaacaaggctacgtcaggataaagatgggcaccgggaagccggagggtgtttgtggcatctataccatggcttcctacccagtgaaaaatgcaacactctggggtgcctaa

SEQ ID NO: 7936 - protein, 356 aa, Sorghum bicolor
  misc_feature: Ceres ANNOT ID no. 6086207
  misc_feature (133)..(348): Pfam Id: Peptidase_C1 Pfam Desc: Papain family cysteine protease
  misc_feature (45)..(101): Pfam Id: Inhibitor_I29 Pfam Desc: Cathepsin propeptide inhibitor domain (I29)
  misc_feature (4)..(349): NCBI GI: 22759715 NCBI Desc: cysteine proteinase [zinnia elegans]
  misc_feature (4)..(349): NCBI GI: 121308860 NCBI Desc: cysteine proteinase [zinnia elegans]
  misc_feature (4)..(349): NCBI GI: 30141025 NCBI Desc: cysteine protease-4 [helianthus annuus]
  misc_feature (10)..(349): NCBI GI: 37780041 NCBI Desc: cysteine protease 14 [trifolium repens]
  misc_feature (3)..(349): NCBI GI: 92874307 NCBI Desc: peptidase c1a, papain [medicago truncatula]
  misc_feature (9)..(349): SWISSPROT Homolog: EC 3.4.22.6 Chymopapain precursor
  misc_feature (1)..(350): SWISSPROT Homolog: EC 3.4.22.30 Caricain precursor
  misc_feature (24)..(350): SWISSPROT Homolog: EC 3.4.22.2 Papain precursor
MEPKLPVLVLFLAFAACSASHHRDPSVVGYSQEDLALPNRLVNLFKSWSVKHRKIYVSPKEKLKRYGIFKQNLMHIAETNRKNGSYWLGLNQFADITHEEFKANHLGLKQGLSRMGAQTRTPTTFRYAAAANLPWSVDWRYKGAVTPVKNQGKCGSCWAFSSVAAVEGINQIVTGKLVSLSEQELMDCDTMLDHGCEGGLMDFAFAYIMGSQGIHAEDDYPYLMEEGYCKEKQPYANVVTITGYEDVPENSEISLLKALAHQPVSVGIAAGSRDFQFYKGGVFDGSCSDELDHALTAVGYGSSYGQNYITMKNSWGKNWGEQGYVRIKMGTGKPEGVCGIYTMASYPVKNATLWGA

SEQ ID NO: 7937 - DNA, 1440 bp, Sorghum bicolor
  misc_feature: Ceres ANNOT ID no. 6086208
  misc_feature: Encodes the peptide sequence at SEQ ID NO 7938
atgcatctgagcgcgaacgaggggattgagggcgtccggttcgccgtgacgggcgggcagggcttcgtcggagccgcactctgcctcgagctgctccgccgcggcgcccgcgaggtccggtccctcgaccttcgcgcctcctcctcctggtcccagcagctcctcgacgccggcgtccgcaccatccaaggggacattagaaataaggatgatgtggggagggctttccgtggagtggactgtgttttccaccttgcttcttatggcatgtcagggaaggaaatggtgcagactgggagatccgatgaggtcaatataaatgggacctgcaatgtactggacgcttgccatgagcaaggtgtcaggaggcttgtgtatgtaagcacttacaatgtggtatttggaggaaagccgattgtcaacggaaatgaggccttgccttattttccaattgaggaccatgttgatgcttatgggcgcagcaaatcagttgctgaacagttggtactgaagagtaatgggcggccagctaagagtgataaaagtactcgtctttatacatgtgcaattcgccctgctgctatatatggaccaggtgaagagcgtcatcttccaagaatcctgtcccttgcaaagttgggattagcattcttcaagattgggggcccagatgtcaagacagattggctgtatatagataatctagttcttgctctgatattggcaagcatgggacttttagatgacattcctgacaggaagggaacccctgtagcagctggtcaggcgtatttcatttgcgatggatcaccatgcaatacttttgaatttatcatcaagcccctatttcaaagtttgggttattccgttcctcaagtgaggctggacacctctgttgcccttgccatttcaagaatgtttttattcatatctacattgttctacccatggcttgatagtaaatggatgcctgagcctttaattcttcctgctgaagtgtataaggttggtgttacacactacttttcgttcttgaaagctagagaggaactcggctatgtacctatggtgaggcctcacgaaggcttagctgcaacgatctcatactggcaggagcgtaagagaagggaactagatggcccgaccatatttacttggttggctgtaacaattggaatgctggctgtgttttctgccgcttgtcttccgccagtcggcccattgaaatgggtgcttgacatccatctgtttgtttttcgctcgatgcttgtgatccggctggtcttggtgatagcaattgcactgcattttggtgaagccgtgtatgcctggttcttggcgaaaaaggttgatccaaggaatgctactggatggttttggcaaaccttcgctctagggttcttctctctccggtatcttctcaagagagccagagggtga

SEQ ID NO: 7938 - protein, 479 aa, Sorghum bicolor
  misc_feature: Ceres ANNOT ID no. 6086208
  misc_feature (15)..(301): Pfam Id: 3Beta_HSD Pfam Desc: 3-beta hydroxysteroid dehydrogenase/isomerase family
  misc_feature (14)..(261): Pfam Id: Epimerase Pfam Desc: NAD dependent epimerase/dehydratase family
  misc_feature (16)..(239): Pfam Id: NAD_binding_4 Pfam Desc: Male sterility protein
  misc_feature (16)..(403): NCBI GI: 116268111 NCBI Desc: nad(p) dependent steroid dehydrogenase-like [homo sapiens]
  misc_feature (16)..(396): NCBI GI: 18043625 NCBI Desc: nad(p) dependent steroid dehydrogenase-like [homo sapiens]
  misc_feature (16)..(396): NCBI GI: 123980766 NCBI Desc: nad(p) dependent steroid dehydrogenase-like [synthetic construct]
  misc_feature (53)..(403): NCBI GI: 119615929 NCBI Desc: nad(p) dependent steroid dehydrogenase-like, isoform cra_c [homo sapiens]
  misc_feature (16)..(374): NCBI GI: 63034416 NCBI Desc: 4alpha-carboxysterol-c3-dehydrogenase/c4-decarboxylase isoform 1-1 [arabidopsis thaliana]
MHLSANEGIEGVRFAVTGGQGFVGAALCLELLRRGAREVRSLDLRASSSWSQQLLDAGVRTIQGDIRNKDDVGRAFRGVDCVFHLASYGMSGKEMVQTGRSDEVNINGTCNVLDACHEQGVRRLVYVSTYNVVFGGKPIVNGNEALPYFPIEDHVDAYGRSKSVAEQLVLKSNGRPAKSDKSTRLYTCAIRPAAIYGPGEERHLPRILSLAKLGLAFFKIGGPDVKTDWLYIDNLVLALILASMGLLDDIPDRKGTPVAAGQAYFICDGSPCNTFEFIIKPLFQSLGYSVPQVRLDTSVALAISRMFLFISTLFYPWLDSKWMPEPLILPAEVYKVGVTHYFSFLKAREELGYVPMVRPHEGLAATISYWQERKRRELDGPTIFTWLAVTIGMLAVFSAACLPPVGPLKWVLDIHLFVFRSMLVIRLVLVIAIALHFGEAVYAWFLAKKVDPRNATGWFWQTFALGFFSLRYLLKRARG

SEQ ID NO: 7939 - DNA, 1164 bp, Sorghum bicolor
  misc_feature: Ceres ANNOT ID no. 6086218
  misc_feature: Encodes the peptide sequence at SEQ ID NO 7940
atgggtgccggcggcaggatgaccgagaaggagcgggagaagcaggaacagctcgcccgtgctactggtggcgctgccatgcagcgatctccggtggagaagccaccgttcacggtgggtcagatcaagaaggccattccaccacactgcttcgagcgctcagtgttgaagtccttctcctacgtggtccatgacctcatcattgccgcggcgctcctgtactttgcgctggccatcataccggcgctcccaagcccgctccactacgcggcctggccgctctactggatcgcccaggggtgcgtgtgcactggcgtgtgggtcatcgcgcacgagtgcggccaccatgccttctccgactaccagctcctggatgacatcgttggcctggtgctgcactcgtcgctgatggtgccgtacttctcgtggaagtacagccaccggcgccaccactccaacaccggctccctggagcgagacgaggtgttcgtgccaaagaagaaggaagcgctggcgtggtacaccccgtacgtgtacaacaaccccgtcggccggctggtgcacatcgttgtgcagctcaccctcgggtggccgctgtacctggccaccaacgcgtcgggacgcccgtacccgcgcttcgcctgccacttcgacccctacggcccgatctacaacgaccgggagcgcgcacagatcttcatctcggatgctggcgtcatggccgtgtcgtttggtctgtacaagctggcggcaacgttcgggttctggtgggtggtgcgcgtctatgccgtgccactgctgatcgtgaacgcgtggcttgtgctcatcacctacctgcagcacacccacccggcgctcccccactacgattcgactgagtgggactggctgcgcggcgcgctggccaccatggaccgcgactacggcatcctcaaccgcgtgttccacaacatcacggacacgcacgtcgcgcaccacctcttctccaccatgccacactaccacgccatggaggccaccaaggcgatcaagcctatccttggcgagtactaccagttcgacccaactcctgttgccaaggcgacctggcgtgaagccagggagtgcatctacgtcgagcctgagaaccgcaagggcatcttctggtacaacaacaaattctag

SEQ ID NO: 7940 - protein, 387 aa, Sorghum bicolor
  misc_feature: Ceres ANNOT ID no. 6086218
  misc_feature (95)..(347): Pfam Id: FA_desaturase Pfam Desc: Fatty acid desaturase
  misc_feature (1)..(387): NCBI GI: 92380879 NCBI Desc: delta-12 fatty acid desaturase [zea mays]
  misc_feature (1)..(387): NCBI GI: 125661169 NCBI Desc: fatty acid desaturase des2 [sorghum bicolor]
  misc_feature (1)..(386): NCBI GI: 83702515 NCBI Desc: endoplasmic reticulum 18:1 desaturase [populus tomentosa]
  misc_feature (1)..(387): NCBI GI: 42541363 NCBI Desc: omega-6 fatty acid desaturase [cucurbita pepo]
  misc_feature (1)..(387): NCBI GI: 117957296 NCBI Desc: oleate desaturase [ricinus communis]
  misc_feature (1)..(387): SWISSPROT Homolog: EC 1.14.99.33 Delta(12) fatty acid dehydrogenase
MGAGGRMTEKEREKQEQLARATGGAAMQRSPVEKPPFTVGQIKKAIPPHCFERSVLKSFSYVVHDLIIAAALLYFALAIIPALPSPLHYAAWPLYWIAQGCVCTGVWVIAHECGHHAFSDYQLLDDIVGLVLHSSLMVPYFSWKYSHRRHHSNTGSLERDEVFVPKKKEALAWYTPYVYNNPVGRLVHIVVQLTLGWPLYLATNASGRPYPRFACHFDPYGPIYNDRERAQIFISDAGVMAVSFGLYKLAATFGFWWVVRVYAVPLLIVNAWLVLITYLQHTHPALPHYDSTEWDWLRGALATMDRDYGILNRVFHNITDTHVAHHLFSTMPHYHAMEATKAIKPILGEYYQFDPTPVAKATWREARECIYVEPENRKGIFWYNNKF

SEQ ID NO: 7941 - DNA, 1077 bp, Sorghum bicolor
  misc_feature: Ceres ANNOT ID no. 6086233
  misc_feature: Encodes the peptide sequence at SEQ ID NO 7942
  misc_feature: Up-regulated in root tissues in response to salicylic acid treatment
atggacctgccggtggtggatctcgcgccgtatcttcgggccgccgccggcgacgcggccccggcgggtgaggaggagctgcgcgcgctgtgcgccacggtgagcgctagtctgcgggatacgggggcgttgctggtgatggacccgcgctgctccgcggcggacaacgaccgcttcctcgacgtcgtcgagcgctacttcgcccgatccgccgacgcaaagcgcctccaggaacggccccacctccactaccaggttggtgtcacacccgaaggggtggaggttcctcgcagtttggtcgacgagaacatgcaggagaagatcaggagcatgccagaggagtttcagccagccacgcctaaagggccggacccgaaatggcggtacatgtggagagtgggtcctcgccctgcaaatacccgttttaaggagctaaactcagaacctgttatccctgagggattacctgagtggaaagagacgatggattcctggggttctaaaatgatttctgcaatcgaggttgttgctgagatggctgcaattggctttggcctgtccaaggacgcatttacttctttgatgaaggagggaccacatctcctagcaccaactggaagtgacttgcagcgtcatggttctgagggcactgtttttgctggattccactacgatcttaattttttgacaatacatggccggagtagattcccaggcctaaacatctggttaaggaatggtaaaaagatggaggtgaaagtccctgttggttgccttctaattcagtctggaaaacagctggaatggcttactggtggcgattgtttggctggaatgcatgaggtagtggtgtctaagagaacgctagatgccatagcactagcgaaagagcaaaatagaagcttgtggagggtttcatcaacattgttcgcgcacattgcttcggatgcaattcttaagccgctcggccactttgctgaagcacctgatgctcattcctatccacctatatgcgctggggattatgtcgagcaggagctttcagtcattaacctgaaaggaaaggatggagtatag

SEQ ID NO: 7942 - protein, 358 aa, Sorghum bicolor
  misc_feature: Ceres ANNOT ID no. 6086233
  misc_feature (32)..(352): NCBI GI: 33862407 NCBI Desc: iron/ascorbate oxidoreductase [prochlorococcus marinus str. mit 9313]
  misc_feature (143)..(352): NCBI GI: 56179780 NCBI Desc: 2og-fe(ii) oxygenase superfamily protein [idiomarina loihiensis l2tr]
  misc_feature (125)..(352): NCBI GI: 124021884 NCBI Desc: iron/ascorbate oxidoreductase [prochlorococcus marinus str. mit 9303]
  misc_feature (115)..(352): NCBI GI: 16124455 NCBI Desc: oxidoreductase iron/ascorbate family [caulobacter crescentus cb15]
  misc_feature (137)..(352): NCBI GI: 84702671 NCBI Desc: oxidoreductase [parvularcula bermudensis htcc2503]
  misc_feature: Up-regulated in root tissues in response to salicylic acid treatment
  misc_feature: The sequence is a functional homolog of SEQ ID NO. 513 in the 11/188,298 US application
MDLPVVDLAPYLRAAAGDAAPAGEEELRALCATVSASLRDTGALLVMDPRCSAADNDRFLDVVERYFARSADAKRLQERPHLHYQVGVTPEGVEVPRSLVDENMQEKIRSMPEEFQPATPKGPDPKWRYMWRVGPRPANTRFKELNSEPVIPEGLPEWKETMDSWGSKMISAIEVVAEMAAIGFGLSKDAFTSLMKEGPHLLAPTGSDLQRHGSEGTVFAGFHYDLNFLTIHGRSRFPGLNIWLRNGKKMEVKVPVGCLLIQSGKQLEWLTGGDCLAGMHEVVVSKRTLDAIALAKEQNRSLWRVSSTLFAHIASDAILKPLGHFAEAPDAHSYPPICAGDYVEQELSVINLKGKDGV

SEQ ID NO: 7943 - DNA, 492 bp, Sorghum bicolor
  misc_feature: Ceres ANNOT ID no. 6086235
  misc_feature: Encodes the peptide sequence at SEQ ID NO 7944
atggcatccacctcgccggaatccgccgccgccggcgaaactaacgattccatccacatccgtcgcctagagctttccgaccacgagaggggtttcgttgcccttctctcccagctctccgcctgtccggacctcaccgcatccgagttcgccacgcgcttcgccgagctcgcggcgcagggcgacgaccacgctatccttgtggccgaggacccctccgcctcggaccggcggatcctcgcgacagggtgcctcttcgtggagcgtaagttcctgcgaggcggcggcaaggtggggcacgtggaggacgtggtggtcgatgccgccgcgcgcggcagcggtctcgggctccgcatcgtgcgccgcctcgtggagatcgccagggaagccggctgctacaaggtcatcctcgactgcacccccgagctgcgtgcctactacgccaagtgcggattcgtggagaagggtgttcagatggccgtctacttctga

SEQ ID NO: 7944 - protein, 163 aa, Sorghum bicolor
  misc_feature: Ceres ANNOT ID no. 6086235
  misc_feature (71)..(153): Pfam Id: Acetyltransf_1 Pfam Desc: Acetyltransferase (GNAT) family
  misc_feature (1)..(163): NCBI GI: 54873449 NCBI Desc: glucosamine-6-phosphate acetyltransferase [oryza sativa (japonica cultivar-group)]
  misc_feature (21)..(163): NCBI GI: 92867673 NCBI Desc: gcn5-related n-acetyltransferase [medicago truncatula]
  misc_feature (16)..(163): NCBI GI: 9755622 NCBI Desc: acetyltransferase-like protein [arabidopsis thaliana]
  misc_feature (16)..(162): NCBI GI: 19074597 NCBI Desc: glucosamine phosphate n-acetyltransferase [encephalitozoon cuniculi]
  misc_feature (5)..(163): NCBI GI: 115386702 NCBI Desc: glucosamine 6-phosphate n-acetyltransferase [aspergillus terreus nih2624]
MASTSPESAAAGETNDSIHIRRLELSDHERGFVALLSQLSACPDLTASEFATRFAELAAQGDDHAILVAEDPSASDRRILATGCLFVERKFLRGGGKVGHVEDVVVDAAARGSGLGLRIVRRLVEIAREAGCYKVILDCTPELRAYYAKCGFVEKGVQMAVYF

SEQ ID NO: 7945 - DNA, 810 bp, Sorghum bicolor
  misc_feature: Ceres ANNOT ID no. 6086248
  misc_feature: Encodes the peptide sequence at SEQ ID NO 7946
atgaggaaacgggagcgggagaacccgtgcgggatctgcggtcactaccacaagtacgaagagggggaggtctgcggggtgtgcggccaccgcttgaagccatcggatggggagggcgccccgtcgagccatgagtccgccttccccacagaggtgctgaaggagttcctcttcctcgggagctacgacaacgcctcacgctccgaggtcctcaggacgctcagtatctcgcacatccttaacactgtgcctgattgccacaatctttacaagaattcattcacgtatcacagtcttcaacgggacaggcctttggattttgacgaggcaaaccagtatctagagaaatgtgaaagagataaatcgcgtgttcttgttcattgcatgactggaaaaaacaggtctgctgctattgtcgcagccttcttgatgaagtctagaggatggagacttgcacagtcttttcaatgggtgaaagaccgaagaccgcaggttcaactgacagatgcttctcagaatgagcttttggagtatgagctgaagctttttggacccagtgctcaacccttggttcccactgaatcatttgcttctcttggatttggttatgaaaaaccagcaggtgacatccaagcacctatgttcaaccaaatgaccatgccatccatatttgagcgagtcaacccaaatgatcaccccaccaatttcacttttggagctgagaggatagcggaagttaaccctcacgataacaatagtgatggtggggtaaacccaactaaaacagagaacctgatggacggctcttaa

SEQ ID NO: 7946 - protein, 269 aa, Sorghum bicolor
  misc_feature: Ceres ANNOT ID no. 6086248
  misc_feature (48)..(181): Pfam Id: DSPc Pfam Desc: Dual specificity phosphatase, catalytic domain
  misc_feature (1)..(269): NCBI GI: 45735964 NCBI Desc: protein phosphatase-like [oryza sativa (japonica cultivar-group)]
  misc_feature (1)..(269): NCBI GI: 115467748 NCBI Desc: os06g0308100 [oryza sativa (japonica cultivar-group)]
  misc_feature (1)..(168): NCBI GI: 145362106 NCBI Desc: ibr5 (indole-3-butyric acid response 5); protein tyrosine/serine/threonine phosphatase [arabidopsis thaliana]
  misc_feature (40)..(200): NCBI GI: 41055126 NCBI Desc: similar to dual specificity phosphatase 4 [danio rerio]
  misc_feature (39)..(200): NCBI GI: 33416626 NCBI Desc: dusp1-prov protein [xenopus laevis]
MRKRERENPCGICGHYHKYEEGEVCGVCGHRLKPSDGEGAPSSHESAFPTEVLKEFLFLGSYDNASRSEVLRTLSISHILNTVPDCHNLYKNSFTYHSLQRDRPLDFDEANQYLEKCERDKSRVLVHCMTGKNRSAAIVAAFLMKSRGWRLAQSFQWVKDRRPQVQLTDASQNELLEYELKLFGPSAQPLVPTESFASLGFGYEKPAGDIQAPMFNQMTMPSIFERVNPNDHPTNFTFGAERIAEVNPHDNNSDGGVNPTKTENLMDGS

SEQ ID NO: 7947 - DNA, 2325 bp, Sorghum bicolor
  misc_feature: Ceres ANNOT ID no. 6086257
  misc_feature: Encodes the peptide sequence at SEQ ID NO 7948
atgtcctcctgcgacgacgaccacgcgtcgctcctcagatcccaagccgggtcctcgtcctcgccgcgcgggccggcggggcaccagcaacagcaccacgccgacgtcgaggcggacgaggccaccgtcaccgcctccccgaggctcgccagcggcggcggcgggggcgtgcgcggcctcctgcgcaacctcgaacgccgcatgaccgcacgcggatctgggcctggccgtcgccagcaccagcattaccagcagctcgatcgctccgtggcgatcgagtcgccatccccgacgccgtcgcagcggcagcgggagagagcggcggcgggggatgacgacgagctcggggaccgggcgccgcccgagtgggcgctcctgctcatcggctgcctcctcgggctcgccaccggcatctgcgtcgcagcgtttaaccgcggggttcatgtcatccatgaatgggcatgggcaggtactccgaacgaaggagcagcatggctccgcctgcagaagctagctgatacttggcacaggatactgctgatcccggtgactggaggtgtggttgtaggaatgatgcatgggttgctcgaaatatttgagcagctaaaacttgtgaaatcagggcagacgcaaggaatcaactttgttggagccatcttcccaaccataaaggctgtccaagctgctgttaccctagggactggttgttccctggggcctgaaggtcctagtgtggatatcggcaaatcatgtgcaaatgcatgctcagaaatgatggagagtaaccgggaaaggcgtattgcacttgttgctgctggtgctgctgctggcattgcttcaggcttcaatgcagcagttgctgggtgcttctttgccatcgaaactgtattgaggccccttaaagcagaaaattcacctccatttacgactgcaatgataatattggcatctgttatatcatctactgtttcaaatgttttacttggagcaagaccagcttttatagtgccagcatatgagctaaaatctgctgccgagctacccctgtaccttatcttaggaatgctctgtggagcagtgagtgtggtatttgacggattggtaggatggttttcaagattctttggacgcataaaggaaaagtttgattttcctattatagtgtaccctgctttgggtgggctgggagctggtatcatagctctgaaatatccagggatcttatactggggtttcacaaatgttgaagaaatactgcatactgggaaaagtgcttctgctcctggtatctggttgttaactcaactagcagctgcaaaggtagttgcaactgccctctgcaagggctctggccttgtgggagggctatatgctccaagcctgatgattggggctgctgtgggagctgtttttgggggttcagctgcttatttaataaattcagctttacctggtaatgctgctgttgcacagccacaagcttatgctctggtcggaatggctgctacactagcctcagtctgttcagtcccgttgacttcagtactgcttctctttgagctgacaaaggattacaggattttgcttcctctcatgggagcagttggtttggcaatatgggttccttcagtagtaaaccagccaaacgacactgagccttctgggtttaaaacacccaaacgaggttattcttcaatttcagcagaagacagaaatggtagctcaaggcaaggtgatgttgtggacgatcttgagctcagtattatacaaactgacattagtaactatggaacttataatgaagaaatgcttctggatgatttgaaggtctcccaggccatgtcaaaggtatatgtcaaagtgttaccatctgttacagtaacagaagctcttaagctattgcatgataaacagcaaaattgtgccctggttgtggaccctgaagattttcttgaaggaattattacaataggggatatacggcgcatgggatatgggttacacatggaaagtttcatcaatggagatcaccccaagtctgatgacaattcttcctccatttcatcatgtcttactcgaggattccagtactgtgggagtgaacgtggattgttaacatgctttccagatactgatttgaccactgcaaaaagtcttatggaggccagagggataaaacaactgcctgtagttaagcgtggtgttgcccatagaactgcaggaaagcgcaagccggttgcccttctgcattatgattctattggttgctgcgttcgggaggaaatagagaactggaagaccatatatcagagactggcttgttaa

SEQ ID NO: 7948 - protein, 774 aa, Sorghum bicolor
  misc_feature: Ceres ANNOT ID no. 6086257
  misc_feature (179)..(544): Pfam Id: Voltage_CLC Pfam Desc: Voltage gated chloride channel
  misc_feature (612)..(750): Pfam Id: CBS Pfam Desc: CBS domain pair
  misc_feature (37)..(662): NCBI GI: 8778501 NCBI Desc: f20n2.5 [arabidopsis thaliana]
  misc_feature (191)..(771): NCBI GI: 30695978 NCBI Desc: voltage-gated chloride channel family protein [arabidopsis thaliana]
  misc_feature (279)..(616): NCBI GI: 86438776 NCBI Desc: chloride channel-f protein [brachypodium sylvaticum]
  misc_feature (111)..(754): NCBI GI: 41688502 NCBI Desc: chloride channel protein clc-e (atclc-e)
  misc_feature (111)..(754): NCBI GI: 14039799 NCBI Desc: clc-e chloride channel protein [arabidopsis thaliana]
MSSCDDDHASLLRSQAGSSSSPRGPAGHQQQHHADVEADEATVTASPRLASGGGGGVRGLLRNLERRMTARGSGPGRRQHQHYQQLDRSVAIESPSPTPSQRQRERAAAGDDDELGDRAPPEWALLLIGCLLGLATGICVAAFNRGVHVIHEWAWAGTPNEGAAWLRLQKLADTWHRILLIPVTGGVVVGMMHGLLEIFEQLKLVKSGQTQGINFVGAIFPTIKAVQAAVTLGTGCSLGPEGPSVDIGKSCANACSEMMESNRERRIALVAAGAAAGIASGFNAAVAGCFFAIETVLRPLKAENSPPFTTAMIILASVISSTVSNVLLGARPAFIVPAYELKSAAELPLYLILGMLCGAVSVVFDGLVGWFSRFFGRIKEKFDFPIIVYPALGGLGAGIIALKYPGILYWGFTNVEEILHTGKSASAPGIWLLTQLAAAKVVATALCKGSGLVGGLYAPSLMIGAAVGAVFGGSAAYLINSALPGNAAVAQPQAYALVGMAATLASVCSVPLTSVLLLFELTKDYRILLPLMGAVGLAIWVPSVVNQPNDTEPSGFKTPKRGYSSISAEDRNGSSRQGDVVDDLELSIIQTDISNYGTYNEEMLLDDLKVSQAMSKVYVKVLPSVTVTEALKLLHDKQQNCALVVDPEDFLEGIITIGDIRRMGYGLHMESFINGDHPKSDDNSSSISSCLTRGFQYCGSERGLLTCFPDTDLTTAKSLMEARGIKQLPVVKRGVAHRTAGKRKPVALLHYDSIGCCVREEIENWKTIYQRLAC

SEQ ID NO: 7949 - DNA, 1554 bp, Sorghum bicolor
  misc_feature: Ceres ANNOT ID no. 6086259
  misc_feature: Encodes the peptide sequence at SEQ ID NO 7950
atggcccgctgcggcgacagagacatcgtgacggcggcgatggcgcggcagccctggcgccgccgccacggatggcagctccccctacaccctcttcagctggtggccgcggcggtgttcgcgctcctcgtcgccgcgttctacgtcgtcctggggccctacatcggcaacaccctcgccggcaatatcctcctcggcaccttctccttttcggccgcggcggcggcggtgctctacgtgcgctgcacggcggtggacccgtccgaccggactgacgcgaagaagaccaagaggcggcggcagctcgcgcggggcggcggggccacggcgaagctgccacggctgcggtatggctacatcctgtggcgctacgtcgtgcggacgcttcggcgcgttgaggcgcgcgtcaccaaccgctgggtgcggcggagctacctggagcagtggaacaccagcgttcagctcgatcccatgctccccttcgccttcaccagcctcgatgacattgtctctccatgcgccactgccgacgggcacgacatctccttctgccctatctgcgactgcgaggtgaagctgcgtagcaagcactgcaagacctgtgagcgatgcgttgatggatttgatcaccactgcaggtggctaaacaattgcattggaagaaggaactatgcaacatttattctgcttatgttctttgtcctgctgatgcttgtcattgagggaggaacagcaattgcgatcttcatccgctgctttgtcgacagcaaaggggtgaaaatggaaatggagcacaggctgcacatgaggctcccaaaaggagctcatgcagcactatcaatggcttttgtcatcttcacattgtacagcactgcagcgctgggccagctcttctttttccacatggtgctaattagaaagggcatgaggacctacgactacattcttgcgatgagagaagcaggagcagcatttgacccattcgaagattcggactctgacgagagtatcgactttgactcaccagagaagccatctttcttttcaagggtcttttgcagaaaagatgaagaaaatgaaagtgctcggaagctgtcgatcaggatcgagagcgaccaaatggatgcttcaggaaggaaggatgacatccagatcaacccatggacattgatcaagatgagcaaggagaaggcgatggcagctgctgagcgtgcacgcgaacgaatcagacagaagctgccaacatcaccgatgaaaccactgccggtggagacaaagcgaggccctctgaacccagagagaaaacacatcacaactgggaaagagatcgtaccggtcttcaccaagagctggctgtcggtgtcgcccacagcgaggatctcgagccccaggaggcgattctcagggtcatcgtcacctaagccgcagaggtacaggagcaacttcgacctgaggctcgccgaggtgtcgagggatctggagacccacatctcgaagcaggtgctgtgctccgtcgtcatgaagggtgtcgaggacgaaggctattcgtcgtag

SEQ ID NO: 7950 - protein, 517 aa, Sorghum bicolor
  misc_feature: Ceres ANNOT ID no. 6086259
  misc_feature (174)..(237): Pfam Id: zf-DHHC Pfam Desc: DHHC zinc finger domain
  misc_feature (32)..(355): NCBI GI: 3859602 NCBI Desc: contains similarity to human dhhc-domain-containing cysteine-rich protein (gb:u90653) and several s. cerevisiae probable membrane proteins (gb:u20865, z48758, u43491)
  misc_feature (32)..(355): NCBI GI: 3859602 (continued) [arabidopsis thaliana]
  misc_feature (183)..(349): NCBI GI: 38344276 NCBI Desc: osjnba0013k16.7 [oryza sativa (japonica cultivar-group)]
  misc_feature (180)..(342): NCBI GI: 92875106 NCBI Desc: zinc finger, dhhc-type [medicago truncatula]
  misc_feature (21)..(326): NCBI GI: 15233295 NCBI Desc: zinc finger (dhhc type) family protein [arabidopsis thaliana]
  misc_feature (183)..(320): NCBI GI: 42563074 NCBI Desc: zinc finger (dhhc type) family protein [arabidopsis thaliana]
MARCGDRDIVTAAMARQPWRRRHGWQLPLHPLQLVAAAVFALLVAAFYVVLGPYIGNTLAGNILLGTFSFSAAAAAVLYVRCTAVDPSDRTDAKKTKRRRQLARGGGATAKLPRLRYGYILWRYVVRTLRRVEARVTNRWVRRSYLEQWNTSVQLDPMLPFAFTSLDDIVSPCATADGHDISFCPICDCEVKLRSKHCKTCERCVDGFDHHCRWLNNCIGRRNYATFILLMFFVLLMLVIEGGTAIAIFIRCFVDSKGVKMEMEHRLHMRLPKGAHAALSMAFVIFTLYSTAALGQLFFFHMVLIRKGMRTYDYILAMREAGAAFDPFEDSDSDESIDFDSPEKPSFFSRVFCRKDEENESARKLSIRIESDQMDASGRKDDIQINPWTLIKMSKEKAMAAAERARERIRQKLPTSPMKPLPVETKRGPLNPERKHITTGKEIVPVFTKSWLSVSPTARISSPRRRFSGSSSPKPQRYRSNFDLRLAEVSRDLETHISKQVLCSVVMKGVEDEGYSS

SEQ ID NO: 7951 - DNA, 1341 bp, Sorghum bicolor
  misc_feature: Ceres ANNOT ID no. 6086261
  misc_feature: Encodes the peptide sequence at SEQ ID NO 7952
atgtccaattattatgatgactacgatgacattgatgagatggaggatgaatatgatttggatgatcctgctgatgacatggtagatgagcagcgagggattagggattctgatgcggaggataatgattatggacaaccaaatgataagatcccagatacttcatcagtggacgcaagaaaaggaagggacattcaaggaataccctgggagcagataaacataacccgtaaaaaatacagacagtccagattagaacagtacaaaaattatgagaatgtacctaactctggagaagaagctatgaaggattgcaaaccaacagagaaaggtggaatgtactatgagttcagacgaaatactagatcggttaaatcaactattctacattttcagcttcgaaatttggtatgggctacgtccaagcatgacatctacctagtatcgcattactcaattcgtcactggtcagcattgagtggtgtggatactgaacttatcaacgtccaaggacatgtggcaccaagggagaagcatgcaggaagtttattagagggtttttctcagactcaagttagtaccttggcagtcaaggacaatttactggtagctggtgggtttcaaggagagctaatctgtaaacaccttgatcgggaaggtattagtttttgctgtcgaacaacttatgatgataatgctattacaaatgcggttgatatatttaatacctctagtggcgccgtacacttcatcgcatcaaataacgactctggtgtgagatactatgacatggagagattccagctgttcaagcattttcagtttgaatggccagtgaaccatacttcgttgagtcctgacagaaaggtagttgttattgtgggggatgatcctgatggtctacttattgatgccaactctggaaagacgcttcattccataaaaggacatcgggactattcatttgcatcggcttggagccctgatgggcgaacatttgctactggcaaccaagacaagacatgccgaatctgggacgtgaggaatctatcaaaatccgtccatgtgttgaggggtaaccttggagccatccggtcgatccgcttcacctcggatggccagttcatgtccatggccgaacctgctgactttgtgcacatctacgacgtgaagagtgactacaacaaaaggcaggagctggacttctttggcgagatatccggcacgtcattcagcccagacactgatacacttttcgttggtgtgtgggataggatgtatggcagcctgcttcagtttggccgcctgtacaactactcttatcttgactccttgttttga

SEQ ID NO: 7952 - protein, 446 aa, Sorghum bicolor
  misc_feature: Ceres ANNOT ID no. 6086261
  misc_feature (308)..(346): Pfam Id: WD40 Pfam Desc: WD domain, G-beta repeat
  misc_feature (1)..(444): NCBI GI: 22655036 NCBI Desc: at3g13340/mdc11_13 [arabidopsis thaliana]
  misc_feature (1)..(445): NCBI GI: 18423837 NCBI Desc: wd-40 repeat family protein [arabidopsis thaliana]
  misc_feature (1)..(445): NCBI GI: 21536732 NCBI Desc: wd-repeat protein-like [arabidopsis thaliana]
  misc_feature (1)..(445): NCBI GI: 9758639 NCBI Desc: wd-repeat protein-like [arabidopsis thaliana]
  misc_feature (3)..(446): NCBI GI: 92880690 NCBI Desc: wd-40 repeat [medicago truncatula]
  misc_feature: The sequence is a functional homolog of SEQ ID NO. 502 in the 11/188,298 US application
MSNYYDDYDDIDEMEDEYDLDDPADDMVDEQRGIRDSDAEDNDYGQPNDKIPDTSSVDARKGRDIQGIPWEQINITRKKYRQSRLEQYKNYENVPNSGEEAMKDCKPTEKGGMYYEFRRNTRSVKSTILHFQLRNLVWATSKHDIYLVSHYSIRHWSALSGVDTELINVQGHVAPREKHAGSLLEGFSQTQVSTLAVKDNLLVAGGFQGELICKHLDREGISFCCRTTYDDNAITNAVDIFNTSSGAVHFIASNNDSGVRYYDMERFQLFKHFQFEWPVNHTSLSPDRKVVVIVGDDPDGLLIDANSGKTLHSIKGHRDYSFASAWSPDGRTFATGNQDKTCRIWDVRNLSKSVHVLRGNLGAIRSIRFTSDGQFMSMAEPADFVHIYDVKSDYNKRQELDFFGEISGTSFSPDTDTLFVGVWDRMYGSLLQFGRLYNYSYLDSLF

SEQ ID NO: 7953 - DNA, 1881 bp, Sorghum bicolor
  misc_feature: Ceres ANNOT ID no. 6086264
  misc_feature: Encodes the peptide sequence at SEQ ID NO 7954
atgataatgttctggggtttgccatgctctgttgcagagggtaacgtggatagcatcgagatatctgtcagtaatgatgagaggaggaatagggcagatgccgagatctcagaggatgagccgaggcacaccaggatgcggtcgctgaggaagaaagccctacatgcatcgacaaggctgacacactcgctaaagaagaggggaaagagaaaagtggactgcagagtgccaaggatagctatagaggatgtcagagatgctgaagaagagcaggcagtgagctcgtttcgggaggttttgtttgctaggggcttgttaccagtcaagcatgatgattatcatatgatgcttagatttttgaaagcgaggaagtttgattttgaaaaagcagcacagatgtgggcggacatgctgcagtggagaaaggagttcggtacagacaccatttttgaagattttgaatttcatgagctagaggaggtcctgcaatattatcctcatggttaccatggggttgacaaggaaggaaggcctgtgtacattgagttgcttgggaaagttgaacccaacaagcttgtacaaatcacgacagttgagcgctatattaagtatcatgtacaggagtttgagagagcttttcgggagaaattccctgcatgctcaatttctgccaaaaggcatatagatactacaactacgatattggatgtccatggtgtgggctggaagaactttagcaagatcgcgagggatttggtgcgttgtatgcaaaaaatagatggtgactattatcctgagacactacatcaaatgtttattgtaaatgcgggaccaggtttcaagctgatatggagcactgttaagggacttcttgaccccaaaacgtcatctaaaatacatgttctaggaacaaaatatcaaagcaaacttcttgaagctattgatgcaagccaattgccggagtactttggtggttcatgcacgtgttctaacctcggagggtgcctgaggtctaacaaaggcccctggagcgatccttcaatcatgaagcttgtacatagcatggagtcattgaaggaagttgggcaagtatctgatatagaagaaacatttacaggctccatgagattgcgtgctctcaagttaccagaacgaattagtgacacatcaaatgctgaatcaggttcagatgttgatgatcttggatcccctgtggctcctgaagatgttgaatatcctagtttggccccagttcgagaggaagtgagggaatcaggatctacaacgtacagtggtttgattggcatgtctcatacggcagataaagctgtaggatccaacaggagatacaactctactggaaatgaaattaggcaattcaacacagaacaaggttccctgataaatgggggtttacctgcgccaggtcggcgtgccccaaatgatggtgtaggcaatgatgatgggttcttgaaatatatatcaagaagagttgttgatgtatttcttagagtactatcatttttgcggttcttcattcgtcgacgacaacacttggaaaacgttcattcacatgctgcaactgcacccagtaatctggcagatcttcagacaattaaggaagatcgtgtaaatccttgccttgagcgtcttgatcgacttgagtcaatgtttaatcagctgagcagaaagcctccagagcttccacaggacaaggatcgggccatacaagattcttttgacaggataaagtccattgagtttgatctggagaagacaaagaaggtattgcatgcaacagttatcaaacaaatgcagatggcagaaaccttggaagctgtaacggagcctgatcttaggcggaggaaattttgtacataa

SEQ ID NO: 7954 - protein, 626 aa, Sorghum bicolor
  misc_feature: Ceres ANNOT ID no. 6086264
  misc_feature (166)..(352): Pfam Id: CRAL_TRIO Pfam Desc: CRAL/TRIO domain
  misc_feature (80)..(149): Pfam Id: CRAL_TRIO_N Pfam Desc: CRAL/TRIO, N-terminus
  misc_feature (17)..(448): NCBI GI: 38423984 NCBI Desc: phosphatidylinositol transfer-like [oryza sativa (japonica cultivar-group)]
  misc_feature (38)..(430): NCBI GI: 86438771 NCBI Desc: sec14 cytosolic factor (secretion factor 14) family protein [brachypodium sylvaticum]
  misc_feature (22)..(625): NCBI GI: 92870325 NCBI Desc: cellular retinaldehyde-binding/triple function, n-terminal [medicago truncatula]
  misc_feature (22)..(625): NCBI GI: 14486705 NCBI Desc: phosphatidylinositol transfer-like protein iii [lotus japonicus]
  misc_feature (20)..(625): NCBI GI: 30695993 NCBI Desc: sec14 cytosolic factor family protein / phosphoglyceride transfer family protein [arabidopsis thaliana]
MIMFWGLPCSVAEGNVDSIEISVSNDERRNRADAEISEDEPRHTRMRSLRKKALHASTRLTHSLKKRGKRKVDCRVPRIAIEDVRDAEEEQAVSSFREVLFARGLLPVKHDDYHMMLRFLKARKFDFEKAAQMWADMLQWRKEFGTDTIFEDFEFHELEEVLQYYPHGYHGVDKEGRPVYIELLGKVEPNKLVQITTVERYIKYHVQEFERAFREKFPACSISAKRHIDTTTTILDVHGVGWKNFSKIARDLVRCMQKIDGDYYPETLHQMFIVNAGPGFKLIWSTVKGLLDPKTSSKIHVLGTKYQSKLLEAIDASQLPEYFGGSCTCSNLGGCLRSNKGPWSDPSIMKLVHSMESLKEVGQVSDIEETFTGSMRLRALKLPERISDTSNAESGSDVDDLGSPVAPEDVEYPSLAPVREEVRESGSTTYSGLIGMSHTADKAVGSNRRYNSTGNEIRQFNTEQGSLINGGLPAPGRRAPNDGVGNDDGFLKYISRRVVDVFLRVLSFLRFFIRRRQHLENVHSHAATAPSNLADLQTIKEDRVNPCLERLDRLESMFNQLSRKPPELPQDKDRAIQDSFDRIKSIEFDLEKTKKVLHATVIKQMQMAETLEAVTEPDLRRRKFCT

SEQ ID NO: 7955 - DNA, 1959 bp, Sorghum bicolor
  misc_feature: Ceres ANNOT ID no. 6086268
  misc_feature: Encodes the peptide sequence at SEQ ID NO 7956
  misc_feature: Up-regulated in shoot tissues in response to methyl jasmonate treatment
  misc_feature: Up-regulated in root tissues in response to methyl jasmonate treatment
atggtggaagactgggtattctctgctttaatagtggcgtttctagcgttcataacaccttgtgagtcattctacttgccaggtagttacatgcacacatatcagcaaggggaggtgataggggcgaaggtgaactcgctcacttccattgagacagaactgcccttcagttactacagccttccatattgtcgtcctcaagatggggttaagaagagtgctgaaaacttaggcgagcttctgatgggtgatcaaatagataattctccataccgtttccatgtaaatgtcaacgaatctctgtatctgtgtaccacaaatccccttgatgaggctgatgtgaagctcctcaagcagcgaagccgtgatctataccaggttaacatgattcttgataatcttcctgtgaggaggttcacagagcagaatggaatgaccatccagtggacaggctatccagttggttatattccagaaggtacttctgatgtttacatcatcaatcacttgaaatttaaggtcttggtccataagtatgaacaaggcaaagtaaaggtagttgggactggggaaggaatggaatttatctcagaggctgacagcgatgccaagtctggatatgagattgtgggatttgaagttgtcccatgcagtgtgaagcgtcctgaagccatgtcgaagtttaatatgtatgataaagttgattccgtgaactgccctgtggagttggaaaaatctcaattggttagggagaaagagaagattacctttacgtatgaggttgagtttgtaaacagtgatatcaggtggccatcacgatgggatgcatacctgaagatggagggttcgaagattcactggttttcgattatgaactctttgatggtaattctatttttggctggcattgtatttgtcatattcttgcggactgtgaggagggacctgactaggtatgaagagttggataaggaggcccaagctcagatgaatgaggagctctctggttggaaacttgttgttggagatgtcttcagagaaccaacctcatcaaagctactctgtgtcatgatcggcgatgggattcagattttgggtatggcaattgctaccattttctttgccgcatttggcttcatgtctcctgcatcgagaggaatgctgttgaccgggatgatagtcctctatatgttacttggaattgtggctggatatgctgctgtcaggctctggaggactttaaaaggaacatccgagggatggaggtctgtctcctggtcaactgcttgtttcttcccaggcattgtcttcattgtcctcactgtgttaaacttcatgctctggacaagaaatagtactggtgcccttccaatctcgcttttcttcggccttttgtccttgtggttctgtgtgtctgtgccacttacccttttaggtggtttctttggcacaagggctgagccaatagaattccctgttcgaaccaatcagataccaagagaaatccctacaaagaagtactcattgctcttcatacttggtgctggaactctaccttttggaacactcttcatcgagctcttcttcattctttctagtatttggctaggaaggttctattatgtgttcggcttcctccttgtcgtgctccttttgctgattgtggtgtgtgctgaggtatcagttgttcttacctacatgcatctctgtgcggaggactggaggtggtggtggaaagctttctttgcctctggaacagtggccctttatgtgttcctttactccatcaactacttggtgtttgatctcagaagcttgagtgggccggtttctgctatgctctacattggatactctttcattgtatctcttgccattatgctagctactggtactgttgggttcctgacatcgttctcttttgtccactaccttttctcatcagtcaagattgattga
